United States Patent 9,328,346 (POLYCOMB-ASSOCIATED NON-CODING RNAS) - sequence listing, part 21

SEQ ID NO: 3317 - RNA, 54656 nt, Mus musculus
ugacgugaaccaugugauuaccaccgcgcugggugggcaguguaguagccacucccguagucacuuuggagcuugcugaguggcggugucaucguggugaggacggcggcccaggagggcagggcuggauccuucgccccagacucagcucuucuuuuuguccuucucgcuguagaugaaccggacgagccccgacucggagcggccuccggcauccgagccggugugggaacggcccuggucgguggaggagauccgccgcagcagucagaacuggucucuggcggcugacgccggugugagcgggggacccggggccaagggagggacagaguuguaguuaccccuccucggggacacgcuuccuccaguauucaaaggcgcaaucucagacaccggggagggcggcccugugggcuucuacccagcacucugccgcgcagacgcggguuuccuuccgugcaguggcuuuucaaccuugcccuccacgccauccugcugagcagauucuguuucugcccucuccaaggacugcuuugucucuacggaggcccuucuguauuagaacuggggcuaaauggggcagcacauauuuuugaguagaucugcucacuucgggaccuaagagcucagaacuuucauacaagugggauuugggguguuuugucacacuauguggucucuggagcgugacaaccaaacagggcuuuaaaucccuguagaaaugugauacugguuuuguguucuggacaaacuuaucugaugagcuuucuuaaugcuuuccagggucaccugaccuuagaucaacaguaucaucccuuuuucuuaacauaggggcaaaaggggagggguuuuuuguuuguuuguuuugcuuuaaaucacauguaguguugauacuuguguauguuucuuuucaaaauagcuacuacaguuucuacaggaauucucacagcagacuaucuccaggacucaugaaaucaagaagcagguggauggauuaauucaggagaccaaagccacacauugucgucugcauaauguguucaaugacuuccucaugcugucuaauacccaguucauugagaaugugaguuguuuuaugguaucugacuuucgaauaaucccuuuuggggaguaagaacuauugucauuuauaaugauaauaagguucucuucuaaguuuugguggauagauugguucuugguaacugaagcuccuuucucugaaaucagugucuuuuaucaguaaaguucauggguuuuacaaaccuuuaaaaacaucuaauaauaagguuugccucgugcugguuuuucuguuuuuaguuuugagggcaauuaccauuugagcagaguugugugccucucaaaaaagccacugugcucauucaguauggucagcucuaagccuggcuuggccucacgugccccacuuuugccuucagucccuagagacuuuauguagguccaucaugucucccucaguuguguaagugaaugcagaugucugcuuugcauuucgucaucuacaguuuucuuuuucuuccuuuucuuuuuucuccuucuguuuguuugagacaggguuucucuguguagcccugaccguccuggaacucacucuguagaccaggcuggcccggaacuuacagaaaucuacuugccucugccucccaaguacugagauuuaaggugugggccacuacugucccgccagcaccaguuuuucaauuuggaugaauauaugacacagagucaccaguacaaaugcugcuggccuuuaacuaaaguguaugugaauuuuguuuucauagugaguuccugcaaucugcuaggaauacacagauaaauuaucuugguagaauuacaauagaaaagacgcaggcaugccuggagccaucuagcaaagggaaaggaauguauugagaacagggggugggguggggggcuguggggggagcuuaguucaucugauccaagaauauuuuucugaauuaauuuguagaaaggcauugggggggggcgguuguauuuuuuuuuuuuuuuuuuuuuagcagcucaggauuaguucugacuaguguagaacuugcuauauagaccaggcuggccuugaauuuggagagaaauucucaccucugagguuacaggcuuacagcccuacacccagcagugagaagagaauuacucaaguccacagcauccugaaauuauuagaugaggauuauuaaacaauuucauaaauguuuaagaucauaaccccgugauuugggauuguaaaagcagcagagugccaaguaggcuguugcugaugcauguuugcauaauuuaauagugugaacuggagugccauaccucacauuccaucuuguuugagacaugggguuuggugaggacucuuguucagugcugccugugccagccuaccuggcucacugagcugacuaggccaccaauuauuuucuuuaauggcaauggguuugaaacauaacaugaauucaaguaaacccaugcagaugggugugcaaauucugggauacuggggcuagaaguugcucagauuucagguuuuuaggauguaggaucuacagagaccuuacagguucagcaucccuaaguucaaacagccccauguccaaacuuuuuugaaugucaugccauuguuuggguuucagaguuuuggauuggcaugcucaaccugaggauacucuuugaugugcacagaaccuggcuggucagccugagcacuuuucucccuggaaggaucaguuaggggacuguacucuccuuuguugaugacagcagcccccaucacuucucaucaagcuggaguggauaguuuuaugugcuguucuuuuuguuuuguuuuguuuauaaguuuuaaaguuuauuuaugucuuuuuuuuuuuuuaaguguaggagucaugccagaagaucccuucauagauggucaugagccaccaugugguugcugggaauugaacucaggaccucuggaagcgcagccagugcucguaaccauggagccaucucuccugcccuuaugugcugcucuuauguguaguucuuagcgugcgcuuuucuugcuaugucagaugcucagcucuucuuguaguuaauguuguagcuguagaucaggcaaggaacaaauuugggaaguuuucuuuuguacuccaugucccuguaccagauugguaccagaucacacuguuuucaggcagaggaggcgugagaagcuugauuuccugaucauagaucuuaauuagcuagucucccucgucuagcuuuuucgggcaaaguuuucuuaaaauuucccauagcuuagguuuugugaaaacuuuaaaauuguucuuuacguaugucuacuucuguggauucuguauuuccauucaugucuuuguccccuuaacgagaaggccuuauuccucucccagucugccaucaggauccuucagaaguguguuggugccacacuaaauguaaaugcuuccaagaucuuuuacgaugccacauggcacacacagcgucuucccauuguggaggagcagcugaugauguugggagaauagcuaguccuucagaaaacugagggaaaaaaaaucaacuucacaaaaaugccuauugcaucugucugcucaccuguguauguucuucaaacucugacauugauucucaugaauuccaguucaggcuaggaggcugaagcuauuuagguuucuggaaacccauuugagagauuauuuaaagucaguuggguuuuguuagucucagaggcagccccauaauugcaaacuacaucuuagaauuagugaagcaagcuggacuuucuagggcaaaagaacaguaaggacuuuugagggcaauagaaguuacacagaaucauuaguaaggacucaagagggacuccugaaaaagaacagcuguucaguguuggccuguguuuuaaauucugagcagaaaggaacccaguuccuaaggugccaccccuugccuuuuuuguuuuucccuugagacagaguuucauucugcagcagaggcugaccucagacucagcaguccuaguuaaugacuugaguuuguuaaaagaacacaggaggcucgagaaaagaauggcucagguuaaauagcacuggcugcucuuccagaggaccuggguucaauucuuagcaccuacaugcagcucacaacuacuuggaacuccaguucuggggaucuaaugccucccucugacauaagguacacagauauagauguaggcaaaacaccugccuggauauauaaaauaguaaagaccauaggaaguuuuuaaaauccaauuaaagauuguuuuagcuuuguggaaaaaaauuuaaaaagaaacuuaaauugacuuuccaggaucauucuguuaaguauaaaaauuauguuuucaucauuucccgaacucagaaauccuccugccucugccucccaagugcugggauuaaaggcaugggccaccacgcccggcauggagcuucuuuugcuaccaggcuuuuuuuuccucuuuuuagauugcucuguaugcucuugucugccugauucacccugagccuccaugguaggcaguaccccuugagacaggguuuuaccauuuagccugguuggucuggaacuuacauauuuagaccuggcuggccuuggauucauggagaucggcuugccuuugcuucccugagugcugggauuaaaggcauagguuucaucuuuaguccucauggcauuuccuaacagucuagcaggcuuacuuuuuaaaaaaaagauuucuuuauaacuuuguauguguaugaguauuuugccugcauguacaaauauguuuaccacaugcaugccuggugagauagaucuccuagaacuggaguuauagacaauucugaguguccaugugggugcuaggacuugaaccccaguccucuaaaggagaagucacaaaugcucuuaaccacugagccaucucuccagccacugaagucuuaauuuuguuuuuaaaguuuucaucauauaugugcauuguaugugauguguuauaugguauuuucauauaagugugcauuacauguuagcaaaccuaauuuuaaaguuucagaaucagucuuagcaucuagcuaaacauauccauaggucuuagcacaaucuggauacacagacacccuggauacuuaaauaacugaaugagaaaacauacaacugaaaagcuguguguaaccuuaaaaauccauccuuaucauuuucccuugcuccucgggucauguagcccacuucuccucccuuugguauuugccaguuuuaucauauacccaucugaaugcucaugaaggaaagcugcaggcucagcccaggaagggcgaggaagugacuuagccccgauuagcugcaguuacugggaacuccacccucaaagguuucauagccuuuagggcuuccuaaaccaguggguguuuuagaggucacccuggacuuagcagccuauaccaaacauuuccaauaugagaacaacaauaaaaauacaugaaccuuuaugugggauuuuaagauaguacugcuacuggagucauuucaaauuugcauggcaagaucucuaaccugaaaaggcugacauucuggcuaaagucuaaaaccauccauacugagcauuuuccccaucacuaaaaucuaccccucaagaugucagcauccaggggcugcuaacauguaaugagcacguguaugaaaauaccauggaacacaguuguuggggacuaauaggaaaaccuagcugcacaucugguacauauauguggaggaccuggguuccacuuguguaugcuuuugguauuucugucuuuuugaaguucuuuguauugaucguuuaccugugauuccauucuacugcuuaauuauuuacaagggauuugcuuccuuccuuagcggguguacgaugaagaaguggaggagcaggugcucaaggcagaggccgagaaagcagagcagguacuuguauuaaaugucugucugucugucuuucuuucuuuuuuucuuucuuucuuucucucuuucuugguuuuuugagacaggguuucucuguguagccccagcuguccuggaacucacucuguagaccaggcuggccucgaacucagaaauuugccugccucugccucccgagugcugggauuaaaggugugcgccaccaugcccugcucaaaaugcuuuuuucuuaagaguuacuaaccuggagaagugauaaagagggugaugaggacugggaacaugggaaauguggcccuuggcaguggcccaagaaaacguuuccauuuuuuccugaaauuuagccuguuaguacagagaugaaauagcuggauucuggcacgaauguggagcagaguaaacuauucagguuuccaggccacagaggaaacaucgucuuguccucuuccucccucccuuuucccucuccuuccucacucaccuuuaaagaucuagaagccgcucuucuucaguugauucagaaaacaggccucauccugagcuuugagacaugaugucacagaggucaggucucuggaggcccagcuuccccaucucuuuugugguuguuuuuacucuuguuucugucaccucagaauuaucuagggaauauagguuuaguauguguguauuugaggaccccauggaugcaggauguguuaggacagaguggacugugcagugagcaauuguugacucugucaugggacugcgaggagcugaugaucugggacacuuacucucagaggcuucauuggcuguugaggccauugguuauugaccuaaaugacauugcaugguugguaaguguuuuggaaguucacacaaggagacacuugcugauaaaccagcugggaaaagccucaaggaugagauuuuauucagaugaugaaggaagggcugaguuagaggcagugaauagcccaugccaacagaaggaagccauagccucagguucuugcuuuguucuguguucugggacuugcacaaagcgccucccgcgcauuggaugagcuuucuacaacugagcuucaugcccauuccuuuggacuagguuuguggaagauaguggaggucagcaaagagagggaaaggaagaagguuggugagugcugugugcuucggaaagaaggccaagggaggagggacaguagcucccugguuccaggggcuucccgugugaccacuucauauacauccuugcuuaucucaccuuggaguccacacccuuacucacuuuccugugcucuagcaagugcuguccucacauucaggaaagaauggcaggucguccgaacguuuguggaagucacuugagaagguugauagugaagcuguugaugaggauauuagaaaccaggaaaccagccauggcucucucuguccagcauuuuuaggaaagugaauuuucauuaauagcacucaugcauuugcuauucagccaaugaauauuaucguuauaucaaaccagcauugcacuuaaaauuguuaggcuauagugaaauguuuucugaaugccauaggacaacugucagagccuggcuccgucccuuaaagcuaaagguaggcucgagucaaugagcacacuuauccacacacguguuuuuacagacuccguuuugguuuguuuguuuuucuuuuuucuuuucugagacaggguuucuuuguguaagagcccuggcuacccuggagcagagaucccccugccucugccucccgaaugcugggaguaaaggccugugccccugcugcugggcucaguuuugcuuucuuguucaucugguuuuccagaugaaaaaauuggaauucuagaguuuaggucauuugauugaugcccagaaaguaacaaaacuaagguuuaaagcuuguacaucgacugcaaagucuguaucaagguagaacaugacuccguugacauuuugaauuaauguuuuuggagagggcaugacuuuagaguugguauauuggaggcacacacugaaggauauuuuguuuguaggagaagacccgggaacagaaagaaauagaucugaucccuaaagugcaggaggcugugaacuacggguuacagguccuggauagcgcguuugagcaacuugacauaaaagcggggaauucggacucugaagaggaugaugccaaugagcggguggaccugauccuugaaccaaagguaaagcguucaguuacagcaugacgacguccugacugcucugcugggcacaggguguguaaggcgugggcuggggguauuauuagcaucccaaauugcccccuucugagagccuuacuugacacacugagcauuucagggguacagguagguaaaaguugcagggcauaugucuuccuccucuaagguuuuuaguguguagucugcgagaggggcauugacaugagcgcccauccucagaacucugcaggaaaacuguuguacagucaagaaguuaaggguaagaauuuuaacuggauuugguuugauuuugaauuuugauuuuuaacacuuaaaauuuauuauugauggauuaguaugggacauaugagacaggguuucgauguguagcccuggcuauccuggaacucacucuguagaccaggcuggccuugaauucagaaauccaccugccucugcccccugagugcugggauuaaaagcaugcgccaccacugcccggcucuguggaucauuuuuaagacugaaguuuuauuugauuuaauuuuuauuagaaaaacauaauaauauguauguguguguauguguaucucauguuuugaaauguccauuaauuguaaagugacucauucuaacuugugugucacauacuuacuucaugggagaacaccuaaaaugcauuuuauuagcugugaccauccuguuguauugcuagcuuuugaugguauuuccucuaacuugaguuguuucuuuuuucugagguuguaauuuaguuacaauguuucuuucuuuuuccuucuuaaccuucccauauaccuuucuccacucuccuucaaauuuaugucuuuuuccauugcagucauacguguauuuguauaacauauauauuccuaaauauaaccuguugaguucauauaaugucacuuacauguauguuuucaaggcuaaccauuuggugcuggaaccaauaggcgugcccuucccuugggaggaugccuuucccugcgagcuuuccucaguguccuguaguucugcauguaagguuuaggcagugaggccggcaccuccugcaguucggcacguuggcuggucuuggaguuauccuugcucagcucauguuaguuagggcuaacugaagcuuuugugcccugugaccaaccuuucucccucuuguucccagucuuuaggacaagaaggagauugggguugggguuagaugacuuagggaagcuccugaguggcagauacucuguggcucgugcugaggaaggcuuccuggaaguuacuucuuaggccacaaggcuggccuggaacgcacagagaucugccuguguaguucuaccacagaccaccacugcauggucagauaugacguuuugaaaauguacuuuuuaccuugcuguguucucuuauuuucuacuuuaucaccuuaacuugcuuuagauaguggaugcagcaggccaucaaguacaccauugucuuuauuuucaacccguguguuuaauggcugugcccucuccuuccuugaaggaucucuacauugaccggccucugcccuaucucaucgggucaaagcucuucauggaacaggaagauguagggcuuggagagcuguccagugaaggugcgcuuucucaccaguguuucugccauguguuucagccuaaccuuuuaugguaaaaucauuucagcuuuaugauaauaucgcaagagcaguggcaagugcccauagacccucacucaggugugccaguuaacguuucccuugugcuuuuguucucuguauuucauaaugugucugagucucuguaacccugaguccuaauguucucuguauauuuucucagaacaaggauguuuucguauguaagcaugcuguaaaguggucaguuucaagagauuuuauuacuacuuaaucuuugguuauauucagauuugucaguuaucccaucaaaguucuuuacuaccucugcugccuucucugggcaaaggcuuaaaggcauuaaguucuuaaacuguucuagucacuuuuuaauuccauuucauuauuuuauguuuauuuauuuauuguauguguguggcucuguggacgucagugacagccuaugggggucagucaguucucuguucuauugugugaauuccagagacuaagcucccacugucaggacugcaagcaguuaguugccugcacccucaccaucagugacuuguaacuugauacgguuccuccuucuuuuuucuguuaccaugaaguccuuuuuuuuaaaaucacagaagauacguagagauucuauuaauuaucaaaggugcuuucauuccacuaaauagcaauaguuugacuugagucucuuugaagcuguuguggguggcuacuuggagaaggggcuacagacauuuccuggugaauuggugcugacuuuuccaacuuuucccgacagaaggcucugugggcagugaccgugggagcauuguggacagugaagacgagaaagaagaggaggugaggacaugguauggccaggucaugaugggcaggaagcuuaggauauaugucacgggcuggguguguguaacaugcuugagaguuagggaacucauuucauaaaacuaacaagacagaagcugaaggauugaaauuguuuuuuuuuuuaauuguagagagagaaguaagggaaacugcuuugaucccucucaccguuauuuaccucucuuccuuucuaccaaauuccuucacuuuccauuauauuuugaggagagaacaccugagauauuguagcucugucucugccuaaaacuuuagucuuggacugugucugucuugaauaaucuuaggaaaaaauaaauagcugcaaugaacaacuuuuaaaaaguuauuauuaugcacauaggucuaugugugugcagugccuacagugagcagaaggagggugucagaugcccuagugcuggagccacaggcagcucugagcugccugacggaggugcugggaaccaaacucuagauccugcaagagcagcaugcuuucuuuaccaccgagccaccucuuagcccuugaagauuuuuuaaguccucuaaaggaagcaucuacuucaucuucauuugcuagugucuaaagguccacagagaacagccuugauucagaggagggcaccuugagguguucuucagacaaagagugugagauucuaaaaggagaccauucuguguggcugauuuucauuucuuuguucucgcacuugcccucccucuccugcauuccuuccucgagcucggcagauggaaauccuagcaggggaaagaaacuuaccuauuaccuugcugcagauaccugucugccgaguccuuugauuuuagcugucaguguaguaauugucgguagcaaacugaccuucaguuuuugagcuugaugaaguaguuaucuuacuagagggagcacagagauuguaguccaagauguaaaucaacacaaaccaaccuccuaugauuuguucuuucuuuaaaucugaagguuagaacugggaaauacaaaugauaugagugaaucauuggaacuaucuguaugaaacacaaaaauuaugguagcuagacagguagcacugucgccuggauucaugcugucugcuguuuaaggugaccgagaguacaggcuuccccucugccugacagucacuuaccuuggagccugauaagaucuucucugcauuaacagcaaaucuuuuucaccuacaggagucagaugaagauuuugccagucauagugacaaugaccaaaaccagguaaagcgcauguauugcacugacuccauuuuaaagcuuucguugaagcauaauguguauacugaagugacuuuuccuccugcuguuggcacuagggguugaaccuaggguccuaggcauguucggcgagcuuuguaugguauuuguaugccaagucuccuaaaaaugacuucuuaaugauacgugaggauuuucauacucacaguuauuuuuaaguaugucauguauuuagguuagccauuaccuuuuccaaauuuugcuccuuuuuaauaauagcuucuuauaaccaucacuucuuaagacuaauuuauauuccucuaaaaaugaacauuuagaaauucuaauaucuugcuuugauauuuuugcucuuauauucuuacuaaaaaguaaauccuuuguuuaguuucuaaaaaauaacuuauauggaauauauguucccaacgugguuacauuuuuaaagggagagagcaaaaauugacagugucucuguuucaguuuggugacuugcaucuagaaauucuguucuacauucucagcauaccacacagauaagugaugaagaagaggaugaugauggugaccucuuugcugacucugagaaggagggggacgauauugaggauauugaggaaagugcuaagucuguaaguauaaucaccacucagccagguccuagaagucacauuucacauuguuucuuaauagcgacacuuuacuuuuguguguagccagagguaaacgguagaugacuuccucaauuauuuuuccccuuuauuuuauuuuuuaauuuuuaauuuuuaauuuuuaauuuuuauuuuuuuugguuuuucgagacaggguuucucuguguagcccuggcuguacugaaacucacucuguagaccaggcuggccuugaacucagaaaucugccugccucugccuccugagugcugggauuaaagguaugcgccaccacgccugacuuucccccuuuauuuuugugucagguucucucacugaacguagggcuuaccaauucagcucaacuaguuggcaacaagcccaggggcuucucuuuaucuucacagcucugaggguacagguacaauagccacuucuagcuuuuuaugugagugcuagggcucugaacucagguucucacacuuauguagcaagcauuguacugaguuagccaucuccacaaccccucuauuuguaacuugauuuuuuuccuuuuaaagauugucugucaauguacuuuugguguaucugugugucuguauuugcacacauguacguggguuccuggggagaccagauguggggguaucaguuuucuuggagcuggaguuacaagauguuaagacaccugacauggcucaucucucuugcccuuugacugauaguuuauaaacagcaguaaacgucccggugucuccaguugccuuacuagugcuccuuuccuauaaugcugagggugguuucguuagcucauugggaagauggucagcuccagacuugugagcucaaauacuccccuguuucucucuguauacucauguuaguuuucuuacugagguguguguguuuuuaaggauuuuaaaaaauaaguaacaguaucuccuuuuaaggagauauuuugugaauucuguuacuuaccugagcuuuauagguuccaugcauuuaaauucauuaauaaaguccuguuuuuugcaaguaaauauuuuuuaaaagcccuguuuuauuuguaguuuauuucuuuuugacuguugauauaauuuuguuaggugcccagaaguguacucauuuguuagauuuuauuuuuugccuguagaaaagaccuacaucuuuugccgaugaacuggcagcucggaucaaaggagauaucucaaaccagcggaaagagggacaaacaggugaguucugaaggcagguuaauggggugguuuguggcaugcuguaguuugccugugugccuccuuacacaugcucugucucucucucucucucugucucugucucucucucucucucucuuuuuuucuugugacuggaucucauauauuccaugcuagcuucaaauaugugauauaggcaaggguggccuugaauuucugaucuccuuugagugcuggggaucaaaaacacggccacuguacccaaacauggggguuacagugaucaacacagccgcuggacccaaacauggggacacuauguacuaaggcaugaugagcuuaaauauuaauuuuuguuuuuuuaaaaauuaauuaauuuauuuuauaugaguauaauguagcugucagacacaccagaagagggcaucggaucccauuacaggugguugugagccaccaugugguugcugggaauugaaaucaggaccucuggaagagcagucaguguccuuaaccucugagccaucucuccagcccuaguucuugauuuuuguuguguuuucuuagacuaccuuguuguggccuggcauucauuuccuuggguggagggacgcguauaugccgggcaugcugaacugcuuuucuccugccuccuccugccuguggcucugguugucaggcuuggugcuaagcccuuugacccuuaagccaguggcucucagccuuccuagugcugcguccucaagcauggugaugcccaaccauaaaauuauuuuuguugcuacuucauaacugauuuuucuguuuuuuuuuuuuuuaaugaauuuuuuagugaacuguaaucuguguugucuaggucuuaggugaccccugagaaaggcugcuuuaagccuugucaguggcucuuggauucuacuugacauuuagauaccaugaguguccgauuucucccuugccccaguacauguguauaucuaugcaacaucuuacaugcaugcaguaugggaaccccagagaacuauggacagcaaacugugaauccagggcuuaauauuuacucuuaaacuuugacuaaaguuauuuaccagaguagaaagguagaguaguuucuuccaugcaugcaguccugguacgcacaugaccuggcagccuacuccuauagucagugcucuaagagagcugagauauaaacuugagucuccugcucuuggucugugucaugacgaugcagucaugagcagcgaaucaguaucuauaacaagaaugcuaauaaguauugugaaaccucugagauucuccuaaguuaucccccacagauggaaaaccucagaagacagugaaggagaagaaggaaaggagaaccccugcagaugguaaguccuuugcucauuaggagccuuuagagaaugggaagaugucacuggcaacugcugaccaguagguugcaccuccauucacuuuuuuaaagcaucugaaaacacauuuuaggugcgagggugaaagaaaggcaagugcagaguaaugcuuugaguguugaauugcuaguccagaguaggcguuucugucuuucuagauuuuuuuuuuaaauauuuauuuauuuauuauauguaauuacacuguagcugucuucagacacuccagaagagggcaucagaucucauacggaugguugugagccaccaugugguugcugggauuugaacucaggaccuuuggaagagcaguuggcgcucuuaaccgcugagccaucucaccagccccuagauuuuuuuucgauguguaggaauuauggguugcuaaaguuuucagugaagauuguaugugacccuuccauauuaaccagugacaucuauguguucccuugccaugucuccaucuaugggacuguugcucaguuuguuuuuccuuucucuaaacuugggcauguggcaguuaaacuauauuuuugcuucaaaguaagucagucaaguaauugcccuaaagaaucacuuuuguccccagacauugcucccuuaaggaugagagccuguuuuuuuuuuuuuuuuuuuuugagacaggguuucucuguguagcccuggcuguccuggaacucacuuuguagaccaggcuggccucaaacucagaaaucugccugccucugccuccugagugcugggacuaaaggcgugcaccaccacgcccggcugaggacgagagccuuugaggcacgucccuggauuguuugaaaucuacugcuuuguucucaauacuccuugugaaauauggcuuuauuacagucaugccauuauacuauagaugcagucccagauauacagaaaucccaaacccagcccccccuuucauucuuauauauuugagggaaaauauugcuguauagcccaagcuaguuuggaauuaguguguagcccaagcuggccuuaauccuaccaugcccagccuguccuugaucuuagucuccugaauguuggaguuacaggcagugugccaccaccacaggcuacaccaguuuaacacucccugugcaacguuacuuucugauagaugaagaagacaucuuguucccaccccccacacugacugaugaagacuucucacccuuuggcucuagagguggucucuucaguaacgggcaggggcuuuuugaugaugaagaugaggugaguugggcgaucgaguaaagcucuuugugucaucgagcaugcaaggaaaggagccaugcuuuuguuagggagaagaagcuuccuaccaguuacgccuuucauauuugggcacauguuaaagugagaaucacagaguaagaaauacuaucuaccccggugcccuauuguuccuugaugugaggagaggcugugauguaucaauaguagguaauuuccuugaauuaccucccaugucauccucucccauguuuuaauucagucccugacaggcccaaauuaagaucauuuugcucuagucugcaccuugucacugauucuuuggcaggacaguaaauauguagcuucagaguauaggauacgucucagaaaucuucaaggucagccuuguuuaccucugcauuuuaaaauuacccuaugccuuacuuaccacaaccagagugaccucuucaaggaagccccucgggcucggccagcgcaagcuccugugagugaagguagguguggggacggaugcuuucucguugccugcacuccuggcuugcuuucuguuucugugauaaacaccauggcaaaagcagcuuggggaggaaggguucuugccauccgugcagcuuauaggccaucauccuggcuugccuuccagguucacauuuagcuguuuuucuaucucccccaggauaaucuggcugagcauugguacuguauaaagugggcugugccacaucaaucauuaauuaaggaaguguuccacagucuaggccagucugauggaggcaguucucaacugagaguugcucucuccagauaacuccagauuguaucagguugccagaacacuacccggcagacacguucucgagcucuuucccugugaggcagagcgcccugaagcuuauccccgcuaagcugaagcugguuugcuugagccaguugaagacaguuuguuguuacugugucuuagcaauagggaauggugccaucuucagacccauaucacgcauuuacccuuugucuuagucaggguuucuauuccugcacaaacagcaugaccaagaagcaaguuggggaggaaaggguuuauucggcuuacacuuccacacugcuguucaucaccaaaggaagucaggacuggaacucaagcaggucaggaagcaggagcugaugcagaacccauggagggauguucuuuacuggcuugcuuccccuggcuugcucagccugcucucuuaaagaacccaagacuaccagcccagagaugguccuacccacaaggggccuuuuuuccuugaucacuaauugagaaaauuccuuacagcugaaucucgugguggcaucuccccaacugaagcuccuuucucugugauaacuccagccugugucaaguuggcacccaaaaccagccaguacacccuuuaaagaugauaaaaaagucagaaagaaaaagauuuguuuguuaugcugaggcuagcuuuacuauauugacauuaauucacaggaacaccauguugagaauaucacuuggucaucaggaacucaucagaaucaucuguuggaauuuuuuaaaagcccaaaguauuuuuugaaaacuuacaauuuuuauuccauuagauuuaaagaaaaaagcuguugauaucaggaaaaauaaaaaaauaaaaauuuaaaaagacuuauuuaggaacagauugccucagagaagggguggguuuuuuuuuuuuuuuuuugacgguuuugcuauguagucaugguugguuaucauguagcccugagcuguucuugauacacgaccauccuccugucucagcugcguaagucuugugauugcagguauauccugccaugcucagcaacucugaugaaguaauugacuuuucuuucuuauucuagaauuaccuccguccccuaaaccuggaaagaaaaucccagcaggggcuguuucuguacuuuuagguaacagguuuuauaguuaguguguguguguguguguguguguguguguguauuguguacacaugugaaugugagggaaacuguauguguguauuguguguacauguggcuguguauacagagggaagaugacaaaacccuagcacucuugaggcaggguguuacacugaaccuggagcuaagcugguagcaguaagcuccagagagccgccucagcccugguuccagcacugggguuacaggcacagguaccagccacacccugcaauuuuauuuuauuauuuuuuucuuuuugagcucugaggauuugaacugagauccucauguuucagaacaaguccuuaacuugcugagccaucaccucagcggucuuucuuaagaauuguagaaauccauuuugucaucacuuuauaaggaguggcuagggcuugggguggguggguacccaggagcccuagaaagcauuggaguguucauaaguccaguguauucacuggugcucugagcucacauucuguaugaauucagaggcuuugcaugggaaugugacagaguaguucagugcuuguuucauaugugcauggcucugguuuccuguccaacacuacagaggacugcauguguuggggaaaggagagaagaggaaagaaggggagagccugacagaccagcaaggggggaggagcgagggcaucaguccagguuccugagggcuaggcagcccugggcugcauuuugcuguccaacaccugcacaaagguuauuucauuuccuaaguguuuuguggcugaaccugacucaugagugcugucaggaggcuccugcuggagcauagcucugacuguccuuccauccucagggcauccugaugugucuggguccaccucugccccaucacugaaggagcuccagaaacaugggcagccuacuccggggaagagcucacauuugccaacuccugcuggccucuuugaugaugaugauaacgacaaugaugaagaugauaauaacuuuuuuaugccaucuucuagcaagccuucuaagaccgguaccacuuuuaggcuaauucugggaacuuagagaagaaaauuaaacuuaaggggacacaguucuucacauucggugucucuuacaguuccagaaugccuuacuuacugaacauuacugucauugucuuaucuaugcuuaaauugugcuauagccuugggggggucccucauaggucaaucuuuucugcuuugggaaucaauuacugagguuaucuucuuuaauagggagcugaacuucuucuguauucuuuucuuaaaguuuuugcuucugccuuucacauuacaggcagaaauuuagucacacuuccuccuagcaacuccggguaguuacaugagcggaacauugcgugcuuguugcuuaauucccagcuucucuuuuuucugccagagggcucguauuguuuuugcuuuggugcauccucuccccuccuccgagguccacacugauguccuuccugugcuuuuacucucugacggagcuaugccuggggagucaggaaagcuguggucuuucuguuuagugggucuuuguucgauuuugaaaagaaugagcugcuggagggauggcucagauguucuggguacguucuacacguccugggaacgaugcccggaccuccagcugugcaagggcaaagauaggauccuccagcugugcaagggcagagauaggauccuccagcugugcaagggcagagauaggauccuccagcugugcaagggcagagauaggguccccgggcuuugcuggcuuugaggcagguagagaaaacacaagccccaagaucaggggaagacccuaucucaaaggacuagguagagagagaguaguaggacaccggacaccuucugaccucuguauacaugcacacacacccaccccaaaaccugagcaaacaaugcaacacauaaacaaacaaacaaacaaacaaacagaaaucucguaaaaaaaaaugaggcauuuacuuuucuacccugggauauuugggauauuuccauuguacauuaaauggaaaacacaaaugguaggucauuuuacucagauuauuccaaauuuauaaucuuaugaauagcugauauaaacauaagguaagauuuagaaguguguguaccaagcucuugugucugucuugucuaggugggcagguggagaugagggaaugccagcauuugguuucaucuauuucuguauaguuuggucuuuaaugaaaacaggagucacccuucacaucuccguccuacaguuaaugacuuuuuggcuccuuaaagugaucuuuacucuuuauccccaucuuggauauacuuagcacaggagucuucuguuuggagaagguucauucauaugguuagcgucuuuugauuuauuugaacugcuguugcagagugccagggcuguggaucuggggagagcagcucuguggcagagcacuugacugcaugucgcccucucuggucagccccgagaacugcagggaagcagcagggaaaggaagcagccgaacuaaaggcagagcagggcuccacucacuuuguauuucucuguaaaugagcaaaaaauaagacaccuuccauauuuaucuguggaagagaagaagugugugucugugugucugugugucuguguguguguguguguguguguauuuugaccuuaguguaauuuuuaugcugugguuucucuuuuaagacaaagucaaguccacugccauuaucuuugaugaugacgaaggagaucuguuuaaagaaaaagcagaagcuuugccggcagcuucugugagccagacacaugaaagcaaaacgcgggcagauaaaacggugaguggagguggacugagggacauuggccugggcagcuuacaguagccguuuaucugggucucagaggcacguagaguucuccuucauguuugcuguccuaguuugcuuucuguugcugugauaaacacuggccaaagcaacguaggggagggaaagguuuauuuuacagguugcagccuguccuugagggaagccaagagaagacuucaaggaggcggcaguggaagaacacggcugcugacuucaguguuuugcuggcuugcucagcugccuuucuuacacagcccgggcccaccugcccagagguggcaaaguuagcaaccgagaaaacaccugguagacaugcccacuggccaaucggauggaagaguucuuuaguugaguuucccacuucccgaauaugccagguugacaaucaagaguagcaacuacauuuauauuaagaauuuugaaaaaaaaaaagaauuuugaacauaaaauugaaaagcacaaugaaacucuaaauaacuucuaaucagaucugugagauuagugaggauuugccaaauauaugucugagccuucgugcaagcaugcuguuuucaggauuauuuggaagugauuuguaguuguuauguuuuaccacccuacauguuuuauuaggcaguucugggaaugcuguuuuauccccacaugccagaggcuggcaguaacucuauagaagagucucauggcagucugcauccaugaggcuccagguagccauaacauuucuuuuauaaaauaauacucaauauaauacugauuuaaaauaauuuuauacauaguugguauucugucuuuuucccccgugagacaucuuauucuacagauguccuauauagguuuuucuuucuuuaguguauguguauauguguauguguauauguaucaauaccuauauguauguauauacuuacauauauaugagggaauuuauuaggggauuuauuuagaaagggaauuuucuugaaugguuuacaggcuaggccagcuaguccaacaauggcugucuacuaguggaagguccaagaaucuaguaguuguucagucggccaggcuguauaucucagauggucuucaauauacacuggaauccuaaagaaguaggcuccagugcuagugaaggaauggacuugcuagagagcaagagcaagcgaagagagccagcuuccuuccauguccuuuauugaggcugccagcagaaggugcagaccaaguuaaaaaguggauuuuccucucucagaaggucuagauuacagaugcaucuuccuucuccaaaagauccagauuaaaaauagggcuuuccauuuuaaaagauuuaauuaggaaaaaguucuucacaggugugcccaguuggguuuuaguucauuccagauguagucaaguugacaggaguagccauuacacaugccacaguguaacauccucauuuaacucugacaacuaccaaagugacagcauuuaaaaucaucuucauuccucaaccagcuuguccuuugucuguuucuuaagugccugugugacacuauauguuucauguacacaagcugugccccaugugucaguguauguuccauagacacagaugugcccaugugacaguacaugucccauguauacagauguauuccaugugacagugcaugcuccauguacacagauguauuccaugugacagugcaugcuccauguacacagaugcauuccaugugacagugcaugcuccauguacacagauguauuccaugugacagugcaugucccauguacacagauguauuccaugugacagugcaugcuccauauacacagauguauuccaugugacagugcaugucccauguacacagaugugcccugugcuuuaucguguuugcaucaucucuucugggaaaucugagaaacuuauuuuccagugacacuguuucuucccuguucacuaauuuacaccaguguuuaauccuuugucaugguaauucuguacaaaguccugguguaaacuucauacagaugaagggccagggcauguuuagucccuuggugcuugccuggugccuucuccuaggagaggcuggggacauuugcucagaugagcuuguuuccaugucucuuccuugcuaauaguguacuugcuuuuccuuucucuuuuuuguggggauccaaccagaucgccuuaccuucuagcaaaaaucugaagcuugugucagaaacaaagacucagaaagguuuguuuucagaugaagaagacucugagguauggaauuccuuucuuaguucuguauguuuauacuaucaguaacuuucugaugagccugucagaaagguuuaagacuuuuuauucaguaguucaguucuuauuuugaaaauaaucuugggcuggggauauaauuuagugguauaaaaugccugccuagcauauacaagacucuuuguuuucuugaaaguaugugaucuucagaaaacaacacacgagugcgcgcacgcgcgcacaaacacacacauacacacacacacacacacagagcacacacacaguagcuuuaacuuuuggguuugaauccauugcauuuccuuuaacauacuuaaauuuaagacuguugguugguuggcucacaacugugaaagaagaaaugagcuggcugcuucguguccugguaaugcuacuuacuagagaguuuguugccauugagauacauguucgguacaccuuuuccugucauugcuggugacagaugacaggcuguggguaggaagccucaagcagcuugggcuccuauccccaugcggugggucucuaagcaugguagcuucaggaagcggggccuauuucugcuuguucagcuccagauaguguagauagaggcuguguugccuuuuucauccuagucuuggaaguuguccuagauauuuuuucugugguugugauaaaaaaacugaucaaaagcaacuuggggaggaaaggguuuauuucauauuacaagaugucucuuauugaggaaagccaaggcaggaauucagcagaaaccuagagcagaggccaaggaggaaugguguucacucgcuuucucucucuccugcuuggacugagccugcuuucuuauacaccucagggccaccugcucagggauggcaccgcccacagugggcugggcccuccuacaucaauuagcaaucaagaaaauaccucacauauauauccacaggccagucuggugaaggcaguuguucaguugagaaucugucuuccuugaugugugucuucgucaggauuucuguugcugcaaugaaacaccaugaccaaggaacaaguuggggaagaaaggguuuauucaguguacacuuccauauugauguucaucaccaaaggaagucaggacaggaacucacacagggcaggaacuuggaggcaggagcugaugcagaggccauggagggaugcugccuauuggauugcugccccuagcuugcucagcuugccuucuuauagaacccaggcccaccagcccagggauggaccacccacaaugggcccucuccgcuugaucacuuauugcgaaaaugcccuacagcugggucucauggaggcauuuccucagcugagacuccuuucuuugugauaacuccagcuugugucaaugugacacaaaaccagccaguggaaugugucaaaugacaaccaagauuauacaucacagaaguccaugcuguucuuucugcaguuguugaugggacagaggcaggaaacaaauuucauugcguguguguguguguguguguguguuuguguguauguggagggugugggaauacuggagauugggaggauaguaggggguugaacccagggccuuguguacucuaggcgagcauucugcuacugagcuauauauuuccagucccucaaggucaguucuuuuguuuuuuguuuuuuuuuuuuugaauuacuuauuuauuuuauuagauauuuucuuuauuuacauuucaaauuuuaaccccuuuccucguuuccccucugaaaaucccccuaucuuaucccccucccucugcucuccacuccugcuuccauguccuggcauuccccuacacuggggcccuucacaagaccaagggccucuccucucauugaugucccacaaggccauccucugcuacauauguggcuagagccaugguucccuccaucuauacucuuuggugguuuagucccugggagcucgggggugggggauaguugguuaauauuguuguucuuccuaugagguugcaaaccccuuuagcuccuucaauccuuuuccuaacuucuccauuggggaccccauuggggacccugugcucaguccaaugguuggcugcgagccucugccucuguauuuguaggcucuggcagcaccucucaggagacagcuauaucaggcuccugucagacagcacuuguuggcauccgcaauagugucuggauuuguugacuguauaugggaugaauccccagguagggcagucucuggauggccuuuccuucagucucuguuccacacuuugucuccguauuucuuccugugaguauuuuauucccccuucuaaggacugaagcauccacacuuuggucuucuuucuucuugagcuuucauguagucugugaauuguaucuuggguauucugaguuuuugggcuaacauucucuuauuggugagugcauaccauguguguucuuuugugacuggguuaccucacucaggaugauacuuucuaguuccauccauuugccuaagaauuucaugaauucauucuuaauagcugaguaguacuccauuguauaaguguaccacauuuucuguauccauuccucuguugaaggacaucuggguucuuuccagcuucuggcuauuauaaauaaggcugcuaugaacauaguggagcauguguccuuguuagauguuggagaaucuuuuggguauaugcccaggagugguauaacuggauccucagguaauacuauauccaaauuucugaggaacuaccagacugauuuccagaguuguuguaccagcuugcaaucccaccaacaauggaggaguguuccucuuucuccacauccucaccagcaucugcuguccccugaguuuucgaucuuaacccuucugacugaugugagguggaaucucaggguugcuuugauuugcauuucccugaugauuaaggauguuguucuuuagguacuucuuggccauuugauauccuucaguugagaauucucuguaccucauuuuuaaauagugguauuugauucucuggagucuaacuucuugaguucuuuuuguauauugaguauuagcccucuguuggauauaggauugguaauuaucuuuuccaagucuguugguugcuguuuuguuuuauugacaguguccuuugccucacagaagcuuuguaauuuugugaggucccauuugucuauuguugaucuuagagcauaagccacugguguucuguucaggaaauuuucuccugugcccauguguucuagacuuuucccggcuuucucuuuuauuagauucaguguaucugguuuuauguggagguccuugauccacuuggccuugagcuuuguacagggaaauaagaauggaucgauuugaauucuucuacaugcugaccuccaggugaaccaguaccaugugaugaaaauguuuguuuuccacuggaugguuuuagcuccuuugucaaagaucaagugaccauagguguguggguucauuucugggucuucaauucuauuccauucaucuaccugucugucucucuaccaauaccauacaguuuuuauuacuauugcucuguaaugcagcuugccaaccuguuugccauuguguaaaaugcagagggggcauaggacacuggaaccuuuuuguaaacaaaccauuggggcucaugaagccagguagaaaccagugugcuaagaacucucuguaggucaguaaacucauuagguuuguaucugaugagugguaggcacugauuguauaguaaaaagauaucguccaaauaggucauggaaaauguucuugucucauuuaauuaucuggcucuuguauugcggucccucugcccaggggacagguuguccuacuuccuguuucuaguucaugcagcucagccagcagugucccuugggcucugagcugacaauccguccgggguuaaggacacccucagagcuuggcagaccuuuugcaguguuucauaguuacaguucaaguggaauaguagacccugucagcacauauccuaccacugcauucgcuuccaaguccaagccuuuuaaaauaggaauuucauuuguauuuauugaaaagauguaaugcauucucuggggagaaacaucuuaacaauagagccauguuggccuagcucucugcaaauccagcccauuugugguagaauuugucugcuucucauagauaauucagacaauggaaaccuuugguuugccugaugggacugacugggaaaugucuuccugccucacauccuuucggugggaauaugguugccuuacagcuuacaaagagucugccuuuucuccuuguaucacacacaacaguggcacaugcugagacaucaaaucuagacgcacaaagccgccauguccuaguguuuuguauuuauuacacaguaaagcugacagaccuggcuaaccagcagcuuugauuuugauucaacaggauuuguuuucuucucaaaguucaaguaagccaaaaagugcaucacuuccauccagccagcccccaacaucagucucccuuuuuggugaugaagaugaagagguaaauguuguuauugcaacaccagaugauuaaccuagaaauuuguuuuagguggcuuuacagccagaguggaguacaguagaaaugagcgacugggaagguucuaggugacuggugucugguuauguuggugacuuccaaguuuuuccaguaauacauuuaaaaucuuguacguacacacacacacacacacacacacacacacacacacacacacgaguguggaucucuuauacccaguaaucuauacgaaugucuuagauaaguggcaguaggaaagaggaggcagccauguuuuuuguuuacauuucuucucacccuggguauagagagugucuggggugguaaagaaaaguaagagguaaaaggauauagauuugaaccuuuauguagcacugugugcagugguugauucaugugccuguugguccacacucaguuccaccauugcaaauuucugcagauugcuucugugcguuaaaggucacuagguucauuguagccacugaaacaaguaaugucacaucuuugcccagugguugguaaaggguuuaaguguguagugaaggaaagcuguugucacuaacaucucacuggccugcagccuguuauacuugugaucuuucuaccuuaccaguguuuacuuaaagaccuccaguacugucuuuggcucaggacagcuacaguauaagcuauuaagaguuuuugcggggcuggugagauggcucaguggguaagagcacccgacuguucuuccaaagguccggaguucaaaucccagcaaccacaugguggcucacaaccauccguaacgagaucugacuccuucuucuggagugucugaagacagcuacaguguacuuacauauaauuaauaaauaaauaaaucuuuaaaaaaaaaaaaaagaguuuuugcaucauaaaccaaaccugggcucucugaugguuuuguuaccuuaauguaaguggguaaauagaauuuugggugggguuggguaugguagcaggaucucuuagguaguccagauguuuuguaacugaccaugcacagcccaagcuagcuucaaauuuauaaucuuccugccuuggcuucauuaauccuauggucaaaggugcauaaagccacagucacuacauauuagauacuuuuagacuauuuauaaaggucacugaauuuccuuaagaugccagggguuuuauuuaguaaaccguuccaugccuuuguauucuuauuauaaauuaauuauaaauaauacuucuuuuucuaacuuucuuaucuguaaaaacuccuuuuagucauuaaugcaauaucuaauucuucgagagaugcuugauuguuggcuguugccaaggcucucaugccugcagguggacugggaaggugaccuccuggugcuuccaccagcuugccuguccuuugcccucucaagcucuggcucagggucuguaguaacuccugaaaguuguccucuaaccuauauacauguacuuuccccauucacauauucuguauauacaugcacaugcagaauaauaguuaaacauuuuuaaaaagauuuauuuacuuacuauguauauaguguucugcuuacauguauuccugcaccccagaagagggcaucagaucccauuacagaugguuggaagccaccaugugguugcugggauuugaacucaggaccucugcccuaagccaucucucccaacucccucccucccucccucccucccucccucccucccucccucccuucuuucuuucuuucuuucuuucuuucuuucuuucuuuuaaauuaaaagaauucugugguaaucucguuuuucuuuuguggauaguacuuguaacuugaagagguuguagacugauauaugcagaugucuugugacugaguuguugauauguucuauacuguccuaccauuuguucuuuuaggacagucuuuuugggagugcagcagcuaagaagcagacuucaucucuacaaccucagagucaagagaaagcaaagccuuccgagcagcccucaaagaagacaucugccuuguuguucagcagugaugaggagguaggcuacgguuugcccacacacacggucccgaugcaaaugaagacugaguuagagcuguucuaaacguguuugcuuacugugcuguacucacuggggcuuagucauggaaagaugguguuugcaacacugaucuuucaaagaaaaguguuuaaguaauguguuaaacauuaauacauucaaaauggaguuaauauggcuuccaccacagguucauggcugaagcucuguaucaaaagauagcaaggaaaaagcauucacaucuaagguacauuuggggugauaaggaaccuguggguaugcguugcuaagugugacaaagaacaacguuugggagaagcacaguaggacuggagagaggucugcagugaagcugaaggggagaggucugcagugaagcugaaggggagaggucugcagugaagcugaaggggagaggucugcagugaagcugaaggggagaggucugcagugagaagcugaaggggagaggucugcagugaagcugaaggggagaggucugcagugaagcugaaggggagaggucugcagugagaagcugaaggggagaggucugcagugaagcugaaggggagaggucugcagugaugcugaaggggagaggucugcagugaugcugaaggggagaggucugcagugagaagcugaaggggagaggucugcagugaagcugaaggggagaggucugcagugaagcugaaggggagaggucugcagugaagcugaaggggagaggucugcagugagaagcugaaggggagaggucugcagugaagcugaaggggagaggucugcagugaagcugaaggggagaggucugcagugaagcugaaggggagaggucugcagugagaagcugaaggggagaggucugcagugagaagcugaaggggagaggucugcagugagaagcugaaggggagaggucugcagugagaagcugaaggggagaggucugcagugaugcugaaggggagaggucugcagugagaagcugaaggggagaggucugcagugagaagcugaaggggagaggucugcagugaagcugaaggggagaggucugcagugaugcugaaggggagaggucugcagugagaagcugaaggagagaggucugcagugaagcugaaggggagagguuugcagugagaagcugaaggggagaggucugcagugagaagcugaaggagagaggucugcagugaugcugaaggggagaggucugcagugagaagcugaaggggagaggucugcagugagaagcugaaggagagaggucugcagugaagcugaaggggagaggucugcagugagaagcugaaggggagaggucugcagugagaagcugaaggggagaggucugcagugagaagcggaaggagagaggucugcagugagaagcugaagggcuuuugcagacuccgcuggugcagguguugcuuuuugucuucagcaguggggccaccuuuccugucaguacagggaggacacuguuggucuugcuucacaguagaggaccauagcauccucuuuuguuuuacuauuagggaaaaggugagaaggucaggggcuugucuuuguugccaaggggcuauacuuugagggccacgugaccaggacuccauccacuguguauuaucucaaggacugcuuugugucauuaagcuacaaugcaguagacacacuagcagugguguacgcaaauucaacuccuuuucuguaaggcagugaauuugugauuuggauagagaucagcaaaaucaauaguagcuuaauuauuauucagauuuagcugagcaagaagaccauaaauccaaauaagauuuagaguuauauuuuaucuuagaaggcugagaaaaaacauaaaaaauucagugcccugaauuguaaaggucuaggaauguaacuagugcaguugcagugcguauccagcaagagcaagacccugauucuauguccaauuaggagaagacuacaauaauaagacaaaucgaaaccuuuuaauagaguggguugcagcccaguugguaaagugcuggccuagcgucuuaacuuugcgcuucuauuggucugaucaaacaccaugaccaaaagcaacuuggaaaggagagaguguauuucagcucauaguuauaugccagagucugucacugagggaagucagggcaggaacucagaguaggagccuggagacaggagcugaggcagaugcuagggagggugcagcaugcucacucauucccuccucaugacucacucagccugcuuuccuguagcacccagguucaccagcucagagggcacgaccuacagugggcugggcccgcccugccaauuguuaaucaggaaagucccccacagacuuucccucaggccagccuuguggggauauuuucucaauugagguuccuuuuucaaaaaugacucuugcuuguguuaaguugacacaaagcaagccaacaacucuaguguuuagaaagccuggguuuaauccccagguacggucugaguuucugguacuugagaggaggaagcaggaggaucugaaguguaagauuauucccagucacuuagugauuuaaggccagccugggcuacuugggaccccuucuuaaacggaagaaagacaucuaagucuuuagaguaugcuugauuuuuaauuuguuuguaacuuaacaguuaguaaacucauuuuacuugccguauuccauauuuaaauuagccacuagauaauguaugucucugccacuaacagagcuggcugguggcuggcagaccucuggacuuggggaccacccaagaccaagaagcaaagcugugaaagaccaaccuauuugaggaggagggagaagagaaagauguguguacguguguguguguguguguguguguguguguguguguguauguguugaguggaggggcccuugcacauguuuguguguggucuggcucagcugaugggugcuccugggguccaccuagaucugcccccaaugcugggauacugauguguguggcuauaucuggaucuuuuaaacaugagaucuggggauuugaacucaaguccucauguuuauguagcaagucuuuuuuccucaccuagccauuuugucgucacuguccuguggauuuuuaaugcaugauuugugucuuaaggaccaauggaauauugcugauucgcauaccaaguuagcaucugacaauaaguccaaaggagagcugugggacucgggggccacccaaggccaagaagcaaaggcugugaaaaagaccaaucuauuugaagaugaugacgaugaugaaguugaucuguuugcuauugcaaaggacaggugagauguuuacaaucgcaggaaaaguuucaugugugagacggaaugucuguugacguggucgauggcuuaguguuacauacacacacacacacacacacacacacacagacagacagacagacagacagacagacagacagacagacagacagggcugcucuugcuuaucugugcgaaggcuuugggaaaguuugccuugauuuuuauuucugacauuuuuguaaccuugaaacaguuuuuucucuaagagguuuaagaaugauauuguuaucuuuuaugucuuccccucccuguuagguauacccuaaaaaagguuacuuaaaaguuuguuacuuugauagaaauccugaaaauguugaaaaacaugauauuaggaggaguaaacucccagcaggcacuaacuaugccuucuggucuaugugacugagcugaagcuaguggcuuguggagugugacaucgggcaugcuguaugugccgcuggagagcccugugugugugccgcuggagagcccugugugugugccgcuggagagcccugugugugugccgcuggagagcccugugugugugccgcuggagagcccugugugugugccgcuggagagcccugugugugugccgcuggagagcccugugugugugccgcuggagagcccugugugugugccgcuggagagcccugugugugugccgcuggagagcccugugugugugccgcuggagagccguguguucagaggagcucccacauucagccuuuuccuuuggagaguugucuguuguucggugauuacguggaagcucagcugaauggucguagaauaagcaggcaguccauugaaugcggaaguucugugcgguagcugguggucuucacagauggauucagauucaaaguaccucagauaucucuauagagagguccaucucagacuuuaauguugccgcuuuuaggcucccaagacuugacaccugguuuaucuguggccuuugguccagcauagagaaugucugaaauccuaguucuguuuuaaauucugccucuaucugaauaacuuugggcaaguucccuaacuucuguaggccucagauauuucaucucauauaggcuuguugagauagucaugcacuuguuaugugaaaugcuuuguguaguagcugguugugggcagcauucaucauaguucagggaaauacaucacucuuauuuuuauuguucuuuccugggauacuugccuuuccugaacggcuucugucaagagucaguguaaguccucucuuuugaaagccuacuauuaauccagauaugagaaagaagaacuuggggcuuagagcacaugcaucucuuugccuucccccacccccuguagcuccacuguaguugagcauccucuguacaugugugcccuaccacacacauugccaagaaccugaugaccugaaacacaucccauuuguagggcuuagugccagccacacaguuccuggcuuucaguaaugcuuucuguauuucuauaaaauguuguguauagaaaguaagucaggggcuggcgagauggcucagcggguaagagcacugacugcucuuccgaagguccugaguucaaaucccagcaaccacaugguggcucacaaccacccguaaugagaucugaugcccucuucugaugcgucugaagacaacuacaguguacuuaaugaauaaaucuuugggccugagcaagcagggacugagcaagcggaguugaccugagcaaguggggcgaccagagcaagcagagguccuaaaaauucaauucccaacaaccauaugaaggcucacagccagcuguacauguacucacauacauaaaauaaauaaauaaaucuuaaaaaaaaaaaaaaaguaagucagauuugaacagaucucaaaaaggucauugcaaagauguggaugaguauaaaguggugcagucacuuuggaaaaugguuuugguauuucuucagaauguuaagccugcguuaccgugugauccaguaauuuaacucuuugguauacaacuaagacaaauggaaacaugcucagguaaaacugugcaagaaugucuagugucauauuaauccaucauacccagaaagcagccuaagugcccaucagaugacgaauugauaaacaaaagguuguggaaccacguagugggcuauuauucagcaacaaugugggauaaagugcugauauaugguagggcaugaaguagccugcaaaauauauuaacugaagaagucagucacauacgaccauagauugaaugauucuguuuauaggaaauguccagaaaugaucaauccagagagaggaaguagguuggugguucagaagagaagggaauggggaggugacugccgacaggcaugggguccuuguuagacuguccugauaguguuucguucucaaaaugcuaaagauucuugaaaugugaauuuuaaagguggcaauuuuauuauguaaauuacaccuaauaagucuacucugaaucaaagaaguaggaguggaaaagaagguuacagugcaaaaacugacucuggcucugugaucucucagcugccuuccuuggcaugcugaaaguaggcauagcugcucuaguuucuucucuauuggagaagacgaugauggagaauucuauguuugugacugcuaggagugcaguaugccuucagaucuaggagcuagugcagcugcagugugugcagagugacugacagggcuucagaagcaggucucugggcaccucugcaugagagugauaggcagaggcugcugccuguaugauccgauucugucuauccaaagguuuuucaaaucaccaacuuuaugcuauacaaagucaacaaauggugggagucaucgcugugaauguggccauaaaagcuuuuuguuuuuaaauuguauuuuuuccugaauuugaucuucuauuuguucauagccaaaagaagacucagagaacgucccuucucuuugaagacgaugcugagaguggaagcucucuguuuggccuuccuccuacaucuguuccuucugcaacaacgguaucauuuuucuagacucagaaaauaccuguaggauugugcuacauguguagagaugcugcuuugucagaucugagaacccaugcugggagcugcuaugauaacacauuuaacauaagugaggacggcucauuuggcucaugauuuuagacggucaguccuuaguccuugguucuguugguucuggaccugugucaagacagaacgucauagaaauggaggcuacucaauucaugguggacaggagacagcuagagggacaggguaugggagggcaggauguagcucccgaggauacauccucagugauguuccuccagcaaagcucuguauccuaagguugccaggaccucagauacccccgcuagcucguacgcucuccguaccugagccuggggacacuucaucuuuaaauuccaaguguagugcauucuacauuuguuuuucuuuaaucccuuaaguguugccuguugucaucugcagucuuagugaauuuccauuuucuuugauuucaaguugaauaauuuuugcauccuaaggaucucuuccugaugauaacuaaaagaccucuuaccccaguuuucauuuguaacauuuucaauuauaguuaguguuauccuuucaugguuucccacaucagccaccauggcuugcucaggcacugcugccucccagcuuguaggcaguggcuaauuccaaguuggcuacauggccuguuuccuacucucuaaacugccugccuuccaaagagggaauugacgagcugaggggaaguucuuacaaacuggagcaagauuacuuugugugaaauacugugccuggccauauaguauuugguguuuuuagauaaauuaacaaguagauaaagaauaaaguaaagaaaggaccagguaaagaggaaauacuguguuuauucagagaagcaagauacugaacagaguagaaaaaccuugggugacauuugcaucugggccuugcuguaaacacgaagauaagucuucaaacagaggaacccaggguguggggaugugagagcuggcauaucauuaaggaauggcaagcagggaggugcugcagacgagaagggcaguggguugacucguuccgugucuuagugcaaagagcagagcuuugaaguagcaacuacugacuguugucuuacuggugaguguaagaggagacaaacuaguuacuguucuguggcagucacagcugugagugaagcuauggucaaguguggaggaguucuauauauuacgccuuccauacccaggucacuauuaccaucccaucugcccuucuucugcuauacuuagcucauuccugaaaggacugcguuuggcuggcuuuguauccuaucaugcuguucagguauaauauuuuuaaucauugucaaugccaucuucuuuugguagaaaaaagagagcguccccaaggugccauuguuguuuagugaugaggaggacagugagguaccaucuggggugaaaccugaggaucugaagguugauaaugccagaguguccccagaaguggggagugcugauguggccagcauagcacagaagguaagcugcaucugugguuuuccaauccauuggggcacauauguaacacuuucccacauuuuccaacacugagaaugcuuuacauaaauaaauauuuuuguagaaaggcuagaaaauacugagcauggcaagaaaauagcccguguucaugcuguuccgggaacccuccuucagguucauagcagaauucuuguacucugugagaugaagagcuccuguuuacugacauucuggaucuuagugucauccggguugcagugcaugccaggucgcagugcugucaggcaguuugucugucugcagagugcuuuucuuucuuuuuuucuuuuuuuuuuuuuuuugagacaggguuucucuguagcccuggcuguccuggaacucacuuuguagaccaggcuggccucgaacucagaaaucugccugccucugccuccugugugcugggauuaaaggcgugcgccaccacgcccagcuugcagaguacuuuucuuccucucauuuccauggugacuugcucuguguuuucgucauuugcuucucugcagcucccguuugucuugcucugugcuccucgcuucugaguuagaggucacauuuaggaggcuagguugccaggcucgcucuucuggucgaugcugacuacaucagagcgaagugaaaugggguuucuucugaacauuagcuuucugcuuugaggguuuguugucucuuuggaggcuuccagcuaauacugccaugugacaggggacucaugucaacaguugcuuucugucucugcagugccacugguuucccucccuccccgugcucuguaggucccgcugcucagguucaguuccucccagggcccgugagaagagcaugccauucacguuucucacagcaguccuuacagcugcagugagacucuguccccgagucacugugaucgucccuccuaguggcugcauguggaccugagucacucucucugucccucagucaggugugaaugccugaggaguagguuugucugcuucucuuuuagucauaagcacugcacauugccuuucacauaguacacaggauuucucacauuauccugcaucuaacgaaacaggcuuuuccauuuggaagcuugggaugcgcucugcaguuuaugguaugauuaacuggaaaucguuuuucuuucuuagugaugcauacaauaguaauuguuuugaccaacaguaucuugccagaauugugauccuauugaguggauuaaucuugcauuuuuaguguuauguuagaaauuguaugugcaugaauaauggaagacuacagagugugaguuugcugguuagauuuuccucugggacucacauauuaaaaguacgaauugggugauccauuucuaaugauugacacuuauuaauguucuaguuuagaauuacuuauuaguaaauaaguaaccugugugcaucaggguuguagcugcccucucacguuguagaaggaagaggggccucuggcuuagcaugacuagaaaaacuaucuuuaacugaggauugucugcacaggcuuccugacggcuguacugcucugucacaggguagucuggguugugauaaaguguguuguauuguguccugugaacaaggcagccacugauuuauugucaagcuugugaagaccccaugggaggauuuugauuucuaguuacuaauuuuuuccuuauuuuuguuuguuuauaggaaggacucuuaccagcaucugaucaggaagcaggugggccuucugauauauuuucuucuucaucuccauuggacaaaggagccaaggguagaaccagaacugugcuuaguuuguuugaugaggaugaggacaaaguagaggaugaaagcagcaccugugcaccacaggacggacgggagaaggugagcaaagaguggugcgugugcaagaggaguacgugugcaagaguaguauguguguggggugucgaugacacaagggauucccuuccaagcagggcacuggugcuggccugaggccugaggaagucugagcuuuuaguauaagucuaaauaauccucuuugguuagauguuugggaauaagucaguagcuugccucucggucucacuugcuucugagauguccagaccuuguuccugggaaacuuggcuguauaugaaagugcgccguaggaaaggggaaacguguauacuuuugucaggcuagccuucagguuagaaguacuagugguagaaggaccuuuaccagguaucagccuuucucugaaguaagggcuauagggaaacugauuuucaggccauaugaguuuucuuguaguuggucaucugccaguggucuuagaucucugugauggucucugcugcacaaagaaccuacacccaucuacaggcacagggauaauaauuagaguauagcuagaaauugaauugguuuaggaaaaugucaguaguagguuuucuuguaggaucuauuguuucucuaguauugggcugggguuauaguaguagacaugcauuuccucauacugagagagccuucaguccauuagacagcuuuuguuugcagccagagucgaaacgccacuauuauaccgauugggaggccuugcugggccaucauuguguuuguaggcuucccgacuaggcaggacuggugauuuuuucccuuucaggggcgugagaggcuuucauuagggaaggagacuuccagggcaguucuagcucaguugcucuaaguaguguguggugcaguauauggugacuccaacaccacgguccuuuuuaccuucauguucuuggagacaaucaaggacaaugacaguaacauguuguuugggugucucuuggaauucccccucucuggucaacagugugaagguuccuaugcuuggaaccuaggcuuuuguuaguuaauuuuugguuuuugcagggaauauuuuucaugcaaugcauauaauucuauuuaaauuauauauacauauauauuuguauaaguauguauuuuuuaguagccuuauaaaauucuguacuugcccguggcuuuucaaacaucuuuaauguuguucacucuccgcccucauuccucacccucccucuguauuccccucacuacuuuugcgacuccgccuuacgcaggccagagugguugagaucacgcagacacugacagcagaugcuagagccgcggggggaggugcagcccucaccgcugccaugggacggcacagugggcagcuacucuggaagugaggguacagaauucccaaagcacuacaaguagaucuacuguaggaucuagcuacagcauucccugcggguguauguccaaggacuugacuuccuauccacugacgcugcucagccguagucacugcugcuccauucucaauagccaaacaauggacaacccuaaaugucuucagcgcauuacugaaucaugagaauguggucuguauauacgacggauuaacacucaguugucacaaaaaauaacaucauaaagucugagugaaugauggaacuggacaguagcguccuaagugagguaaccuagaucuagaauggcaaacacugcaugcuccaguagaugucacugaggcacagagccuugcucggagccugauacuguucagaacccaaacuagacggauacauuuuuuuuuaaagauuuauuuauuuauuuuauguauaugaauacacuguagcuguacagaugguugugagccuucaugugguuguugggaauugaauuuaggaccuuugcucgcuccaguuggccccguucgcuccagcccaaagauuuauuauaaauaaguacacuguagcugucuucagaugcaccagaagagggcaucagaucucauuaugggugguugugagccaccaugugguugcugggaucugaacucagguccuucgaaagagcagucagugcucuuacucacugagccaucuugccagcccguauacaucuuucuaaaauuuuuuauuuuauguguaugaguauuuuguguauacauauaugucugugcaucacaugagugcccagugcccacagaagccagaagagggcauuagaucaucugcgacuggagguacagaugguuguaagucacugugugggggcugggaaucaaauauguuguccucuggaagagccaccaaugcucuuaaccacucuagccugaagaccagauaucuauuaaaacugcagacuaguauuuuccgaaaguagaugauaaaaugcuuaaacaguccugguaaaccuaauuuagggaaguaagaauauaauacugcauaagugggcuuucuccugagaauaaaaggguagcugaccuugaaaaucaguccguguaauauauuaauaaaaugcacauugccaucuugauagaugcagaaaggauauuugaaaaaguccgaaucuaggaggaacaacaguaugaacuaaccaguacccccagagcucccugggacuaaaccacccaucaaagaaaacacauggagggacucguggcucuagcugcauauguagcagaagauggccuaguuggucaucaaugggaggaggggcccuugguccugggacgauucuaugccccaguauaggagaaugccagggccaggaagugggaguggguggguuggggagcagggggagggggagggaauaggggauuuuuggaggggaaacuaggaaaggggauagcauuugaaauguaaauaaagaaaauaucuaauaaaaaacaaaguccaagucacuucauaauuaaaaaaacaguggaaaucaaucaggcaucguaugaaaacaguggaaaucaggcgucguaugaaaacaguggaaaucaggcaucguaugaaaacaguggaaaucaggcaucguaugaaaacaguggaaaucaggcgucguaugaaaacaguggaaaucaggcgucguaugaaaacaguggaaaucaggcaucgugugaaaacaguggaaaucaggcaucguaugaaaacaguggaaaucaggcaucguaugaaaacaguggaaaucaggcgucguaugaaaacaguggaaaucaggcgucguaugaaaacaguggaaaucaggcaucguaugaaaacaguggaaaucaggcaucguaugaaaacaguggaaaucaggcaucguaugaaaacaguggaaaucaggcaucgugugaaaacaguggaaaucaaucaggcaucguaugaaaacaguggaaaucaggcaucguaugaaaacaguggaaaucaggcaucguaugaaaacaguggaaaucaggcaucguaugaaaacaguggaaaucaggcgucguaugaaaacaguggaaaucaggcaucguaugaaaacaguggaaaucaggcgucguaugaaaacaguggaaaucaggcaucguaugaaaacaguggaaaucaggcaucguaugaaaacaguggaaaucaaucaggcaucguaugaaaacaguggaaaucaggcaucgugugaaaacaguggaaaucaggcaucguaugaaaacaguggaaaucaggcaucguaugaaaacaguggaaaucaaucaggcaucguaugaaaacaguggaaaucaggcaucguaugaaaacaguggaaaucaaucaggcaucguaugaaaacaguggaaaucaggcaucgugugaaaacaguggaaaucaggcaucguaugaaaacaguggaaaucaggcaucguaugaaaacaguggaaaucaggcaucgugugaaaacaguggaaaucaggcaucguaugaaauguagaaggaaguagccucaguuuggucagaggaucugggaggccacaggugacaugcuuaaggcugcacacaaaaagcuugccccuugagaucacgugugagacaaggccgcucacucuugccaguacucuagcuuuguacgggaggcucuaagugggguguccauguuagaagcugguucugucagggaauagggaaccuuaaaaugacagaauaucuaagcaacacugcaggauagaaaaucaauauauuaauauauuauagcuuuauauauagucuuuuuuuuugaaguuaccucacauuuacuuauuuuuuuauuagauauuuucuuuauuuacauuucaaauguuauccccuuuccugguuuccccuccgaaaaacacccucccccguucccucccccaucccccugcuaaccuacccacccacuccugcuuucuggcccuggcauucccacacacuggggcauguuuauauagucuuaucugaaaauaaaaguaagaaaucccauuuacagcaucaacaaaaaacuaaaauacuuaggaauaguuauugaaagcauugcaaggaugugagguuuaaagucccauggugcugccuguagugccauggaagccucuagaaaccaggacaccaccaugaggagccacucccugugcaccagagcucggccccaaccacagggcucacuuuuaagagcugagagcgggcucuucagaggacggugaaaaggaagaagaguggagucgccaucgcugcaguuucaagucugaaaggaggggccuugaggagucaugugcuggaggcagccagugggaccugggucacgucccagccgcuuccugcccaaggcaugcgugcauugagaugguucccaguguguugaaaguguguugaaggguguuccuagccauccuugggguauguguggcaggggaucccagugagggguucacgucaguucaucuccccaugugccuccacggcagcuaaugucuguguccuaauauggccccaugagguuuguuucucuuuuuuaagcauugcaagaguuacacacgcaaaaguauggaccgugcaugggccaaugaaaggacuuauucagaacaggcgcuugcagcacaagucugaggaccugaguucuagccucagaacuuguggaaauggagcagagaacugacuguucccuuccuaggcuguccagccuguccuucuugccaaauuguggcucuagguucagugagagccccugucuugaagguggagagugacuggagagugaguaaagacaacugacuguggccuugguuucuccugcacgugugccugugugcacacuacucaagugacugaggggagaagguagacagaguauaugcccauucauuguuuggcuuuuuuugaggggugagugagguacaaggguagauuuuuagauugucaggguuucauaacucuauguugaaaaaaaaaucaaugacuuuuauuguaauuaauuaaaaaaaaaauaaacccuagguuguauguccuguagauugccaaguacuggggcuguaucuguguacugccacgcccagguguguuaggugggugaugggauggugggacuuagguccuuacacuugugcaguaagcaccgccgacugagccaucucccuaguccuccuccuuuuuauaucaagccaaagaaauuguuccuggugauuuuugcauuguucuuccuggaugaaauggagaacucagugugguuuggccuuauucucccaacggccagggugcuucucuuccacuccuuacgaagcuaacgaguaaggaguggguagggugaagguaauagaaaacucagcuacugcaugcagguugaaagauuaugcauauguuaucugaguuuacaaauuuauucaccauuacuuuugauaauucacuuaccaucacuauuuugggaagcuauauaauaucuguugugugaaugucuuuuuccugcuguuugguacauaggcuguggucaaacuucuaccaggggaugucuuuguuguauccauuuuugaucuugucuuuugcccagggucucaaaacugacagccgcccuaagagcacaggagucuuccaggaugaagagcugcuuuucagccacaagcugcagaaggacaacgacccagauguugaucuuuuugcuggcaccaaaaaaaucaggguuagucccacugagucccaggguuaguccccaccgagucccaggguuaguucccacugagucccaggguuaguccccaccgagucccaggguuaguucccacugagucccucgguguuagaggugguguggcucacagcccugugggaauugauugacuuuuggauguguagucugacuguacugucuuucagucgucagugccaaguggugggagccucuucggugaugaugaagaugaugaucucuucagcucugccaagacucagccugugguaccagcuuuuucuucucaggcucagggaguagagggaguccaguuuuaagagagaaaauugccagagacuuguaaggcuuaccaguaaacaagugacagagcauauuuacagcaauauauagauauauaguugcucccaguucauaacacuaacuaaaccagacucugauugugguacagucuucuuugauuuuugaagaguuuauugaaggaccuauguucuaugccuuucagauucaaaccuuuaagucugaguauauuuuuucccuacuguacuagguauaauuuuauccuuuuaauugcagaaaggacuccuguguaaguuacauucauuuuccccucaaagccuuguacuugccaggccuccuucucccacugagcugcaucucaucccuagaaacaccgccgugcuuaggaugguauuucugaaaugcugccuaugaguugguuagccaucauuuuagaauggagcccagaggccaggcuccucuguucauuauuauuuaaaacuugaagaugcaugaucgacuuugguguuuuuuuucuuuugaagguaccagaaaaaaaaggaacacugaaaaaagaccacccuguuucuuuaaagaaccaggacccucuugacucuacucaagguagcaaagaaaaaagcacauggaaaacagaaccagcacagguuaggacugaucuccgugagggcccagcgcuuguuugcuugccucuauagacaaguccauugcacaggcccagaguuacugagaauucuuaguuaaggaggaaauggccaccaacacccccucuuucacuguagucuuuuauccccacuuuucuccacuggagaagccuguucuguauuuaaucaucaccguaucuagaauuugauguaagaugggauaaugaaucgcuuuucacuggcauucccauuucucccuccagacuuccuuggaguagaauuauguucuaauuaguacaaaugacgucugacuucuugguucuuucuaagugcccuaggagaguugguaugugaccucucuucuaguaguccucucugugugauguggggcuucuccacgaaggaagccagacaguugcagguguuucuggauuucacugaggcuuccaugccuguggcuggagaugaggcacuuaguuaaucucuuuugguuguuguuguuguuuuuuguuuuuuugguuuuucgagacaggguuucucuguguagcccuggcuguccuggaacucacucuauagaccaggcuggccuugaacucagaaauccaccugccucugccucccaagugcugggauuaaaagccugugccaccacugcccggaucuuaguuaaucucuuaagucaucuggaagacagaugcuuuuguguuuagaacuugggcauccugauggucguggacgagcacaugugcuuuuugguauuugccauguugaauaacaaguuauguucugacaaagcuacugcucuauucucacucgucaccagugucacccuuuacuccaugguucugucaaauggcagccuucuguccuccaugcuggaggaggcgucagugaagaauugguagcuggcagacacugugagguuccagggcagagcuaaggagcugcagauagggacagcuuuggcccgucagauucacuuacagcugugaguguagcccaagagacagucuguugccuguuuccucaauggauuuuuaauugaauuuaauuucacacaggauucuucaggucugacuccauuuaaaagcagagagccauccagucgcaucgggaaaauacaaguaauuauauuggaucuggagucuucauugccugccuguggcaccuauaaaauuuguggauuuucaguuuuuucagcugcuaccaagcauucucucaucucuucccccgccaacaccauacccuccacccuugccuaguuguugcuucuuaugugcugcucuuuaaugucuuuugaucccagugaugggcacaaguaugugccccacugagccuggaucaggugauuuuucugcacucauauucucuuguauucucuugugucacagaaaugguaaucugcuucuguguuuaagaacaaauacugagucccacuuuucuucuuuaggcaaauuuagcaauuaacccagcagcucugcugccuacaguggcucugcaaaucccaggaacaaagccuguuucauccgaauuagcuuuuccuucaucugaaccuggaaggagccacauccuggaaagugugcccacucuuccugggaguguggaggcuggugugaguuuugaucuuccagcccaggcagacaccuuacacagugcaaacaaggugaucaacugucuuuuguuuguuuuccuuuuagccagacccacccagcugcuuccuucuagacuaguccgcacagcuaauucagccuuauuucccccugaaggaugugugucaucuuccucccuucgaccucucuucaguuucuuaauugugcuccugauuuuccauugccuacuuuuguucuaauuuuccugcugaucauuagauacuugcagucaccauguuaugucccauugaugaccacuggcccuggugcuucucccagaaugcucuagagcaccacacagaccucacuuugcugguuuaaccugcuuacuguagcucgggccucuccucugggaucccaagcaguuccugccagcuuaggaagaggaaagcugcugcagaaggcguccucuguggacuccaaaugaacucuuggacguuuucuauguuagggagguuuuuuucuauccgaucucccuucucucugaagucuuaacagguguucaaguaggcagcagaacccagggugaccuguuccuggacgauaaauuaacuuuuaguuuucagauccauuuucucuauauuaaaaaaaaaacaaaacuauuauuuuuguuagcuuucaagcuuaaauuagcuacuuccuaaacuuguggguuuuuuuuuuuuaaaaaaagguuaucuuuuauuuauucuuggucaaguucauguauugcauauaauguaagguaucuugguuaugucuccccccagcucagguucccacccuuaccacucaaagccuccuaaaaucauauuucuuuaaagcaagcaaacauaauuauguaguccgaaacgugauuuuauauuuuggaauuuaucagaaauauuaaauccuaauuauuaagagauuccucuucugaggagugauaacacacuccacccgcaguuuacacacagccucuaauggugggacuggugucuguugacuuggaagagaagaacaccaucaguugccugucucucaccucgccccuccuugcuccuacauccugauaaaguuggugcuagcagccccuucaguucuuuuuuuuguaagguaccugacuuugaacuaagggccgaggaggugccagguuuguggccuguguuuugagucacagagcaccagcacagcugcuugcugaggcuccagcaacagugagccccuuuacaggaaacuguucucaaaagaauauaaaacaggggugggagguggugcgaauggguugagagagaccacugucugcuucagaggacugggcuucaauuuccagcccccacagggcugcucucaacuuagcuuccaucccaggacauccgaagccuuuuuauggccuucucaggcuuugcaugcacacaguacaggcagaacaccaaugcguaugcaccgaaugucuuuaaaaugaaagcuuaggaaacagagaguacucaaguguaaggagggcuaaguccuggagagauaggaauugccagcuccuuuaggaacaguaacuuaacuuuuucuuuuaggucagguuuucaaccuguggguuuccacccccuucagggucacauaucagauauccugaauauuagauauugcauugagauaaaaguaacuauaguuaugaaguagcaaugaaauaauuuuauacuuuggagucaccaugacauaaggaucuguauuaaaggacuguagcauuaggaagguugaaaaccacuguuauccuaauugagguaaaaccaaacagaaaaguguuuugaauuagagucuuugcuguuagccuugaacacguuuccaucagaucauggaauguguuugccauugcagagucguguuaaagugagaggaaagcggagaccucagacccgugcugcucgacgccuggcugcccaggaguccagugaggcugaggaugugacuguagauagaggaccuguugcucaguugagcaguaguccuguccuaccaaacggccaucaaccucuucugcagcccaggauggccaguggacagaccagcucugagacagccacggccccaccuugggaagguggaccuguuuuaucugcagccgacagaagcuucuuuguaaagucucggccucagacuggaaacgaggcugaccuguuugauucaggggacaucuuucccaagagcagaggaucacaguccguggagggagcaggcgucauggccggggagcccccgucccacucgucaggagggcguaaggagaagagccuggcauuuccugaucucagugagggcagcagcaccgaggaucuuuuccagucugucaagccgagagcagcgaagaacagaaacccuuucccucuccuugaagaugaggaggaucucuuugcagauccgagaggcaaaaagaaugagaggaaaccugacagccaucaagacagugugucaaaaacucaugacaucuuugagguaacacaaauuauuucauguuugggccuuuaaggaaaauagcugauuggcuuuuugaacuauaguuuauguuguguguuuugugcaugccucuuaucuacuuauuaaccacaauucgaucucuuuguuaauaacccuaaaauuuacuugaagugguuuguuucauccagggguaguucuuuauuuuacuuuuuuaaaaaauuuuuuaaaaagauuuauuuauuauuuauuauauguaaguacacuguagcugucuucagacacuccagaagaaggagucagaucucguuacggaugguugugagccaccaugugguugcuggcauuugaacucuggaccuuuggaagagcagucgggugcucuuaccugcugagccaucucaccagccccagggguaguucuugcugccuuuaaucuguuauaaguguuggauuauuuuuaaaaauguuauuguagugcaggggauagagcucaaaacccaguacguguuaggcagaugcuguacggaaccacagcauaagcccugggccuuuuuauuuagcauagcauagcauagcauagcauagcauagcauagcauuagcauagcacuagcauauagcauuagcauagcaccagcauagcauuagcauagcauuagcauagcauuagcauagcauguguacaugauuuucauuauuuuuuguuugcuguuuuaaagaguuuguagaauggugcuguggucagcuuuguuggcaugucauucugugacauguaugaccucucucggcacagcuguguguuuaagcgcugaugcugguugggacccugacuagccgaguuuugacaguaaacuguaguaguuguucagcaggugucuaugagcacaguggucgccgugcagcaggauagccagggcauguguucuguccugacaucucaaggcccgagauccaaacugagcagcagguggugaaggugaucucagauggcaugaaaugucacgacgaacauuauguggggcagaguggcugggugcagugggacgcugcucuccaggccacccucaggaccucacugcagagcugccauuugcagauggcgagggugaguuuugcagagaccugggggagugucuugcaguccucaggggagacugugcuugacagugcauuucuauaaauuauugaacuacuuuaguuuuaaaaaugcguuuauuuacaacaaagaauaaacuguuuuuggacuuaacuaggaugauauauuugcuacggaagcaauuaaaccuuuuccaaaaaagagagagaaggggaggacuuuggagcccaacuuauuugaugauaauauugauaucuucgcugacuuaacuguaaaacccaaagaaaaguccaaaaagaaaguugcagccaaguccauguuugaugaugacacaggugaguguuuaucuagaucacgccacugcuugggggcuguuugcugucagucauguugguccuuuccugcacuuuguuccccaguagguucuccuugcuguuagucuaagcacaugauauguagguggacuagucauuuucaugcggcagccauaggcuaugcugagugaguaucaagguuuaagacggugcucagcacuugaccugaagaagaaauuaacuucugcugucaucugacaacaccaaugacuuucaaaggagagucuaucagaaacuucuuccaugugcuaucagcaggccaugaagcugguugagucaggauucuagcuggacaaugagggacagcagccaagagacuggagggucaguaacagagagcagggcugugccgcgaagucacaagugagacucggcagcucccuggguuccucuguguuucugaacacgcuguacccacuccucagcuaacaagcaagccagaugcugaucugaacacgcuguacccacuccucagcuaacaagcaagccagaugcugauagcuauaaaguuugccuccugauacauccuguguuggucaacccagacugaagcccaaaauacacacguccucucuuugucccuccaggccugggcuuugaguugcagagccacgcugacucugucucccuggcagacuuugggcuccguccucacaugucugucuuuacagcacagaguuacaagagacuugggcugcuuauuuccuuuguucauuuucugacacaugaucuugcuguggcccuggcugccugugcugugcacuccugaucuuagcugggguuacaggcaugacuuucuuucauuauuaaauuguaauacaugcuuauguggcagucauacgauuuagaacauuuuguuaaguggagggauuaaagcuuuaaagcuagccaguguuaaguuugcugugcauccucuaagacugugauuuacauaggaauaguaguaagcaagugcaccuuuucuacuuccagucaguuuaaauguguuugauuucaguguuuugaguaauacugcuuuguguuagccauuagcacauugacaaucuagaucucuaguuugauauagauaaugccauggucuuucauuaugucuuuacguacacaggaugaauuugaugcaguagaacccugcugauaaaauuacgugguaagcagcagagcauagcuaagcugagucugaagcacuaauaugaguggaaccagacuccauucuuaccacugagaugugcgcucugagcgcauccuauauuggauuucuguuuguacauucuuacucuucuuaaaauccagagugaaaagaaggcagaaagagagaaagagcaguuccagguggugaggcccucgcugagguggagaaccgcuccacccuccuguuucugacuucaagugcagacacacuucuguagcuagaaacuuauguucagaaagaacccgauguucguucauauguccuuacaaaaguugggugccaccaacugagccaggcccagaaucuaagagguuugacuucgauguugguggucuuaguguguuauuagaauugggcuuuacaguuugugugcaugugucucaaguucccauuuucuuguuugccugucuuaacaucuuucuuuuuuucuuuuuaaagaugacauuuucuccucuggccuccaggcuaaagcauccaaacccaaaagccaaucugcagaggcagcaucugaacaaagaucugagcacaaaguggccagcauuuuugaugacccccugaaugccuucggaagccaguagagcaugcgcagcaugcggggccuucacaguucacccucccauucuguuuuucacguagugacgugcucuccuaacgcugucuucacgggcuuacaagcagauacucacucacuuccuuuacccaauguagcugauauuuuucugcauugauuuuaauuaugcuuaaaauuacaaauaaaaaauaaacgcuucacagagguuuguucuuacuua

SEQ ID NO: 3318 - RNA, 2439 nt, Mus musculus
guuucuuuuuaaaaaaaauuuucccccaggggaaaaugaccacguuuaauguaaaagguuaagcacuggguuauuuacacgugcauuagaaaagauggcggaggcugagggucuucccgagggacuccgagaagacaguucauaucaaucaaccccauuaaauagaagcuucuguuuccaaacagggccucggugcaccagcaccagcuucagaugaggucagccagguucaugggcaucucgucuaucuggguggaguaguacugcucgaugucccugagaauccggaugucaucauucuucacaaaauugauggccacaccuuuucguccauaccgacccgaucuuccaauucugugaauguacaguucucuguuguugggcaggucauaguuaaugaugagggacaccugagggacauccaggccccgagcccagacgucuguggagaugagcacccggcuggcaccugaccggaacuccuucaugauagacucucguucuuucuggggcaugucuccaugcauggacgacacagugaaauuggcuucucucauuuucucugucagccagucaaccuuccucuuggugaugcagaagaugacggccugggugauggucagcgugucguagagaucacacagaguaucaaacuuccauuccucucuuuccacggccacaaagaacuguuugaugccuuccagagucaacucaucacgcuucaccaggaugcggauggggugggucaugaacuuguuggucaucuccaggaucucaugaggcaguguggcacugaugagaacgaccuguguggcugguggcaaauaccuguacacaucauagaucugcuccuugaaaccuuuguucaacaucucaucagccucauccaaaaccagcaucuugauagcccgugucgguaaacuucuccggcggaucauaucaaagacgcgucccggcgugccugccaccacaugcugcccguaguccagcuuccggauguccuccccgacauuggugcccccaaugcaggcauggcacugcacguucauguaaucccccagagcgagcagacccuucugaaucugcaccgcuaacucucugguuggagccaggaucaaagcuuggguuucucgaaccuggauauccaagcacuggagcacugagauacugaagguggccgucuugccugugccagacugagacugugcaaugacaucucucccuuuaauuaucugcuugauagcacgcugcuggaucgcugaagguuuuucaaaaccguaggcguagaugccgcgcagcagguccucucgcaggcccauggugucgaacgugaggguccuguccaccuccucgcuggucucgaacuccacuuuggucaugcccuccucuuugagcagccgcuuccgcgccgagacagaugucgccauccuggccguggucgccaugauccugauuccgcugaaagaccuuaaaauuuuuuauuuacuuacauuucaaauguaaaccccuucccugguuuccccucugcaacccccuaucccauccuccuuucuucuaugaagcugcucccccacccaccuacccacucccaccuuacugcccuagcauucccauacacuggggcauuaagccuucacaggacgaagggccucccuuccuacugaugccuaauaaggccccuuuagcuccuucaguucuuccccuagcuccuucacuggggucccuggauuaguucgaugcuuggcuucgagagcaucuguauuauugguugagagcuggcagagccucucaggacacagcugugucaggcucaggucagcaagcacuucuuggcaucugcacuagugucugagugugguaucugcaugugggauggauccccaggugaggaacucucuggauggcuucuccuucacucucugcuucauucuuugucccuauauuuccuuuagacaggagcaauucuggguuaaaacguuggagcuggguggguggccccaucccucaagcggggugugugugugugugugggguugccuaaccucuggauauggucucuccagguucgcccuccccucugcaugguauuucagcuaaugucaucccuguaggguccugggaggcucuuguuuucauggcaucugggacuuucugguugcugcccccaacuccccaccccccauugcuacacaccucuguucaauuuccugacccucuguacaucuccucccauaccugauucuuccccucuguauuagucaggguucucuagagucacagaacuuauggauagucucuauauaguaaaagaauuuauugaugacuuacagucugcagcccaauucccaacaaugguucagucacagcacuggugaauaguaguccaaggaucuaguaguuacucagucucacacagcaagcaggcaaagggcaugagca

SEQ ID NO: 3319 - RNA, 3076 nt, Mus musculus
uaaauauauucucauuuaugacugcaauuauuuucaccucuccagcauggucuuccauaacuaguugauaagaaaguagcuaccaaccuccacaaacaagauuuaacauuuacuguccucuuuccaaugauuucuuugaauggauauacaaccugucaggugugacauucauguuagucuaugccuucaggcccaauauaaaauuaauacacuuugugggaugagugugcuauccauguccuauggagugggugacuauuccauagaauaugaguauguucuggauuucuagaugauaacucccucgaguacuagugcagguuuggguuuuaugaauugccucaaagggucuagaauuugccugucagguuucuguaagggagagaauggcuguuaguuuccucagguuuagaaaucucuuuauuucuuaaaaauaaguagucuuaaugauuuuucugugguuugaaauauaaagcaagcauuauuuguuuuauaggucaaagacauacaacucuuggugagacugaucuuuuauuuuuauuuuauuuauuuauuuauuuauuuauuuauuuauuuauuuuuguuuccuaggagaaagauuucgguuugugggaagaaagaacaucuacccagggcaucucuuugcugggagcugcuugcugguaaguguguugcagaagggaggaugugugauugaaauagagguuaguccugacuaagccagcacugagguucugcacagugaaagcugcagaucugggcaaucaagaaacuaaggcaaacuaacuugugacgaguuuucacuggaacguuucacucaaaugcccacccuucccccuugagcaguuacacaccauucugccuucuacugggcaauggcucuuagaaaguuaguuugucuucagugauugacuucaaacacaacgggaucauuuauuaacaauguucacaggaaggggaggaucaugggcaaacuguggaggccagcagaagcagacaugccucaagggugguggaaggcacuggacacugaguuacacacuacauuuuucuucuuugugcuuggacugcuuugccaucuccaucccuagguccacuuaaucucagccacuggauuaucaccaaucucauggaagcaggcauuugagcuccuucugggaagugggaaauaacacauuuggacuuuguuuaaaacccagcuuagagugugacaguaugucuauagcuuuuaauguuaacauuaauacuguuuuaacauuuaguuuuaacauuaauacuguuuccagaggccacagucaucacauaggagggcuucauaucacagguccacagucuagaaacuaccacuauuuucuauaggguggcacuugugauguugugugauacuaauauguuucuuucaucuucaaaacuaugacucucuguuuuauucuuuaucuuaagugagaugauccaaagguaauauuuuaagaauauauaauucuaaacaucaauacaaaaccaaacuauaaauuucacauuuguauuucagaaaugagagaagggaaaaaaucuacaauaaaauauuuuaaaauuagaauaugacuccuuagaauaagggugagcaauuuuuugaacauucucaaaaauugaaaauagguucucuucucauacauuacgucccaaccauaguuuucccucccucaauuccucccagcuccucccagcuccccucuccccuagaccuacucccacuccguuucccuucagaaaaaaagcgggucuccaagagacaaccaccaaacacacaaaacaagauacaguaagacaaagcaaaaacccuccuagugaggcugaacaaggcagcccaauaggagcaaaagaaucccaagaagugagcaaaagagauagagacacuccugaccucacaguaaugaauccaacaacaacaacaacaacaacaacaacaacaacaacaaaaaaaaaaucaagcuaagagccacaacaagcugagaaccuggugcggccgugcagguccugugcuuaggcaagcaacauuuaaaagcagugaccaccauuaaauuauuuauuauuuggugauagcagguuugucuaccagaucaaggagggcugauggcaaaagaaguggagguaaggaugaaggcguggaaugagacaacaguccuggaguuuguccuggagggcuuccuuguggcucagcaccugggcaagguccucuuccucgugcaccugcugguguaucuggccucagucacaggaaauacucucaucaucgccaucacgugguccgauccucgccugcagaccccgauguacuucuuccucaggaguuucuccuuuugcgagugcuguuucaucuccaccguuaucccgaagcuccuggcgaucuuucuuuuuggagacagaacaauucauuucacucccuguaucauccaagcguuuucuuuuuuguuucuuggguccacaauuuucuuccacauggcugugauguccuuggaucgcuaccuagccauuugcaagccucugcgcuacccagccaucaugaaccccagggucuguuuccuucugguuuucuucagcuaugugcuuuccuucauccuaguaaccggugugauucugaggcuuuccaggcugucuuucuguggcuccaaugucauuccccacuucuucugugaccuuggcuccuuaauucaucucuccuguucagacaccaaaucucuugaaagcauggccuucggugucgcugugguuguccuuuucacaucuguccuugcggcuauauuugcauauagcaacauacuaaucucaaucaugcgucuuccauuggccaaggaucgacagaaagcuuucuccaccugcucaucccaccucaucguccucucucugauguauggcagcuguguguuuauauaugugaaaccgaagcaagugagcaggcuugaauccaacagagaggccgcucucguaaacacgguagugacgccgcuucugaauccugucaucuauacucugcgcaacaagcagguccaccaagcucugagggacgcacuauccagggugaacuuacagaaauagu

SEQ ID NO: 3320 - RNA, 3076 nt, Mus musculus
acuauuucuguaaguucacccuggauagugcgucccucagagcuugguggaccugcuuguugcgcagaguauagaugacaggauucagaagcggcgucacuaccguguuuacgagagcggccucucuguuggauucaagccugcucacuugcuucgguuucacauauauaaacacacagcugccauacaucagagagaggacgaugaggugggaugagcagguggagaaagcuuucugucgauccuuggccaauggaagacgcaugauugagauuaguauguugcuauaugcaaauauagccgcaaggacagaugugaaaaggacaaccacagcgacaccgaaggccaugcuuucaagagauuuggugucugaacaggagagaugaauuaaggagccaaggucacagaagaaguggggaaugacauuggagccacagaaagacagccuggaaagccucagaaucacaccgguuacuaggaugaaggaaagcacauagcugaagaaaaccagaaggaaacagacccugggguucaugauggcuggguagcgcagaggcuugcaaauggcuagguagcgauccaaggacaucacagccauguggaagaaaauuguggacccaagaaacaaaaaagaaaacgcuuggaugauacagggagugaaaugaauuguucugucuccaaaaagaaagaucgccaggagcuucgggauaacgguggagaugaaacagcacucgcaaaaggagaaacuccugaggaagaaguacaucggggucugcaggcgaggaucggaccacgugauggcgaugaugagaguauuuccugugacugaggccagauacaccagcaggugcacgaggaagaggaccuugcccaggugcugagccacaaggaagcccuccaggacaaacuccaggacuguugucucauuccacgccuucauccuuaccuccacuucuuuugccaucagcccuccuugaucugguagacaaaccugcuaucaccaaauaauaaauaauuuaaugguggucacugcuuuuaaauguugcuugccuaagcacaggaccugcacggccgcaccagguucucagcuuguuguggcucuuagcuugauuuuuuuuuuguuguuguuguuguuguuguuguuguuguuguuguuggauucauuacugugaggucaggagugucucuaucucuuuugcucacuucuugggauucuuuugcuccuauugggcugccuuguucagccucacuaggaggguuuuugcuuugucuuacuguaucuuguuuuguguguuuggugguugucucuuggagacccgcuuuuuuucugaagggaaacggagugggaguaggucuaggggagaggggagcugggaggagcugggaggaauugagggagggaaaacuaugguugggacguaauguaugagaagagaaccuauuuucaauuuuugagaauguucaaaaaauugcucacccuuauucuaaggagucauauucuaauuuuaaaauauuuuauuguagauuuuuucccuucucucauuucugaaauacaaaugugaaauuuauaguuugguuuuguauugauguuuagaauuauauauucuuaaaauauuaccuuuggaucaucucacuuaagauaaagaauaaaacagagagucauaguuuugaagaugaaagaaacauauuaguaucacacaacaucacaagugccacccuauagaaaauagugguaguuucuagacuguggaccugugauaugaagcccuccuaugugaugacuguggccucuggaaacaguauuaauguuaaaacuaaauguuaaaacaguauuaauguuaacauuaaaagcuauagacauacugucacacucuaagcuggguuuuaaacaaaguccaaauguguuauuucccacuucccagaaggagcucaaaugccugcuuccaugagauuggugauaauccaguggcugagauuaaguggaccuagggauggagauggcaaagcaguccaagcacaaagaagaaaaauguaguguguaacucaguguccagugccuuccaccacccuugaggcaugucugcuucugcuggccuccacaguuugcccaugauccuccccuuccugugaacauuguuaauaaaugaucccguuguguuugaagucaaucacugaagacaaacuaacuuucuaagagccauugcccaguagaaggcagaaugguguguaacugcucaagggggaagggugggcauuugagugaaacguuccagugaaaacucgucacaaguuaguuugccuuaguuucuugauugcccagaucugcagcuuucacugugcagaaccucagugcuggcuuagucaggacuaaccucuauuucaaucacacauccucccuucugcaacacacuuaccagcaagcagcucccagcaaagagaugcccuggguagauguucuuucuucccacaaaccgaaaucuuucuccuaggaaacaaaaauaaauaaauaaauaaauaaauaaauaaauaaauaaaauaaaaauaaaagaucagucucaccaagaguuguaugucuuugaccuauaaaacaaauaaugcuugcuuuauauuucaaaccacagaaaaaucauuaagacuacuuauuuuuaagaaauaaagagauuucuaaaccugaggaaacuaacagccauucucucccuuacagaaaccugacaggcaaauucuagacccuuugaggcaauucauaaaacccaaaccugcacuaguacucgagggaguuaucaucuagaaauccagaacauacucauauucuauggaauagucacccacuccauaggacauggauagcacacucaucccacaaaguguauuaauuuuauauugggccugaaggcauagacuaacaugaaugucacaccugacagguuguauauccauucaaagaaaucauuggaaagaggacaguaaauguuaaaucuuguuuguggagguugguagcuacuuucuuaucaacuaguuauggaagaccaugcuggagaggugaaaauaauugcagucauaaaugagaauauauuua

SEQ ID NO: 3321 - RNA, 12836 nt, Mus musculus
ugguuuucgccucuaaagcgcccagcgcucgccucccgcugccgcacuuucacucucgguccaccucgguguccucuugcuguccagcucugcagccuccggcgcgcccucccgcccacgccauggacgccaaggucgucgccgugcuggcccuggugcuggccgcgcucugcaucagugacggugagugcaauccgcggccgggcccgggaaaggcucgcagcucugcgccggagcuccuucggguccgcgguuccucugcccgcgccgaagucgcggagaaagaacucggucggcgccguucacuacaagcgaacuuggggcaguccacuuugcagggcgcacucccaccgggugcccuuucccgugucccacgggucgcaccgagguuuugugcucugcgaagugcggccauaggaccuagagagggcugcaggggaggacccgcaggauuguugggcaagaguggguucggcgcggaauggaagcgugggcgauuguguccggggcuugggccccggagcgcgccagcugcacucagcuagugucuaccggcgcccagauguuuccagaggcgaagggcagcgcggucccggaguugaccgugcaagagguucacucggguggugcgugugucagcaaacucucaaagaccggucaaguagcucgaagugcauggcuuggcuauagguucaguggugaggcugaguuucguccccugcggguguagcguguucucuuacagcacccucgaggggcucagggccaccagcagcgcagcgcagcucuugaacucgcgcugccagccagggccgcgcuucugcacaguucguugguccguagcgacgcggaccugagcacgcgucucuucacugccccuuuuucuucuuacccgggucacuagacaaaggcucagcaguuacccaagcuauaugcacaccucuccccaacccccaaacacaccugcaaacgggcgcuuuuguagccagccccggaguccucagcucuggaaugagagcugcagcggaguucagucucccagacccaggguggugucuucuuucacugggaaagggcuuucauuuuguuuucuuuuuuugacacugaagagaaaacucucagcgcuguuacaagacaccguugcugcaaaacaaaacaaaccauugccucugaacacaaaacaaaauccuacuagucgauccccugccuuccuccgcagugguguuuccuggagagaacugagggacagucggggcucuuggugagacugagcucuaaaugcugcccaaguacaccaacucguucguuuggguucuuucccugugacaacgggguacgggaaugguuggaguugccuaguccgagggaaauguucuguaaaagaauagucaguugcugaucggaguaguaaaaaaaaagaaaugaaaggcaguuucgauuuuuuuuuuuuuuuuuuuuuuuuuuuuuguuaccgagaacacccgggaggcugagccuucccacuggucccccagugccccgucauggagcacauugauuugggcauuaauaauugaaugagcuggugauguugcaagggucacagccucuggcaaguuagguauggggcaagaauguaggacucagguccucaagguuggagugcaauuauccagaguaaaaguugucucacccucaacauauucugacccuaggaagagucggauuguugacagugucuggaucagaccuguucucuaggcaggaccccauugugcugcccgaaugaacuuuuuuaccuccuagugccugugugcccucugaucuuacacagcccucaaguugcagcacggcuaaccuugcugugguuccugucuuuucccaucagcuacuccaacucagaagcuagauaguagacaccggaggcuucuuugguuaaacccagagcagcaggcuugccaggcuuguuagauugaauggaccccugguucccuaagccaagcucucuagauucccaaguccaggguggcagcagagcuggauuagacuuuggucuguaccugaagucugguuuuccuaugcuuuagagucuaaagacacuacccuuccuggggcaugcaucccuuagcuaaauaaugcuugcagaagaagauaaucccaucauauauuuaauucgguccacuucuccagcugcuucccaaaggcagugaacuucagaauacccagaagucuccuggaacucuaaauaagcaaacuuaaaauccuggggcuaacuauucucagucauacuuuuaaacuuuggugaaaagacccauaaauugaaacauuuggggaugcucaguagagcuaggauaaaacccuguuguugggggagcagcuacaaauccagcaguccucaggguuugcaauucuagacuuaaagggugguucuuaaggggggguucuaaaggagccccuugcuaauuuacacuaaugagugucaauuauagcauuuugcaaauuggugaauuggcaaacaaagcugguaauaggauccaggaggccuaggcauccagguagugaccauaaaagccacgguugaccccagcuuuugggaaaagcuggauagaagguaaauccggguccuccccucuggauucuuuugugauuuccagggcuuaggauagggugagugggaggagggaaaacugcaggugguagaagugaagccccccaccuccaggccugcaccagagggccacaagggagcccagaacucugccaccccacuucuccuggguccuuuuguccuuuagaggcugagcccagucagaucucacugugaucccuggccgaggggauggucuuugcaagaaacuuucuguaaccauuccugcugauguuccugagucuuccccacaagagccaccaaacccccugcaccaggcagauaaugacuggccccacuuuucucucuacaccuccucuagguaaaccagucagccugagcuaccgaugccccugccgguucuucgagagccacaucgccagagccaacgucaagcaucugaaaauccucaacacuccaaacugugcccuucagauuguguaaguccuagccgccaucccccaaagaggagcaugguauagaagccucggacuuggcauaacuaggggcagcuguuaccaccaccaccacggggacacugauaugccaucagacauggguuucaaaggauacuuuuguuccccagagcccugauguccucaguguuucucacucuugcuuuccaagcuguuucuugcagcacagugggccgccucucuacagaaaaagccauggacuugauggaggucagcccucagcugacaguugggucugucuugucaguuucaagguucugguguccaaaguuaauccuuucucacauagaaaaaaaaauuacaagacccggauggcacgggggggggggggguucaguuuuacucacuugcacucacuugcucagaggucauuuuuguuuuagaguuuuagaguuugcuggagugugaugguagcugccaguauuugauuuaaauuuaccugggaaauaagaaaagcccaaaaaagguauaaaugaugugaauaucucacucagagucugguagacuuggcagagauguguccugugcuagucuguccugcucacugccccccagcagggguucccauccucgggagacucaacacuaacaacaguauaaggaugcagcagcuggagcaaugcuagccugacggcuuugucacccaacggugacugcuucagacuuucugugcucaucagccuuccucuccagccuccgcugcuguguuauguacaguaggcuuuagagaccuagaugaugaauauuauuuuugcuguuuugauuaaaauacaauacucucccgagaaagggauuuuaaagaugaugaguuuacguuugaauaggcugugcuggugcacugucccgggaagggcccuugaacuuagagggucaaauacaacuauugauucugggugaucacuaaguuaauaaauggcaggauccagacugacaccccugaucccuguugaaguuacaucccucugaacgacuggucaacugcagggcagccugcuugaagaggguuaccugucccuaggacacugaacaggcauuuguuuuuccuagaagacaguucaccagcuggagaggagucgucucccguaguuucuguuugguugcuuuugguuuuuguuugguuuugguuuuuuaauuaucuggcauccaggacuugauggaaaauaaccagagcuaagcucaccgguucaucugcccauuaggaaguucuagggaugggagaaagaacacggcgucaauuaacaaauccacaaagcuaagaccuugaagcauucugugaacuuguaaacgcgcucaggcaaccauuggacaauuugucuagacugcuccuugcccaccugaacugcccuguuccuccccuucuggacuccugccgucuuccuccagagcuaccuuuaagguugucccauguacuaucaaggugcucugucaaaaguucuuaggcugcuucuggcacucuccagaauuuuccaagaccucccccccaccaugauaucagucauccgcgccuucugggugguucuuccuccacacccuuugggcacuuugacuccugugggauauucguccuuccuuuuccuuuagcuuuccucacuugccaagcuccaacuuggccagaagcucaaaugccuccacuguggucucuucucuguguccccugggagacauccuuagcacgucccuaacucugcggugguggucccaacacgauucaagugcuaugucuuccaaaacugaagcuuccgggagcagcagcugggcccugcagugaggaccuuuagcuggguguguugggugagcccacaggaucgcuuucucccgcuuggcuguacagcgucucuccccuuguguuuuggcagugcacggcugaagaacaacaacagacaagugugcauugacccgaaauuaaaguggauccaagaguaccuggagaaagcuuuaaacaaguaagcacaacagcccaaaggacuuuccaguagacccccgaggaaggcugacauccgugggagaugcaagggcagugguggggaggagggccugaacccuggccaggauggccggcgggacagcacugacuggggucaugcuaagguuugccagcauaaagacacuccgccauagcauaugguacgauauugcagcuuauauucaucccugcccucgcccgugcacaauggagcuuuuauaacugggguuuuucuaaggaauuguauuacccuaaccaguuagcuucauccccauucuccucauccucaucuucauuuuaaaaagcagugauuacuucaagggcuguauucaguuugcuuuggagcuucucuuugcccuggggccucugggcacaguuauagacgguggcuuugcagggagcccuagagagaaaccuuccaccagagcagaguccgaggaacgcugcagggcuuguccugcagggggcgcuccucgacagaugccuuguccugagucaacacaagauccggcagagggaggcuccuuuauccaguucagugccagggucgggaagcuuccuuuagaagugaucccugaagcugugcucagagacccuuuccuagccguuccugcucucugcuugccuccaaacgcaugcuucaucugacuuccgcuucucaccucuguagccugacggaccaaugcugcaauggaagggaggagagugauguggggugcccccucccucucuucccuuugcuuuccucucacuugggcccuuugugagauuuuucuuuggccuccuguagaauggagccagaccauccuggauaaugugagaacaugccuagauuuacccacaaaacacaagucugagaauuaaucauaaacggaaguuuaaaugaggauuuggacuuugguaauugucccugaguccuauauauuucaacaguggcucuaugggcucugaucgaauaucagugaugaaaauaauaauaauaauaauaauaacgaauaagccagaaucuugccaugaagccacaguggggauucuggguuccaaucagaaauggagacaagauaaaacuugcauacauucuuaugaucacagacggcccuggugguuuuugguaacuauuuacaaggcauuuuuuuacauauauuuuugugcacuuuuuauguuucuuuggaagacaaauguauuucagaauauauuuguagucaauucauauauuugaaguggagccauaguaaugccaguagauaucucuaugaucuugagcuacuggcaacuuguaaagaaauauauaugacauauaaauguauuguagcuuuccggugucagccacgguguauuuuuccacuuggaaugaaauuguaucaacugugacauuauaugcacuagcaauaaaaugcuaauuguuucaugcuguaaaccuccuaccguaugugggaauuuauuuaccugaaauaaaaucuacuaguuguuagauggagugcacauacauuucugaagauggagaaaaacaggugugccugcugaucaggugcugugggcugcccugcaguccuggugagcgacagacacugaggcaggcuugucucaugaacaggcugccucugcagugaaaguuuuuguguauuuuuuuuaacccaagcuaguuuucuaaugaauaauacuugacucacuaauuuccccuccuccuccuucuccucaguucuccuaacauccucaugugauccccagacucaacuccaguaauaucaagcuuuccuauuuucccauguaaaaaaaucccaugacucugggccauguuaauaucaggcuuuugugggaacagguggccucaccccauaaaucauuaaauaccauucagcuugaaucauuuuaaugugacagucacaaaccaguugcucuaauaaaaacucugcuaaccauccuucuccuuagcucucuagaacaaucucaguuaucccuagggaugcuccccagcauccagaaaagagaagugggaucaaucauccugccuuucucccccuccucucuuggagggcugccugagcccguggccuccaccuccccugcuuuguauaauuugaaaugcagauuuguagugaaggcagaguucaccucugcauugaaagggaaggcaggcccagagcuuccuucccugcccucugagaugugcauuuaugucucaggauggaugagcuuugguaggaaugcucaaaaccaggaccagccagacaaacuggcagucccuguaagcgguucccgggucauaggguuagggcaccccuguuuaacuuugggguggggaaaguaucugguuuucuuugauaaauugcuugugaaccacauuugccaaguggccuccaggccucaaacucaaagaccgagcuaaaucgacucggaaggcaaugcugaaugaagauugugggaacugagauagauacacuccucuauguugcaaugugauuaaugguucuacuaauuuuaucuaagggggcgcagagaagaaaaaguggggaaaaaagaaaagauaggaaaaaagaagcgacagaagaagagaaaggcugcccagaaaaggaaaaacuaguuccccgcuuccugccgauggaccgcagugcgcucugcucuggcgcuuuguaacucgcuccucccucuucgggggcagaccccacacuccgggcaggugcucaaaccugacgguaaacucuucccucuucgggggcagaccccauaccccggggcgggugcuuaggcuuuccugcccugguggccacaccagcugcuguauuuaugugcuucauaaggcccugcucugucugcuaaagcuaugaagaaagaugugcagagacugggguggagacuaagccaaagaggagcugccuagccuggcagcauugccccgagcugagcccccuuggccaggacuucacaaggcucacaccuacaaucccaugaaggccaggguggucugcuuagccaggaaagggcaagugccuuccccucggccacacugccccuuguggccuucucgggacaugugguaacugacuugcucucaggcccacccgcagcuuuuccaaauaccugcagccuucagcccugcugcccugccugugggagcagcuuugacuccaguccagaaggguuucugcagacuguguugggugagacgcagaaaggaugaaaucucagaacacaugucagcugcuucucaggaaaucuuuucuuuggacaauucacuuuagagucuuuaaacgggucucucguggggaggauagaugugcucuggaacuuucugaaggaccagcagcuucagggacucuuagucuguccuuccccacuuuuggucccaacaucccugggauggugugcugucugggcaccacggucuccauccucacuccugagagauuucugccuucugugaguuggguuaaagcucuggaauuaucuacuaucccaauccacuacccucaccuggcaauauuugucuguuuuuguuuguuuguuuguuuguuuuugucuuuugccaguuugaauuagaaggcaaggcucugauuuuaguaguguuuuggaaaaggacuuuuuucuucaccuuccucuuugccucauguguacacacacacacacaucuuguaccccagaccucuggguauaauuuucauaauuggugcagaaagaagaaaugaucugaagauguguuaaauggauugcaggggaaggaaggcccagggcccugugugucaugcccucuuggguuccuaaguucuauguuccuuagagguucuagcauuaaacagauaaagcccuucaugguccuggcugaggaagagucuugcuagggggauucagggaagacccguguuaccagcucuuacccuuuaucuggacagcucuccuacccuguaucuucuccucagaucugaggauagcaggcuggacuauuggugggcaccuuucaagcccagggcuacuguuuguccuguggcagccggcuacagucucgucugaguggccucaucuggacccuuccuguuauuaauaaaacgcuucuggaggccagaucugugcucaagccauaguucugcuuagaaagggaugccccacccuuaccggacacugggaagaacuguuggccccuagaaaccaaaggccaaacugaggcugcccugaguuggaagaccacuuucugaaaugcccauggacucugccucccaaccauucgucucucacuccuagcagagcugucugugcagacuguuucuuaggaggcacagcaagcuccagggaacccucugugcuuaugaagcucgucuggugggcaaccccagcccacuggacagaguccucauggaaaugccugggaagcugauuucaucuaaggauggguugaaguaggaugugcuccugcgacuucucaggcaggugagagggguaguccuuacacugucuagcauaaacgccuuccggaaggaccugcagcuccagagaccaccuccugagcaccaagaccucuucuggugguguggaaccagccaagagauuucaaggaagagugauuauuugaugaaugcuaugggaauggccucuucucuuggaguucugaggccuggggaugcccaggaacacugggcaccugcugcuguuagggccaaugcauagucucagcaccgguguccuaagguuaaggcggugcgccuugucaugugcuccuuguaccaugccaucugugccagugugugucugccucacccugugcuugacauguucacccaucuucucugcuucccgccaccauccagauccucagcggccgccccggcugugcccuucccugcucucccgcucucucaggccucggaaggaagaucgguggcugcgagcugaacuaaggaguagggccuguggcucagcgcuaggccacgcacgcagcaucccaggcauguggugagaaacugccuuaaugugucuccucuguucuugucaacaggaggcucaagaugugagaggugugagucagacgcccgaggaacuuacaggaggagccuaggucugaagucaguguuagggaagggcccauagccacuuccucugcuccugagcagggcugaagccguuugcaagggacuugcuuugcacaguuuugcuguacuuucacauuuuauuauguagcaagauacauggugauuuuuuuuuuuuucauuuagccugauuuuccaacgucauuggugacaggccaaggccacuauguuauuuccuuuguucugguauccuucccuuggaggaccuucucugaguaguggcuccccagguuuguccuuugagcugaggcaggaggcucacccauucuucugaauaggaacuggguguucccaccccccaaggacugcagggcuuucccaagcugaggcaggaacgugaggccagggaagagugagcuucacccucaucccacgcuguccuccucaacccaccaugcucaucauucugucucauccauccauccauccauccauucaucgccauguguccgcaagacugucuccaugacccugaaaaaggacucucgagaugaaauccuuuauucaaaugggacagcaagaaggaaaagccaaugucuggugucucuccccccgccccuacccugcgcgcaucuaugucuuguuuggaauauugucucuucaacccccuguucauguccuucucacucaugaucgaugucuugucugugcacugucucuaacccaaaugcaaaggcugagugugaggugauggccccgagguccagguuguagucauggaaagagcccugcugucucccuucucagggggcccauuuuagacacacaaagcccaaagaaaggugguuugcaacagugcuuagcucgagccuccauauuuccauaacuguuagcuuaaaacugugggguuuuaccuuccuggaaccaaaugcauucuucuguugaggaguaacaggucucaauucuuuucaauuaauuuuaaaagucaaucacuaagagcaucggcuuugggcccugaugggcaggcauuucccuggaaagggggugaacuaccuaccucuccucaagacagccgaagggugggauuggugccgcucugggaagcguggccccaggaguuuuguccucugcaguuuuuaaugcaaguucacugccacuuugacaaaagcccaauuagaagccagucucuaguuccuuaaacaaaacagacagaguaaggaaaggaaggaggguggcagccagcuggcuggacacucgagaaagacggggaaguaagcuacagaaagauagucuucaaaaacagguguuugagagugaauacucuguagaauuguuaguggggugugugugguggugguggggggauuucuacaaaauaguccuuuaaguugaguuuacagcagaugaaaaauccaaccagcaaaauuuugaucaaauuugaacaaaaacccaaaaaccuaaaacuguugagcagguugcgaugaggagcacagggcuagcugcagagcuggauccucaggaggauagcgaauuauuuucaacccuggaauagaaaccacacacuggcuugcugugcaccagccacuuugcaucuaauccaagcuuugaaggguguugcuugggaggaaacaaauacagccuuccaucuucacuccaguuagggauccuuucaaagucuccuucacagugaggaaaaagagaaggguagaaacuuuagggagccggauuuguguaucaauuccuccgcugacagucaguuucuagauggagacagccugcuuaaagcaaauccgaauuuaaauaggacauuuacaucggaaaagucucucccuaccuuaaucccccauucucuugcuuucaaaauacaagcacagcaguccuugaauggcuguugacccagggcaccuagcugucccugcugguccuggggcugccagaauucccuugggcgccaagcaaccugccagguagccagucccucuguuacaagccuuugcaucuggauagggaaagggguggagacauacagucugcuuuguguugaaacccagauuuguacccuguguuuauacacugcugcuggcucccgaggacagugggacuuuagcaaggaagugcagccgagggguaaagagcccucugguucauugccugaucggcuuugagagaggguuuggagggcaaggggcugcauuccucugagggacuuggccugaggccuuucgggccucuccaguggguucuguuuauccucucaugggugauuaucucaguggugucaccaggggcuuccucccagaagucagucauccccaggccgugcacccuuuucagcuggaugagagccagggaugcauucucuccaaacagcuacccuggcccauuuuaagguaaucucauucuucaaaauguuccauagaauccuccaaauucccccagcagacuucuacccucgccaaguucccaaaacccacucagcaaaguugccaaccucgacgggcuagcagugucuaagcagcgauggguucaguguuguguguggugaauacuguauuuuguuucaguucugucucccagauaaugugaaaacgguccaggagaaggcagcuuccuauaugcagcgugugcuuucuuauucuuauuuuuaauauaugacaguuauuugagaagccauuucuacuuugaagucauuaucgaugaaagugauguaucuucaccuaccauuuuccuaauaaaguucuguauucaaauauagc

SEQ ID NO: 3322 - RNA, 12836 nt, Mus musculus
gcuauauuugaauacagaacuuuauuaggaaaaugguaggugaagauacaucacuuucaucgauaaugacuucaaaguagaaauggcuucucaaauaacugucauauauuaaaaauaagaauaagaaagcacacgcugcauauaggaagcugccuucuccuggaccguuuucacauuaucugggagacagaacugaaacaaaauacaguauucaccacacacaacacugaacccaucgcugcuuagacacugcuagcccgucgagguuggcaacuuugcugaguggguuuugggaacuuggcgaggguagaagucugcugggggaauuuggaggauucuauggaacauuuugaagaaugagauuaccuuaaaaugggccaggguagcuguuuggagagaaugcaucccuggcucucauccagcugaaaagggugcacggccuggggaugacugacuucugggaggaagccccuggugacaccacugagauaaucacccaugagaggauaaacagaacccacuggagaggcccgaaaggccucaggccaagucccucagaggaaugcagccccuugcccuccaaacccucucucaaagccgaucaggcaaugaaccagagggcucuuuaccccucggcugcacuuccuugcuaaagucccacuguccucgggagccagcagcaguguauaaacacaggguacaaaucuggguuucaacacaaagcagacuguaugucuccaccccuuucccuauccagaugcaaaggcuuguaacagagggacuggcuaccuggcagguugcuuggcgcccaagggaauucuggcagccccaggaccagcagggacagcuaggugcccugggucaacagccauucaaggacugcugugcuuguauuuugaaagcaagagaaugggggauuaagguagggagagacuuuuccgauguaaauguccuauuuaaauucggauuugcuuuaagcaggcugucuccaucuagaaacugacugucagcggaggaauugauacacaaauccggcucccuaaaguuucuacccuucucuuuuuccucacugugaaggagacuuugaaaggaucccuaacuggagugaagauggaaggcuguauuuguuuccucccaagcaacacccuucaaagcuuggauuagaugcaaaguggcuggugcacagcaagccagugugugguuucuauuccaggguugaaaauaauucgcuauccuccugaggauccagcucugcagcuagcccugugcuccucaucgcaaccugcucaacaguuuuagguuuuuggguuuuuguucaaauuugaucaaaauuuugcugguuggauuuuucaucugcuguaaacucaacuuaaaggacuauuuuguagaaauccccccaccaccaccacacacaccccacuaacaauucuacagaguauucacucucaaacaccuguuuuugaagacuaucuuucuguagcuuacuuccccgucuuucucgaguguccagccagcuggcugccacccuccuuccuuuccuuacucugucuguuuuguuuaaggaacuagagacuggcuucuaauugggcuuuugucaaaguggcagugaacuugcauuaaaaacugcagaggacaaaacuccuggggccacgcuucccagagcggcaccaaucccacccuucggcugucuugaggagagguagguaguucacccccuuuccagggaaaugccugcccaucagggcccaaagccgaugcucuuagugauugacuuuuaaaauuaauugaaaagaauugagaccuguuacuccucaacagaagaaugcauuugguuccaggaagguaaaaccccacaguuuuaagcuaacaguuauggaaauauggaggcucgagcuaagcacuguugcaaaccaccuuucuuugggcuuugugugucuaaaaugggcccccugagaagggagacagcagggcucuuuccaugacuacaaccuggaccucggggccaucaccucacacucagccuuugcauuuggguuagagacagugcacagacaagacaucgaucaugagugagaaggacaugaacaggggguugaagagacaauauuccaaacaagacauagaugcgcgcaggguaggggcggggggagagacaccagacauuggcuuuuccuucuugcugucccauuugaauaaaggauuucaucucgagaguccuuuuucagggucauggagacagucuugcggacacauggcgaugaauggauggauggauggauggaugagacagaaugaugagcaugguggguugaggaggacagcgugggaugagggugaagcucacucuucccuggccucacguuccugccucagcuugggaaagcccugcaguccuuggggggugggaacacccaguuccuauucagaagaaugggugagccuccugccucagcucaaaggacaaaccuggggagccacuacucagagaagguccuccaagggaaggauaccagaacaaaggaaauaacauaguggccuuggccugucaccaaugacguuggaaaaucaggcuaaaugaaaaaaaaaaaaaucaccauguaucuugcuacauaauaaaaugugaaaguacagcaaaacugugcaaagcaagucccuugcaaacggcuucagcccugcucaggagcagaggaaguggcuaugggcccuucccuaacacugacuucagaccuaggcuccuccuguaaguuccucgggcgucugacucacaccucucacaucuugagccuccuguugacaagaacagaggagacacauuaaggcaguuucucaccacaugccugggaugcugcgugcguggccuagcgcugagccacaggcccuacuccuuaguucagcucgcagccaccgaucuuccuuccgaggccugagagagcgggagagcagggaagggcacagccggggcggccgcugaggaucuggaugguggcgggaagcagagaagaugggugaacaugucaagcacagggugaggcagacacacacuggcacagauggcaugguacaaggagcacaugacaaggcgcaccgccuuaaccuuaggacaccggugcugagacuaugcauuggcccuaacagcagcaggugcccaguguuccugggcauccccaggccucagaacuccaagagaagaggccauucccauagcauucaucaaauaaucacucuuccuugaaaucucuuggcugguuccacaccaccagaagaggucuuggugcucaggagguggucucuggagcugcagguccuuccggaaggcguuuaugcuagacaguguaaggacuaccccucucaccugccugagaagucgcaggagcacauccuacuucaacccauccuuagaugaaaucagcuucccaggcauuuccaugaggacucuguccagugggcugggguugcccaccagacgagcuucauaagcacagaggguucccuggagcuugcugugccuccuaagaaacagucugcacagacagcucugcuaggagugagagacgaaugguugggaggcagaguccaugggcauuucagaaaguggucuuccaacucagggcagccucaguuuggccuuugguuucuaggggccaacaguucuucccaguguccgguaaggguggggcaucccuuucuaagcagaacuauggcuugagcacagaucuggccuccagaagcguuuuauuaauaacaggaaggguccagaugaggccacucagacgagacuguagccggcugccacaggacaaacaguagcccugggcuugaaaggugcccaccaauaguccagccugcuauccucagaucugaggagaagauacaggguaggagagcuguccagauaaaggguaagagcugguaacacgggucuucccugaaucccccuagcaagacucuuccucagccaggaccaugaagggcuuuaucuguuuaaugcuagaaccucuaaggaacauagaacuuaggaacccaagagggcaugacacacagggcccugggccuuccuuccccugcaauccauuuaacacaucuucagaucauuucuucuuucugcaccaauuaugaaaauuauacccagaggucugggguacaagauguguguguguguguacacaugaggcaaagaggaaggugaagaaaaaaguccuuuuccaaaacacuacuaaaaucagagccuugccuucuaauucaaacuggcaaaagacaaaaacaaacaaacaaacaaacaaaaacagacaaauauugccaggugaggguaguggauugggauaguagauaauuccagagcuuuaacccaacucacagaaggcagaaaucucucaggagugaggauggagaccguggugcccagacagcacaccaucccagggauguugggaccaaaaguggggaaggacagacuaagagucccugaagcugcugguccuucagaaaguuccagagcacaucuauccuccccacgagagacccguuuaaagacucuaaagugaauuguccaaagaaaagauuuccugagaagcagcugacauguguucugagauuucauccuuucugcgucucacccaacacagucugcagaaacccuucuggacuggagucaaagcugcucccacaggcagggcagcagggcugaaggcugcagguauuuggaaaagcugcgggugggccugagagcaagucaguuaccacaugucccgagaaggccacaaggggcaguguggccgaggggaaggcacuugcccuuuccuggcuaagcagaccacccuggccuucaugggauuguaggugugagccuugugaaguccuggccaagggggcucagcucggggcaaugcugccaggcuaggcagcuccucuuuggcuuagucuccaccccagucucugcacaucuuucuucauagcuuuagcagacagagcagggccuuaugaagcacauaaauacagcagcugguguggccaccagggcaggaaagccuaagcacccgccccgggguauggggucugcccccgaagagggaagaguuuaccgucagguuugagcaccugcccggaguguggggucugcccccgaagagggaggagcgaguuacaaagcgccagagcagagcgcacugcgguccaucggcaggaagcggggaacuaguuuuuccuuuucugggcagccuuucucuucuucugucgcuucuuuuuuccuaucuuuucuuuuuuccccacuuuuucuucucugcgcccccuuagauaaaauuaguagaaccauuaaucacauugcaacauagaggaguguaucuaucucaguucccacaaucuucauucagcauugccuuccgagucgauuuagcucggucuuugaguuugaggccuggaggccacuuggcaaaugugguucacaagcaauuuaucaaagaaaaccagauacuuuccccaccccaaaguuaaacaggggugcccuaacccuaugacccgggaaccgcuuacagggacugccaguuugucuggcugguccugguuuugagcauuccuaccaaagcucauccauccugagacauaaaugcacaucucagagggcagggaaggaagcucugggccugccuucccuuucaaugcagaggugaacucugccuucacuacaaaucugcauuucaaauuauacaaagcaggggagguggaggccacgggcucaggcagcccuccaagagaggagggggagaaaggcaggaugauugaucccacuucucuuuucuggaugcuggggagcaucccuagggauaacugagauuguucuagagagcuaaggagaaggaugguuagcagaguuuuuauuagagcaacugguuugugacugucacauuaaaaugauucaagcugaaugguauuuaaugauuuauggggugaggccaccuguucccacaaaagccugauauuaacauggcccagagucaugggauuuuuuuacaugggaaaauaggaaagcuugauauuacuggaguugagucuggggaucacaugaggauguuaggagaacugaggagaaggaggaggaggggaaauuagugagucaaguauuauucauuagaaaacuagcuuggguuaaaaaaaauacacaaaaacuuucacugcagaggcagccuguucaugagacaagccugccucagugucugucgcucaccaggacugcagggcagcccacagcaccugaucagcaggcacaccuguuuuucuccaucuucagaaauguaugugcacuccaucuaacaacuaguagauuuuauuucagguaaauaaauucccacauacgguaggagguuuacagcaugaaacaauuagcauuuuauugcuagugcauauaaugucacaguugauacaauuucauuccaaguggaaaaauacaccguggcugacaccggaaagcuacaauacauuuauaugucauauauauuucuuuacaaguugccaguagcucaagaucauagagauaucuacuggcauuacuauggcuccacuucaaauauaugaauugacuacaaauauauucugaaauacauuugucuuccaaagaaacauaaaaagugcacaaaaauauauguaaaaaaaugccuuguaaauaguuaccaaaaaccaccagggccgucugugaucauaagaauguaugcaaguuuuaucuugucuccauuucugauuggaacccagaauccccacuguggcuucauggcaagauucuggcuuauucguuauuauuauuauuauuauuauuuucaucacugauauucgaucagagcccauagagccacuguugaaauauauaggacucagggacaauuaccaaaguccaaauccucauuuaaacuuccguuuaugauuaauucucagacuuguguuuuguggguaaaucuaggcauguucucacauuauccaggauggucuggcuccauucuacaggaggccaaagaaaaaucucacaaagggcccaagugagaggaaagcaaagggaagagagggagggggcaccccacaucacucuccucccuuccauugcagcauugguccgucaggcuacagaggugagaagcggaagucagaugaagcaugcguuuggaggcaagcagagagcaggaacggcuaggaaagggucucugagcacagcuucagggaucacuucuaaaggaagcuucccgacccuggcacugaacuggauaaaggagccucccucugccggaucuuguguugacucaggacaaggcaucugucgaggagcgcccccugcaggacaagcccugcagcguuccucggacucugcucugguggaagguuucucucuagggcucccugcaaagccaccgucuauaacugugcccagaggccccagggcaaagagaagcuccaaagcaaacugaauacagcccuugaaguaaucacugcuuuuuaaaaugaagaugaggaugaggagaauggggaugaagcuaacugguuaggguaauacaauuccuuagaaaaaccccaguuauaaaagcuccauugugcacgggcgagggcagggaugaauauaagcugcaauaucguaccauaugcuauggcggagugucuuuaugcuggcaaaccuuagcaugaccccagucagugcugucccgccggccauccuggccaggguucaggcccuccuccccaccacugcccuugcaucucccacggaugucagccuuccucgggggucuacuggaaaguccuuugggcuguugugcuuacuuguuuaaagcuuucuccagguacucuuggauccacuuuaauuucgggucaaugcacacuugucuguuguuguucuucagccgugcacugccaaaacacaaggggagagacgcuguacagccaagcgggagaaagcgauccugugggcucacccaacacacccagcuaaagguccucacugcagggcccagcugcugcucccggaagcuucaguuuuggaagacauagcacuugaaucguguugggaccaccaccgcagaguuagggacgugcuaaggaugucucccaggggacacagagaagagaccacaguggaggcauuugagcuucuggccaaguuggagcuuggcaagugaggaaagcuaaaggaaaaggaaggacgaauaucccacaggagucaaagugcccaaaggguguggaggaagaaccacccagaaggcgcggaugacugauaucauggugggggggaggucuuggaaaauucuggagagugccagaagcagccuaagaacuuuugacagagcaccuugauaguacaugggacaaccuuaaagguagcucuggaggaagacggcaggaguccagaaggggaggaacagggcaguucaggugggcaaggagcagucuagacaaauuguccaaugguugccugagcgcguuuacaaguucacagaaugcuucaaggucuuagcuuuguggauuuguuaauugacgccguguucuuucucccaucccuagaacuuccuaaugggcagaugaaccggugagcuuagcucugguuauuuuccaucaaguccuggaugccagauaauuaaaaaaccaaaaccaaacaaaaaccaaaagcaaccaaacagaaacuacgggagacgacuccucuccagcuggugaacugucuucuaggaaaaacaaaugccuguucaguguccuagggacagguaacccucuucaagcaggcugcccugcaguugaccagucguucagagggauguaacuucaacagggaucaggggugucagucuggauccugccauuuauuaacuuagugaucacccagaaucaauaguuguauuugacccucuaaguucaagggcccuucccgggacagugcaccagcacagccuauucaaacguaaacucaucaucuuuaaaaucccuuucucgggagaguauuguauuuuaaucaaaacagcaaaaauaauauucaucaucuaggucucuaaagccuacuguacauaacacagcagcggaggcuggagaggaaggcugaugagcacagaaagucugaagcagucaccguugggugacaaagccgucaggcuagcauugcuccagcugcugcauccuuauacuguuguuaguguugagucucccgaggaugggaaccccugcuggggggcagugagcaggacagacuagcacaggacacaucucugccaagucuaccagacucugagugagauauucacaucauuuauaccuuuuuugggcuuuucuuauuucccagguaaauuuaaaucaaauacuggcagcuaccaucacacuccagcaaacucuaaaacucuaaaacaaaaaugaccucugagcaagugagugcaagugaguaaaacugaaccccccccccccccgugccauccgggucuuguaauuuuuuuuucuaugugagaaaggauuaacuuuggacaccagaaccuugaaacugacaagacagacccaacugucagcugagggcugaccuccaucaaguccauggcuuuuucuguagagaggcggcccacugugcugcaagaaacagcuuggaaagcaagagugagaaacacugaggacaucagggcucuggggaacaaaaguauccuuugaaacccaugucugauggcauaucaguguccccguggugguggugguaacagcugccccuaguuaugccaaguccgaggcuucuauaccaugcuccucuuugggggauggcggcuaggacuuacacaaucugaagggcacaguuuggaguguugaggauuuucagaugcuugacguuggcucuggcgauguggcucucgaagaaccggcaggggcaucgguagcucaggcugacugguuuaccuagaggagguguagagagaaaaguggggccagucauuaucugccuggugcaggggguuugguggcucuuguggggaagacucaggaacaucagcaggaaugguuacagaaaguuucuugcaaagaccauccccucggccagggaucacagugagaucugacugggcucagccucuaaaggacaaaaggacccaggagaagugggguggcagaguucugggcucccuuguggcccucuggugcaggccuggagguggggggcuucacuucuaccaccugcaguuuucccuccucccacucacccuauccuaagcccuggaaaucacaaaagaauccagaggggaggacccggauuuaccuucuauccagcuuuucccaaaagcuggggucaaccguggcuuuuauggucacuaccuggaugccuaggccuccuggauccuauuaccagcuuuguuugccaauucaccaauuugcaaaaugcuauaauugacacucauuaguguaaauuagcaaggggcuccuuuagaacccccccuuaagaaccacccuuuaagucuagaauugcaaacccugaggacugcuggauuuguagcugcucccccaacaacaggguuuuauccuagcucuacugagcauccccaaauguuucaauuuaugggucuuuucaccaaaguuuaaaaguaugacugagaauaguuagccccaggauuuuaaguuugcuuauuuagaguuccaggagacuucuggguauucugaaguucacugccuuugggaagcagcuggagaaguggaccgaauuaaauauaugaugggauuaucuucuucugcaagcauuauuuagcuaagggaugcaugccccaggaaggguagugucuuuagacucuaaagcauaggaaaaccagacuucagguacagaccaaagucuaauccagcucugcugccacccuggacuugggaaucuagagagcuuggcuuagggaaccagggguccauucaaucuaacaagccuggcaagccugcugcucuggguuuaaccaaagaagccuccggugucuacuaucuagcuucugaguuggaguagcugaugggaaaagacaggaaccacagcaagguuagccgugcugcaacuugagggcuguguaagaucagagggcacacaggcacuaggagguaaaaaaguucauucgggcagcacaaugggguccugccuagagaacaggucugauccagacacugucaacaauccgacucuuccuagggucagaauauguugagggugagacaacuuuuacucuggauaauugcacuccaaccuugaggaccugaguccuacauucuugccccauaccuaacuugccagaggcugugacccuugcaacaucaccagcucauucaauuauuaaugcccaaaucaaugugcuccaugacggggcacugggggaccagugggaaggcucagccucccggguguucucgguaacaaaaaaaaaaaaaaaaaaaaaaaaaaaaaucgaaacugccuuucauuucuuuuuuuuuacuacuccgaucagcaacugacuauucuuuuacagaacauuucccucggacuaggcaacuccaaccauucccguaccccguugucacagggaaagaacccaaacgaacgaguugguguacuugggcagcauuuagagcucagucucaccaagagccccgacugucccucaguucucuccaggaaacaccacugcggaggaaggcaggggaucgacuaguaggauuuuguuuuguguucagaggcaaugguuuguuuuguuuugcagcaacggugucuuguaacagcgcugagaguuuucucuucagugucaaaaaaagaaaacaaaaugaaagcccuuucccagugaaagaagacaccacccugggucugggagacugaacuccgcugcagcucucauuccagagcugaggacuccggggcuggcuacaaaagcgcccguuugcagguguguuuggggguuggggagaggugugcauauagcuuggguaacugcugagccuuugucuagugacccggguaagaagaaaaaggggcagugaagagacgcgugcucagguccgcgucgcuacggaccaacgaacugugcagaagcgcggcccuggcuggcagcgcgaguucaagagcugcgcugcgcugcugguggcccugagccccucgagggugcuguaagagaacacgcuacacccgcaggggacgaaacucagccucaccacugaaccuauagccaagccaugcacuucgagcuacuugaccggucuuugagaguuugcugacacacgcaccacccgagugaaccucuugcacggucaacuccgggaccgcgcugcccuucgccucuggaaacaucugggcgccgguagacacuagcugagugcagcuggcgcgcuccggggcccaagccccggacacaaucgcccacgcuuccauuccgcgccgaacccacucuugcccaacaauccugcggguccuccccugcagcccucucuagguccuauggccgcacuucgcagagcacaaaaccucggugcgacccgugggacacgggaaagggcacccggugggagugcgcccugcaaaguggacugccccaaguucgcuuguagugaacggcgccgaccgaguucuuucuccgcgacuucggcgcgggcagaggaaccgcggacccgaaggagcuccggcgcagagcugcgagccuuucccgggcccggccgcggauugcacucaccgucacugaugcagagcgcggccagcaccagggccagcacggcgacgaccuuggcguccauggcgugggcgggagggcgcgccggaggcugcagagcuggacagcaagaggacaccgagguggaccgagagugaaagugcggcagcgggaggcgagcgcugggcgcuuuagaggcgaaaacca

SEQ ID NO: 3323 - RNA, 1131 nt, Mus musculus
ggacguuuaaggcaucuuaaaagagauuuuauugaauggaugcucaauuucauccacgccccucucaggaccaaaagggcuacucucccaucucuaauaacuaauuuuagaguguucaaaucucaacccuugugucauuaacuucuucaguuaggaagacaauguuaguguccacucagggaauacuguucccucgaguucccuuggcucagaaagucucccgggccccgcguaggugcccuaugggguccuggagccgucggaccugggcuccccacaagugagcgcccugggucguacaacuagucgggguaguaccuaaacuccgaaguccugcagugccucguccaucuuuugggugaaaaaaaacuuauuacacggaccagagaguauuccugauucuuuguccgaaauacuuggucccggcuccuauagggaacccugagucuucugcaguuuuaacgucauaagcauucccaagcuucaaccaccgcuccuccacaggacggcgcuccccaacaaccagaagcagccaccgcguuucugccgcagcucggucgcggcgcuucccacagugccucggggcgcgcgcgggcuccugggaguugugguccggcgacgcgcagcguugcagcggcugcuacgggcucggcgccggcuuugucugucugcgggcgcgcgccgcugcggugaguguugcugaggccggggcugugcgcccgagagagggggcugugucuugagccugcugcuccggccagggcgcgugagcaggccaggcuggccguccgggccaaaaucgccaaccgcagacaagggugcgcuggucggagagcgggugggccgcggugugcugcggaaggguccugcugcaaugucggggucccugggaggcuggggccccgcgagcgugggaggggccacaggaagguccagcuaggccaggagagcagaguucacgccuagggagagagccuagcagggaguggcguccagcguggggggaauucauccucacccaaagcuccuaaucgcacguuaaauugccucauuagauuuuucccaaacccuacagaucacccugucuguccuccagcccucucuccugaaaaagcaccauuuuaggucuug

SEQ ID NO: 3324 - RNA, 1131 nt, Mus musculus
caagaccuaaaauggugcuuuuucaggagagagggcuggaggacagacagggugaucuguaggguuugggaaaaaucuaaugaggcaauuuaacgugcgauuaggagcuuugggugaggaugaauuccccccacgcuggacgccacucccugcuaggcucucucccuaggcgugaacucugcucuccuggccuagcuggaccuuccuguggccccucccacgcucgcggggccccagccucccagggaccccgacauugcagcaggacccuuccgcagcacaccgcggcccacccgcucuccgaccagcgcacccuugucugcgguuggcgauuuuggcccggacggccagccuggccugcucacgcgcccuggccggagcagcaggcucaagacacagcccccucucucgggcgcacagccccggccucagcaacacucaccgcagcggcgcgcgcccgcagacagacaaagccggcgccgagcccguagcagccgcugcaacgcugcgcgucgccggaccacaacucccaggagcccgcgcgcgccccgaggcacugugggaagcgccgcgaccgagcugcggcagaaacgcgguggcugcuucugguuguuggggagcgccguccuguggaggagcggugguugaagcuugggaaugcuuaugacguuaaaacugcagaagacucaggguucccuauaggagccgggaccaaguauuucggacaaagaaucaggaauacucucugguccguguaauaaguuuuuuuucacccaaaagauggacgaggcacugcaggacuucggaguuuagguacuaccccgacuaguuguacgacccagggcgcucacuuguggggagcccagguccgacggcuccaggaccccauagggcaccuacgcggggcccgggagacuuucugagccaagggaacucgagggaacaguauucccugaguggacacuaacauugucuuccuaacugaagaaguuaaugacacaaggguugagauuugaacacucuaaaauuaguuauuagagaugggagaguagcccuuuugguccugagaggggcguggaugaaauugagcauccauucaauaaaaucucuuuuaagaugccuuaaacgucc

SEQ ID NO: 3325 - RNA, 2934 nt, Mus musculus
uaauaccaguuguggcugggcacaccuuuaaucucucacuuuaugccucaggaggcaggggccgguggaucucugaauuggagccauagugaguuccaggacagccagcuuuacaacagagauaccaugucuuaggguggggguguggggaaccaaaagaaacaauacaaaacaaaacaagaguuggaagccagccuggguugcagucagacagagggagcucaaaagugaaaccucuggcuguaaaaaucugggaacuucaauuugaccccuggaacucaccuaagggaaaugaaaauacuugugaaaaguugcucucuggcuucuucaagguuagaagucacuugcaccuuucucuggcaauaguaaggaacuuuaaaaauaaauaaaaccacccaaggagcagggugagaggucucagcagaacuugcugcacaggccuuucaaccuugaguuugaucaggaccccacaugguggaaggagagaacacucaggauuguccucugacuucaguugaaaguguggugauaacucgcacgaacuuaacaauuuuaaugccccacucccugggcaaacaaacaaacaaacaucagaggugggggauguaauuugccaacuacaaggcucuggguuuagugcucacgaauacuuaucuaacuuuuguagcaucuguuuucuaucauuugacuucuauuuuucuucuuggacagguuuuccucucaaaguuuucuuuccuuuuucuggaguuagucugguguguuguuuuauaaacguuuccuucaucacuguaguucacuuauaaccagagauuauucugaacggccuuguaauuucuccaguguuuauauagacagcagcucgcgaccaugcauuguagccucggccgccuccaugcagaaauggaguucguaggaaccagcucguguuccuacgcccgccuaggcggcucuggaagcuucaaaaauaaucuucacuuuagcuuguaucucgacaucucgcagagaauccucccaaauuauuacacaucaagaaaaucugucccagcguucacauagugcugagaguuagaaacuucagacaaaucccuccggacugccugagaugcccuuaggcggucuuucuuuuacauaagacaccauucuaguuuuccgcacgcaugcggucauugauuccuuugggaucacuuuucgggaugcggagacacgcgugcagaauucagcguccaccgacucaccagcccacaggucucuuuauggacaacccccuccaccuugcugucuccccccccccccucguuugcccgcccccucccccugcuaccccccccccgcaauguuugcgccugcgccgucacuguccucuccgggacucagaggcggguccacagcucucuagucccgccccucucccucccccggccaauccuaggcuccguucugggcucgucagaauggcgccgcggcugcccugugcccggauguccgcugccugaggcuccgccccaucaccgucuugcauccuuccggcuccgucguggaaggaggacugcgccucgucuuccugaaggugggguucggggaaggccagcccgcggucacgccggcugugggaagggaaagugggcuccccgggcuacuguuuccgggugcucggggcgugggccgagcggggagcggaccggggaucaggagggcuuccggaggcgccgcuggcgcucggcaggcgggaguugaggagcaggccggccgcgcgguugacucgccccgcugaggccgucccgcgagcgcgccuguggggguuuccauggugacaguaaacaagccucaacugccucagcuacaacugccaaguccccgggguuccacccuccucuaggugcucugagggccggcgagguccggaugugagugggagcguggagccgagaagccggaggugagggccgccggcggggugugcuggcgccugggcccggcgggcguuggauggcgggcgugggauccggacucggaaggaacggggccgagguggccgccgcacagccauagccgugcggaggcugcccacggagcuggggaccgcguggccgggguuuggggucgggagccgaaguucagcgcauuuucgacggggauugggccgcguggccgaggugugcggucgggggagcggggacugagggcuggaguccggucgguagggccgggccucugggcugaggugugcggagggccugggagaccgcagccgcggcccacgcccgcccggagaaagcgcggcuuuccucagagccgcccccccaccccgcccgcaggcgcggcuuccucggcgggauauugggggggggggugaggguggagcgcuucucacccaccgcggcuuacgcucugucagcggccccccggcaggcccgggcggugguuguaguuuggagaaagacgagcgggcgcucacguggcccgaggcgcccggaguuucacaagacugggcgggacggcuccgcccaccgcccacgcccggcccgagcgaagccgagcgccucgcuuccuccucguggcggcccgggagcuaggagcaccggucugcgccggucccgucccccagagguaucguguuagcguguggggugcggagucuuugccuagguggguuagucggccuuagccgcaguuacgagcacuuuugugcuguguuuguggagccucacgugucugggaaaaguugaggugggcccgcucggccuucccucggcgcgugcucuccggagccuucccgacccggcgggaucggagaggcagccccaugugcccuaagacucccacccagcgaccuuuucugccccugccaguccgggaacaaacaaaugggccucuuuccuaccugcaagucgggcugcggaguaagcgggcgagcgagcgcggguggccgccaug

SEQ ID NO: 3326 - RNA, 1194 nt, Mus musculus
uaacucguacacacuauauacacugguaucggcuuuagauccuccugcguuaagcccccugagcgauuaagugcggccaccacgucuggcggaaguuuuuaguuuuuuaaaguuuauguuucaacauggaaaauauccucgagcccauggucaaaagaaaaaaagcaaguauugggugucggcaggucuuuauccuguagcaucccagugcuaggugauucgguuuuacuuugcugcgucuucaacgccucauugcgcuccccuuuccaacuguagcuguagucuggacuuugcucagguggcuggcuccuuuacccagaacucggcgagaagucuuccccuuuccuucccccacuuccggcgccggccaaacccacuguucgcgggccacaccugcaggcacgcuuuucucauuggugacauauuggcgggcccggcagggcacuuccuucucugcaccccgugaccccaguccgacugccgcuguagaucacgcggcugcagcuucccggacuccggacccgaacgcccuuuucggcguggugagccccgcuucccgcccgagccucaggcuccaggcagcguacuuuaccuggucaccuagaaguuucccucuuggagccuuuccacccuucggccugcgcgaguucuugcucagcccucuuccccgcccugagucuuccccuccaccacccuccgaggcgcaggagccucccaucccccgcccccgcccggaagcucccgcccgagcccgcgcaggccccggggcggaccuuccugcccggcaggcgcucgcugcgcggcgcggucgacuaccgggcgaaggccgcggagcagcgucaccuugcccuccgcccugcuucccgccaaaacgcucgucuccaggggcuccgcuuccacagaaagcguuugcccauggucauuggaacuuccauuucagguugagaacaaaaagaugcaccuggacuuuccccggagcccucugcguuuuuaaggcgucggguggaguuugaguucguaagccgcguuccuuacugaauauagaagucacuucuaccuuccuccccugguaaguuuuagagcagaaaaaggcaguaguuuugaagccgcggcucucguggucuuaagaguguaacuuucugaguaagagaaucugccuggacgcgcucccggcguuccggagguuaaaacuca

SEQ ID NO: 3327 - RNA, 1194 nt, Mus musculus
ugaguuuuaaccuccggaacgccgggagcgcguccaggcagauucucuuacucagaaaguuacacucuuaagaccacgagagccgcggcuucaaaacuacugccuuuuucugcucuaaaacuuaccaggggaggaagguagaagugacuucuauauucaguaaggaacgcggcuuacgaacucaaacuccacccgacgccuuaaaaacgcagagggcuccggggaaaguccaggugcaucuuuuuguucucaaccugaaauggaaguuccaaugaccaugggcaaacgcuuucuguggaagcggagccccuggagacgagcguuuuggcgggaagcagggcggagggcaaggugacgcugcuccgcggccuucgcccgguagucgaccgcgccgcgcagcgagcgccugccgggcaggaagguccgccccggggccugcgcgggcucgggcgggagcuuccgggcgggggcgggggaugggaggcuccugcgccucggagggugguggaggggaagacucagggcggggaagagggcugagcaagaacucgcgcaggccgaaggguggaaaggcuccaagagggaaacuucuaggugaccagguaaaguacgcugccuggagccugaggcucgggcgggaagcggggcucaccacgccgaaaagggcguucggguccggaguccgggaagcugcagccgcgugaucuacagcggcagucggacuggggucacggggugcagagaaggaagugcccugccgggcccgccaauaugucaccaaugagaaaagcgugccugcagguguggcccgcgaacaguggguuuggccggcgccggaagugggggaaggaaaggggaagacuucucgccgaguucuggguaaaggagccagccaccugagcaaaguccagacuacagcuacaguuggaaaggggagcgcaaugaggcguugaagacgcagcaaaguaaaaccgaaucaccuagcacugggaugcuacaggauaaagaccugccgacacccaauacuugcuuuuuuucuuuugaccaugggcucgaggauauuuuccauguugaaacauaaacuuuaaaaaacuaaaaacuuccgccagacgugguggccgcacuuaaucgcucagggggcuuaacgcaggaggaucuaaagccgauaccaguguauauaguguguacgaguua

SEQ ID NO: 3328 - RNA, 4136 nt, Mus musculus
cugagcagcaagaccaguuuaauauaaaaucagcuuugccacacccuuuccugucaaugaagacuuaacaguauguucuagggaagccauccuggagaggaaggucuccagaggagaaguacggcagaaaguugucaaaaaccugccuccaaacuugguccuguguucaguucagcagguauuggcagagccuguggagaauuuagucaguucuucagugaccuguucccuuugcuacccuaccuaucacucccccuuccugcauuccaccagaggcccagcuuaccuggaaugaugaguggaguggcuuuuccagguaaggaacuagagaaaggaaacacaaagauaagcaucaagaucuuuuauuuccucaggauuucccaugucccuuugcuacaagggcaugcuuuauuuacacuuauguauuugagcuuuugagacauggucaggcuagucuugaguuugguauguagcccaagauggccugaugaucucccuaucuaccaaaugccuggauugcagguguguacugccgugggugcacagacccgaauacucugcuuccauagugacucuuaauaucauaggacaggcuuuucccugauuugaggccuuugagaguuuauuuaaucuucaaauaaaucccacuuuuugcccaaugaauagucaggguguagugguucuguugguccuagaacuuuauccccguaaagauguugcucagccaaagauccguaccacuuggcuacugucuuaccugggcuuauggguacgccuacauuugcacuugccaccuaggagaagagggacaucgauccagccugagucugagccuuccucuccccacucugcccaucccucuacucacucagggccauggcaauuccagcgaugcacaggagcccuccaaaaaucaauccucccagcugcaggcucucccagucugggggugggggcaaagaggagacauugccucacaguacccucacacauucauucagaagguauuuauggggcugggaguguggcuuugugggacgucuuuacaagcacccacuugcccuauaaauacgugcuugcccacauggcacuuaaaucccagguaaugaaaaagagaccaaguggguuaauagguacgucauguaauagcaucucauggggacaagugccaugagagacaaaguagacgaaccuagagaaaggaggacaagguucauuggaccaaccccagcuccaugccccaaggcccccuuuuuccuucuucuacuuuuuuuuuuuuuuuuuuuuuuuugucuuuagcucuuaaugaagaucaggcuuggugucccgucccaccuugacuauuagauuauguaccauccucaucaguuggcuuggugaagaggucuaaggcagacaagaauugaaugugauggaguggggaagggauggggauuggugucagcucuuaccauaguagaagggacugucuuuaucugcaguaaaugaaaaauaaguaaauaaauaccagaacuaggagacaggauauggggucuuaggagagaaaugcaggcagguggcaggugucacuugugaguauacaaugguugguacucaccaacugggucacuggcuuccaaggccggcagaccugggugagacaagcagagguggguguuuaucccacuugaugucuaaaaacccagcugucuagagaggucugugaagugacccugauccuaggccuaccagaucccaagcaggccuuggcuuuuucaacgcauccugaguucugagucccauucacagcccuucauauaucgugucugcucuucuccugcucugaacaggauaguugauucauuuuuaaccuugucugagaaguguuggacagagccaggcuuuuugccucuuaaagaaaaagccuaagcugggcagugguggcgcaugccuuuaaucccagcacuugggaggcagaggcaggcgaauuucugaguucaaggccagccuggucuacagagugaguuccaggacagccagggcuacacagagaaacccugucucgaaaaaccaaaaauaaaaaaaacaauaaaaaaaaaaaaaaaacaagccuacuuugauaggcacgguccauuuuucacagucaacugacucaguagccauuaagcaauuuuucaguguucucauucauccuguacuaguguugcgugcaacugacaguuuaaagauaaacacacuuauugggccgcaguccuacucuggggagaggcugucuggucuccacuaccuuggugggcggaguguauggagaacucaccugcuagcagcaggagaaaggcacaggugauuuccuccauaucaggacccagggugagacugcaggcugcugggugagaugcagaguagaagugguggcuugggucugugaucugugaccugccacagcucaccccauuaguaagaggcagaacuggugugaaaauuagacauaugaaucccacauaggcaagcgcugaccuuaaggaaacgaucgcuuuccacuuccccauacagaugguacuagugauuacccggguauguggauugcuuaauucuaguuacguguucagaaacagaacacccuggagugaccacguaggcuuugcgaucaucucuuucacagaagguaggaauccacgaagauaaaaccaaaugcuccaagugagguaggugucuguucuacgaaggagcuaggcuuucccaaccagguguccaggcccugccucuuccacuugaaaagaucugggccuggaguaauccgguugagucguagauuaucucagaauucaacaacagggcuggagggugcaguuccagccuccucuucuagagccaggaacucugcuccaagcagccccagaucuacucagagcauagguaccugcuagaaaggucugcuggugugagagacauagccccuuucuccugugaguagguccuacccagggccucauuuacauugcuugugacaccccuugugcagcugaguuuuagagagaaaaagccccagccuuucuuucuguauaaugguagcuauaggcuagugccaaggguucaguuuugaagccucgguuacugucuacuauacuuagcucugaucugcuaaugagaucacagauccagcaccuacuggcugggcucagucuucucacauccacuuaccaggugugugacuuagcagguaauaucucuguguuucaguguccugaaaauuauaacaaccuuguaaauuaugcagaugaaauuaagggagcuauguaugauauguaaauccuaaaauauagaccuagcccugaaaaccugcuacaguauauauaaaccacaugggcuuuuugccuuaagauggaaaaauggauuaaaaaucuccuggacaugggaguuuauaaucuaccagucucugaagcugguuuucuuuuguccuucaucaguuucuccuaccccuucacacaaagccacagcuccuggauugucucauuuucauuuuacuucugcuucuguuaaagguuggcccuuacuuccccuaguccugaacucgcugcuacacagucuuaaaaucagaacucucaaggccgggagaggccaucucuguucucacaauccccaaauaguuguucacuucucagagucuuggaggcauccccucccccuuccucagauggucuuucugccaccccuucuaaggagcacacuuaagucccagcaaacaucuacucacccgggagaugacucgagccaggggaguggugcagagaggaagucugaggagagccuagguggguucugcucuuuaaacccaggggcuccgcccugggccacacaccagcagucuggagggaacugguccuaccucuuaugcucccguaggcagcccuccccaccugcucuuaaggccauagcucacuuaccacacccaggguagagccagugcuggguccuggcuccuucaagcuaaggaaugagggagagacgggaaaacugagacuacuggauuucaguccaugcuccagaggaaaagggggccuccucagucuaccuaggucuuacgagaaagcuccagguuuggaaggauggcuuggaagguaaaaguacuuguuaccacaacugacaagcugaaucug

SEQ ID NO: 3329 - RNA, 4136 nt, Mus musculus
cagauucagcuugucaguugugguaacaaguacuuuuaccuuccaagccauccuuccaaaccuggagcuuucucguaagaccuagguagacugaggaggcccccuuuuccucuggagcauggacugaaauccaguagucucaguuuucccgucucucccucauuccuuagcuugaaggagccaggacccagcacuggcucuacccugggugugguaagugagcuauggccuuaagagcagguggggagggcugccuacgggagcauaagagguaggaccaguucccuccagacugcugguguguggcccagggcggagccccuggguuuaaagagcagaacccaccuaggcucuccucagacuuccucucugcaccacuccccuggcucgagucaucucccgggugaguagauguuugcugggacuuaagugugcuccuuagaagggguggcagaaagaccaucugaggaagggggaggggaugccuccaagacucugagaagugaacaacuauuuggggauugugagaacagagauggccucucccggccuugagaguucugauuuuaagacuguguagcagcgaguucaggacuaggggaaguaagggccaaccuuuaacagaagcagaaguaaaaugaaaaugagacaauccaggagcuguggcuuugugugaagggguaggagaaacugaugaaggacaaaagaaaaccagcuucagagacugguagauuauaaacucccauguccaggagauuuuuaauccauuuuuccaucuuaaggcaaaaagcccaugugguuuauauauacuguagcagguuuucagggcuaggucuauauuuuaggauuuacauaucauacauagcucccuuaauuucaucugcauaauuuacaagguuguuauaauuuucaggacacugaaacacagagauauuaccugcuaagucacacaccugguaaguggaugugagaagacugagcccagccaguaggugcuggaucugugaucucauuagcagaucagagcuaaguauaguagacaguaaccgaggcuucaaaacugaacccuuggcacuagccuauagcuaccauuauacagaaagaaaggcuggggcuuuuucucucuaaaacucagcugcacaaggggugucacaagcaauguaaaugaggcccuggguaggaccuacucacaggagaaaggggcuaugucucucacaccagcagaccuuucuagcagguaccuaugcucugaguagaucuggggcugcuuggagcagaguuccuggcucuagaagaggaggcuggaacugcacccuccagcccuguuguugaauucugagauaaucuacgacucaaccggauuacuccaggcccagaucuuuucaaguggaagaggcagggccuggacaccugguugggaaagccuagcuccuucguagaacagacaccuaccucacuuggagcauuugguuuuaucuucguggauuccuaccuucugugaaagagaugaucgcaaagccuacguggucacuccaggguguucuguuucugaacacguaacuagaauuaagcaauccacauacccggguaaucacuaguaccaucuguauggggaaguggaaagcgaucguuuccuuaaggucagcgcuugccuaugugggauucauaugucuaauuuucacaccaguucugccucuuacuaauggggugagcuguggcaggucacagaucacagacccaagccaccacuucuacucugcaucucacccagcagccugcagucucacccuggguccugauauggaggaaaucaccugugccuuucuccugcugcuagcaggugaguucuccauacacuccgcccaccaagguaguggagaccagacagccucuccccagaguaggacugcggcccaauaaguguguuuaucuuuaaacugucaguugcacgcaacacuaguacaggaugaaugagaacacugaaaaauugcuuaauggcuacugagucaguugacugugaaaaauggaccgugccuaucaaaguaggcuuguuuuuuuuuuuuuuuuauuguuuuuuuuauuuuugguuuuucgagacaggguuucucuguguagcccuggcuguccuggaacucacucuguagaccaggcuggccuugaacucagaaauucgccugccucugccucccaagugcugggauuaaaggcaugcgccaccacugcccagcuuaggcuuuuucuuuaagaggcaaaaagccuggcucuguccaacacuucucagacaagguuaaaaaugaaucaacuauccuguucagagcaggagaagagcagacacgauauaugaagggcugugaaugggacucagaacucaggaugcguugaaaaagccaaggccugcuugggaucugguaggccuaggaucagggucacuucacagaccucucuagacagcuggguuuuuagacaucaagugggauaaacacccaccucugcuugucucacccaggucugccggccuuggaagccagugacccaguuggugaguaccaaccauuguauacucacaagugacaccugccaccugccugcauuucucuccuaagaccccauauccugucuccuaguucugguauuuauuuacuuauuuuucauuuacugcagauaaagacagucccuucuacuaugguaagagcugacaccaauccccaucccuuccccacuccaucacauucaauucuugucugccuuagaccucuucaccaagccaacugaugaggaugguacauaaucuaauagucaaggugggacgggacaccaagccugaucuucauuaagagcuaaagacaaaaaaaaaaaaaaaaaaaaaaaaguagaagaaggaaaaagggggccuuggggcauggagcugggguugguccaaugaaccuuguccuccuuucucuagguucgucuacuuugucucucauggcacuuguccccaugagaugcuauuacaugacguaccuauuaacccacuuggucucuuuuucauuaccugggauuuaagugccaugugggcaagcacguauuuauagggcaagugggugcuuguaaagacgucccacaaagccacacucccagccccauaaauaccuucugaaugaaugugugaggguacugugaggcaaugucuccucuuugcccccacccccagacugggagagccugcagcugggaggauugauuuuuggagggcuccugugcaucgcuggaauugccauggcccugagugaguagagggaugggcagaguggggagaggaaggcucagacucaggcuggaucgaugucccucuucuccuagguggcaagugcaaauguaggcguacccauaagcccagguaagacaguagccaagugguacggaucuuuggcugagcaacaucuuuacggggauaaaguucuaggaccaacagaaccacuacacccugacuauucauugggcaaaaagugggauuuauuugaagauuaaauaaacucucaaaggccucaaaucagggaaaagccuguccuaugauauuaagagucacuauggaagcagaguauucgggucugugcacccacggcaguacacaccugcaauccaggcauuugguagauagggagaucaucaggccaucuugggcuacauaccaaacucaagacuagccugaccaugucucaaaagcucaaauacauaaguguaaauaaagcaugcccuuguagcaaagggacaugggaaauccugaggaaauaaaagaucuugaugcuuaucuuuguguuuccuuucucuaguuccuuaccuggaaaagccacuccacucaucauuccagguaagcugggccucugguggaaugcaggaagggggagugauagguaggguagcaaagggaacaggucacugaagaacugacuaaauucuccacaggcucugccaauaccugcugaacugaacacaggaccaaguuuggaggcagguuuuugacaacuuucugccguacuucuccucuggagaccuuccucuccaggauggcuucccuagaacauacuguuaagucuucauugacaggaaaggguguggcaaagcugauuuuauauuaaacuggucuugcugcucag

SEQ ID NO: 3330 - RNA, 60965 nt, Mus musculus
gugagcaugcgcggcagcaagaaggcgcggguugcuaguuugcagcucggcuuggcgauuauugugcuuuaaaaaccugccgggccaugcagcgucuuucccggugggaucccgugcgucuaggccggcuuuucaauaagugcccuagcugcguuguguugucagccaacguugcgcggggaagaaggugccugugaggggcguacccucugccaugaagaagauuuuuggcuucaggaguaagggcccaucgcccuuaggccccucugcccgcccgcgcagcaacugcgugggcuuuggacgcgagagugcuaguggcucccacgugcccagguaccauauucacgacaaggauaugggcaagauccacaaggcugcaagcgugggagauguagccaaagugcagcauauccuuauccuuggaaaaaguggcgugaacgauagagacaagaaggacagguaauaaauggcccgccaguuagcggggcgggacgaagcuggugggggagcgugcaccuaccuugucuggcuuuggggcuggaagacagagagucuaucuuucauuaaggaagcuugacucuucccaccuggcuuugaaugccuaagucuuaguggggucuaagcccugaccuguaugaacagcaaggacagcaacaaaaaacacuucagcugguuucugauccacugacaguucccuucacuggcaauguaaagcgaguuaacuaacauuuuaacuuucugcauacauauaagaaaguuuuauguuguagaaauacauaauaggagaaauguuucuguucaagguuaaaaauucuuccacuaacauacaggauccaucuuaucacugccguacaccugugugaaugguuuugguugguugguuuguuuuuacugcauuuugaagugggaaaauaguuccauauucucgagucaaagauugguaauucccagaacucgaacucugaauauccugaucaauuuaacguaagccaaacccgaccgucagcguuuuaacaauuuugaguuucuuauguugcuuuugauuuugugaugagacgagaaaaaaaaaacuuucuaaaggauaaaacuacuaguuuucacaagucagucguuuacuagcagccaaagagacacagcagugagcaggguggaauagaaaacccagaacauauccaaucaaguauauguaagaauuuagauauugcugggcagugguggcucaugccuuuaaucccagcacuugggaggcagaggcagguggauuucugaguucggggccagccuggucuacagagugagcuccgugacaaccaaggcuacacagagaaauccugucucaaaaaacaaaacaaaacgaaaaaaccaaccaaccaaacaaacaaacaaaaaaaccaaaaaagaauuuagaaguugauucuggugacaccccaguuaguagggaacaaacacuuaggaaugaaaugguuguugacuuguuuggagaaaacuagcaacauuucuaugucacuaaaauaaaucccugauagaauauaaguuaaacacuaaaagaaaacacagugagaaaaguaccaaaacaaaacaaagagaugaggaacgacugcagaaccacugugugugugagugugugugaguguguguguacacacccguguauguauccguguauuggugauugaaugcagguuuguaguguauccucaggauacuuucuaacauugagcuuuuuaaaaugaagcauucucaagacccauugaacaaaaucugaggauaaagggacuguauacuugcaaaguguucacaguauguauguauauauauaauauauauacacacauauguauauauauuaguauauauguguguuauagauagauagauagauagauagauagauagauagauagauagaugagagcaguguuccugcugaagcugguguugcuuagggcuucccaguagaugcacugauuuuuauguugcuuuguaucgugggugggaggggaaguacgucugcuuccauccuuuaguuuguguggcuuuagugagauguguuucacucagacaaacaguaguguuauucaggggaucucccccacccaccccauugguucaaauaugguuuauucuuuuguauucauagccugggguuugcugguauacuguuaguccuuuccauccccaguucucaucucuuuaucuguccccugucauaccugccccucacccaugcacacauacacaagaacugcaggcucgccuuguggccagggcugucgcucuauuuucuuucuuuuuaauauucuuaagagagauagaugauagauagguagguagauagauagauagauagauagauagauagauagauagauagaugagagugugucuguguguguguguguguuagugaagauguguguaugccaugcugugcuuguggaagccagauaacuuucaggagucaguucuccuuuuaacauaggauuuagggaguguauugagguuguugggcuuuuguggccaaugccuuuguccagagaaaggcuaagugaugacuaguaagcagcagaccuuaaagccauguuuauacccaaguccaagccacauccaaaggauauauacacuucuuugcaaauuggcugcucugggcuaggaauguaacucaguaauuguuugcuuagcaaaagucucugcugcaaaacacacacacacacacacacacacacacacacacacacacacacgguuguauuuucaagaauguacuguugucugcagaaaaauacuuguuuugaaagaagauauaacauagcguucuacauuucaugaaauguauuuuuagaugauacuauguaguuuuccuaagaugugcucugguuuucacaggacugcucuacaucuugccugugcuuacggccacccagaaguggugacucucuuaguagagagaaaaugugagauagaugcccgugacagcgagagcagcacggcccucauuaagguaccagcagccagcacuucuggcugaauugcgucucauuuaaacacuuggggcauaaaagaccucgauuugauuuaaauauaguaauaaguaaagccgacaauguguguauuuugaaucccuaagcugaugauuuucuccuugaugcacuaacaccaggccgugcagugccaggaggaagaaugugcagccauacugcuggaccacggggccgauccaaaugugauggacagcagcggcaacaccgcccuccacuacgcggucuacagugagaacacguccauggcagccaaacugcucgcacacaaugcaaacauagaagccaaaaacaagguauaacggcaucuuucuuuccaaaaucaccaaagacacagagacacaucgugaaggucauucuugucacccugacuggacugagaaaacacugcuguguauuuuauaggaauguguucagaaaugcucagaucaugaggucucgggaucuaaguaauguuugaauccauugguuagaauguaagauugaauagaauugccccuuuaagguacuguggcugugauaaagguaauccauacaccagucaggaucucgcugaucaagccagugucuuauuuucuucuuacugcggucauuuauuuauuuguagggguaggaggugccugugcgccacaguggacgugcagagagcagaggacagcuuuagggaguugcccgcccgggugucaggguugaacucggguugaagggcuuagcagugagaaccuucaccugcugacccaucucucccccugccucccaaaccaauugcauuuuaaaaaauguccuuuuuacccuuuuagaaaaguuagauguuuuaagggcuagagaaauagcucagagguuaagagcacuugcugacuuacaaaagacccgaguucuguucccagcaccugccugguggcucacaaucaucccuaacuccucuuccagggacccucuugccuucuacugcuguuguguuagguuuuuuuuguuuguuuguuuuuccuaagacugugagguccauugcuaggcuauuuaucuaagagcucucugacuuuucaguguuaaaacagcuauaaacguuccuccuggauccuccucugcgacccagaggucaccuuucauuuuccuuucauuccaggaccuuuuacauuugcucccugauuucuuccaucuccugauauuuauguggcuucuuugcuuuugauuucuaguuuucuuucacuauaguaauacaagaagugauuuugguccuuuuugcauauguuagacuugauuuguggucuaggaugugguguguuuuagagaagcucggagaggcugcugagacaggcguguauuccauaccuguuguaagaacuguugcgugaagaucgcuuaagcgcauuuggucuguggcauaguuugacucugagguuucuucuuugaauucugauuugaaugagcuaucuaaagaugcgaguaggguguugacaucacucacuguuauccuaucagaaucugaccuucacgcccauccuaauucugguucucucuggucagauuacuguuuguucuuuuauuuaucgucccguuaauuuuaugaguuuguuguucuauuguuuuggacaugauagcuuuccuuugcuccuuuuaugaaaucugggaguccguuuccucgucucacugugggaucaagucaucugcaaguacuugguuuuuuuuuuuuuuuuuuuuuuuuuacccacugaaccaucuuggcaggcucuuguauuuuacagugguggcuugcuuguugugaauugccuuaguguguguguguguguguguguguguguugugaaguguucuuaggucucagguagcuauaaaugauagcuuugcuggagauagcacaagaguuggcaguuacuuacuuuaggggcuugagauaauauuguucucuauaugcagauggcucuccugaugagagaucugcuguguuugccccugaggucaguugguguuuugacaucuugacuguuaucugucauggggcaggucuucucgaauuguaucguugaugccucauguuuugggaugcuucuuuuuuugagaucugugagauuuguuuuauuuugauuucaucgaauagauucccccgggcauuaguauuugucucagcgccuuugccuagcccacugguuuuuaaguguuacauuuguguuggugauuuauauuuugucuaagauuaaaugacaaaaacaccugagucucaauuaaaaugaugccagcguaacaaaaaacaaacaaacaaaugaaaaacaguaggguauccagguucuucaugagcaacaguaacccuugcuccugcgccuugcaguggaaacagcaucccuucacacucuaagagaaccccgcagaccuuuuaguaauaagggcauguccauuggcaucuaggucuuuuaauuaagugcccaucuccuuagagacucacuugaagcaggagugucugacacuggacccuggaauccuggcauaaacagaggagaagcagggaguuugcauccuagagggaacauccacauucuuauaaaguguuucaaccugcuuccucgaaacuuacuucuucuguuuuaauguuugccacaagaaauaauuuucaaauaaaacuugaguagaguuggagauccccuuuacuugucaugucaguuuaugaauggauggaucuucuaggaaugcugcuucuagagaagucagugccauuugguguuuguauguagaagccuucucugaggaugcuaauuuugcucauuaauucaauaagacauuuauaacuuuuacuucuguuagaguuacugacaaaaauguuagcacaacugccuucaagagaugcuugacugggugggucgcaaucacauaacuccaaaguauaguucaggugagaagucaguaauuugugaauuauggauugccugugaugucuuacaggaugaccuaacaccuauguuacuugcuguaaaggaaaauaaacaacauauuguggaauuuuuaguaaagaagaaagcaaguauucacgcaguugaucagcuuggaagguauaguaguuuaucuuuucaaacuuuguggguaagagugcuugcugugaguuuacauccuuaacacucuuguaaaagccaggcauagcugugugugcuuauaacccaagugacggggaauggagagaagccgguccccaagagcuugcuugcuaacugggguggauuguggaauuucagauucagugaaagaccuugucucgaaacaggaaguggagccuaauagaggaagacaccuacuguccuccucuggccucugcaugugugugcaccuauacauguaugcauacaccacacacuacacacacuaaacagguaaaaccuggugugauaacaaacacucagaaauacaaguggaagaggaggagaaggaggaagaaggagaggagaagaaggaggagauuaauuuaauuauugcuauguuggaaaaacaucaguaccuacauuaguugggugaacaagcaguuauucacacuaggcaagacaaccucuaguuggauucaccuucccauuuacuaugagugauauuuguaaccugaucuaugaucuuauauuagcuauaccaauuucacauuaguaacauugaccucucaauuuuuuuucaacauuuuaaaccucccuuucuuuugaccagacugaacauaaaugaaguugcaaaucagcccgucuuuuuacucuuuguuuuaaauuacuuuugugaagaauguucauguugucaacauuauaugcucuucuuaauuuuuuucuguuuugcgucuaauauucuaauguauuucuaauguauuuuuuuaaguagcuugagcagaggaaagggauacucuuuaauggauaaucuuuuccuuuaaugaaaauaagccauugguggauaauaaugggggaaaagauaguuuuagauucagauauugccaagcuuaacaccugacuuccucauauaaaaaggaggguaauauguccuguggauuauacugugguugaggagguagcucaguggguaagaguucaugaugugugagaggagaagugcaguuagacucuccgggcccuguguaaauagccaggccaggcaguuugccuguaguccuaacauggaggggcagacagacagauccuggggaccugcugggcuuggcuaagcagccaaaagcacaucugguuuagugaaagagccuguuuuaaaggaguccgguggagagcgagaaaccaggagcuucccuucugggcuagacagccuggccagcaagcucccacgaucugcuuucgcuuuucaaaguauuuaaaauuuggauuaacaaagaagcuuuucagcagacaucucuaagucaaagucacuuacacuccuacaagaccuaggcccucaugaccaaccauuauaaaagaacaauuuaucuuccacugcaauuagcgauaaauggagaaauuaaauauuaaggagagaaguccugggucagaguuugauuagaaaggaacagugcccagaccaagucuuagucuucacguuuucugcccugggugauuggauacuucggucauaguagagaguuaccuaggugaaugagcuauugaccaauccguuuaguuucagauuacuauguaacugauuuggcccaaauggccacagagaauugaagcguuaauaucggggugagccucaguauuuugugaccacugcaacauuguuagaaacugugaaugcaugcucgugucguguugauucugcuuggaacuccaagcgagcuuaacacauauuuauauuuaaccgacugccuucaguuuaucaccgacauuucacugcacauuugaaucaugugggauaggauccugauauuagcucugauuuugucuguaaugcuguuaugaauuuaauuaauauauuuauaauuuuuuaaccuaccagaauuaaaacaauauuuuuugucauuuuuaaacauagcaacaggcaaauguuugaauaugaugggaagagacuacaaagaucugaaaacagcaauccagguaaggucccucaugaagcaucgcucugugggccgucccuggguagccauggagaugaaggauguuuugaucacagaagagcaauauaaaacauagaucauuaugggagugucacucgcaugcgugucuuuauuucucaguguaaaaugcaggauuagguaagaaauuagugaaaagaaguuuacacucuaaaacaacauuccuggggauggagaucuuuuuacuuuggcccugaaguccauuagaaaagugauuuucaguuauugcauugcaugcuuccuccauccacaugacagcaaauugaguuuagcauaagaguggauuucacagcaaguagauugcuuuaguaagagaauguuauuuuaguuguuuagauuacuaauaaaguguugcaaguaaaaguaaauauaauuuuuuucaauaauguuuaucuguuucuucccuagauauagaauuagaauaguucaguguauuuucagagucuucaguuuaggagagaauaccauauuguuccuuugaauuuuuuuguuuugguuuucucugcacaacacacacacacacacgcgcgcgcacgcucgcacauacacgugcacauugggagcagaaccuggggccucauauaugcuaggcaaauguucuauuguggguuuaaauccuacccccuaauaaucuuuaaggaaguuuucaguucacaagcaaaauuaacaguaagaaacagaauuucccauacacccugggacucccaaacaugcauagcuucuuacauugucauuaccaucuaccugaguacugaguaguggauacaucuguuaguccagcuggguggugauggcucacgucuuuaaucccagcacuugggaggcagaggcaggcggaucucugaguuugaagcuagucuaguguacuaaauggguucuaggacagccagggcuguuacauagagaaaccguguaucuaucuaaaggcuaaaaaaggggaacuaguuaacccuacauugacacaccuuuauuauuccagcaugucuagcuuacaugacaccugggagagccagauuccaccauaacaaaguaauuguacuccugugacuguuuccagugcuauuaguccagaaaaacccugcagaggauauggauucugaugaugaugccaggugcugucagucugagaguguccagucaguuguggccaucguacuggcagucuuccuuuaaguaucauaguuuuauaaauucuccuccuucuuggauuugauaaacaugaaggggagacaaagcauucuuaaugaauuuguuagcuaucgcuaguauuagcauucuuucuaggauagccucuagcgugguaccaaagagaaagcauuaauaauaauaacauugcuuuacauuguucuguugguuuaaacuguaccuucuguuuuucuuuaacaguggauaaugguucugaagauggcucuuuaaccagguggguaggcauauauaacaauauaauuguuaaaauuaaauguuaauggcuuaaagaauacagaggaaagagacuaggauuugcuaaguguucugcuuugagcuagauacugugugguguggcuaacauuucuuacaauggucacagagcuuagaaaugggguuucauauaguccagaguggccucaaauuuguuauguaaucaaggauguccuucaacuucuacucuuccugccuccucauuggcacaggcaguuuuugaaaccaaaucacucauaggcuugccaguauauugacuuucucaguuuaauauggaaugaagagugagucuuaaguauuucagaguuggagaaguggaggcagaaaggcaacugaaaagcuuuuugagaagaggccaaaucugagucacauccaccaagagacguguauuauacugguugccgaucugcuccuagauuucuuuuaagcacucccauacugcuggagagauggcucagcgguuaagagcacuggcugcucuuccagaggucuugaguucaauuccuagcaucuacaugguggcucacaaucaucuguaauggggaucugauguccucuucugucaugcaaccauacaugaaaauagagcacucauauaaauaagcaaacaaaaaguaaauaaaugaaagaguucgucuuacaguuuuuguuggcuguugcucaaaggucuuauaacacaccuggcccugcugauuccuggccgacaucagaugaggaggacuauaacuuugacaacaagguaaaaugcaguuuuguggaaguaauguuuugcugaguguuugcucugaaaauuuagugaugaucuaucauuguuuuaugaggaauauugaucggagaaacauuuuuuuagaacaaugacuuguuaaauaauuuuuuuauuuugaugaauaucaaagacugauuguuccuucagaagguggaggcugggaaugggaaagugagugagcuggaaaagaaaucuccaucaagaaaaacguccuacaguacacaaaacaggagauuggaucaagaauuacuuuaauaaauaugccuuguuaugacuuguaaauuauaugucugacuauuauacccaaauuaaaucucugaugggcccaguuaguacaguaaaccauugacucuccauggugacuuaguuucaagagugucaacacacagcaugcaguuucucuucaucuuuuuccuuggacuccucuuagucuuuaggugaacuuuucucuacuccuauccuugaucugcauguaaauuaccauaccaucagaagcuguagaaauaugcaaauuuaauuuaugcaaguuuauugcaguccaugccccaugucauucccucaggacuguuacaucuguagacccgaagaguggaugcucuguccugaacaaagucucuugaauuccuaggacuguggcucacuuuauauuccuuguauaguaaacucaagugugccuuacauugaggaaaugucacauauaaaaucauaaagucuauugaauucuuaaaaacaugcucaccuugugauguuuagauguaaacuugcaugacacugaggaaauaaucauguuaaaaagacaaaaauaacaaaaagcaaaaacagagaagugucgugaaaggagggcgaugcagcucauaacugcugucugaaacuguggcguuggaucaugaugagacuaaaauaucuuugccuuauugcauuaguuaauauauuuuugaaucuguauauuauccauagaauucuaauuagcaaaucaucuccaaguaggaaauuaauggagcauugcguuucccagugucaucuuuaucuaguagugauguuacaucucucaggugaugguagcuaaacgugacugagcgcuauguacuuacaguacagaauuaacuuuucauuacaguaaugucuuuaaaauguaacuacaaaucauuauuaggguuguacugugagucaagguucucauguuaugcuggcugguuuuauuuugacuugauacaagcuaggauugucugagaggaaggaaccucaauugagaaaaugccuccauaugaucaggcucuagggcauuuucuuaaucaugggggugguccagcucauuguagguggggccaucccuggguugguaguccuggguccuauaagaaagcaggcugagcaagccauggggagcaagccaguaagcagcacccuccauggccucugcaucagcuccagccuccagguuccugcccugcuuggguuccuguccugacuugguaaacagugauguagacccuuuccucccaagucucuuuggucaugguguuacaucgcaguaguaguaacccuaacuaggccgggcuuuccuccuuucuucuucauuuaaaacucauucauacguucccugccuccguacgcggacaugugacagcugucugcggugucuucuaucggugcccuuuucuccaugguuggcauguuuagccaugcuucucuucagucccugcguguggcuuugccgcacaagauuuauucuuuuucccuccucuugguuagaaagagcuaaauguguauaauaauuugcauguuacuuuuggcacacaggguagaaucacuuacacuguuuggauuuuaaaccaugaacuacagaaaguaagcccucauagcuucuccuuuagaugcagucaugcaaauauaggucacgaugauacauucaaaguauuuucaauuucuuuaaaugcuaguguuuucagaaguacucuaaauugugaauacauuuuuguucuagguuauuucauuuaaaucauacacuaaaggauaucauaaaauuuguguaauaauuagguguaaggagaguaaaauuuugauaguccuaucccauaauccucguguaguuggaguauguagacuaguaaauggcacaauuaauauuugaaucuaccuuaaggauucagaaacauacucuugcuguuagaucagaugguaagagugaauacuauauuuacuuuauuaucauguuauuuucaaaauuauuuuuguuuuucuagaauguccccaaaauuaauuugacagaguuguggacagcugcucagcagucuaggaaaaaccguaagucauuuaaauuuaaagauggccuuuucuugugcuggucauucauuuaaaaguaaguauuuccauguguucuuuuuuuuuuuuuuuuucauaauagaaacaaaauguggcuuugaggagcuagacaauggagcccgguuugaugacagugauuccccuagugaaagugaagaugccauugagguugagccugcgccaucagucagaguccagacccucuccccaucccgucagucaccugacccuguggugagcacauucuuuuaucuuuaaaagucgggcaugccuguugauuguuuugggggcuccuuucucuuucccugaaaauacuggucaaauuucucucuuugcugcauguuguguaggccagagguguccgaugcccuggaacuggaauugcaugugaaucugagcuucuguggguguacugagaauuacaguuguguccucugaagacagcaagugccccuaacugccgagccgucuuccagccccauguuguccucugaauacauucuucaugucugccuuccugguccuuugucuaccucagacagagggcauggaccuuucgcuuacucacugcagccugucuuacucauuuucaccaaacagugaauagcaagcacccugugagcugcagggugagugaaguuucuguuuucuccccgauaggaaggagcaaccgagcuagcaauugaaggagaagaaaacgguacugauguuauugagagcgcuucacaggagcaaccaaaucaugacaauuuaacccgugcugaugguuggcacaaaaguaauaaaaguggugaguuagugacuacuuccaaacauuuccaugcuuacuguuaaaaagcacugaaggguugagcaccaaagccagcaucuguuucuucuaacuacucuuccuuuugcucuucuuuuuuuuuaauuuauuuauuuuauuuauaugagcacacuguagcugucuucagccacaccagaagagaacauuggaucccauuauagaugguugcgagccaccaugugguugcugggaauugaacucaggaccucuggauagaacagccagugcucuuaaccgcugagccaucucuccagcccucucuugcucuuccuugcuauaccaauuccgugugaagcugcuuaaccaccaaaagcugucaucuuuauucuaacuuuguggauauagauaaacacacaugaguuuaaaauucaggacuacguguuuuaaugaauauguaugcaacuguguuuuauagaaaugaugucugcauuaggauuaggagaagacgaagaugaacacucgccuugggauucugagguacggacaaugcauaacugcagcuacucacguucucaccugcacgugccuuugaggggcuguuuccucgcaucuucaauccauaaauaauacuucuaaaccaaggacugcucgaaccccaacccugcucaucuguaugcuucagucagagauguagaaggcagaggaaccacuuuggauuaaauuuaagugcaaauuaaaaaguccgucaaccugugaccugaaagauucugugauagaugugggugugugcacguccaaugggauucugagggaaaggguaaacugaguuuuuacccuugagaccugaaacaggugggacuuggggugucauucaaccucgguuguaaaguauaaaaccacaagggagaaagaaaagaaucaguguaacuuuguagcuguagugauuuugguuaaauuuguuuuaaccuaauucugcuguaauagauuuaaauugucuucagacgugaagugcguuuaguaccaguguacuguccgucuguccauaacgacccauuuuaaugacaccaccauagaaagaguugggggcggcuuggaagugcagcagccgugcauacuggaacuucacagucaaaagacauggccauccuugguucugacauuuaauauuuauagaauuuggaggaaguuaaccuauuugagugucagagacuguguuugccauaaagacaugagacgaaccaaugaggugagaagauaacacauccugugaggagugacauuccuccacucauguggcagcacccauauggcagcacaauccuacugcuccuugaaaugaaccaaagagacguagugucaaggaaaggauggaaaggugcagggccacucagaucuucauucuggaagucucaagaaauuacccauugagguaacccggaagauacagcgauucugugcaugaggucuuucccaagaggccuuaaaugcuuugcccugaguaaacugugacugaguuaccgcuauagcugaagcagcuagacacucgguaugacaaguggaggaggcucaguguuaguguagcgauagaacagaagaccacacagcugucagucagucucacugcaucagcuaaaggaaacaggagggagucuggguuucagguggaguugagguggcauuauuagggcucugucugaggaugacauucaaacucccaacuaaaggaggagagcagcagccagcccaugggaguugagaacauuccaagaaauggugaaccgaguuuguuuaucacuuugcucuaaauguccaaagacaaagcaugaaguugaauauucauuuauauauguauagucuauacaaaauaauuccuuggcgcauuguaaacacuuaggcauuuuuauguucucucuuguucaagcuuacuacauauuuuggaaguucuuuuugauuggaagggaucacauucugccuuugauguuugugggcuuuuauuuauacaaacagaaaacagguucuuuaucguucuagucaaccaauuuuugcuggcuguaaaaguuucacacaaaauuacuuagauuuuuccaagccuugguuuuaccuaaauauagcaacuuuuuuaaauuggauaucuuauuuguuugcauuucaaauguucuccccuuucccauuuucuccucugcaaacccccuaucccaucucccuuacccugcuucuguguaggugcucccucacccaucuacccacuccugccucaccacgcuagcauuccucuacacuggggcaucaaggcuucacaggaccaagggccuccccuccaauugaugccagauaagcccccuucagccucuucaguccuuccucuaauuccucuauuggggucccugugcucaguccgauggcuuaaagcaagcauccacaucuguauuggucaggcacuggcagaaccuuucuggagacagcuguaucaggcuccugucagcaaguacuucuugguaucggcaauagugucaggguuuggugucuacaugugggauggauccccaggugggacagucucuggauagcccuuccuuuaggagcaauucuugguuaaaauuuugaagauggguggguggccccaucccucaaccaggggggcaugccuaaccucuggauuuggucucaacagguucucccuccccuucguuagguauuucagauaauaucaucccagugggguccugugaggcucuggcuuuccuggcaucugggacuuucugguugcuacucucaguuccccaucccccauugcuauacaccucuguucaauuucaugacccucuguaucuccucuaucuccucccauaccugauucugccccucuuccccuccuccacuuuuccuccuaagucccucccacccucuauuucccuugacuauauuguucacccuucuaaguaggacugaagcauccacucuuuggucuuccuuccucuuaagcuucaugugguccaguccauguguuguauuguggguauuccacccucuuugccuaauacccacauaccauguguguuuuuuugugacugaguuaccucacucaggaugauaguuucuagauccauccauuugccugcuaauuucaugaagucauuauuuuuaauagcugaguaguucuccauuguguaaauauaccacauuuucuguauccauuccucuguugagggacaucuggguucuuuccagcuucuggcuguuauaaauauggcugcuaugaacauaguggagcauguauccuuauugcaucuuggagcaucuugugaguauaugcccaagaucuuccgguaguacuauguccaguuuugugaggaaccgccagacugauuuccagagugguuguaccagcuugcauucucaccagcaauggaggaguguuccucuuucaccagauccuugccagcaucugcugucaccugaaccauucugacuggugugagguagaaucucaggguuguuuugauuugcauuucccugaugacuacagauguugaacauuucuuuaggugcuucucagucauucaaauuuccucaguugagaauucuuuguuuagcucuguuccccauuuuuugauaagguugcuugauucucuggagucugacuucuucaguucuuuguauacuccaacuuguuucuugggaccauuugcuuggaaaauuguuuuccagccuuuuacucugagguagugccugucuuugacacugagauguguuuccuguaugcagcaaaaugcuggguucuguuuauguauucagucuguuagucuaugucuuuuuauuagggaauugaguccauugauguuaagagauauuaaggaauagugauuguugcucccuguuauuauugauguuauuuuuauguuugugugguuaucuucuuuuggguuuguuaaaaggaaauuacuuucuugcuuuuucuaggguguaauuucccuccuuguguuggcauuuuccaucuauuauccuuugucggguuggauuugugaagagauaauuguguaaauuugguuuuaucauggaauaucuugguuucuccaccuaugguaauugagaauuuugcugcuuauaguagucugggcuggcauuuguguucucuuagggucuauauaacaucugcccagggucuucuggcuuucauagucucuggugagaagucugguguaauucugauaggccugccuuuauauguuacuugaccuuuuccccuuaccgcuuuuaauauucuuucuuuguuuugugcauuucguguuuugacuauuaugugcaggaggaauuucuuucugguccagucuauuuggaguucugaagguuucuugaauguuuaugggcauaucuuucuuuagguuagggaaguuuuuuucuauaauuuuguugaaaauauuugcuggcccuuuaaguugaaaaucccaauucucaucuacuccuauuauccguagguuuguguccuggguuuccuggauguuuuggguuggcuuuuuuguuuugcauuuucuuugacuguugugucaauguuuucuaugguaucuucugcaccugagauuuucucuucuaucucuuguauucuuuuggugggugaugcuugcaucuuugacuccugaucucuuuccuagguuuucuaucuccaggguugucucccuuugugauuucuuuauuauuucuauuuccauuuuuagauccuggaugguuuuguucaauuccuucaccuguuugguuguguuuuccuguaaaaaaagggauuuuuguauuuuucucuuuaaaggcuucuaucuguuuacauguguucuccuguauuucuuuaagggaguuauuuauguccuucuuaaaguccucuaucaucaugagaugugauuuuaaaucagagucuugcuuuucugguguguugggguaucuagggcuugcuguggugggagaacuggguucugaugaugccaaguagccuuauuucuguugcuuauguucuugcccuugccuuuugccaucugguuaucugugguguuagcuggucuugcugucucugacuguggcuugucccuccuguaagccugugugucagcaaucuugggugaccagcucucucugggcagaauucagguauggagagcuguggcacagggucagcuccaggacagaaauggaaaccggaagcauccuguccccggcuguuccuugguuccuguguccugggggcuccaggugaaucccucuugggcaagguauuugagcagaaguggugguuuuaccugugcucucaggugugucagcacuccugggagaccagcucucucccagcaggauuuggguacagagagcugaggcauagggucagcucuggccgcagauggaaaccugaagcuagcaacgucuacagugccuucuguguaauccuugugacacgcucugacguuucuuacuuuauacauuucugucauuggacauauuugaaggguuucaugcuguauugaagcaggugaacuuacaagaauuucuuaagauaccuguuuuuuuagucaucuucuuacauugcaugaagaaugaggagcagugcuaaguguucuaagcuucgcugcuugccgaagcaugaaaacacguuaauucuuuaugaauacccuccucugaccuuccacgcuugccuucauagcugguaaccagaugaagagugaagguggguuuaaucuagaggaaacacaugcagucuucuuuauugacauguuucuuuucaguauagacuucuuauuuuucuagcaguguuuaaacaagaaacugaagcaucaucuuagaaaaugauuaagaaaucucuguguaacucguuuugaucucugcuccaacagaguaucuccgagagugugucacugaaagacguaggucacuucucugggacugcagaucaaacgggaaaaaggagagcacauggacagauagaagguaagaauggcuucauaguuugugcauagcagcaaagcaucuucaggaggauggugggaggagccauagagaagaagaaacccuagauccuaucaggucugccagccguuaugaucugaguuugauuuucuaauuaauuuucccucuauuaccuuacaaaacauauccaugugacauacaaguauaauaggaauauuaucccuaaagucaaagaaauaaaaaacagagcauggccuuaaaaaguaaaggcugcaguaaaggaaaugagcauuuuaaaaauauuuauuuuauguaugagugcucuaucugcauguacaccugcacaccagaagagggcaucagguaccagugaagaugguugugagccaccaugugguugauuggaauugaacucaggaccucuggaagugcucuucuuagcuacugagccaacucuccagccuggaaaugggcauuuuuaacaauauuuaaguauaucuauaucacacucugagcagcuacacuguauucuccucuuguaccagagucauucauacucugccaacugcuuugaaguucauaguauuuuaaaugauuuauuuuuauucuuuauuuuuuuucuggccaguuugaauccaguuugaauccucuaucaguuucuggaugacagcuauucuaauagggugaagugguaucucaauguaguuuuaauuuguguuuccaagaugaccaggaauauucaagacuuuuaaaaauaguucuugaccauuuguguuucuucuuuugaaagcuguccauuucauuagcccguuggucguuuuguaguuuugcuucuuugguaugcaacuucugcauuucuuuguaaauucucaauauuagcccccuguuugaacaguugguaaaguagccuucauauguaucauaacaguauacucucagagaaagaaauuaaaaauaaaaaacacuuacaauagcuuagaggaguuaagugugcauggaauauaccuaacuaaaaaaggagagacccuucuagugggaaugucaggacccugagaagggaauccaggcagaugcuguggauggaagagcuuccgcgcuccuagacuggcagaauggcuauugugaccauggugccauguuggaucaacagacuggguuuugaccuugggaaucuuuaauuuuaugugcauugaaguuuugacuucaugugaggaugugagaucccuggaacuagaguuagagacaguugugagcugccgugugggugcugggaauugaacccaggccuucuggaagaacagccaguacuuuaaacugcugagcccucucuccagcccugacaugaggaauucuuaauaaccuuucauuauagcuaccuuacacccagcacaugcuugaagguuuaccuuuucaaaacucuucaggacaaucuuuagccuuccaauugcuuaucaccuguuuuccuuuucaaaaaauccuuuccuuuaggccuccuaguuuaccacacaaagccuuuucauauucaaaagcguuucuuuuuccuuuaacaguuaacccaaaacaaauuuucuaaccuuuacauccccucuucuuucugacuguucuuucagucuuacuguuuuuacauaauuagaaaacauuucuaguuauauucuaagugaaacccaagaaguuguauaggagacauaggauccgugaauauuguguuuugaauauguggcaguuauaaauacagacuggucaugcuucuaguuagaaaguucaaaagaaaggggaaauagggauuauaauucagaauuauaauacagaggaaggaagguacuggaauaaucaguagaaaacauguaagaugaaagccaugcaugugaaggucuggaggucacuagaagagaagaguaacuuuuguggaaaggagggaagcagccgggcgcugugggagcugacccgggguggggguggggaugcuaaggaacucaggcuagacucuugcugcuucgagguguuacuggaauuuggaaacagaguuagaauuugauuuacucacagaugucaucugaacaacuaacaggcaccugagacucucauuaauauguuacuuagauuauauuauuauuguuauuguuguguugcugucuuuugagauaacugauuuuuuuuuuuuaagaaguuguuguuucaugaaaaucuauuaaagacuaacauaguuaacagcuaaaccaaacugauuuuaaagcaaagcauuaugguucauuucuuaaguauuuuaaauaaauauuaaaccaaucuugaaauaaaaguguauuaauaucucugguucuaguaucugaugacucagucuaaaacaugugcguuauuucuuagaugugacuuauauaccuucuugcaugaguggaucaagaagcuuuaaaauggcuaaacuagaggagucaagaaauguaggccuuccgguagcccacauggguauggaaaaaaaugguauuuuuauuaacuauuauucuacaaguauaugucuaaaucuaauugauuuuuaaaaucuucucuggcaggaaaugaauugugcauuccacugaacuuucuuaucuuucugcuuugcaaauuauagggcaaacugaaaaccaugaugaaugcuuguaguauaaugugaaaaaccauucuggggugcugcauuaaagacacgcuuuuaccaucgucucugcaguggaucuucacagucaugacuugucgcucuaacuaacgaucauguuucugucuguucaucagcaugcucacuuuggugaaaacacauguuucuguuuuagucacggucacuggacacgccucgcuuugaguccuaacugcauguuuugucaaacuuacucucuuguuuuucauugaauagauuucugauacauggguggccuuagcagagggggauagcagaacugaucauuuucaaaugugucaugaggguucagugccauaguaacugcauaaaucgaugguuggcuuaccauauuuauauauaauaaauuauacauuuuccuuuugcuuuucagaggcccccaggaaauaugcaaucauggagguauaguaauguuuuucaugaguuuuuacuacauguuauauggaguacacauuuguuaaauauuguuuucaaauccauccagccuaccaucgaaaggagggcuccuguucugaacaaaacggagacagugggaaugacggaugcacagacuuucaagucagguaaauugugggguacucuaggggaaggcgcguugcacauuggaaaugcucggucuuaugguuccuaaacauuuuuuacucccuauuuuauuagaaagauuugaaguaaauaaaacagcauuguuauugguaccugucauugguagguaccacacugucuccuuuggaagccaggaguuacccgaauuguuuaggggcuucaacuaagucagucucuggauuuguggauucgacauaggaaagaauguucagacuagccaggaugaaacaaaguugagguuuuugcuaaaaguagagaggaagacacucaaaugaauaaaagcccaucugaacaugcguaugacguuucauugagcuguggcuccuaagcagaggagcuaagagagacaugugggaaagaggauaugcccacgagugggugugagcuucuaaggaggaccugacugagugugggaucauuagccauaucgcuuugguggcucucaaguuacaucucaaaggguuguuuagaaacuuugauuuuuuuucuuauauuuuccucuuguuuugauaaaugagauuauaaauugacucugggucccuugaaugaaaaauucaaaauucaaaaauucccguggaaccuacauuaaauagaauaugaguaucuuauaagacuuacuagagcaauauaucuuuauaccaucuuuaaagcaguuaauucaaacuuccacuaauaucugccuauaggaagcagaugguuuuuaauuguuaagcucucugccuagagcagccauccuguuauagcaucuaucuguugugcucucuaccuagagccacagacauuuaucaauuaacaccuguucuuagcaggcgauuaccacugcucucucuacuuggagucagugacuaauauucccuaucugguuccgaacugcaagcgaaaaugcucugauaagguaaacgagggccaugcaaggggguuauaucuuuuaguguaaauaggacuucuggugagaccucuaccagguuuacagcugagaagacagaagucucuaaagcugugguucccaaccuuccuaaugcuuuaauacaguucuuuaacacagcccuuuaauacaguuuuuagguuguagugaccccaaccauaaaauucuuucauugcuacuguuaugaaucguacuguaacugucugauaugcaggaugucugagaugcagcucccaugaauaggucauucagcccccaaagggguugugaccuacagguugaggagcaugacuccaaagcaagugguaccuaggcuugccucugcugcucagcuggcuggccauguaaccacauacuguaguggcuucuuucuuuucucguguccccauaauugucagugucugucacucuucuggacuggguggggcuacaaagcccacccccacagugacacacuuccuucaacaaggccacacccccuaacagaaccacucccuaagggcaaagcauauucaaaccaccacaaugucaaaagacuagaggacuuuaguggagaaaugguucuuacaguuucaucauauuuucccuuuuaucucaaaaaagcuuaacucuggccacucugcuuagaaaagaaaaaagaaacaaauauuuguuguguuuguauuuccugucuccuguuuauccacucuuugauuuuauguggaacaagacucauucuguuuuuacaugggagacaggaaaucacuuuggaaaucauuuauucuuaaauuugugauguuuauccuugucuuaaaaggggaacucugaaaauacuuggugugcaucaaacaaguaguacuaauagaugaaaagaggauaaauaauugaacaucucugaaugaauaggaaaagggauaggugacauagaguuccacagaccaccccagucggguaugggggucccuggaaugagagucuuugaagcuagguggguaaggauccagcagugacaaacagaaacaaacacagaggcaguuugaaucugaguguauucugcagcucucaagcaggggauuuuauacauuuuuuaaaaaacaaacauuauaucucuuagaaacuauauccagugaaacaaucacaaauaccaacaaaaaucacuuggcacaauaaagcacaaaaaucauccaagcauuacaacucugaaacuauguagucagugaaucacaaacagaacagguaacaucauuauaaaucaucaaaauauaacaauucuaaaaggauguauucagugggggcuaucauccaaggcuaguggcauauuuccaggagcagguuaauaaaucuuuaacagucaguguucuuaauugcugaacuaacucuccagcccuguggucaauuauuauuuaacaucuagugccugcuuuuuuaaaauaaaucuucaaugcauaaauuuaaauuauuuuaauucuuucuaauuaaggcuuucuuuaccauauacuaaaaccuaccucugaugacacacauguagacauaugaaauuuuauuguugggaaguuuucaucuaucaucauaguuuuguaaaugauuuagaaaguaaagcguugguuucccuggggauaaggucauguuagugaccccaucucuaaggaugguuucuuacccauuauucucacuuaagaucuuggccuagguucccaggaacauguaaauaagaaaaggaauaagagaaaacaaaacagauagacugcccugagaacuacggcucaauauuuuuucuccggcaaagaguuccacaaccgguuccaggaggccuccccauuuugaggucaaucgccucagucuguggaacuugucacgcagauccuacgggagguggcguggcaguagaguaacccauggugucgagcuugugaggcagaggaggauauggggcuucuucaaggaaaacuuugugcacauuauauuuguaucguuuauguccuaagaagugaaaacguuauacucagauauuucagauuguaauccugauuugaccuugucuaagacucaucaaagauuguguuaacgugauaauaaaaaugaguucauagcauagucagggucaaaaacucaggugccaugcacagaacuugcaaagcuguccccaggaggacaugggaugaugaauauugaauguaucuuuuccauuagaaaauuauauucugcauggcuugugugacucauagaagacagaaaacagaacaaagaacuuucaacucuagaauacuucugccuaucuuuauaauacuggagauaucauuuucacauauuuuguuagcauuguaaaugaaugaauuccuucaacauaggaagaugugaggccaaacuacaaagugagcacagcuaacgaauuggguaguuucuuuuugcaugauacuugauacuuuuugcaaugaaaagacuaguauuucagaacucaaauuuguacauuucuuuguuaaaugaaauuuuguucuauccuaggcccagauaaugccguguccuaaauuuuucuagaaacagucccucuguccccuuuauucugcugcuguccucuacugauucauugacuucaguuccccuggcccucacacuuagcacccacugcucccaccacccuagggcacuuggcacucugccaccagugcagaugggaucauaaagcacccuaauguuagggccacacaguuaccugcaaaaccucacaggccgacuucugcccagcucucaaucuuuaacucuuccuucuguuucucucucaugauucugacauuacuacauugcugguaauguccuuuucuuaccgucccguuuggcaccgcucuuacacugcugccuuucuugaacuaaugauccuuuuccgcccuuuaucuggcuaaccuggugguuuacccuuaggaaagccguccuucgcgccauucuuuaaaugcuuuugacuccaaagccuggcauuuaguaggaacucaaguacugguucccaaggaaaauaaaaaucuuuauaugcagaugguuuuuaaaaauugaccuguccaauacaggagcaaaacgaauauacauguaaggaggggaaugcagcucaagugguaaagauguggcgggaaaauugcuaagacagccccaagaaagcagcaccuguuagccagugacgagaugccucacagcagcggcuggacgcauucagauguaauacaguguucagccacgacgggcauaagagguaacaguaauuguggaagccaaagucacugguagcgcacggaauugugugcccuuugaguuuauguucugugagucuggaauuucuaaugcuccuccucgggguguauuauggugagugaauuugugcaugagucauugagauuuuguauguaaugauuuuggcuccagagagugucugaaugauuuguagaaguuuuggauaauuaggaguauuucccuaaaguaguaaauauguagcuuuauagcuaaggauuaagugugacuuaaacucuuaaaagcaaauuguuuauuuuucuagguuuauaaagauuuuaucuaguaaagaaguuuauuuuaacccagugugcgcauuugauuucagagccagaaucaguaucaagagaagaacagacaaggcucaguggcagcgaggacagccagcagaagguacgugaauguugcaagccggccugcgacuuacaaggaccagguacaccagggaggcaggcuagggcugaaagagacuuagacagcgagagguuaauggagccaagacaagauucuguucaaagcccccacccccuuauaaaaaggggaaggcccaucccccgccaguccauucuuggugucuggagccagccuguaggcgaugugcagaauucccauagaaaaagcccaagguagacauguguguugguaacugcagcaccgaggggcagaaguagcagagugugggagcucaguaaccccacaacauaaccuuugaacuauucgcugagccagcauauaaaauaccuccaucgccuggcagagaaucacagcucugcagugaggccucgguacugggcuacuaggugauacgcuuuaccguucuaauuugauguaucgucagaaccuggcaaauacccuaaauggcuucauccaccaucuuuauugaacaggagacuguauuagaacuggacuuaauacaaaugacuacacuguuauaguuuuauaauuggaacuaauguugcucuuuuuucuaaucaguauuuauugacuuuggcacuuaauaaaguuugccuccucucuaaagaucauuuggugaucuuuagaaagaggacuuaagcuacucuuuagcgugugaugagguaaggcuuuguaacacuaaaaaacaaaacaaaacacgacccucguaaucuguguuuaguaaguguagcacagaguccaguguggugcagucagucaguaggcacgaugagucugcugggucacgguguccacuguacacugaguaaguuagcuuuuacuucuuaguuacaguccagugacuuaaaauuagcuaaagcccuucuuacugguaagaucucaacugcuuucuuuguauauacucuuuuauuauuuaaaaauaaaguucuuuuaaaaauauacagccuuacaguaagaacucuuuuuaaagauuuauuuauuuauguuuauggguauuuugccugcauguacauuugcacaccagaagagggcaucggaucccauugcaggugguuaugagccaccauguggguucugggaauugaacucaggaccaauagaagagcagucagugcucuuaaccaccgagccaucucuucagucccagaaagaacuccuaagaauaaaauucuguguaacguuuucuuucucaauaugcaaaacgugggacucgagugucaaacgcaaauccuggcuaaacugucacgugauagagaucaaugacaacuaagagcuuuuaagaaaagcaggaauuccuuugccauugaauaaugacuuuuuuuuuuaagauuuauuuuuauuuuaugugugggugugucuggccugcauguacauauguucacccuggugccuacagaggucggaggagugcacugggucccugcagcaacagguccagaugguugugagccaccacgugagugcugggaaccaaucagcgcucucgaccccggaaccuucucuucagccccucccacagaaagucuuuuuuuuuuucuucuucuucuuuuuuuuuuaaaucaagucauccucuguccacuuuacauuaaagguugaagaaaagagaaaauacaaaaauaacgaagcagaacccucaggaaaucuauacagcggugcugcugacggcggugcugauguaaagccacagaguggagacacugagaaccagcagucuccccgggaggggagugagggacguggcagguaagagugggcaauauuuaacauuguagagguguuacuauaaaacccauugcaauuuaauuugaguuacuauucauuuuuaaauaaauguugugcauauagguuaggcauauucagccuuacaugauugacagaaaaacauuaaaggacauauuuuuuccaauuauauuaauauuuuguuuaaaaauauauacaaaacauauauaagauauccuuaacauacauuauguuacuuaccuauaaugugugacacaguauauaaacauccuuaacauauguaugcauguaaguauuuauaagucaugguuuuuuuuuauuccagaaggauuugaucccaggaaugaagcuauuaacugucaggcuaggguguauuucagaucaugauacaugcuauuaaacuaucuucaaaaaguauuuacuaucuccuauaguaagaauuuugguuucuuuaaaauucaguuauguuaugugaauauauuucugguuuuuaaaauuuauuuuaaaaauuuauuucaagaauggcauacuauuuuaauauauuauuuuaacaagucugggaauuuaauccuuuuugaagagguacuauuagagauuaauaauacauguuaaggauuaauauauacauaccaaauuaauuccaguucaauacauuauaaauauaauaaaaacaaacuacucagguaacugauauauaauauauacauauucuuuuuucauuuggguuugagugagaauggccagcauuagauuugaaauguuauuuucuuguuagagguccaucacugggagugacuuuugagguuucaaaagcccauaccaggcccagucucacucuuuuccacugcugccugucagaauuguaccaaaauugcuuuucuuuuauucuuugucaguagaauuauuuuuaaaagacauuuuuuuaaaaaaugauuuguuuuuaaauagugguccugccuugcuuaugaaggaagcaaagaaaauggaaaaugaaaaauggguauccagagagcccgcgaggacggcaaugagugagcgcaccggcuuaccaacugguggcuggccacaaaugcaggaugguuccugcuggagugacacggaccaaagugaagccagguaaaauacucaucagauuucuaugcugggaacgauaauagaaauguggguacugacugauuuaauagucuucuuuaaaaucagaauguuuguguaguuucagggaugacccagcagagcugucucugcuuaccucagugucgcuggguuuguacgucuaaguuacugacacuugacauuuucaagccaggugugguagcacagcaacucugaggcaggcacaucugugaccuaggccaaccuggucuacagagaguuccagaacagccaggauuacacagagaaacccugacucaaaauaauaacaacaacaacaacaacaaaaagauuuauuucaaaacuguggagguguaagguuuuuuauuuagaaaauguuuacaagauucagaaauuaaguuacaaguagcaguaaaauaauaaugugaauucauuugccgcugugucaguauaaaucccuuggagauagauaggccugugcucacacuguguagcaugccucuggguuugcugggugccaugguuugaauaugcuuggcccagcgaguaggaauaguugugucaccguggacaugggcuuuaagacccucauccuagcugccuggaagucagucucccacuagcagccuucagaugaagauguagaacucucagcuccucuugcgccaugccugccuggaugcugccaugcucccaccuugaugauaaugaacugacccucugaaccuguaagccaaccccaauuaaauguugucuuuauaagacuugccuuggucaugguaucuguucacugcaguaaaacccuaacuaagacacugggccugccacugauccgcuguguucucuagagcuuuucuuugccccacuuuguaaacugccuacugcacuuuaaccuuucucacaggauugugaggaccacagugagauuagcacaugaauagugcuuacagugaugcacaguaauuguagguccagaaaaggcuacauuuucucaucauuaaaaaacaaaaaacaaaacagugucucugaggcuggggagaugagauggcuuagugauuaaaagcugaugugauggcugcucuuccagaggccugaguucaauuuccagcaaccacauggugguucaugaccaucuauagagagaucuuaugcccucuucuggcaagcggauguccaugcacucauacauuaaaacaaaacauuaauuaauuaauuaguuuuaaaaaacuguuuucaguccagguaugguaguuuaugcuuguaauucaaggcuaaggcaagaggaucacauaagccagccuggaacacauaaugaauucuaggcuuaccuagucuacagaguugucuguuauaggcagaacuguaagacauuuaccuuaucucaaaacaaaaugguuuccuauguaagaacuucugaaacacuuuuuauauagguuguagugccuacaaaugacagugacaaugacaaauggggccagcaauacagcuuagaggaugaaagcacuugccaccagccugaggcccugagucugauaucccagaauacacuggcugcaggagagaaccacucauacacauugugcucugaccuccucccuugcacuauaacacacauuuuugcaugugcacacacacauacacacuagaaagaaaaguaaaaaacuuucuugaugaucuuuuucuaucgaauaaagcagguagcauguuuuuccuuuuucugugaucaucagaacuucgaccgaaguuuaauucuuucuagccuggggauauauggcucagguaguagagagcuugccuagaauacacagaacccuguauuugaugaccaacaacccacugagggccuuggugguucacaguucagaccccagcucugggggugaggcuggggcucaagaucauccccaagugaauaaaucaaguauauguguguuucacuuucuuacgauaguaauaauuguuuuuuaccucuuacuuuguuuauaacuaaacccccuacagaaaaugauuauguaaauaaucuguaaacuuuauuagugaaagaaauaaguuucaaauguagagguuuuauauaaaagucaauaaucuaucuuauauauucuucucuuuuuuuugguuuucgauacaggguuucucuguguagcccuggcuguccuggaacucacucuguagaccaggcuggccucgaacucagaaauccgccugccucugccucccgagugcugggauuaaaggcgugugccaccaagcccggcuuauauauucuuuauauuuaacuuaacauuagucuuaaaggauucuuaaugguuuuguuuuuuuuuauuuuaggcccacaaagaaaacaucuaguaaacauaacaagguaaugugaaaagaauaaaaaacaauaauuuguuuuaaaauaugagauguauuuaaaaauguaaguuaaaagauauaaaagacaaagugaaaacagaggaccuugucaucagguaacaaacaguggcgguugacaacaguguccuuuugacuacaauugaguucuuuuagaaagugccuccuucugcuuguauaaacagaaagcuuguuaucuuacauguacgguguaagcaucagggaacaguuuaaaaucguguuuccuuuacaggacagcgggcagacagcugcaguggacaaccuugacgacuuuacugagucgucugaaacagccucugaggaccaugagcuccagggcccugauuccgagagcauuuugugugcgaucgagcaucucagacuggaguguaaagguauggccaugguguaaauggaaggccuuguuauguauggugauguaugccacuuagcucagcauugccccucgacccuggauguguggcaguacuguuccuguacugaggaguguuucgagagagaaguacucguuagauaacauaguaugugagcugcucaauauguacucucagccaaagcugcagucccucucacgagacugacacauccaguguuuuuguucagcuugcuuuucuguguuucaguugucuuagauguugcaguagaauguuuuguuuuauacaguuucagcaagacauauugauauauagaggguaauuugguucauuucaacauauguauuaaacacauauuuaauuaccagagucagccuaguuaacagaucuauugaagaagcccccguuucucccacacucucuauuuaaaagcugaaagauuguucucuagcaugucccccguucugucuuccagaccaugagauaggagagauccagugugugugugggugggugggugugagugagugagugugaguguguguguguguguguguguguguguguguguguguguguguguguguucucagaaacacugauuaucaguauuuuaaaucuuagcuauucugacagcugcacaguaugcauaucaugcuggucuucauguccauuacacuacuaguuaacgucaaacauuuuccuuaacgucaaacauuuuccguguauuucuuuuccauuacugugucuuugaugaacuucuuucuugaucuguguccauuaucuuguaaauuguauuuguccagccugacuaagcagaauagacauuauucuuauaggagcgguggaugagauuucaucuaaucuuuucagauaguuuauucuuguuuaauguaguuucuugcuguucgugucuuguucaguuccuugcugaguacuccaggcccucuauagaccugauaaagggucuuuaucuguguggcuggcuccucucuggucuguccugugaucucaagcugucuuugauuaucagacucugaacucauucaccucaacucagcaagucuagggagcucuacuucaguucuuuguccgugagugguaagagagucaggcuugggauguucauaaauuucauuugucuauuaaggaucauugucgugagaauuauuuaagauauuuuaucagucuccguuuguguuguuucaagugggaacauggcuccacaauuguuaccucauccuggcuaaaagcagauugaaauggaggcucauuaaaugcuucuuguuuuucuguuuuaaaucuagcauggaauguuugacugaguuuaguuuaacaugaagaucuccaguucuauccaguuuuauaagaacaaccccauuguguauaaauuacacuuuuuuuuuaaagcugaaccagggcaagggucgccuguguuauuugcagagccuaguguaauguguuccucauuguuggcgcuuagugugagugagugaacgcaagcaugcaggcuuuuucuaauaugcacacucauuuuaucugucucuuauuuuuccucauucagauacugcuagucuauugaaaauccgggaugccguuuauucauauaaacgauuaauagaacuuaaaagaagccacugugaacuacuuacaggaaaacugaaaagaauggaaaacaaauauaagggauugcagaaggaaaugucagagacagaagaagugaagucacgguuggaacaugaaaaggucggaugggaacaggagcucugcaggcugaggugugcugucucugucuuuauuuauuacuguuuaauguucuguuacacucacucacucauaugcgagcguauacaccuuggcaaguguguggaagucgggugcuaaugggaguguugaucuccuuccgccaugugggucccagagauccagcugaaguagucuggcuugaucaggugccuuuagccucugacgcauguccccagccaugauagcgcagcucugaaagccuguuagagccuuuucagcagccuguucugcagauagugagaugaucaugcgguaggcuacauugccugauuuacauagguugaacuauccuuagaucucugggaugaagccaacuuaaucaugguggauaauuuuuugauguguuuuuaauuugauuggcauaucuuaaugggaauuuuugcaucuguguucgucagguagacugauggauacguuuccuucguugguguuucuuuaucggauuuacuaucagugcagugccuccuucauaaagagaaucuccuuuuaaaagaacuuacuuaauuuaucuuccuuuucuuuguuauagaauugauuuuaguucucuaaagcugugacaggguucugcggaggauucaucuggaccuaggucuuauucuuguuuuggucucauugcuugugggggaucuguuacauuuuuaaaucucuuuaugacuuaauguugguaugucacauauucaucaguuucucucagauuuuccagcuuauggaauaaagauuuugaaaguauauccuuauuacccuacggauagaaaaaaaaauauccauuuuuguuuuuaauuuuauuaauuuggauagucuuguuuaacucggcuaaagcuuugguguguguguuuuauggaauuagagggugcugucuuaagauguaaugcuuuagggaggccugaaauauuucauaaagauaaaaauuuuacuucugauacacaguguaaucuuuauuuucuauuuuuuaaagaguuauuuauuuauuauaaguacacuauaacugucuucagacacauuagaagagggcaucagaucucauuacagaugguuaugagcuaccacaugguugcugggauuugaacucaggaccucugggagaacagucaacaagaacucuugaccacugagccaucucuccaguuccccagucuaauccuuauaacuaauaccuuuuaaacaauuaaguuuaaauugccuguuuugauugagaaguaaauacaauuguguaaagauaucauuuccuuuuuuaaaaaauuuacuccaugaguuuggaaguuuuguccacauguauaucuguguagugcagugccugcggaggccagagagggucaucggguccuuuagaacuguugcuauagaugguugugaacugccauguggaugcucugaacugggcuggaguccuagaagaagagcagccagugcucuaaccacugagaaaucucucccuucaaaagauaauucucaacuuguaacuuuacugaaugaguucagaauuccuuuuuaauaacacuuaccagacuucuagaaacuugcuaauuaaagcuuuuauucauccuuauuaucaucaagagcauaugggcuuuagaagagauuaacagcagagaaguuuuauuaggguaguccuuauaaaggucacaggucacaacguguugagguccaggucacaacgugaucucuguuucuauaaacaaguuaauuuuaaggugagcacauuuaauuucagauuugcacugaaacaagaggaagagaagaggaggagugcagaccagcuuucugagaaaaccucggagcagcuuagaaggaaaggcgagcagugucagagugagguggaagccaggcagcagcuugaagccucucucagaacccuggagauggagcugaagacggugaaaagccaucucaaccagguaugccaaucccugguaaaagugucucucuuaccuucauuuguuguuaucuuaauguuacuuuaauuauauaaguguauucacacacauacauacacauacguauaucuccaugagccacuugagauaugucguuuuccuuauuaugcaaacgucaugagcuucaucacuaguuggcgugauuggguggggcugccgggguguauacagcccauugugggccaguggcuccuagugcugagaguaaaucuuaccuagagagcugaaguuauucauugugacucucggaaacagacggguuuacauaugucucaaagugaaguaacggaaggcgaguuuaaucuggaaaauaaaguuaguuuagcacucuuacaaacaaaagcugacuuugaaacuguuaaaccuaguuaaauguuuguaauaaacucuaguuuacaauauacuuuccaccuguaggaaguggauuugcuuuuuaagcaauuaaacuauaauaggcaguacaaacuugagugcuuugugugggcuccucauguuuucauuggcugucuccaguuuguuuuuguuguucuagcccuaaguaagcuuuuagauaccguguccacagcaggcacagaggccugacacugaaaacuucaucacuguaucucuaggucuuagaggaacgaaaugagacucagaggcagcucucccgagaacagaaugccagaauguuacaagaugggauucuugcaagucaccucugcaagcaaaaggagauagaaaugacgcagaagaaaaugacuucugagguauuuucuguagcuuucaaaagauuuauguauuuacauauuuucagaaccagccuuauagaccacagaacacauagaggauuucugaaccauaugugugcauacauaauaaaccuguuucaggagguuuccugcugucugaaguaacguaaagaaauaagugcuuugugagggagcaguagccacagcuucaggggacuggggaauucugcagcuuguaauuauuuuuuuuuuaaaggagagaacaaucgucuccugucuuuuuuuuuuuuaaacauuuguuuguuuguuuguuuguuuguuuguuuguuuuauguauguggguacauuguugcucucuucagacacaccagaagagagcauuggaucccauuacugauaguugugagccaccaugugguugcuggaaauugaacucaggaccucuggaagagcagucaauguacuuaaccacugagccaucccuccagcccagcuuguuauauuuugaaucuuuccuuuucgcagugguagugacaauaauucacucacaugugcagacauacuuucuuguuuagugcuuauuuuuagcauuuaucaauaaaugugauuuuagugacuaaaaauaguguuagaaaagucuuucuggauaaaaagaacuaaaagcuuugggaaauuucuucuguguaaaugaaagaacuaagggucuuauuauagacugauuguuaucaguguaaaccugauuguguguucauauuuguuugugggcacaugugugcauguguguagggguuaaugggaccugaagccuguuguaauucagagaacggcuuuucuagugcuaaguuucuuacgaaguauuucucucuuaauuucauaaagucauuguccucuauuacauuuaugaacuuuuaggaauuauacuacuauaagcucagaaauuaguuuauuuuucuagugguuauaugugucucagugcugaguucgaagaacuacaugcuguucuugaauucuauaugagauuuugacauuucauauacugcuggcuaaaugucucuuuccuuucuuagguuucuguuagucaugaaaaagaaaaagaucuauugcauaaaaaccagaggcugcaggaugaaguugcuguguuacgacuggaaauggacacaauaaaaagccauaaccaggagaaggaaaagagguaucuugaggauauuaagauugcaaaugagaagaaugacaaccuucaaaggauggucaagcugaaugaagaaacauuuacaaaaaccauauuccaguauacuggacagcuuaauagucuuaaagcugagaacacaaugcugaguucuaagcuggacaacgaaaaacaaaauaaggagagacuggaaacagacguugagucguuccgaucuaggcuggcuucugcucugcaugaucacgcugaaauucagacagcaaaaagagaccuagaaauugcuuuccagagagcgagagaugagugguuucgugugaaagacaagaugaauuucgauaugucuaaccuccgagauaacaaugagguucucucccaacagcuuucuaaaacugaaaggaaguugaauagccuagaaauugaguuucaucacacgaaagaugagcuucgagagaagacgcuggcguuaaagcaugcgcagagagaccugagccagacccagugccagaugaaggagguggagcacauguuucaggacgaacaaggcaaagugagcaaguucauggggaagcaggaguccauagaggagaggcuggcccagcugcagagugagaacacgcugcuccggcagcagcuggacgacgcugccaacaaggccgagagcaaagacaagaccauagucaacauccaagaccaguuccaggaugugcuaaccagguuccaagcugagagucagcggcacagccugaggcuagaagacagaaaccaggaguuagucagugagugcagccaucuaagagaaagacugugucaguacgagaacgagaaagccgaaagagaggugaguaucaacaaagagaaguauaauuuaaccuuccguuccuucccaucucacggguaugggugugcgccugccuguacgucugugcacugcgugcaugcagaaugauugcagaggccaggugacggcaucaggucccuuggaaugggaggucaugaaccgcacugugggugcuaggaaucgaaccagguucucugaaaaagcagucauugcucuuaaccacugagccaucucuccaaucccaagaaagauaaacauuuuaaaaacaucccaaagggaaauucaaaauaugguuuguuaauacuaagcauuaagucuagcuaaaaaaaaaaaucuaguggcucugcccaaagcugggcagaauccuuuggugcuugaccaaaggacgguaacugaagaccaagcacagaaacacaaggaccucaugaucucccuuaaaaugaaggaucuuaauaaacuaauuucuuaaaagccccaaaguacaauagugguucuuggagcugggggugagaugaggagggaggugugacgggagaugugggucagugggucaguuacagugaagaacaggaagcguggagcuacugaacaauaacauacccuguauuucaacuagaagaaaugacuucaccaaucaguguuugaagccauaacugugucuaacuugauuuaagcacuaggcaguguauacauguaucaagacaguauguauacuauguacaaucuuauguuuuuucauaucaguuagaaaauggaauuuuuaaauaugaguaaauuaaaaauaaaauacguaaaaaaguuucucaagguagcauccgucccugccagccccacugacacacacuauugugugcagugauauuccucagagcguguggaagaaagaaauaguaugaguagauguuguaauauguuuuauaaaauuaguaacaaaugucuuaccagguaguugugaggcaacuccagcaagaauuggcugauacccuaaaaaagcagucgaugucagaggcuucgcuggaagucuccucccgcuaccgcagcaauuuagaagaagaggcgcgagacuuaaagaagaaauuaggucagcucagaagucagguauguaugaauuugguaugccagcugcucgggauggugucagcagacagccuuccucuggauuuucauguaauccaccauuaccuuuaugaugaacuuauuucuuaaauuccacuuugauuuuaccauuuuuuuccuuugauuuuaaagaaugcauuugcuucuugugagggaacaggcuuaagcaugccuccucguuccaguggagggcagaggacagcuuguggggucuguccucaucugccaucacaugaucuagaggucugaaaggucuggcuuaugucaucauuagccacagacaccuuccaccuccacagccaucucaccggccccaucuuuuucuuauaauuucgucuuucuuuaauauauuuauccuugugcaaauugagagcuauauaucguuccucagagauuuuucuauuccaauugagauaaaguagguuaaacucagauucuguuuauggaaaguuccagaaaaucugccuacuuuuuacccccacuuuuaugaguggguacaguaucuuugaaacuuauuuaaugaacuucaagauaacuugaacgauacagaacggccauauauguuguucaaaaaugcagauguuagccaggugugguagcacaccuguaaugucagcuauuuggaggacugaguuugaggcuggccugaaaacaaaacaaaagagaaagagacugaggaguguguucaggugcaggacucgccucgaaaauugaguccuuaugcucaaucccuugggccagaaauaaaucaaaagcaaauguuuuaggauaauuuaaaaccugucuccaaagcuaggcauuacuuugauuuagaaauaaaaucguauggaaauauucagaucauauauaguauucauaucuaaaacaaaaugaaagcagugucuggagucuaccaucuguuuuguguguuugguuuagaaucucuguagcuccaaacuggucuagaaguaacagcaugaagcaggcuguccugcagcuugcagccauccuccugccuccuccucucaagugcugggcuuauaagcaggucccaguaugcguggcucgcaaagugcagcaacaguauugaguuaccauuaacauagaaugcacagcucacauugaaguaaaaaauccucgucgcguuguauuuacagauacauaggcgucagcaccuuucgguguagugaauaaacccugcgccucucaguugucacccuugucccuuugccuuucccagaccuacuaauccucuuuacgucuguauauaauuucuuguuucugagcauuuuguaucauacaauauuuacuccuuuugaacggcucuguucucagcacauugcugucaggccucgguaucucccuuuagcuuccuguugcugcaccaggcuguugcucuucucccuucgucagguggcggauguuaggcugcuuacuccguggcuguuaacgcugccugugcacugucauuugcagggcacuucgcugucuuccgugggguuuaccgccucaguuaccuaggccccgagugcuaccugcauggcuuugcucaugccauguuuuuagucuucuugguuuuuauucauuuuuaccucguuuauccagaacugacucacaguuaacauuuucaugaagcauucccuaaauauacgucacucuuaacauccugauuuuuccauuacucuuaaaugguuuuugcuucuuuggguguuauuuguaugagaagaaaucuuacccuugaauaaguugaaaauguuuuugcuuaauagucauuagaauagaauuagguacuucauaccacuacuucuuuugagaccuuaaguugauuaaacuuuuuuuuuugagacauguauccuaggaucgcuucaaacuguaauauagcugaggauggcuuugaacuucuaacccuccugccucugucucccagaugcuacaguuauagacaagucccaucaugccugguuuaugccuugcugaggcucaaacccagggcuucauguauacagcaaguacuucaccaacugaauuuuaugccucccuggaauaaggcucuuacucuaaaguaccguaaggacuugcauguggagacagcaagcacauaaugugacagaggagaaaugcucugccaaacauuuuuuuuuccgccaugagaaaaaaagucacugcauuugccgccuuucauucuguguccagaguugggaucuauaagucuguaggaggugccagcugugaggcucugucugcagcuuuucugaucuuccuacgcaaaaccuucaugggccauuaggggccuggcuaaagcaacccaacacacuuuugggaguguauugcuuuaaggaccucaguccagccucugguugucuugcauucacugcugacaccaggaaacacaguuuacugcacugugugauccucaccagcugagugguguggagaaaaaagaagcuaaaaacugagccaguggacaaagcaacugguggccagagagauuuccgggagcugcaggggguccuagggauauaguaugggcuccagucuucccguuuccugccauacucagugagauaagccaauacaguuugcauaacggaucuugucuaugguugucauagcaccuaccuaacaucucacucacuggaugcuucaaauauuuuauauucuaauuaaucaucucaguagucuauuggcauggguaggagcaugucccuuucacagaugaagacacuaagauacacaaaguuuauuugcuuagaaucuaucuagcaacuggaggagaugggauuuggacccagucauucuggcuuccuuguggauauaccuccacugaagcuauuucauaaggcaaccaacuaucauuaaaauguuauauucaucauagcugguagaucuaugaucaguugucauuaaaauauuauguucaucauaacuggcagagcuaugacaauuuauagauauauagguagauaacacauaugcauaagaaauuuuaaaaucacacccgagagagagagagagagagagagagagagagagagagagagagagagagagagagagagagagagagaggagaaauucucuuuucuugguuccaccaguguagcugguuugcauaucugguuaguuauaguuaagacuucccugcucugcugacugagcuagccaaguacuaguagacaaugauuuacaaaugggacugucagucacagcagauaucaguaaacuucuguaaagggcugaguaauauuuuagcuuuugagagcauaagaccccuuuugcaacaacucaguuaaaacugccuucccuucagagaugcacaugaacagcacagaucacagguaucccuguguuccuagaaagucguagcacagaacaaagcgugcagauuuagaauagcucauuaguaaagguuuguuuuauucuuuauuccaguugcaggaggcgcgggaucaacacagagaggcuguacaccaugcugagaagauggaagaccaccuacaaaaguacaguuuacacagugugacuccaguguuuaggaagcaaauaagcaauauauuguggcuacugugccaguuaugguagcaguaccucugaagccaggacaccgcuucaccucuaaguuucagaagugcauaccuuuaaaacaggaugcaguuagggguucgaccuuugcaugcagaugugggcucaauuccuaacccacaaaacauagcuagagaaauaauaguuaucaaaucaucuacauuucagacuuuuaagaauuuaagaauuuauuaaguaacuguugauuuucaaauuuugugauauuuuaaaaauuacuuuauaaauauaauuauuuuaaaauauaauuuuaggcuugaacuugaaaaauccaaguucgaaauuacaauuaaaaagcaaucagaggaaauugaucaacuucaggaaaaccugucaagggugaauuugguaagugguccucuuccuggagucuucccugcugagagggagggucucugcucugagagagcacagcagacaguccucugcaguaguacuacagguggaccucaguccucagcaguggugcugugggaacgaacgcacacagugggcaguguucugcagaggugcuaugggaacgcacacagugggcaguguucugcagaggugcuaugagaacgcacacagugggcaguguucugcagaggugcuaugagaacgcacacagugggcaguccucugcaguggugcugugggaaugcacacagugggcaguauacaaagucuugguguuguuuucuguucacacugcuugcuccucacaguacaaguccucucugcagagaaguuggcugaguucauaaguuaauaaguucagcccaaacguuugaauaaaguacugugauagugugcugcuguguacauaccucauccuguuuaugaucugugcacugguaggcuuguggauuagcugucucucggugaagagauguaauguugcuaaggacaucggacagcaucgccccacuagagcuuuacaguaaagcuucuaaugaaaguuauuugauccagacgccugaaacuuucuaguaaucaaagccuuccacugagauuuugaaaaugaauugcuuacccuuuuuauuuauccagaauagauaccagaucaugauauaagcauuuuucccuagggaacuauguuuuccacuuugaauuuaaaaaaaaaaaaaaaaaaaaaaaaaacagcugacacuagaaaaguuuacaagauagacgcauuggacacccacccacagagcuguucucaccgcugaccugagccaccagagucacugugcucuguaugaggaacauacuuuuccuaacacgauaaucuguugaugaaucuaugaggcuggcggaggaauguauugagaauacaaauuuaaguuuaugguuugugucucguguuguuuugguuuuuugagacaggguuuuacuacauagcucugguuguccuggaacucaacauguagaccaggcuggccucgaacucacagagauccaucuacaucuaccucugccuugcaagugcugaaauaaaaggcacucugcccagcucccguuuccuuuauauguuuccuuugauggaaggagagauaugcacaugccaugcccuggguguggcgcucagaagacaacuuaggcugucuccuuccaucauggauuccagggaucagacucaauuggucaggauuggcagcaagcauguucaccuacugggccaccucacugccccugagcauuuuauagcagggcuucaaacuuguuaagcuuauuccaaagugaugacauuucuguagcauucugagaaaaugauaagaauucagaauaugcgcuauguugaagucuucucugugaaugaagaguuuauuaauaaggagccaagguuuauaguuguaaucccagcauuugggagacugaaggcagagaauggccaaaaguuagagccagcuugggcuggauagucagcuccaagccaagcugugaaaaacuuaaagcaaagugaagcaaaaccaaaucuaacugacaaagcccaagugccggcacgaugggucaggcagauaaaagcucuugccacgaagccugaccuaaacuugauuccgggaaucugugugcugaaaggagagcacugacuccugagagcgguccucugacucacgugcacacacgcacaugcacacacacauccacaugcucacgugcacacacagauucacacagauucacaugugcacauacacacagagacacacagacucacacaugcacacucacguacacacacacaugugugcacacacacagagacacaugcacagguacacaugcaaaauacccccaguagacacacaagagaaauaauuuuuuaaucaaguaaaaacaaaaagucuuuucuuucuuuucuuuuuuuuuaaaauucuuuucaaagucugaagaggauaaggaaaaacugcagaaacuuaccgaguugaaggagucucuggaauguacuguggaucaagaacagaagagaagcagugcguuagaaaaagaacuggcagaguaagguuuuacuguuuccgucuucucagccguucugagcugauggaacuaacuguacuagagccugcauacaaauucauuucucucucaauucauuuuucauaaguaaauuacuuuaaaauugacuucagaaacugacgagacugaagguuuuuuccucccuaagauacugcguuuacgcuaagguuuucugagacggugcagugucuuugguguagagugugagcugagcuguucaucagcuuagaggcuucacuggcagcucgcuccccaucucuuuccuuccuuugcagcauccuucuccucaccaucugguuauuucgacaucuuaaaaacuuauaucugagccgggcgugguggugcacaccuuuaaucccagcacucgggaggcagaggcaggcgaauuucugaguucaaggacagccuggucuauaaagugaguuccaggacagccagggcuacacagagaaacccugucuggaaaaacaaaacaaaacaaaacaaaaacaaaacaagaaaaccuuuaucugugguuuucuuuaauuauaucauaaacuaccuuuauauaacuuauauugucuuucucucuuguuuuuguuuuuuugguuugguuugguuugguuugggguuuuguuuuguuuuguuuuguuuuguuuuguuuuguuuuguuuuguuuuguuuuguuuuguuugagauagaguuucucuguguagcccuggcuguccuggaacucacucuguagaccaggcuggccuugaacuuagaaaucugccugccuuccaagugcugggauuaaaggugugugccaccaugccuggcucuuucucucuuuaguuacaaaacuuuauuauggagagaaacuuguuccaugggcaucucccauguguauaugagguuuacaugauauugaacuucagguuaaaauuuuuaaauacauacacauacauagcauauaggcaugccaucccuugcugcuggcaccagaauguagacaagaggucugacucugagggucccucacuccaguugaccaagagguaaaaggaccaugggacagaaggcaggagauuguucaggauacucauacugggaaaaaguugugcugcccugcaauccaagagcaucaggccuaucuagagagggacugggagacgggagagaaauaugcuuguggucagccugggauccaguuaccauuuucuuaugugcuuggagacucuuaccaguaaaguggaugcugucuaggaagagcuugaaauguugucacacugugcuuacagauaguguguacugucccuagaguccgaggaagucugagagggaagguggauuccguucccucggacuuguggugaugacuggagaguccaggcaccacggcaggggccuggaacaugacgcuguaaaaguuggcaucgggcaaucuuuugauuaucuugucccugagcgucuuaacaauguccuguuucucguggcauugcgucuuuagucuuaaaggaggauugccagcuagcuguggauaaacuccugaaaugacuaagguggcugcaggcuuggacaagagcguaacccacagucagggccacagaagggaauaagaacggcgcccagacuuuuaucugcuuugaguuuccuacugggcagccaggggccuaaacgaggagguaggacuuccaguaaaauuaaacugugagucugcuacgguaucuucaggagacuguaucuaggacacccuacagauaacaaaaucggugauucucaggucccuuaaaugaaauaggguacuauuugcauuuaaccucuucccagccucuaguauacugucucuccucucuaaacuacuuaaaauaccaagaauaacguaaauguuaauuaagcauguguuguccucuguuggcuagggaauaaucgcaaggaaaagguuuugcacguguucaguauaaacgcaguuuuuccuucuucaccauuuuuaaugcaaagucaguugaauucuuagcuauggagcccacgaguacacagagcugacugguuagcuccugcuuacaaacgugugcauggcuuaaauaaagcuacgugagcauuuguguuucugucaccgccccaccccauugaaaauagcuguuucucuuaugcauuucuccucgcucuacuccucccaguuccuccccauaucccuucccaucuggacucacucccuuuuucucucauuagaaaagaacaggcuucuaagugauaacaacaaaacauaagaaaauaaacuagagcgagauaaaacagacuguuggauggcugggcaggagcccaagagaaggcacaggagucagagacccacuuguucacacacucaggaguccccuaaaaacaggaaacugaaagcugugguauucacgcaggggaccuggcagacccgccucuucccuguguugcuggucucuuaaaguggaaucuuucccagcguuugcagcuuuucuuucuuucuuucuuucuuucuuucuuucuuucuuucuuucuuucuuucuuucuuucuuucuuucuuucuuuuuuuguuuguuuuaaagauuuauuuacuuauuuauuuauuauauguaaguacacuguagcugucauccagaagagggcaucagaucucauuacagaugguugugagucaccaugugguugcugggauuucaacucaggaccuuuggaagagcagucagugcccuuaaccgcugagccaucucuccagcccuguuugcagcuuuucuguucauuccugagauuuugggguuucugucugauucuaaucaaugcuuuuuucuuuuuaaauuuaacugucuugugugcaugacuuagugaugugugcaccagcccugggcucugugugcaguuguacauguuuuggguuuuuuagcuaucccgaucaaagacuuugugaugucuucuuuucucuguaagucauccuacacuguuuuucucuuucauuucuugugaaguucuguuuaguuuuucccucuacucaaacuacaaagacuuguuugcuuuuccccauuucugcucuggaugcucuugauacuuucuggguuuggaugcugaucauucauucucauucuauacuaaauccucaugcucggcuguguguuuugccuugcagaagaggagggacaacaggugacagcauucaaguguuuccuccugaguuaccaauaucuggguuauagcuaacaugcaaaaauggguuuuuuuguuuguuuguuuuuuaugagauauuuucuuuauuuauauuucuuuuuuuuuaauuagguauuuuccucauucauauuuccaaugcuaucccaaaagucccccauacccacccacccccacuuuuuggcccuggcguuccccuguacuggggcauauaaaguuugcaaguccaaugggccucucuuuccagugauggcugacuaggccaucuuuugauauauaugcagcuagagucaagagcucugggauacugguuaguucauaauguuguuccaccuauaggguuucaguucccuuuagcuccuuggguacuuucucuagcuccuccauugggggcccugugauccauccaauagcugacugugagcauccacuucuguguuugcuaggcccuggcauagucucauaagagagaccuauaucaggguccuaucagcaaaaucuugcuaguguaugcaauggugucaaaaauguuuuauaguaauauacuaaaauggauauaaauaauuacaggcguucuguacaugauuacaauauuaacucugccucccaugcauagcauauuuuuucuucauauuauuuaccuaagauuuuaauuacaucagaaugcuuucagauuuuaaguaugguaacuuaaaaauuaucuuuuuguuguuguauuuuuugaaacuguuuucucugaaccgcuugcucucaaagagaucugcugcuuauuuuaugacucccaagugcugggauuaaaggcaugugccaccacacccccaaaauguaugucuuuuaaaugacagaacuuaguauauguuuaaauaauuguuggcuauacucuuuaaagucuucauuuauucuguucauuuuugcagauuuaaggaagucuuaaaaaugaccaaaaaagaauuaaaugaauaugaaaacagagaacuuaaucuucgucaagauauaaaaaacaaucaccuugaaauggauaucccaguuaguacacuaauaaaaaagguaauuuuaaaucaguuuuggggaugaaaaauaacuuaauuuuaaguaacauaaaucuguggaugcauugaaguuuuuauauugcuucacggacuuuaugucaaugaaaauuguauuuucuauuagaaagauguacuguugagucuuacaucuggaacccaggcugcaguccaucacuaugugauccuaaaugaguaacacaucuucuauauuuguuuauugguagcaguuuuauuggacugcaguuagcauaucccauacuauugugaucccuuccacuucaggauauuucugcuacccuaaaauaacacuuucaucuaucacgugccuccucugcauggccuuacggauccaccaagucagcuuugucccuguaucugccuguucuggcauuccaugucagucaccauauguguucugacuucuucgauuuaucgcuguguucaggguccaucuguguugaagcaagcauccuuacagugucuucuuguuguugagucuacccuauuguaugauagaacguacauuauauuuaacauacaucacuuauugcuucaccuugcuuggguauuaauagcauugcuguggagaaguguagcuugcaucuauuuucguuuuucuucacgugcuuaggaaccacagagcuguguggaaacugcuagacuugagcagcucccacaaaguggccacacuuuguaaccagcgccauuggguuaacaguuucuccauagccccuggaacacuuguuuuccaccauguuuacaaguuuccaaccuaaugacgugacgugaugcuugguuacggcuuuccuucgcuguuuccuaggagugaaggaauggcguggaacauguguucucaugugacucuuggccauauguguguccucucuggagaaacgucuguuugagugcuccccucaaggguuaucuucuugagguuguuguuguuguaagaauccuuuauaucuccuagauaucuacagauaaaacagauacaggauauucaaguauuugcucuugucuugguagcuugcauuucauuccuugauggugucaaacacauguugacaaaguccauuuaaucuauuucuuuccuuuaauauaaugucuaaaaagcuuaccagauccagucacaagaacuuauaccugugcuuuuuucuaagaaucuuauaguuuuauuauguuuagauaguaugcucuggguuacuguuuucuaugggggucuccacucguccaagcaaugguuuugcuggaaagacauaguucacaucauucuugaucaaacuugcuggagucagcucaccaucgauaccugaguggacuuuuaguccccacuuugcaugcaacggugccaaaucaaguuggguucucaagggagaacuuuccagucauguugcauauggcuggauaccgugguaguagccuauggccgcagagugaaggccuuuacuuucacuccuguggaaacacugguuuucaucuagaaacuuguuuucugccuugcugacccaugacacaaugugaaggcagacuuggaaaggcaggguccauucaucuucuuaagucaaaccuuuggugucuugccgagugcuucucccuucgcuucuguuugucucuggucgugggcacgggauccgcuggcucagcguguuugcauuuaugccacuguauuucauucacgcauuaccauuucuaagaucgucuguagaucuuugccaccuagaaagaagauuaaguaugcgcucccagcuuuucucauuggaaacugagcugauuccagaguucagauuugaauugucuuuccuuccuuccuuccuuccuuccuuccuuccuuccuuccuuccuuccuuccuuccuuccauuuuuccuuuaggaucuugccauguagcccagacuagccuuggacucacggucuuccuuccucagucuccugaccguggggccacaggugugcuccaccaguccugcucuccuuucucagccuagcaucugauucuuaagggaagcaccagagugcaacaguggccaugucaguuaguuuaaacuguaagaugucaccacuccucaccaaagucacugaaguuuucggugccugaacaacaguauaucccuaagacuucucuagaaauuguggggcauaaagauagggaucacaguuacagauuuuuuuguuuguuuguuugagugauuuuuuuuuucagacaggguuucucugcauaggcccuguuguccuagguugaccuugauuucagagaucugccugccucagcuugcuucugcuucucugccucuauuccucuccuucugccuccaccuccgccucccaaaaaugcuggauuaaaggagugugccacugugcagauuuuucaagaugacaaagaaggaaagauaggagacauucacauaaaauaaaucuaacgugaaugcugguguguaaaaaauaaugaucacaaguaugcuuugugacagcugcuacuuuugacuagaaaccuuaugaguugggcauggaagcgcacaccuuuagucucagugcucagggggcagaagcaagcagagcucugaguucgaggccagucugggcuacaaagugaguuccaggacagccagaguuacacagagaagcucugucuugaaaaaccaaaaagaaaaagaaaaaccugauuauuguuauuauugcaggcuauauuuaaucgcaucuguucuuagguaggauuugugauugcuuuaugcugcccuguucucggcugccuucaucaucaccaaacuguagcauuuuauuccugcagauugaugaucuuacagcaaaacuggaaacugcaucuucaaaaugucuacaucuggguaaaaaaaaucagcugcuucagcaggaguuacuauugaugaggacuauacaaaagaagugugggaaacuagagaagaauaaaaagcaauuggagcaggaggucgugaaccucagaagucacauggagaagaacaugguggagcacagccaagcacagcaguacgcgcgggaggucgaagagcgagcgaggcaggacuugguggaaaaguuaaaacaggucaaccucuuccugcaggucagcuuguuuccauggccacugugguucucacacucuaagggagagauggaguguguguguguggggggggggggguugcacagcguccugugucuccucaaaucuuagaaaaggacacgugcuuaucccuagaguuuuagaaaguucuagagagaagaagacacgugcuuauuccuguguuugaggauucuuuguuguuauaacucaguggaccuuucauuagagacucauuugacuuucaaagcuaguuugcaaaaacugagauuguuagaaggggaacagaacagguugacauaugaagcacacgaaacucucacguuacuccuaagccaucuaguucaggcuuucaucuggagcugauugaguucuugaaaugaugagaucacugugugccuaugugucguucagagcugggcauacccgcagugggaauguguucaguuagcaugcaccaggcccuggauuugagucccaggacuaaauaaacaaaagacgaugaggaagauuccauuuuuuauaauuuccugucuuaaucccagcaucagcaucugcuuucacauguuucauucaaaacaacuggacaguaaugauucggguuauaacugcuucugaaguguguucucucgaucuguaggcucaagcagcaucccaggagagcuuggagcaguuaagagagaacaguaacgcuucgguuagaagucagauggagcucaggauuaaagaccuggagucccagcucuacagaaugaaagcccaggaagacuucgauaaaauagaacuggaaaaguauaagcagcucuaccaggaagaguucagagcuagaaaaucgcugucaaguaaacuaaacaaguaaguucuaacauugaaucucagaaaagaaacucggggcuuuagcucuacagcaucgucuucagugagacuaggaggcugugagugcuauagacaacacuagaaauaauguucauuugggauagcuuauauucuuuuuuuuuuuauccuucugucuuaguuaauauggucaacuuuagguagauauuuuugaagcuuuauaguuaagaaaguuauauuauuauaaaauugcuuauucauguucccuuaaauagaacuacuaauagguuugauuguguuuuguuuuguuuuguuuuguuuugggaagaugauaacuuggucccaaggaucagguacuguaauuaauauucuccucugagcaauuucagcauuugguauuuuaauauucuuugauugucgucuguacuguuuccaguagaggucccuauaaacuguaauugacagguuuucuaaucugugcuuuuacacgcaugugcgaugcagggaagcaguaaugugagacugaagcuucagcacggcgccucuuucucucucagcuguggcucugaguuauuccuaguuuauccugaguaaugggagcgaaugcuuacaugucuccacuucuaugucuucagggagugagauguguuaauuauacacaguggcacgucugcuguagugaagcaaauugauacaucaaucaucucccaguuaccacuuagugucucugaugaggcccucaggaagccgggaagcagggcccuuccaaggcaccaugguuccuggugaagcugcucaucccagcagccaugucucucccuccuacuuggcuggaauuucucauguguuaagauucccucuagaaauaccugcacuuuuuagaauaauuuuaaaccugcaauccucaguagcugcauucugucagguuuucuaggcugugucacuguugaguugcaaauuccuuguauucaccgcaaccucuuagacagccaugacucaggguucauuugggacccuggagacacuaagcauuugcccucuguggucuucacaggaccagugagaagcuggaggaggccagcagcaagcugcuccuggaggagcagcagaacagguccuugcugagcacucugaguacaaggccuguuguggaguguccuuguguuggaaguuuccauaauaguuugguauucaacagaacucuuauuccaagagaaaacauagugguuccuacuucaggccuacagccaucaaauaagagaguggagaucuaccugaccaagguuaguguauuucucuguucaaguuucugauaaaauucucacuuuuaauuuaauacaugauacuguuuugcuuggccaaugcaugcugucauaggaacuuauaugaauggaaaaacauuacuaaaguuucuagaguucucguuucaguaggugcucacuguugcuugguucagcgacggucgcuaaaccaguacauuucuuuaaaagcugugcuuaaguuauaguuuggaaaauagauauggcugugacuaaagguauagcuugggacaucaugacacaccuucuaaagacacuuuucccauagcaucauucuauucuagugacaagagaagggcagacauccagagaccuacauguggauguguauccuuuagaggaaucugauagaaauacuauuauuaaguaaguaaauguguuggcuuugaggauuuagcucagugguagaaaggcccuggguucgguccucagcuccagggaaauaaauaaauaaauaaauaaauaaauaaauaaauaaauaaauaaauguguagcauugcauaagauuaauuucugaguuaaaaacuuuccauuuucuuaaccauuauaaauauucaucucauuucagaugcaucaagaguuggaaaaaaguauaaauagagaacuuaaagaagguaugugccaaaauuuaugaauuaagguuagauugacuaauuuuuaaaauaaauuauaaguauuacaugaccuaauuuuccuugcucaaugaauggauuuuacaguaagcauuauuuuacacaaaauuaaacauaugaagguauuuccuucggaguuuaauucagcaaauguuuguuucauuugaauacuucauauauaaguacacugcauuagcgucgcuucugccucuacccugccucuaaugccacccacguucucccuccccucaaauucauggccucuucucauguaugcaaccuguagcccaguuagcauugcccuugcuugccugugcucuggacuaaccacuuaggaacaaggucucauccuugaaaaaagaacgguucucccuuucccagaagccaucgccugucucuagcucuucaucucaggguacggcugccuuagguaaggcuccuguugcugugauaaagaacaugacgaaagugacuuggggaggaaaggguuauuucauccuacaagucuguugcugaaggaagucaagucaggaacugggagugaggagcuaaacagaggccauggaugaaggccaccuacugacuugaugcuugcagccuguucccagauaaacugugucauuuuuauaccaccuccccaccccccaaaaaaagccaaguacacgcuuuggauuuuuccucuacccuuguagguaugcagauugguguggucuuuggagguaauguggaagcagucauacuguugggaguucacgguucuguuccaugauguguccugcacuaaguguaggcuugugacagagguguucuguuuggugaucggcaccacacagucacuuguucuuugauuuugaccagugcuggucucugugauagucuccaugugcucacagaugagagcuacacauaucuaaggcuaugaagaaugagaaauuucaaaggaaugugaaaagucuuacuuuaaugacaugauaguguuggguucuccucuaaggucugaggccuguccagccacaguuucuuggcuaguuuauaauaucaggcaugaauucccuccuguugagugggcuuuagguucaguuagacacuguugguuacccccaaggaacaagggccacuguugcauuauugggguaucuugccuguccaguugugguucucuggcuuuacagccugguagaguuaacuuccucccucggcagcuuaucccagaccuccuaacacugcgugcuggccucugggaggagcucucuggucagauccaacuucuuaguccuuguccuaaguguccagugucuuuggcaauagggcuuuaccaucaaccucuaccagguagccaaggcuacaucagcgauauacauaucguugugggagucccugguacccccacaaccguucagaaggaggagucuccugacuguuacuggaguuuuucaugguuccugucaggaacauuguagcuuaaguggcauaacuuccuuuaagguuuccuacacaaaucuuuauacacacacauguacacauacccuacucuuuggcaaauauaaaauaauacaguucccugggucuguaucacacaaccuccucccguguuccacuuccuacuuccuguggccugcauccugcuguuauucucuccauccccuccagccagugcucccuuuggacuucucugggcuuugguuccauuguuuagaacucuguauagauccauaguucacucuuaauugaguuauugguuuucuugauucuuugguauuuauauauucugaauauuaaucuucugucagcuauacuaagauucucucccauucgagagguuuccucuuuauccgacuguucccauuccuguauggaagucuuuuggucuaugaggccacucugucaguugugcugagccaucugacgccuguaccggaaguccuuugugcuguguguguccuguagggugcugccuuguguucucccagcacucucagguuucucgcugacgucucacccguguagagcuggugucaugcaggcugauacagaagaauuuaguuucguuccacggguggacaucagcuuuccaaacaccauuagucaaagaacuucucuuuccuccaguguguauuuuuggaaucuugucauauaucggcagcuaugaauauguggucuuacaacauggucccaguggcauucugcuccacugguccaagugccuguuugugugccggggccaugcugguuucaauacucuuugaugucaccgcuaugugauuaucugcagugaacuguauugucucaucuugucauuccugugcuuguaacuguagcuucgcacaugauuguugaagaaacgagucaacaacacagacacuuugguauucacgaugauaauuaaguaugcaccugcaaacaaguuaaauucagucaugagugugcacugcaguuucauaugcagauuaccaauucagucucagcucuucuucugacuugugcuuuguuaacugugaacucuugacauauaaauauauauauauauauauauauaucccuuucuuuccagcuacugcugaacuugaaucugaguucugcagaguuucuccccugggaucugcuacuaaagcaagccaagaucaacucucagacgcaucgcaagaauuuauagacauucuaaagaaaaaauauaugaucugcugaauuuaaaaagagaaaaaggaagaaaaaguagaagugggacuuuuugggagagaggaucagagaaguuaaaggggcacgugcugugugucugaaaugucuccguggccugggugugguggcacgugucuuugacuccagcacuugggaagcagaggcugguagaucucugaauucaagggcagucagagcuacaugucucauacugaaaaauaaagucauaauggaaccuacuauuuuguacaaauaauacacauuaauauacaugaucuaaaauauaacauuuugggcuggaaaggugccucaggaguuugagagcacuggcagcucuucccuagguccugaauucaguucccagcauccauaugguggcucuaaccaucuauaaugugaucugguguccucuuuugaugugcaggauuaugugcaaauagaacacucauauucauaaaauaaaucuuuaaaaaaagaaaacaaagauauaagugcuuauuaaaauaaauaaaacauauuuauuaaacuguuuauauuuguauuaaccauauaacuugaaagcacgagaaaaacuuuuucgucauauguauuagaaauuaauauauuuaccaggaguuuuuugguggucguaagcagauuuugcaaguauuauugaaccaguauuacuaaauuuuacuuaugaaaacacccuaaagcgaguuguucaaacaaccaaguuaccgugaauacuuuggugggaugaaauaccauccuuguguuuauauuuuucuauuuuugucacucugcaugggccaaaagauuuagccagacaucaguucaguucaguaggcugcugccuuggccacuguuaauguuuucacgguucccagccauaguguugccaccaaacuuaacuuuaauuuuaagcacugaucauucuugauccuguggaacagcacgaugaccuaaggcuuuucaccaagucucuuuauucauuugcugguucauccuugauaguuuuuucaagucauaaaauuagggagaagcucagguaauucuaucccgcucgucugaaccauuugagagagccuugcugccggccauugucauuccuuacuacuucaguauuuauuguaguuagcaacgcucuaaguaacuguagugucgccuuuguaacgagaaggcuaacacuaacagauuccuuuccagcuuggcuucuucucuacaguguccuuuaauaaagacuggucccauucggaccgaugggucccagguacugacguucugagacuccuucagucuggaacauuguucaguccuuccuggacuuucacgaccuuaaaucuucaaggggcaauucguguaguauguucuugaauugaauuuuucuauuuuauuauguuucaucgcgcauucuuggcagaaguauuacagaaguaauuuuucucacuuaauccuauuaugugaucucuaauauagauguuucucuguuauuaugauguugauauugaucacuagagcaauuaccuacuguuuuuccucaguauauuuacuuuuguuuuguaauaauugauauguggagagauaauuugugacuguaaauaucugcuucuuaucaaauguacaauauauucauuuacuaguauucauguagauuaauggcucuuuauuuuauuuaaugagauauaaguuauugauaacaaauuauuuuuauauuuuaauaaauuaaauuuuugagaauuucau

SEQ ID NO: 3331 - RNA, 46366 nt, Mus musculus
agggggcuuccugaaggcugggcaggagggugggugggaagauggcggccgcggcggcagguggccugccugggaagggacacgauaucagccuggcagcccugcggcgccacgaccccuacaucagucgcaucguggacguggccagccagguggcucuguacacuuucggccaucgggccaacgagugggugcgugcggacgccgcggccgugcggaaggcggggcgcggacagggcgggagaugcugggcacggcuaggcgggcgggggccgguccugguggagggcgacccgcggguccaccagcaggugggggacgagggacacagaagguguggccggcuccgcugagugcgggccacgggcuuugagaucagaagacagaagcucuccggcagcggagggcagcccggaagccccaaacuuagauaaguccagccucgcggaggaggagcagccggagugcgaaaugcagggcaggcacccaccuaagagcaagcgugggagaauaaagaggaaauggacaugggugggacaccccagacuuggauguaggaggccaggguugguaaccuaaccauuucaguccauuuccaacaagaccgagucccagccuacaguaacuggaugaaguuuaguuuuccacacaacuagacuggaauugcaacgggagaccaauuaguucuggccuaggcauugguucuuaucauuuauaaaccaucccuuugaauauauaaaagugucauuuccuccucuuuugugacuuuuguccaaauauucaucaguauauaaccaaugcuuuuaauaagguucauuggguguauggaaaacaccuugcaaauuuucaauuuuuuucccccgguguguucgccaagacugaaacaaacaucaagauuuaugcaaagaaaacuuucauuuuugagcagauuuaugauuaaguaggcuguaauaagaacgacccaaaaaccaugcacacaaaagaaugaagaaaguucuuggacguggagcuuggggcaggcaccugcuucauccccaacaccccugaaacagggccgggaaucuuuuccgauaguuuuguccgaguucuuaacugaagugaggcaaagaauucaugucuguucuccuaagagccaaaccugaaggggaaaucugcagagauccauuguucugaauaucccuaguuugauuaauugaggcugucuuucuuggacaccagaggaaauuacacuaugggccuauauaaguaaagggaguuuccccacugaaauguuucucuauuuaugugaagauacuguacauaaacgugcuucacuucucuaggucaauguuucucagccuuccaaaugcugggacucuuuaauacaguuccuccuguuguggugaccccuaacauaaaauuauuuucguugcuacuucuuaacuguaauuuugcuacucuucuuauuguaaugcaauuauguuuggagauagacguaugccaaagggguugcaaccuauuaguugcaugcccucugccuggacuggccucugccugccaauccacaccuaauauuauggagguaauucaguuaguauacauggaguaggacccaguaagaguuagugggguaaguugacucggcaggaggcucaggcuagaagaucagaagccguugaaauguacagugcaccauucccaccccucgguagcaguuuuccuaacgccucuucacaguccuguguggcagaaaccguuuuaaaucccuacagagguggaccaaacgcccagugaaggccagugucacauugcauuauuuacaggaguuuuguuuuccugcuuccucgacuuguuuucuucagacaggauauaauucacucaguaaaaggucauuucuuuucaaagcccugaucuccuaggcugugguugccuggcaaaggagagagacuuaguucaacaauagagcagucucugggggcaaucaagucaucacugcuguuuccccgugcuguaucacucaggucuccggaugaaagccuuuccaguguaaaccuaauaaguauaaaaauauccuuaaaaaugaaagggaagggauuggcacgaagacgggugagguacaggcagggaguccuuaucacauuggaagucgacgucggguguugagaggaagaaggaggaaugcacagagagugagggucaagggaccggggaucagugaagugguagagcaugugauuagcauguggagccucaugugauuagcauguggagccugugcucagugugugcacagcccuaguuuaauccccagaacacacguauacucacacaaaggauuaagauaguucugccaugacuagaauaggaauuuuagaacuaaauuuacuccucucugccaggaacgaauccuuccccaaaauacccaaugugucgaugaagucuacagcuggucagaccauuuguucucagcuggauuugauuccccgcaccccccuccacacacacacacaccccggugacgauuggcaauaucaggaaacuuugaggaugaagguguugguggcaucugcagaguagaagcagaggugucgccaaaugccgugcagugagcaggcauuauauaguuagucuaaaauaugcacaaugcgaagcuggaggcgugucuuagaaccacaagugccccuuauuuucaggucacaauccugaauuuucugugaaucaguuacaguaugauggcuuugcugcugcauacaugacggagagagacggcuucagaaagaugaagugggcccacuuuugauuauuuuaacuuagaauauucaguaaaguugagauugauuucaguugucccagaugugucaauguauuuacuucccauaauuuaugaaacagcauuauuuaugcgcuucauuauuuugaauagcaaacaauucuguguguauauauguguguguguauguguguguguguuaccuuuauuuucagaacacuccagagcugaacuuaacaaauuuaagucugccuuacuuaaaggaucugaggagacuaauugcuauaccuuaaauccacuaauuuguacugaaaggacaaaaaaagaaaagaaauuuggcugccuuugaaagucagucugaggugcagaucuagcaacaaaauacauuuccagagcugcuguuagccaagcaagagcucuuaaaauacggcuuuuuuuucuaauuauuaaaagauuugaguuguguaagccaguuacccuuuuaauggagaagaugagacaacaguaaaugaauuaucccagugugaucuggcaggagccucacuccaggcccauauuguaauuacugagccauaauuccaucccaugcguaacuccaaauaagacucaaguuuaagaauuguuuuugugaguuauaguuaaaauucugauuuuggauuauucuaaacuaaagucauuaaaauuuuuguuuuuaaaguaaagagaauuuuuguugcaagggggaaauaccagucagaaucaaucagccuaugugugcugacacuaugaaaggucugaguugcauuuccaugagaacaggcccgggucaaauacugcagagcaggaaacugcuuuuggucuuguagccauggggcccgcugugcaugcacagaagugucuugccugccuuaguuucccaucaguguaacucauagugccaaguacuuggcuuuugcaauucccuuuuaagguguuauguauugccuaagcucuugccgguuaugucaauucggcucagaggccuaaggcuguggucucuuaacaggcucccaggugacccugcugcuucucaucuggacaccacucuucaaaaaccccuguacuaagucacagagaagacaguuguaaucguguagauuacuugagaagaucaugcuuucaaaucugugccuuuaaaaaauguuacucuaauauuauaccuuucucuuaaagaguauaucuugcaucagaauuauagaguuuaguuuuaaaugaucuggguaacgaaaacuaugaaauauuagagacuuaaguaggauaauagaauggugaaguuaaauuauguaaauuccaaaagcacacauuaaauucugaauuagaauaaucucauuacuaguuaagcaaagagcugcauugugguaauaauguugaugagcaggagccuggggagccccaaguuccuccuguccuggagaaauggaaggaaagccagagaacucaaacucuccucgaaacuucaccucccccagguuuucccuggcuguucucgaguccuaacuugguaauaguuguguguaguguuguuucacgucuuuggccaaaaugacucugcaguuguucaugccaaagagagaggugcuuguacacuugaaggcucuagcacagugcuugucuggguaguaaucagaguaguuauugacagaucaucugcucuccuagugaugggacaugguggugaacacaagaggaagugaaggguaaugagaugcagacaacaguuucccugacagcuugccgggcaugccauuugguggauggagaaggcacacacccgccaucucuuucugaugagaucgagagcucacuuuucucuguuccagccaggccggccacucacaccucgucugggaaagagaauggugaccacguaaugccugcucagcaggcccuggucacgucaagcccacgccuuccccuuggguggccucuguucuauacugccacuucgucuacuagagaauggguguguuuuccuggcguucuguaaguucccucugccuuagaaugaagagacguacagaugggauguguuugcuuuguuucuaggagaagacuggaguggagggaaccuuguuuguuuauacgagguaagcauauucuauuagaaaaaugacucgaaauauuuuaauguauuuuugucacuucuugaagggcaguuuuacuuccaugaauaacagccaaauccaucugaaauuaccagucagcaagaggaauaaaauaacacauaaugucaccagcuauauccugaugacaccaauuucaggcucuaacuccaaccucagccuuaauacuugguuuagcagaacauagucaucguuugaugccagugaguugcacacaguccuugaacacuacgcacugccaagagauaagaggugcacuguuaggaaagcuaaauuaaucagugguuggaaagggcuuuguggcucaccuucccucacccugaggcuuaaaaaagcacaccccaggauugagugugucucucagucuuccauuguuuaguuaaugauguuucaggauuaauuuaauuaauaagcucaugcuuuuagucauuucuuuuuaucagauaucauuaacgucacacauucacacagacacacaguccauauauggucuuaaugacuucauuuuauucaugcauauuucuucauaaauaucuucccugaauucugucaccuagugggagcacauagaugaaauacaaaacuaguguaaacucugauugacauaaguacacuuacccacauucagguuuaagauaaauacaagauacgccaucccaagaacugguuuccauuuaagccucacagggcugcuaugcuguugaaggccuuguacagugaccagucuuagguugggcuucaggacuggaagucucaauaggaagaaaggcaaaaguagagacacagagccuccugucuaaagggacaguaagggauuuacucugguguagaggguuuguauuagcauaagugauacuauuagacagaauggcagacugaggagucugaggcuuauuuuucuagcaguagggaguaacugaaggcuuauggucacaaggaugcuugauaagcugugagaaaauauguggagagucagugcguuagcaucacaaggaggcacucguucuaaaagaaacuggaguucggguguugagaggaugauugccuugaaguagauaggggaugcuagaguugggaccagaauaacugaagcugaaaugaaagucugcagggacagaggguacagugacauugagaaaugaaaccucuagguaaaugccagcauuugaacugaaugauaaaauuguugguagaauucaaacggcagcgggggaggaggggcuagguuucuacuugaucucguuguguauuuugcagagcuggggaugugagggccucaagcuuauacauucuuaccaccagacuaccccccucagccuuggucuucagggguuugaaguaacacuuuauucagggguaucagugaauucacauugaggaauccagccacuuggcauggggugauuguuggagaguuuggcauugucugaaaggacuaucaaaggagaauaguuaacuuuuagggucaguaggggcauaaaaagcagaacuaggguaaccaguucugggaacacagcaugggaacagugggggagagugguagcuacccugucaucaaggagagggagggacaggaaggaguagcgagccaggcugcaggcagggcaacaagucaggcaguuguuuagggcugugaauacccaagaauuguuggcauuuuaguccaugccaacauuuagaacauuccagaaccaucacauggauuugauuggcaugaguacuguuaagaguguaaaauguauagagaaacacuaaaacacgcaauguguauucucuuucauuucuaagaagggauaauuuugaggcgaguggugcauuaauauauauuaaugaugacuuuaaggucuuuucugcugaauuauacaauuauuuucuuuuuuguacccaaacuaaauauagcuuuauauuuucaagcauuuuauuuuauuuuugaaauagugacucaugcagaccagguuggccucaaaauaaccauguuugagaucacuuugaacuucugaucuaagugcuggaaguacagcaaugugccaauuuuauguaacacugaagauggaagcagggcuaccaguugaaguacaauccaucacuuaaauccuuccuaacauacuccacauugcuaauggagcagugaguuacaccauuagccuggcucuuacuccuguucccaacucucucuuugagucgaugcuuacugcuuccaucucuccucccgugcgugucugcccccaugugugcacauguauacgugugucugcucgggcaaggccuuuuccuuagcguggaaagcaguuugagcuaaggcgcugaagcugccugugucuucaccucugcuucacuuucagucgugugccuggcauccuuguuccugaccugcaguguagucccuugcugucucugccaugagacccuuucccguugacauacauaagacaucucacccaccuuaaggaccacuccuucugccugccuucccaugucuuugccucugagauacaguucaugaagacaggcugcagaauuuuugcauuucagaaauuuaauguucaggacccucugucagucuuuagagcaauugaggcuaugccuaccagugcuuuuuuuuuuuuaauguagaauaagcucaucaaagauugucuucuaucaacuaaaagguugggguuuaaaaauaaaauccuguaaguggcaagguagcaguguuguaauuuaucaguauaaagugguuaaaugugaauuaaaacuagcucucuuccugacuguuagcagcccaguuaacucgaaugaaugagugcugcugacuucuguuaaaugugacuguguaccuacuugucaccagaagguucacaguugaauuaugauauggcugucacccagcacaagcaaaggcacacgugauguacaacgggggcccucugugccugacacggggguacucaagauuuaugggauggaaugaaaaaucaaauucacaaaggucaugcuuuuacugagaaaaguuuucugguagcuuguccagacagccauuugcuuguauugaagagaacaaggcauccgcccuuuagccagcacaugagcuuuguuugcacuuugccucacagggucauuuuccugaaguucucaauuucaaacucaauuuacacuuucaaugaaaauuaccuuuuuggaauaauguacgcuuguugaacucugaaauccuuugagaguaucugccaguaagaauguuuuaaaggcaguuaccaucuuugucuuaaaggaauauacagcauagguaggcauauccguuauacacaagauauacacaggcucacagguuaaaaacagugaccugcaggacagccugaggugcagagauguacgggaucccaggaguaaaggcauguugcuucguauguaugcagacugcugugggaaacugaauccgcacagcagaguuaacagacaggcugggauguggcuacugcaggugugccaugcuuaucagucggucucuccccugcucugugauuuccaggucugccuccccaaagcacggauucaccauuaugaauaggcucagcauggaaaacagaacagaacccauuacuaaagaccuggacuuccagcuccagaacccuuuccuucucuacagaaacggcacacgugagucucuaaugcagugcuagucacguuucccagggcuggucagauguccccuccugugcucugcaguuaguagcagggacugagggauuagcauuuguuagcuuggaagugguuuuuuucuuagaaaaguuaaagugagucuccuuaagcccugucgugagcagcucuuuugccuguagaaugaaccaguuauugacuuuaauccuaagcaggacugggggagggggugcuuggucggaagccaggaguggggcacagauguaucacugaacacagaacuaaugauuugguuaguggaaguuuucccuuguguaucaccucugaccaagcauagugaagagagauugaggaagagggucuauauuuuugaaggacugccuuuugaauauguagucauugaaaagccagaguccaaauaauuuuggccuuuuugauucuuuuaacugcuaguaguggcaagauuacaguaggucacuaacugguccuugauggacuugagaugaaguaguaguggccuguauaguauucugcccucuuuucacuccugugucuuaucuggcaccugucuuggaccagagaaagacuaaugaagcugucagcuucggggcuccuuccccacgggagcauacugccugaaagguaaguaugugcgugcucuuaggccuugugggugacuuucaaagagacucuaaucuaguaaugguuuacucuuugaauuuaagauacaggaauuugguacuagggacauggcucagugugcuuacaacaugaggaccugaguucaacacuccagcacacacacacacacacacacacacacacacacacacacacacaccagaagacagaggugccaguggauauuuguaauuccaguguuggaaggcaaagucagguggcuucccagagcuugcuggucugccaguccggcuaauccuggguucagugagacccugucucaaaaacuaagguagucggcacagagauucaguaggucaaggccuuugcugucaagucugacagccuaacacagacacacacgcacagaguugcagacaacacacaaauaccaaaaagguugggaaaggcaaagaacuuggucugcaagcauggugacguguguaugaugacacaccuacauguaguccagcauggugguguguguauguucugccugugcccuggacugcccgcugccuacuugcccagugcuggggcagagacaggcagagcaugggauugucccuauucagucuagccugaaugguuagcugcagcuucucugggagacccugucuuuaaaauaaaauggagaugugguagaggaaagcaugcugccaucagccucuggccgcuacauacuccuguacuggugagcacacgugcacacaugcucauaaacacaccacauaccuccaacacauacacaacuugcugccuguauuuucagaguuuuaauaaugugauacaaguaauaugugaagaaaaucccaaugauuaguuuaaaacuaaauguaacauuuaauauauuaaauaugcugcuauauuuaauuguacauagguuguccugauaaauguccauuccuuaaaguuuuaugagaaaaaauuagaacuauuaagacuguaacaugacuugccaaugguaggucucauggaaagaaagguuuugcaauaauuuuuuaaaaaugguuuguugcuguuccuuugcuguauguuuauaguuaugucagaauuuuuaaaggauauuauauuugagcuaaggagcuaacucaguuaguaaagagcuuauugugcaaacauuaucaccuaguucaguuccucagaacccacaugaaaaagcugggcagagugguguuugugcucuuaauccuaagaaacagagaacggggccggggggcugagggggguugguggcgcuugaggcgucugggccagcuagccuagccagugagcuccaagccagagaggcugucucaaaagacaagaaugcaccuuagaaagaaugcacuagaguagauaucugcuaauacacacaaaaacuacuauguccugugucaaauuaacauauucaaaugcuaauaaagaagccacaaaaauuaauguagaacagagucuggagagauggcgcugcgguuaagaacaauggcugcucuuccagaagcccaggguucgauucucagcccccacauuguagcucacaacugucuguaacuacaguuucaggagacucaacacacucuucuugccuccacaggcaccaggcaaaauaguacuccguguguguguguguguguguguguuuguguguguguguguguguguguaauauguaaguaaaaugaaaauacaucuuuaaaaaugaauguagaauaaaugaguacuagugaucuauuauaaucauuccugguugcucuuauuuuggacaaauaauugaucuaaugcauugauuuuagaaauuauuuccuaaguuucacggggccugucugacagaaagugguuuguggaguuagugagcccacaggaugcuucacuguuugcaaguauccucaggaugguagucugcagcucccgugacugugaccucaguguagcuugucuagagggacaggaguauguguuuaaagcacacagcauguuucagagucuuagcacgaaggaagaaaggaaggaaggaaggaaggaaggggaaaagggaaaggaaaaagggaaaggaaaggaaaaaggggaggagaggagaggagaggagaggagaggagaggagaggagaggagaggagaggagaggagaggagaggagaggagaggagagagacaucguauuauuucuauugguuaauguugagaugaugguaauuuggauaacuggggaaagaaaauguauuguuaaauuuauuuguaucuucuacuucacuauuucuaacuuaaaaugucaggugcaguccacaccugccggucuuaacgcuuuuauugacagcuacccuacucuugguggcaucuuacagaugagaaaauggcugugguagguggguggggucccagcucacacaccucuggcucugccccugaugcuuguguuccucaccgggcacugcucccucugcuguuaagcguggguaccaauggcagccggucuuugggaugcauguauggcuguuucugaugagucuucaucuacaaaaacgaauccguucaacaguagagugugcagugucuuuucacucuucugcauucguuuugccccauuuuguucuccuuacugucugucucugacugccuaugaaaccagucauuuccucaaggcuucucagccccugacauccauccacagacgguuuaucacgcaugccgucagggucuggguaccuuccucucagauguuuucuccagcuuucucagaugcuuauguaaccauugcauuuggcuuucuaauucuuccacaaugccccuuuggccagggagccuggcuuccugcaggguugauugucaugguggcuaucucaguggggucuguacagaccuaggccuuuugccugccacccagcucuugaguccugucugccauugcaguagagcagggcuggaacagcuucauggcagauuuuuuuuuucccagaguuuuuuagacucauuggaugaagaaaaaaaguuaauuagaugaaucuaggagagugaacuaagaaaguagaaaaauccaaaacucccuucauuuaacuaguaaagaaaaaacauuugauaaguaauuuagaauuuuaaucaaaugcaaaauagauuauuguagaaagggguuucuagccuaaaccuuauuggaguugacugaaaugagauuuaaccuaagugagcuuuugugugugugugugugugugugugugugugugugugugugugugugugugacauacacauggaugugcagggauaugcaccugugagugcauacagagaccagaggaagaugucagaaaucguccucuacuauuuccuucccucuuccuuuauuccuugagacaaguucucucucucucauccuggaaacgugccaggcucaccgggauagcugcugccagcucacggaaugugccugucuuuaacaccucuccuucuccucucgggcuugggcuaugugcaugcacagucaugcacgacuuuucaaacaaggaugucaaaaaccaauaagauaguuauuaaaucuggggccaaauuucaugcauucauuuacugucugccaggcacuguguuggacuuugaguggguuauccuaauaaauucuuguaacuuuuuauugggaauacuguguuuuguguuugaccaaugaggauacugagcugaaaaauagcucaguggcuaagagcacuggagagaacugaguucaguccccagcacccacaugguugcucacaacugucugugacuucaguuccaggggcuccacuucccuccucuggccucuguagacaccaggcaugcaaauggcacacagacauacgugcagacaaaacacccauagacauacauuuuaagaaagaauaaaaaguccaaaauguuuuaaguguugaaaugauaguaccaagauuuggauuugggauuuuccauuguuucucaauugggcuaagaucaagugcaaguuuuaauuuuuuucagauuggagaguuacagaugaaugucagguugaauuacaggugaagucuaugaaaauauuccaacaacaauaacaaaaaccucugaaaacugaagcaugcuggcccaagcauuucuccuaagggacaugcgguucgcugucagugcaaagccagugucgauuaggaaacggaaaaauagaucuauacacugaaaacucccccuccccucccucccucccucugcucccuuccucccuugccccuugcucccuucuuccuccgcuccucuuacccucucccaugaaccucggggccuugggcaugguggacaagcacucaccccaggccccuggugaacuuuuugcauuaauugcccaguaaugugaguuauaugcuaggguuaggaagagcaggugagacccaugucuuccuuaucaucuucauugacucuuugccuuuuuuuguccaaaauucacuuuuuaaauaguuaauuucuagcagagaugcaauuuucuguaauuuuaaguauuuucuugauggcuauuacaaagaauauacuuuaauuuaucccagagcuuuagcuaaauuguguaacacacacacacacaaucagcaguaagaaagucaaguuuacaguaaagguugggcauaacuuggaagaagcguugcucacucucuaacggucucuaugagaccuuugcucugccguuaucauaccauaaaucaguaaguugcuuuguaggcaucaguaaucaauuucaagucucuugugaacagagacuguaucuuauauuuuaauugcguucugugauucuacaugggccuggaaaacaaguggauccagauaagaaauagacacgcagacuuaaaguaauucccaaaucauuuguauccauugcagaauugggaugugugggugggugggugugagugugagauaggccuaaugauuuugucugguguucuaaucuucaaugugcuuuagacaaagcuuugaagauauuccgcauggagugauugcucuauaauggccacaggguugcccagcuuucagaaauucuucauauuccucacuucgugucaaagagacaaccuugccuccuacacuaauauagagcacugagcaaggcugaacugugugguccccucacggauuugguuugguuuuugagacaggguuucccuguguagcccugauuguuguuguguaggccaugcuggccucaaacucacagagguccaccugccucugcaucugcaaugggaauuaggcuucuuaagccuucuggauuucaauacguuuacaggaauaaaagccuugcagcucagcagguucugaagccgugagauuuguuaccucuagcccaagccggguggugggugguggcagcacacaccuucaaucccagcacuugggagacugaagccagccuggucuacagagggaguucuaggacaagcaagacuacacagagagacccuaucuuaaaaaauaaaaauaaguaaaagcagcugaaaggucaacaggcaggcuuagggaaacacuacaaagggaaugcgagccuuggcaccaccaagacagcugugcucacauuuuccaucuuaggauauuugcugcuauguugauauucucaaaugguaaauuuuuaguuuuuagauguauuuauuuuaauguguaugaauagcuugccugcauucauguguaccauguacauuccuggugcccauacaggucagcaaaagguauuggauccucuuggaacuuguacugcagguaguugugaaccaccaugugggugcugggaacugaaccucuuccuguaagagcaacaaaugcucuucucuccagccaucucgaguaauaauuuguagcccuuuuugggccauagaaucugacugcuauuuaccucucccucccucccaccauccuccucccccucuuccauguaccagguaucaugugucauguuucacccucagaauaucugugcacaccauuuuacagacuuaacuucuagagaugcuguagagagcucugaagccaucuaaggccaacacacaccuuuaaaguaaugagacggcuggaaguccuugcaucaaaccuugaaaguguuuuagacagaaacuugauauuugcaagaauaagaauagcaugcuuaucucuuccagaucucucuaguaauauaagaugcucaugggaaacucagccaaagcacaaauaauguagagcaggagacaaagaccuugacauuuuguguuugguaagaauaggaaccuuacaaauccaggcucuuacugcauguggugugugugauugccgcccuugguaaccuucaaggacuguggugaacuucuuaauaaaagaaguucccuuaaaucaaaacucaugauuuggucagagaaucucaguugugucuuuaagccaccauuuccauuucagggagaggcagccacuuccuauggcccugugcacaaagcugauagccuuuaguaagugacaaaggauugcacgccuccuuugacuuaagggaugaaccugucacuuggaccuuacauccagagucaccgcucauucagucaggacucugcucaugcugaaaggaucuaaacucuaaaggauacgauuuauguaaaaacuggcauucugucaauuacagaaaacuccagaagaugucaaguaaggcaauauuucauuuuuugaguacuggaugucauaauuuugguuucuauacauugaguuaaaacaucugauagcuccggaaacagguuccuaucugcaccccacaccaccugagcaagccacacugcuuauccagacacccagccuaaggacucugcacuuccacuguagacuguuagggggacucauugggggguagggggaacuuacagaauuuaauggcuagguuacguguguguguauacucauguauacacaugcucacucauggaauaauaugggaugcuuggguaagaaagaauccaugagccgaaaucauccgucacagcuaacccccagcuacuguggaguaaccucugucaggugaagccacuuugcuccccucagccaugcagaugugugguucuuggcauacaaggaaguaagcauucacauaggaugcucuuuugauucauaugcugcguuuguggcuugugguuguacaauauuuuauauuuuguuuuagagagccaaauuugauaugauaaaagccuaaaucuuggcagagaaaaacugucuucccaaacacucugcuccgugcuuugugggagaagcauccuucagucucccugccucggcauucagagagugggcagcauggcuucagaguggugguguacauuuugcauucuauuuuuauauugcuuauuuuuguucaggaaucacaagauaauuucaaguaaucguguucuggaaucaagguuaacugauugcagaaggaaucuuguguuuguucuacagucuuaagugcucaggagaaagaaaacaaagugcccacgagucauugcguccacaaucccaguccucaucgcaggacagaccugaagcaugaccuaauugguuucaacauaaagggcuuugggacauucgguaucuccggugucuccgguguccacgguagauaaaggucagaaugacagagguacagagccucugauucacucuucuucuuccuggcuacauagccucugugucaagccuuagaagugguccaguaaucagguaguuucuaguucaacuguuucagcaaagcugcccuguuaucaucaaacaccucaucagaucaugcaacucagauaugaggaagugugugccuuugggauuuuuguuuugaggagaacaauuuuugaccuguaggaauauuguuuuauguuucagcuuuaagcaucacaaacucuaauuaugagguaagacuuauuucccuuugcugauucucauuuguaauaauagcauuucagaguggugugggaauaauuaagaugacuugggugggugugagcucaggguuacuguuacagcacaugacuagcaugccaguguaguguuguuugcuauaucaaggccuacuguucaucuguaaggaagagaaguaugugcuucgucucucaguugccaggaggagaagucgucaggaagcacgacaguuguacucguaacacacguaaagucaguacgugugcaucggcccagugccacgucaauagaacugucgucucuggaaacgcacaucgaacggcaagguccugucacugugaccuauaccugagaagugaagugcuugaagcagagucaccucucagcacaguuagaagacugcagggccuucugaggaacagcugccuacuggcugguagagcagaucacuuggcagcggacuccagccuaucugguccaugaugguuaauuaagccggaacggauauuagccaugguaaggguuaucgguugacuaaagucuuuggccaguuuaacucggcagacauuugcugagugacugcacacgcagcucacugcacugcauugucgaagcccuccaggagcuuguggucugacccagggaacagauguggaaaugcauaagcaggacuuuuauuuuagcauaaagauacacaaaaagacugggugcaaagaaaaccauugacaguuuauccugggagcagugacgguuagguugucagggaugaauaggagccauagggaauggauggguuagggaauccacuugauauucguggcucagagcuugaaaauuaucagcaaaauuaugaauaaaauggagacagccuuacguggucagcaaggaagaguaaaccguucuauuucuauugcaguuaaucuacgguuuuccccgcaucuucauuucuuugggcauuucuuuaugcugcugcacuucucaaaguaacuucccccugagagaaguacaaggagguggucaguguuugcugacgacuccgcugcccuugaggugucaucccccauugaggggggcagagauucugagugaggaagucucauggcacauguaacccugguuauaaaugaaacucuaaaaauuaaaacaucuuuuacuuuuaaagucauggguucuuauggaugguugaaaaugcaugcuaacucaacugaacauaacgcauuggguauaagguuuguaacuauucagcuuuaauggccucaacucucugagaugguucauuuguuuggaauggggaguuuguuuucacuagucaggguuucugcuguuggcugccaugcucaguaguguuaguugccguuaaauagcaaccgcuucucgucugcugugaaccuuccaguguccgaagaucaugggaucaggacugcugauuugugaguugcaguaaaacuaugucauaugaaaagaaccagacccagagacagagauaacaacuccggagagcuguucugaggccgugaaaaggcuguuuuacaagacguguccguguuuggucaggaaagccagagcggaaggugaaugaaagaacauuacuuuaaaggcaucgaagagcacaccaaaggaagcagcguccaguccaggcauuccacaugggcagacggauggggcugacacaggccagccagccacccgccacagccgugguuucccaucuauggagccaggacagagcccucaggugcaacucuaggggcuccugcuguaaacaccacagcuuauacaagccucuuggccggccucucugccuccuucccuuccucucucccucccucucucccuuccuccuucccuccuuuccuaccucccuuaaacucccuuacauucuuuauucugaaaacccuggccuaaaaaaauacaaaucccagguaauccacaaagucagacucaagggcagcacagccacccaguaaaaagcagcgcggcgcaggcuacgucacagagcccugucucugagcaaaagggcuggcacuuguugccgaggcugcugaccugaguucaauccccugaguauacacuguugaaggagagagcugacccugcuggcuacccucugaccuccacgcacguauacacaaauaaacaacacgugguacaaaucaaagcaagcccaaacacagacugauuccagucccuaauagccaagcuuagaagucaagucaaaccaugugaaagguguucugagacguugugucucuaauuuagagggcugugccggagcauaguuuagagaaaaucgguaaaaucggggggugcuuugacugacuucagucauggagccuuauguggccacagagccccacacaccuaguggcugcagcuccuucaagguugucugucuccuguaaugcagauuaggucuuugagaaguguggcugccauggaugugugugccacccgucucuaggcagccucagcuugcucagacacgcagccacuugaacuggguaaacgggacaguaaauuaaacacuacuggguuugagcaaagcccaccagauagauguuuacagcaauuauacagccggguuagagaucauuauaucacucauuugagaaagaccagggcugggcaguggugccgcacgcuuuagucccagcacuugggaggcagaggcaggcagauuuuugaguuugaggccagcuuggucuacagagacaggacagccagggcuacacagagaaacccugucucauacaaacaaaaacagagagagagaaagaccagaauguaaguggggucugaagagauuuaauuuuuuugaguccuccucaaauacccauccagguugcagagcugaugucagccagguuccuagugacaagaggaguguuuccaaaggcaagcugauggcuagacccuuagacagcagcaggugaagaagggaaagaaggaaagaauggagggagagaaggaaggauagauggaaggaaggagggaaaaucagggugccuccaggagagaaagcauaaucaagccagaguucccacuuaacgugcucucuucauucauuaacacauuuacauacgacuugcuaacuguauggauagguuacacuuucuuuuaaaauuucggcccaaguccuuauuaaauaguuucaaguugaaaaauccuuggcauaaaacuagggaacaaaugguaaguaucucuaaggucauauuaaauagaaacauuuauuaggagcauaaacaggauugagggagggguccugugacaauucauccaaaaugaacuuuugcacucuaccaauggaagucagaggugcauuuaagugacauugguccugccucugaugaccacuuacuuggcccauuucaaucaagugucaacuugauuggcugucagguuucccacggaagaaacugaagaagacuugcugccauucccuagcagucagcucgcucacacucaccuguagaugcucacaaacccuagauacggaauugaauauggaaauacugcuccccuggucuuucuuaaggaguugaaagaacaacagaagacagauaugucaccauggaaaggcuguucuauggagaaugguccaaacauggcaucauggaaaggacagugccagaacauuacaaccaugcaacgagaaguucggauuaaacacacgggcuugcaucaccaugccagagcguguaucagggaaccuucuaggacccuacuuuguaggguagcucucaccucacuugucuuuuucuccacuccucuuuggguuucuuaccuccaggagaaauguagaaacaguugaguugagcuucauguaccaccuugcccuugaacuuccucucuguuuccucagacgagugacuggagaguggcugguauggggguguggauggcugaacaaaggcccgaaucauuguggcuuccaguuggguaccaacaacugacuucacaacugaacaaguaucccacuuguaauuuuuccuuguacuuucuaaaaacucacaaacgaucucugugaccacauuugaaggcuguaaagucucauguggcccugucacucagcugugaauccgagcuucugcuuucagauuuggaauucugaaagcacuccuccuuucuugguucuucucugcugcaucaucauucugacuuugcugcuguggucagaccuaugcggagacaagcccuuccccaguggagcccuuggauggaaaugugaaccaaauggcuucugucagccugucaguucgucaccuccugaaggcuugaugagcucuggucuuuguauaucagcacaggcugucuggcacagccucuuguguggaagggugauaggccuggucaaggugggggccugggcccacgacacagacgacucgagcuggaauguguacuuccguggauucacggugcugcugaucuacaaaacuauuuuaaggagagaaagugcaggcccaguccucuaucuuggugcuccuuuuaguagccaggaaugcugggaacugugugcuuucgcugucccucucccugccuauuuaagccuuauguucaagcuaaauauuaacuagauaaaaagagcuguuucagaugaucccgugugaauguuaaaaaccauauugccucauagauaaaucuccaugagguucuaaauaacaauggcaaacccguguuucuucauucugcuuuaacacuugagaguuuucucuuguuuuucugcccugaaccugugugucagcaucucaugauaaugaagaugucaaaaggcgcuuguucgugccaacagcuccuuggcauccggcccuuacagaacucgaguuccuuauguccgaugucacacaggaggaagaaugacacccaaaugcuuguuaguguaguuuccugguaagacacccaguggugucugccgcugggcuucagugucugguugcacuauagguucuugaccugccauuuuggaaaacuaagucuccaaagaaggaaaguuuucacuguggucgaaucguccagagcaccuauugugacuaagacaaaacaaauccaaaaaaaaaaacaaacaaacaaacaaaaaaacaacucagccacacuuagauucuucgcagggcugagugcuggcaauccagccugaccuuacaagaacagaggccaggagccuguggggaagcaagugggaaaugcccugagauccuagaucccacacacaguaagucgggaugcaaagguucuguuggugugcaagcacagcgcucacagcacaccgguuugaggacauugauguucucauuuuccuuagguuugucagagccccuaggauggauguguguauuucucucugagagagucaccaaguugagaaagcuuggaccgucaucucccuuugcacucuucauguguaggugucugagaccaugguucugcaugcaggggcuggagaggugaaccagaggcgaggagcauuaaaaaauaaagauucugcgugcacuugauggguacaaaaugaaguuuuaaagucucagugaugacuuuuggcaaguuguugguuuggauucauaaaguuucuuuuugauaccugcuuaaaauagcauugaaaagacauguccuguacauuuggcuaucccuuaguccuauccugcgccuuggugagacgcgugaggagaaaaagauguugugagccugucagagcugucuucaugcacaacagcucccugcuuugaaggucuaauuugguguuuuccuuucaaaugccuuuugcuaauuuucauugcuccgucauaauauugcuguuguuuugaaugaaguuuuguuuagugcucaugcaguucauguguuauuuaugugauuauuugcauaugugaccaggcccuaaacuagauacucacaaauguauccugcaacugucuuaacccguacuauagaucugauagagcuggguacacacuaaauuuaauagacagcuuacuuggaaaaugguuaaaaucaaccacaacgguauuuuuuccguuccuugcuaaaugguuacaccaucgucacaccuaaccuuccaacauuuguaaauuuucuguacagacauuuuaaagugaaauugauuauuaaaauuauauuuuucuaguuuccuauccuaauaacucauagccaguuuuucaguuaccguguuccuuggagagggagagggaaggaggguuccaggcaugagaugagcaucagguucugaauauuuaagaauaaagaugaaauguguuugugagaugugcaaauggaacauagaaacaaugacgucucaaagccaagaaguuuagcauccugaucucauuuucaaucuguagccgcuugguuaugaagcgcucaccaacugccuguuggguagaggcagggaagcaggcuucaggguguaggccgcucagcagcgcuucuaacagcacaugcuuuuccuuuuggcacggggucucauguagcccuggcucugacuccaaugacugcuuucaucuauuuaauaaucacucgaaugaauucacugugacugauuauugcggauuuuccuguaagacggaaaggggguucccuuccauugugugcuuugaggaugcuuacggcuuguugauguguuuuuccccaguguccauuuauggaauuugguuuuaugauaaggaagagugccagagaauugcaaaacuaaugaaaaaguaaguauuaaaaggccaaucguguccuaggagcuggcacuguggcucguauuucuaaaugugugaaucaacacuagcaggaagugguucucagcugucauccucacacgaccccacccccaccccaccccaccccaccccacccccagacccugucacugcuuagcauaugaagagagugagaaacaguuuugcccugcucucugcaaacucagcuucuguggcuuauuguucucuccaugugcugugagcuguuccgcggggugguuuucuuuggcauuuucuucauuuguaaauaaguaguauuuucuauggaaaguuauguguccaucaguaaaaugaacaugcagggucacccugaaaggcugcccagagccuuugauacccuccacuuccuucuaaacugugcuuguaacucagaguucccagauacaccucaaacaccaagggccuagaauccuccucagucccccucucuggggaaguccgaaucaguucauguuaguuuagcagucgguacagaaucaaucaccucucucuccccaucucccccccccccacuacucuuagacuuauuagucucuuucucucaagcuguuccugagguacucucugacuuuggcuuccuuaauuggaucacaaggaggcucaggugcgauugauuggugggcucugaccaguuccgacuuggcugcucacugucggcugcuguuuaugcaaauagccaaggucaucagaauuaaucaaauuccuaauggggcugggucucuguuuaggauagcuaguccccauguggacgugaugcucguccugcaaagaaccaguauucgcuucuacaucccagggcaauggaaugaagaagugacccccacaaggaaauaaaaaccagggaacacauuuuuauaaauaaaauugacuccugaaacuccugcuugugagagcuaauuuuaggcaaccagcucaagucccagauggugauuaaguguguucaaacugguauuuaccaccauaacaacuaguuccuuaaacauuucaugguguuguaaauugugcaagggacaauaauagccggauuucauauggauuaaaaaauacccuguaacucagccaagaggucaugguaaaccuggugcgugccucaccccucaggcaggaagccgauuguagauagcaaggagcaguugaucuguguggauucagaugcauucucuaguuagaaggaaaucuguugguaacuuugcaggucauacuuuaccaguaucugcauaguuaacauaagaauuugagcugaaaaaucaaagcacacaaagaaaaggacuuaaaaaaauguuucccuguagcauuuaggaccaugaggucaguguucgaaugggaccuuuucgauucugaaucgccaaggucugaggugguacagcccaccuugcuugaccucacagcauucuggaagggaaggagucuguaccauagagaucuucccuguugaauguucuguaaggcuuccuccacagucagcagccgcccugcggcuguaguguaaaagcagccaggacugcucuguccagcaacgagcaggccuguguuuguuauucucuuuauuagaacagguggagcaggcuagaguccaaaggacagagcuucugauguccuacccuggauuugcauauguggccuguuggcucaggaccucuucucucauuuucuguuucaaaugcuuaagcaguccuaagaugguuguagugggaugaaaacccuugggagagaguuggagugauaaauagcaucgcuuuugacuuuaguuuccugaaucgcagcuucccguuuuucuagccucacucagagcgaacaguugaaagccugucauggagccggauccucccccgugaccuugagcucaggagagggccaagaaguagauauccugcagaugcucaccaaggccaaggaugaguacaccaaggugagucuccucuuccucguggggauaccacgguggcaaagcccaccacugacggcagcaggugaagucaacagagcaggauguagagggagccuaagaaaucaguggccugcauacaaaugguauccaguuagagggccuccuagacuuagaguggcaacguguaaaccaaauucaugucuuuguugguggguaggccuguaaucccagaauuagggaagcugaaacaggaggauggugaguuucagacuagccuggacuacauagugaaguauuucauaacucaaagcaugagcccagcaacauggcuugguaggacaccugccaccaagcuucauggccugaguuugauccuugggauccacaugguagacgggcagaaccaaguuccacaaggucuccucuucugaacuccacacaugcgcugugguaauuuaaaaaguagaaaucagaacaaaaggcauaaaaguagacuugaacagacaaaaguguaugcccuguucuaacauauauauguuagcuaaggagguguguguguguguguaugugugugugugugugugcauccuaaguauuaaguagagauagcaaaauuaguucaugguuuguuaaauaaaaacuacagacuccugacucccugaaaaggcugcaaaaugcuuggcacccaguagcaguaagcaccucuguugcccugggugaccuccuccuaagcucgcgaugcucugugaagaugguucugguugcugggcaaaugggauccuauguagugggcacuguagccagcuuacaagagugucacgagagcccagcagcagugcagacagagugcuggguguggaguuaaguaauaauccaugaugucauggugacaaugacagagacagcguggaccaagucuaccaaaaauaaacuauugcuaucuuguuuugaaaggacucagacaccaaaccugccucugacacugauauuuaauugagugcuggagugcauacauguguguaugcacauauauauacacacacacagagucacaaacaagccacaguucacauguaaaggucaggacagcuuucaaaagucaggucccucagcccuguggguuguggguucugggaacaagcuaaggucauuggugauuucaggcauuaaacucagguggccgguggcugggccccuuucucccacuagucuucucauaggugucaccugauaauacucccucugugcauucuucuugguagugagcucuaggggucuucagacuuuccaucacauggucuuugggguauuuucuaagcauuggaaacugguguugcuuccugaaagugccuuccugccuuuccuccccuuuugcacucauccaaacaaggugagccuuucacaguccaucuccuacccaucaucaccagggccacgcccaaccuccacagcuggauggaaggcucuccuguuagcaucagucguacugcauaagucccgccuguguugucaccucuccugugugcaugucaccucuccuuugugcauguaggcauguuagaugcaugcagacagugugcagaccauugguaaaauaggucugguaugaagaagugggaaguggaaacaguaauaaaacacacaaguuuuuuuuuuccuuagaauucuuguggacggcaucuccauuuuuggacauguuuaaagcggcauaguggagauguuguaaaagaauuaaacaaagauuucuagaauccuuuuugacuguggaauuugguggggaguucaguuuuguauuuaaauuauuuuuaaaauuucaauuaaaaagucaaauguguauaaaugagggcauacaacacgaggcuuugauacauacacguuguagagugacuacaugaagggaaugaacacauacuuaccuuacgugcuuagcauucuuguggugagaacacuuaaaaugcacucucagcaccuuucacagaugcuguuacuagcuguagucacuguggugugcguggguccuuugaaucuccugcccugucuggugucuuaugaacauccccacaguagccugcgccccaagccucugacagucacucuuacccgcguuucggccggccaggaagaacacaacaaaccggaaucuucugcggcaaaagcuuuauugcuuacaucuucaggagccagagagcaagagagcaagagccagagcaagagagagaaaaagaacaagaacaagaaagcaagagagagaaagcaaaaccccgucccuuuuaaggagaauuauccuccgccuaggacguauuacucccugauuggcugcagcccaucggcccaguugucaucacgagaaaggcagaacacauggcgggaaaacugccccugcacgugugcagauuauguuuacuacuuaaaacacagcugucagcgccaucuuauaauggcaaaugugagggcggcucccaacaagucaccaugcucugugcccuuggaacucugcuuuucuagaguccacauagaacugaugucacgugaccugugucuuucugggcuguguugacucaacaccguauccuccaguuuuauccacaugugguggcagaacuacuuuuuuucuuuuuugaaaauuaaauaucccaugcaugugugugugugagagagagacagagagacagagggagacagagagagacagagagagacagagagagagagagagagauuucaucuauagucacacauaacgacccauagucacacauuuaauugacccgugucuuggcuguuguaaacgaugcuuccgugaacauggaagcacagcugucucugggacauaaugcuuucauacccuguaguuaugugcccagaagcugaagugggauuguuaggucuucugguaauuacauuuuuauguuuuugaggaacuuugaaaggaacuuucuacacagguuaccaacaguacugugcccggguucccguugcucuacagcagccccaacacuuuguuauccuuugccuuuuuaaaauuauuuuuauuugaugcaugugcacauguaggcccagugcccacagaagucagaagcgagcaucagaucuccuggaacuggguugugagagcugggaaccaaagcuggguccucuggaagagcaacaacugcucuuaccuuugagccaucucuccaggccucuuuugccuuuuugagagugcagguuccaccuggagugaugugaggucccauuguaauuuugauuagcauuacccugaugauuagaguugucauuuugaguccagacugggcuauguagugacacuguuugaaaaagaaaaagagaaaaagaucuaaggagugauauguacaagaugcaaagcuacgccccagugcauaagaaaggugaggaaagucuguuuccuugcuuaaaaugaagucauucugcagaauucauacccaccuccuuguaagcagcaggagggguuagcaacuccucuggccggcacuucauacgccuguguaucuuacuguucuggccuggccuggccugcacugcucuuaggaagacagccgguccaugcaguggcaccacccaucacgaucacucaugagaagaaugcaaagauaacgcuucaggauuuaacagcaauuccauacucucuucaguacuaaugccuaaugccgacacacccacacuucagucuuccuucuugagcuucauguggucuguguauuuuaucuugaauauuugggugagugcuuugguccuucuuagaagggaaauaaaauacuuacaggagcaaauaugaagacaaaaaguggagcagagacugaaggaaaggccacccagagacugucccaccugaggauucaucccauauacagucaccaaaccuugacacuauuguggaugccaagaagugcugaaaggagccugauauggcugucucccgagaggaccugucagagcuuuacaaauacagaggcggaugcuugcagccaaccacuggacugagcacaggguccccaagauaggaguuagagaaaggacugaaggaguugaaggaguuugcaacccuauaggaagaguaguaauaucaaccaaucagacucccagggacuaagccaucaaccaaggaguucacauggcuccagcugcauacguugcagaggauggccucgucagacaucaaugggaggagagguccuugguccuaugaaagcugaauagaugccccaguguagaggaaucgaggguggggaggcaggagugggcagguagguggaggaacaccuucauagaagcagggggagggaggaugggauaggguguuucuaggagguggggaaacugggaaagggaauaacauuugaaauguaaauaaagaaaauauucaauuaaaaacaaaaaacuaaugccaaaaaacucuuuuggccuaaugccaaagaguugacagagcucucagaaaugaaguuuagaguuuuguauagaugauuaaacagaugcacacagggacagccagccccaggccuguuuccuagugagaggaugugccccuugggaacugugggcucccgaggugugagacaaugccucucucucaugcuuugucguguggucacaaugcuuucaggagugaggccuugccugggcagcugaagcaaaugcuaacagaguccgcagugugcguggcccuguuguguccuauguuuuaacaaaauaagccccggcauuauuguuaggugcuuuuguuaugaaucuuacuguuagcaguugcaugguugguuagauuaacaggugaguaugaguccauauuugaaaugaugaggcuugucucaucuguuuaugaaauucuaauuuguagugaauggcacagaacacuucauuuaaauuauccuguuuaugcaagaagucaucuauuaaauaaagaugguguuagcaguuuuuaaaucggugguuugagacagcuguacauuuuaguuuguagaccaaaaagguuuaggaucuuggguuaaauacuuuuggcaguucuccauacucuacucuaguuagguuauaucugugauugcuuacaauugaaacucauuagccugguuguuuuuaacuuacgucuucuuuuuuuuuuuuuuuuuuuuuuuuuuuuuuuuuuuuuugucuuuucaagacaagguuucucuguauaguccuggcuguccuggaacucacuuuguagaccaggcuggccucgaacucagaaauccgccugccucugccucugccucccgagugcagcaccacgcccggcugaacuuacaucuucuuaaguaagcacauggccucccagcuccccaauagcauguggguccugggugccugaugugaguggugguauuucagggcaccgaauuacacacaaaggcaaauuuguacuugguuucuacucaaauauaguucccaucagaacuguauuuuaaaguagccauuuaccaauuagauaagcaagagcagggguaaaaaugccgugcucucuuacuaacauccaaaaugaaguauuugaauucuuccauuccaguguaagaccuguuccgagccaaaacagaugaccaauuccucugccaucugugacaacccuaaacuuaucaaaccuguccccgugagacccagcagcagccagaggcugcaaggaccugcgcccagcaagguaggaauccacugauucugguuuguuaucuuuucuuuuuuuuccuuuuuuuuuuuuucacaugauugguuuuuuuuucuuuuuuuuuuuucuuuuuuaucauuuuuuauuagguauuucccucauuuacauuuccaaugcuaucccaaaagucccccauacccucccccuccuccccuacccacccacucccacuuuuuggcacuggcguuccccuguacuggggcauauaaaguuuacaugaucaaugggccucuuuccagugauggccgacuaggccaucuuuugauacauaugcagcuagagacaagagcuccggguuacugguuaguucauauuguuccuccuauaggguugcaguucccuuuagcuccuuggguacuuucucuagcuccuccauugggggcccugugauccauccaauagcugacugugagcauccacuucuguguuugcuaggcccuggcauagucucacaagagacagcuauaucuggguccuuucagcaaaaucuugcuaguguaugcaauggugucaucguuuggaggcugauuaugggauggaucccuggauauggcagucucuagaugguccauccuuuugucucagcuccaaacuuugucucuguaacuccuuccauggguguuuuguucccaguucuaagaaggggcaaaguguccacacuuuggucuuccuucuucuugaguuucauguguuucgcaaauuguaucuuauaucuuggguauucuaaguuucugggcuaauaucuacuuaucagugagaacauaucauuugaguucuuuugugauuggguuaccucacucaggaugacgcccuccagguccaaccauuuaccuaggaauuucauaaauucauucguuuuaauagcugaguaguucuccauuguguaaauguaccauauuuucuguauccauuccucuguugaggggcaucuggguucuuuccagcuucuggcuauuauaaauaaggcugcuaugaacauaguggagcaugugucuuucuuaccaguuggaacaucuucuggauauaugcccaggagagguauugcaggauccuccgguaguacuauguccaauuuucugaggaaucgccagacugauuuccagagugguuguacaagcuugcaaucccaccaacaauggaggaguguuccucuuucuccacauccucgccagcaucugcugucaccugaauuuuugaucuuagccauucugacuggugugagguggaaucucaggguugcuuuaauuugcauuucccugaugauuaaggaugcugaacauguuuucaggugcuucucagccauucgguauuccucaggugagaauucuuuguuuagcucagagccccauuuuuuaaugggguucuuugauuuucuggaguccaccuucuagaguccuuuauauauauuggauauuaguccucuaucugauuuaggauagguaaagauccuuucccaaucuguugguggccuuuuugucuuauugacggugucuuuugccuuacagaagcuuugcaguuucaugaggucccauuugucaauucucgaucuuacagcacaagccauugcuguucuauucaggaauuuucccccugugcccauaucuucgaggcuuuuccccacuuucuccucuauaaguuucagugucucugguuuuauguggaguuccuugauccacuuagauuugaccuuaguacaaggagauaggaauggaucgauucacauucuucuacaagauaacaaccaguugugccagcaccauuuguugaaaaugcugucuuccacuggauggucgaaaaucaagugaccauagguguguggguucauuucugggucuucaauucuauuccauuggucuacuugucugucacuauacuaguaccaugcaguuuuuuaucacaauugcucuguaguaaagcuuuaggucgggcauggugauuccaccagauguucauuuauccuugagaagaguuuuugcuauccuagguuuuuuguuauuccagaugaauuugcaaauugcucuuucuaauucauugaagaauugaguuggaauuuugauggggauugcauugaaucuguagauuacuuuuggcaagauagccuuuuuuuuuuuuuuuuuuuuuuuuuuuuuugguuuuuuuuuuuuuuuguuuuucgagacaggguuucucuguguagcccuggcuguccuggcacucacuuuguagaccaggcuggccucaaacucagaaauccgccugccucugccucccaagugcugggauuaaaggcgugcgccaccacgcccggcucaagauagccauuuuuacaauguugauccugccaauccaugagcauaggagaucuuuccaucuucugagaucuucuuuaauuucuuucuucagagacuugaaguucuuaucauacagaucuuucacuuccuuaguuagagucacgccaagauguuuuauauuauuugugacuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucugguagaauuuuuagggucacuuauauauacuaucauaucaucugcaaaaagugauauuuugacuuccucuuuuccaauuuguauccccuugaucuccuuuuguugucgaauugcucuggcuaggacuucaaguacaauguugaauagguagggagaaagugggcagccuugucuagucccugauuuuagugggauugcuucaagcuucucaccguuuacuuugauguuggcuacuaguuugcuguagauugcuuuuaucauguuuagguaugggccuugaauuccugaucuuuccaagacuuuuaucaugaauggguguuggauuuugucaaaugcuuucuucaagucuaaggagaugaucaugugguuuuugucuuugaguuuguuuauauaauggauuacguugauggauuuccguauauuaaaccaucccugcaucccuggaauaaaaccuacuuggucaggauggaugauuguuuuaauguguucuuggauucgguuagcgagaauuuuauugaguauuuuugcaucgauauucaaaagggaaauuggucugaaguucucugucuuuguuggaucuuucuguacuuuagguaucagaguaauuguggcuucauagaaugaguuggguagauagaguaccuuuuacuucuauuuuguggaauaguuugugaagaacuggaauuagaucuucuuugaaggucugauagaacucugcacuaaacccaucugguccugggcuuuuuuuuugguuggaagacuauuaaugacugcuucuauuucuuuaggggauaugggacuguuuagaucguuaacuugauccugauuuaacuuugguaccugguaucugucuagaaauuuguccauuucauccagguuuuccaguuuuguugaguauagccuuuuguagaaggaucugaugguguuuuggauuucuucaggaucuguuguuaugucucccuuuucauuucugauuuuguuaauuaggaugcugucccugugcccucuagugagucuggcuaaggguuuaucuaucuuguugauuuucucaaagaaccagcuccucguuugguugauucuuugaauaguucuucuuguuuccacuugguugauuuugccccugaguuugauuauuuccugccgucuacuccucuugggugaauuugcuuccuuuuauucuagagcuuuuagguguguugucaagcugcuagugugugcucucucuaguuucuuuuuggaggcacucagagcuaugaguuucccucuuagaaaugcuuucauugugucccauaaguuuggguauguuguggcuucauuuucauuaaacucuaaaaagucuuuaauuucuuuauuuauuccuuccuugaccaagggaucauugagaagaguguuguucaguuuccacgugaauguuggagaagguauauccuuuuguuuuaggauaaaauguucuguagauaucuguuaaguccauuuguuuaauaacuucuguuaguuucacugugucccuguuuaguuucuguuuccacgaucuguccauugaugaaagugguguguugaagucucccacuauuauugugugaggugcaaugugugcuuugagcuuuacuaaaguuucuuuaaugaauguggcuguccuugcauuuggagcauagauauucagaauugagaguuccucuuggaggauuuuaccuucgacgcauaugaagugucccuccuugucuuuuuugauaacuuuggguuggaagucgauuuuauucgauauuagaauggcuacuccagcuuguuucuucagaccauuugcuuggaaauuuguuuuccagccuuucacucugagguagugucugucuuuuucccugagauggguuuccuguaagcagcaaaauguuggguccugucuguguagccagucuguuagucuaugucuuuuuauuggggaauugaguccauugauauuaagagauauuaaggaaaaauaauuguugcuuccuauuauuuuuguuguuagaguuggcauucuguucuuguggcugucuucuuuuugguuuguugaaggauuacuuucuugcuuuuucuagggcgugguuuccguccuuguauugguuuuuuguuguuguuguuguuguuguuauccuuugaaggcuggauucguggaaagauaaugugugaauuugguuuugucgugaaauacuuugguuucuccaucuaugauaauugagaguuuggcuggguauaguagcuggcuggcauuuuguguucucuucgugucuguauaacaucuguccuggaucuucuggcuuucauauucucuggugaaaagucugguguaauucugauaggccugacuuuauauguuacuugaccuuuuucccucacugcuuuuaauaugcuaucuuuauuuagugcauuugcuguucugauuauuaugugucaggaggaauuucuuuucugguccagucuauuuggaguucuguaggcuucuuguauguucaugggcaucucuuucuuuagguuugggaaguuuucuucuauaauuuuguugaagauauuugcuggcccuuuaaguugaauaucuucauucucaucuacuccuauuauccguagguuuggucuucucauuguguccuggauuuccuggauguuuugaguuaggaucuuuuugcauuuuguauuuucuuugauuguugugccgauguucucuauggaaucuucugcaccugagauucucucuuccaucucuuguauucuguugcugaugcuugcgucuaugguuccagauuucuuuccuaggguuucucucacuuuggguuuucuuuauugugucuacuucccuuuuuaggucuuggaugguuuuauucaauuccaucaccuguuuggucguguuuuccugcaauucuuuaagggauuuuugugcuuccucuuuaaggucuucuaccuguuuagaguguucuccuguauuucuuuaagugaguuauuaaaguccuucuugauguccuauaccaucaucaugagauaugcuuuuaaauccgggucuaucuuuucggguguguuggggugcccaggacuggguggggugggagugcugcguucugaugauggugugugggcuugguuucuguuaguaagauucuuacguuugccuuucgccaucugguaaucucuggaguuaguugucauaguugucucugguuagaguuuuuucucaggugauuauguuagccucuaucagcagaccugggagacuagaucucuccugaguuucaguggucagaguacucucugcaggcaagcucucuucuugcagggaaggugcccauauaucugguguucgaaccucccuccuggcagaaguuguguuccacucaccagagguccuaagaucccauggagaguccucuggggacauuagggguguccgcagacucugcgcccaaggugccccggugcuggugccgacuagaagggacuugugacccuggucaggccggguuuucugcuucccuaauuaaugcugucucagguuccgcccuauuggauuggagcagcaguuguguuccacucaccagaggucuuaagaucccguggagaguccuguggggaccuuggggauguacgcagacuccgcacccaaggugcaucggugcuggccuguuuucuuuuuuaaacauuuuuuauuuuugaagugaaaaucugauuacauaauucccccucuccuuuccucccuccaaaccuucucuuguaagcucccugugccuucucauucauggccucuacuucuuuaacuccuaaauauuauagauuccuaaauauauaaauacagcuuguucaguccaggcuaucagcuauguguaguauacaguguugcucauauauacacguugucaggguggccauuuggugucagauaaucaaucggugugcucuucccuggggaagacuguuucuccugcugucagaucucauuuguuguaguugucuguccagucuuuucacaguggcuugggaauaaaaacauccuagaugacgaguggauaaugaaaacguggugcauaugcacuguggaguacaauucagcuguaaagagaaaugaaaucaugagauguguagguaaagggggagaacuaggaaacguccugaguaaggcaggccagccccagaaagacaaaugucccacggccucucucacugaggcuccuagcuccagaucucacagucugagcauggaaccuggagugacuguagaccaggaaacgcucugccuuuaucugcuaccucucuaggguucucaaagagcuuugcccguguacuacagggagggccggccagugcugaaggacacugaaggucaguggagaaaggcagggucuugcugcacuguucauucguacuguguaaacugacacuccuccugguacugucccacuuaccaugugcugugcucauggcucaugacaagugucagcagacagaaucauaagccauugggucuguguucuucuaggaugggugacuucccaggccacuggaggaggagccaucaaggcagcacaauacaauguaacaguuuugagcaaugcucuguuccaggggcaaugccaggcacugcaugcagcuuccagggcccguucuggguuagcgcugggccaggggguagucuaagccccacaggccuguggugguaugugugcugugugcuauucagaacagugcagcagagacaaaauuugcugauuagcagggcccugaucuguucuuucaucaaaguuauuccuaaguaaagagguauuuuucaaggaauugaguuaaacaaguuccaaaaaugagcaugagccaaaauauauaaaaugacugacaaauguaaaucagguuuugaauucuuaaaaaaauaaggaaguauuuucuaacuuauuuuaggguuuuauugcuuuccaggagaauguuuuauuucauuuuaguagagauaccaagcagcucuagaaaggagcuuauguuuucaagcagaacgugcagaaggaggaagggcucaggaggaagagggcaggagcggugcagcagccaggccaaggcauugcauagaccugguccuugcacacuagauuagaauacccgcuucucgcuaaccuuggcuuucuauaguucuguggaaagcagccaagauccuucgcuccuacauucuucuauuuucagcacgucuuguucucagcaucccuagauggacccuggcugcagagauggguuaccaugaagaugugcagucuucugcuguagaguauaauuguacacccuggucugugagcugcaaacuccuggcaugcuuuaucagcagaccagauacugugguauaacaguccugggggcagggaggaggaugcugugaagauguuagacacuucaaaggucucaggcuuuccaagguaauaaauuucagcucugucagcaacccuuugugacuagaggaagccaucgguuagcugagcugugcuucacagccuucccucccacaacuaaauggugggaaccuauuuugggauaucuuuuuuuuuccccagaccucggacccugagccucagcacuuaucuuuaacagcacuauuugggaaacaagacaaagcucccugucaggaaacuguaaagcccucccggaccuuugcccaccaccaccaccaucaccaccagcagcagcaagagacgcguccaguucaucacggggucgcaugcucccuguccugugaggagcccaggaagcucucacucccgguggagaagcagcucugcccggccauucagaaacucaugcucgggagcccggggcugcacccccugccucagcacccugaacagugguccugcaaaaguggcagccccaguccugccgggggaauucucccugguccuguccagcuggggucccccuggaauggcaggguugcacacugcacacagagcacuugcagaggccacaagcuauuagagcagcuucaaggugccccuggggcagugcauaaguauaaccccugugcgccuaccgguccagcuguggccacucagguggcuccgggccagaguguggcccaaucacagcugguguauuucaguggcccccuucaaccucccgccccaggacaccaagcucucaggaaggagcagggugcacugccugcacaagcggugucccucucuggcagccaggagagcagccccaccgugcucccuacgcaggagcugcuaaggaagcuccagguaguacaccaggagcagcaggcggccccccggccagccuuggcagccagguucccugugucagcccagggaucagggacagaaaagcccuuggaagccugggucagcaagacagccagcauggagaagcaggcuccucuucugcagguaaauauguacuggggagaaggcugcucuaggacugcagugggauccgcagcuggcugcugggcuacagggaacauguaucacauggguccccauuagaacagcuacacgaagccccuggggucucuggcuuucaccuugucuuuuugccggcauagagacgcuucugugugcuuagucugccugcugcuccucugccauuuagaggugguuuguuuguagaguucacaugucauaaggccuaaagaccagcccagagguggaaaaacacuuagucuuugacuaugaagacccaugcaguugucucuaacaguuuaggaugcaaacaucuggcugauuccugguuuucacccuaugguugguuauugcuugcacauuggcuggguguaugauuuugagugcuuccuacauguuaguagccacguuucuacacagucaacgaucuuguagguucuugaaguaaacagaaauaacagaaaagauacuauuguuuguauugccuucuaggugcacaguauuaugaagaccaggcaggaacaaguauaccacccacaagcugccagagaagggaacauagugugauugcuagaaauaguguaucuuucugggaggaugguugccucuacccaucagcuacugggauagugagccagaaucuguugaccagcugccuguaauggcaucugaaggucugcccaggucuguuucccaugguuugccaugcaguggcagaaaacgugcugccuuuaaagauuggaaugguccuuguacuuauuuuuauuuuuauuuuuauuuuauuuauuuaaaaaucuugaucuuuuuuacuuguuucaucacauagcucagaguagguccucagaaauuguucaugauuuuuaaaacaaaggccuugggcauacacuguauguguuugggugugugaacaugucaggguguucuuuuuuauuaaaucccaggugcaagugccuucugauggaaacugaggcuguguccccucucucacugcgagacaguauugaucccuuucuaaaugucuguuuuucauuucucuuuguugauuuggaaucagaaaaucaggguuaauaaucagacuuaaauuucuacauauacaauucucuuuguuuucaguccucacaaaugccagggaccaaauaaggaaagugugcauucugucagcccacgcugugcucuuccugcugcugagacuccucccuuugggagcaucagcucucaacaccucuccuugggagaucaaauagggaaagcuaagagaaacaacagccugucucccucuaggccauuuucugcccccaaagaugccaagggaaugaugauaaaauuauagccauuucuaaaucgcugcuucuccgcuuccuucucaugaguuuuagaguacuuugagguugagaaauaagacaccuuuuuguuaccugaguuagagacacauggcagccguaggagucagucagacccaguucagaaugucauuugcauaauugggaaagccauuugaaaacuugguuuuagaccugccagucaagggauuagauagacucggcagacagauggguuacaguguuccacacuccauguccccagacuuugcucuucaccccaggaucuacucucacccuguccccacgcccaugacagccaggagaagcagaagcuucuauagauaauuagagacggaacagaaggggcagaugcacaaaucacagucccuccuagugacaggggaggugucuccuugaagagccaggguugggaacugugugugcgucugacaagcguaugggcgauaggaccuaggucagagcaguggacagcuagugcugacuaaggaaagccagcaauccuaagugcauguugccugaaaaccaaacucucgcccaggggccuuaguuucaugcacagaggucgugacaucagcaagaggcuccagagcuguggaauaaccacugaggaaaguucugaggguagaacagggauaggccugccggccuuucucacccacggcaucugagcaccccacuaccaccagugugaacaugacccuucaucucaggagcuacaauuuguggguugcuuccuaaccugccuugugugugucuuugcugugagcagaccgucucaacucagugugucccugcugcaguggcuucucugcucacgcccccugugguuuucacacagucuaccugugccccacugagggagacugauaaugggcucauggcccuaggaggccaagaacuuccugcugccuccuccagccuccuccugccccugcagaacugggaguccuccaccguggccagcaggccccucaccaggcugcagcuccaggaggcacugcugaaccucauccagguaagacuguugaccuuacagucggcaccagggcagggugaguugucucaugccuacuuuggacucuguagagugcuaccaccucccccaacagcuucuaaacucaguuaacuggaugagaucucucagggcuucaagagauuugugacuuggaggaaugaguaaggccuccuaggugccagcagccagaaagaaagggaccaugugaugaaggaucggccagcuagggcacccuaggagcucacucuugggaauagucguagagucauguagggcaagcugcuacgguuuugaaaccugcugcugagaacaggguggaaugauaagaugccuugucagccccugccuugagugucucugcugcucugugugguaacucacagcgaacugugcuguguacuacuuuaacuuuaaugcuuacaggaaagccucuuauaugggcuaacgagaucagguaaaggugcuugccaccaagccugaugauccccauaaugggagaagagauuccuaaguguggucuucucacacaaauacauacacauucacacaaaauaaaucuguaaaauuaacaguuaagacccucuuguuugauuccacagacaaggaaacugaggcuuguguuuggucuggugugacacugagccuggcugcugugcucccaucuccccucguauggccuuuguaaauuaauguuccauuguauaguggagcauucuccugagugaaugauaggccuugguaaggguagugcucaaagccacagagaagcaggcaccucaacuaauguguuuaggaaucccgguaggccguccugaaggugucugcaggcucuguguaagcaucagacugcugcaggagaacaggccagccuuugugugucugguucuccaguugcuguuuaaucccuauuacugaaaacauuucuaagauaacauguuuuagaaagaacaaaaaggaugggacuggaaaugagcaucuguuuggaaggagaacgcaguccgcugugauugagccucccuguuuaauuaugucacuaagcuuacguaugcacuaagacagaaacucuuacagauagccuaacaugguaaguucaugagaauuuagaacaaaugccuacaaauuucuuuaucagaacaguaaagaaauguaagccuaagcuuagauuuuagggauuguugcuuuucuuggcucacuccccucuggucgcauaacccagggcuguguguuuugacuuagccauucaguccuguggccucuggucucuguguguguuucacacuucuccauggugccaauuugguaucccugauacacuacuaaaagugacucagggcaucuuuguaggaaaggcagaaauaaucucuuuauucguccuuugagcacgucacugacugugguguggagaaggaguacgucagagagggugaaacguaggugacugcagaagccucauugccuuugagugggaggggaaagccucuagcauucaucaagaacagcacugcuuagacccagccuucccuucccuccuuaccuagacagaagagcgcagagacucccuagcuacugcuguucauuugccaaggccggaggcuucccgcaggccaugggaagaaacccugcuggcuuugguaaauuaccagugagccacgcuguggguaaaacccagugaaugccugaaaggcugacacacagacauucccggcagccuggaggguguuuaggaaggaccauuccaacucgccagcuccuacccaauggccgagacacuucguguggcucguuccuccuggcugugcuggguguucugagcacauggucuucacauguggacagugaaaucgggcagcucugcccagccucgccuccagccccuucacauccacacacaggccaaccugccugcuggcugucagcacaaacagccgagguggguaaggccagcucagcuccaggcaggcaggaagucuuggcuuuugcuacuugaguaauggucccuggaccuguuggcuuuguuuuccagaaugaugacaacuucuuaagcauaaucuaugaagccuaucucuucagcgugacacaagcagccaugagaaccacguaaccagcuacaugagagcaaagacuaagaauugaucuuccagguucuucaugugaacuggugugaccaaacacacuuaugccuuuuuaacaaaguauagugauacagaguaaaauguuuuauacugucugaugucuggggguuuuguuccuuguuuuuuuuuuuaaaaaaaucacacucuccccuuuacuugguacuacaaguugagcaguuagaugguucuggccaggucauguaagguucgauuuuuccuccauuuaugaggccauuugaggaagaguagaguuuuucaugcgaagggagguucucagagcuauuuauuaauagaaucgcucaggguagagaaggcaguuucucaggguugggcucugugugccauggugcuugauaaccaccagggggcaauauuaccccacaaguugccuacuaaggguuccguguuuucggaagcaaugaggacuuuaccaaagucagccuuuuauuuguaaagcuccauuuggcauguuugaucugagccuuuggaggaagaaucuuucugaagacauuucuagccagcuuucguucuaagugucagcagcggccccggcuugaagcaacgcuccguuucucaguucaaguuggcuuucagacagccacaguuagaaaaugcccaugagaagagguaguggcuauucuggggcagaagguugaagauucuccaagcucuguagagcucaccucuguguccugugcagagagguaagaagcaaaauucaaggggagacagcagaccgaccgacugccuugcauccccaacagugcgugugggcaucagcccugcuaaguauucacaaugaauaaagcuuugucuuuacuguccuaguuauuccugggucauaaaaagaccuuugaguuagcccuuuauaguugaaucguacucuucuauggagaauuuaaaauggaggcuggggugggggugcagguuuccuuacagcuucugauacccagaccaggaagcuuuugacccuuguccucccuccuggcagcagcauggggcuucugggacaccaccucucccuuaggagggcgugcuuucccuaaggaaggaagcugggcugaagagggguuggugucugcucacccucacagcacaucggcugagcaucggcugugcuggccucuggaagggguagguccacaaccgcacugugcugaacucauagggaucucucaagugcuugacagugaguauucacaccgcuuuagucugaugaggagaacagggcaagagauauccaugguucugugguccugaaccauaggaaaaugucgcuuuccaacgugcucacuaaaaugggagcacuauuaggcuaggguguaccucagugguagagcacacacaggauagagccuaacacacaaggcucuugguucaaucccuagcacuuaaaaaaagaaauguuauuuggccaguggccaggcuuuaaaaauaaucugugagggcugggaaugugauuuggugauaaaaauaaauaaaaaguaaaauaaugaaaaacacuua

SEQ ID NO: 3332 - RNA, 277359 nt, Mus musculus
cgggcgccggucgugcuguggcgguggcggcggcggcggcggcugugguagugucggcggcaggcuguccgggaagcaguagcagcaaccgcagcagcagcggcggcccugaggagaguaaggcggccgcgucggcagcggcucgcucgucaggcggaaccucgaucugcccagaggucgcaggcgccgaggcauuugucguuuccuacccggcucggcgcucccggcccuggcugggcagggcagagcgccccuggggaggggcggagcuguaggugaggcuuggggaccccucccccuccuuuuugggccggggguggggaggaggauggggaggucgggagggcggaccccgccccagcgcacccgagcccaccggcggccgcgcccugcggagcucccggauugggcgggagcgaaggcgcuggcgguaaggaucgcugcuggaggugggagguggggggcuucuggcccaccgagagccgagggugggaggcaugauguggggcuauuggggagcccuggaguuggggugcggccaagguggaucggauguaaaauguuuaagaugaucuuauuauuuugaaccugguuagauagaagaggaaagguuguauuucagauggaaaaugaggcauggaugucgccuuggagguagcuggaggggcuacugcagcagaucucacauugccacucuaggguuuugguucuuuucuuggucagaugaguagaauucgcugagggaagagaaucccuuugcguugacuugggguugguaaauugggagcgcgagugagugagguuuuuacacacaagaaggaagauguugguguuuagacaacuucauucuauagcaaccaaccaugaaggagugagucucauuacucuuagccccucaaaagugcuaucagccuuuucuuuuccuugccccccucaacccccucuccugugcuugaucucuuuguaccauuuuucauuuuugaguugacccguuaagaaaaggcccuggacucagaguaauaguugcaggugguuguggcugauugcuuugagcgaacugugaacaguucuguuggagaugacuguaugaaauugcuuaagcguuuaaagugcaacugucucuuacaucuuguuuuucaauagaccuugauacauuuugcguuuauuuaaucauuaugugugugugccuggcauacacacgauagauuacucccucccucuuugaggucaaaggucaaagcuuuugggacuugguucucccacuguggauggcugggaucaaacuuugguuauuagacuugugacauaagcacuuuuuucuguugaguuaucuggaugucccuauuuuuccgauucuucuucugucucagccuuccaagugugagauuagacaugaucuggcuuucuugaagaucgauuuuauuuuuuuauuuucagguguacuuacuguugucucccccccccccccuuuuucuuugguuuuguuguuuuccgagaccugauuucucaguguagcccuggcuaucuuagaacucgcucugcccaccaggcuggccugcuucugucucccaagugcuagaguuaauggcaugugccaccacaccuggcuuuauuucagucuuuacuaaauauuaaaaaaugaaauagaaauuguucuuuacguaaguaccuccauuucuaaggaauauugucagagucaagggauuuuacaauguucugguacccugugggaacauguaucguacguuguugggagacauuacuaaggcgaacaguguccaucagcauuuuacucuuuaccacaauaaaccuaagucuuuuuuggauucuuguuuucuauuagauuauuguagucacgugccuuaucauuuaugacaaaauauuucuuguuaagaaaauaggccauuugauggauauauauuguaauauaaugagaggcacagcacucaguaguucacuuauaaaagaagagaaacugcuauaaaaucaaauuuaaacagcaacuuuccuaacacuuaccuaauuuacuuggggaaguguccaggggagugcuuuucuguaacucaagagagaaacacauagguuagguucaguaguucuccaacugacuguuuuucaugcuaacuucaugaacagacuuucaucuaccagaaaaaauaacuaccuguagagagauugguaggaaacggaggcaaagauaguuaauugauaaaguguauagaucaauuuauagucugaugaucugacuuccacuuuugggcuccucaggcaccugcacucauucacgucauucacacucuccauccuuccuauaacugagcauaaaauaaaucuuaaaugucuuguagcaaaugugguggcucacaccuguaauuccagcuuaggaggcugagauugccuugaguuugaagcuagccugggcuacaaagugaguuccagcucuuacugagcuacaguguagaauugucuuuuuguuuguuuuuuuaaauuaaggugauuugccucuuauucccugugcuauacuuguugaguccacugaaguuuuucuucauugcuaaagucauagaguacuaugucagucuuguaauucagcuucaaacuagaaauuuaaaagugaagguucucagagaaacagccguuuuaugcuguuuacacuuuguaggaaggaggaugggaguuguugaaugcauuuuuguauaagguaucagaaacacugauggagaaagcagggaacacagugcuauagggaaucaaauaagucaucggcuauuuugagagcgaugggccaugauuauguggaguauaauugaauuguauggugcuugagguucuccguguuuuggagugugaguguccaguccuggccuugccauuguguaguguaaggcauauugcugcuuaagcuuagguuguuuuccuuuucaagacaaggugucucugaauagcacuggcuguccuggaacuagcucuguagauuagguuggcuuugaacucagauccuccugccuuugccucccaagugcugggacuaaaguaugugccaccgugccuggccuuaaccuuaacuucuuuuuaaaaaaaaagauacauuuuuauauaugcauauaugugaguuuauguauagcacauguaugcagagggccagagggcaucagcucucuuagagcuaagauauaacauaaacuguuauaaauugccugaugugggugcuggggcagaacccaugacucuugaaagagaauaaaugcucuuagcuguugagccaucucuccagcccuaauuucugaacucuaaccucugccuaaagucuucugaagaauuagaauaauaguaauaguauuuaaccucuuaggauggcuaaacgaguuaauguaguugagacuguuuugacauauaauuagcuugguaacaccuuuugaacuuuauuccuuaagcauuauuuacucauucaguucagauauauauuuugaaggcugggcgauguuucaguagguauaggcaguuguugccaggcugaacacuugaguucaggccgcaggaccgacaugauaggagagaacugauuccuacaaguuuucgucuggccuucacauguucaccauacacacaugcaccagugcacauacaaauagaaaauaaauaauguaauuauuuaaaaaaacacacauauaaaacauugagcauguacuaugugccagguguuuuaggugcuaaaacucuaguaggggacaaggcagaaaaaaaaguugaaaucacagaggcuggagagauggcucagugguuaagaacacggacugcuuuuccugagaucaauucccagcaaccacaugguggcucacagccaucuguaaugggguccaaugcacccuccuggugugucugaaggcagcuacaguguacuuguauaaauaaaaauaaauaaauuuaaaaaaaagcagcacaguagucaggagauugugugauguuucugaugugaauggcucagaccgugauagggaaaagacauggugagaggugguuggauuuugagucuauauugaggguagauaagcuguaguaauugaauuugggaugcaagcaucuuaaagaauaagugaguuuuuuuuuuguuuuuuuguuuuuguuuuguuuuguuuuguuuuguuugaauaaccagaacaaagguggagacagcacuugaagcauguuuugggggaauucuggaaguugaggggagauaugcaggaaaauuaagcuguuucuucucauauuuaaaauuguggcaugcugagaacaucagggagugaguuuagauagagaagagauccaagcuucugagcucggagacacauuguuuuauguuucauccuguccugaaguaagaaugguucuaggugcuccuuagguauuggggaugcaauagcuaacuggcaaacaccucuaucuuuauggcccuuaccuuaucaaaaccugcaagauauccuggagaaaugcagaggaucugacaguaaagucacugaauaaggaaagcuagaaaagcacaguguucuacaggaggaaaagaaaugaucaacucugucauuguuagaugugccagcauguuggguaagagaacucggcuugacuguaaugucuagcagcauagaugacucagaauccugagugaggucgaggaagcagguacaagcaucauucaguucuuuuacuugccuggauugauuagaaaaguuaaaaaugaacaaagaagaugucugugaguuuuuuuuuuaauucuuauauacauaauguuauaugcugaaauaguaaauguaucauauuaagaacucaggaacaguuucuuccguuccaucuuaaguuuucuauuucuuuuuuaaucacuauuucucucucucucucucucuuuuuguuaaaaacuaaaaaacaaaaacaccccccccccccacuauuccaguguauguguauggguguaugccuacucuuacaucugugccugccagugugaguggugccugggguguccggaagggggcauuggaucucuuggaacuggaguuauagaugguugugagcugccagauggaugggugcugggaauugaacuccgauucuuugcaagagcagcagugcauuggacaaucucucaggcuucuuugugugugugugugugugugugugugugaguaugugaaggugucuaucucccuguuguggacuguugugggaaauauuuuaaaaggugccauccugcuaccagccacucuugggccccugccacccugcugccccuauggcuagccccaggcagcagccucccaucucgaaguucucuugcuguggauucugcucacauucccagucauuuacccccuguggucaguggucucagaucccaguaaccugauaaaaucaaaacucuggaggcuuguaauuuauaagucagauuauaucaguaaauuuucaccccacaaaacauccauacagugaacucagagccaauugauauagauauaaacugcuuacuuaccuggauaagacaaauuguccuguaauuauccaucccuuauaagauauucauagcuaccugucacuauuuaaagccucgggaaucuggauugucuuucucuuccuccauuuuccuuccuucuccucucucuccucuccugucucuaaaagucucugccugccuuccuuuuccacugcccaaucacaagcuucuuguuguauuaauauuuaaauuaauuggggaaaaauucugcuacacuggaccaagcuacaauccuucuacuuccaccuacagaggguuggaauuucaggcaugcauuccaugucuaguuuuuguuuuuccuaccaguaaauuucuuugcaguuaaaugcuauuuagucauuuuaaaauugcauuaagaaauauuucauuuuuuucuggucuaaugaugaacucuggcuuuauuuuagaauagauucucuuaauagauaguuuugaacccuuucaagggaaauagcgaucucuaggguucugcagagauucacugaaucacaccagacaauaccaguuuuacagagggaucugguuacuugacugaugaauaaaagaaaugugguuaucauguacuggauuucagcuacauuuuuucaugcucucuuuguggaagauaugaaaaaaaaguucuauauuucauuaggacagugacugucauguguucucugcugagcaaauaauagguaguuacuauauuugaugaaugaauggauaauaguacaaguaaauaaaugaauucacaagugauugaauggcugaagccagaaaauagaguugcuuacugaggauggagaguuucaaaagcugacguuaaaggacccauucauguguguauugaacugagcagcacuggagcaggaguggugguguagggcauagcgacuaucgugaaguuggcgccugugcauccugagaugguugucagcagucagugaggagggcgggguagaagucuauguuggcugaauggcaugagaagcacaguaagggucuccaugagggucuaggaaucauggucuggcgaaggccauuucuuguuauuacguauggcaugggagacuagaaaagggcuguguggcaagaggaaagccaguuuucaaguaaaggcagaaagaagacguagguagacuucucaagaaaguauauuggcuucuuaccauuucuuaacuuaaaaagucucuucuugaaaaauucugcaacuucauauuuuauuguucuaagcugcuuucagcuuugcagccaaagguuguuauuguuugauuuuuauuuuauuauuuuauuuugagucaggguuucaugucuguccucagauucauuaugaccuugagcucuugauccuuuaucuuaccuacucuauccaaauuuagggauuccaggcuggaaccaccauccccagcuuuagagccaaacuucuugagaagagugguccacauuuauuguauucuuccauuuuuuuuuuuuuuuaccugcgauuucuuuuccuucugugucaucuuuaugacuucacugagacugaaaauagcacaugaauauagccaguggcuguuuuucuguccuuguauuuaauccuuuagcagcuguaccuguggucuguugcuacauaauaaaugacccccaaauuuaaaauaagaaacauuucuccuuugaugguuucugugucagagucugguuguguuuggugccucugauucagggucaucagugaggguguggagguguugacugagguugcugugaucucagagcuucuucaccggaggagguucugcuucuaggcuucccaugaauggcuggugguaggcuucagguuuuuguuggcuguucacugccauauggaucccugcguggguuuaugcgggcacuuacaacaauagcaccuuguaucccuugaaucaagagcucgggagggcaguggggagauacuagccacaguguuuuguaacuuaaucuuguaagugaugugcucucacuuuugcucuguuuuguguauuagaugguuguguuuagauccagcaaacucaggaugggauuucauuccuaaugccaugacuaccuggaggcagaggcuauccauguuggaaacugcccgccacagaagaugucacaguugcucuuucuuuuuuuucuuuuuucuuuuuaagguuuauuuauuuuauauauaugaguacacuguagcugucuucagacacaccagaagagggcguugguucccauuacagaugguuaugugccaccaugugguuguugggaacugaacucagaaccucuggaagagcagucagugcucuuaaccacugagccaucuuuacagucccacaguugcucuuucucuugcucuugcucuugcucugucucugucucugucucugucucugucucugucucugucucugucucugucucuucucuucucuucucuucucuucucuucucuucucuucucuucuugagacaagguuuuguugugucuuccaggaugguuuugaacucacuacauagcucaggcuggcuuuaaauucacaccagucaucuuguuucagcuuuuccaagugcugggauuccagguggguaccaugauccuggcauucuccuuuugaaaaucucucucuugaggauuuucagagggugguccuguguuucuugcucaguuucucugcucugcuuucagucacucuuugaauccuuuccuacccacucauuaaaugguugaauuucuccaggccaucuuauccccuuguguuuuaucuuauguugaggauguauucucaucccucuuuccugagugugaggaccagugcauuuaacuugauuuaaguugaucacuauuuccacuuagaagcuccuuagacuuagugcauuccaaucugaaugcaugaugccugcucuucucugggguuucuuagucaggacaccaauccagaaauauaagugguuucucccuccuuucuaccuucugcuuacuauuccuuauugauuuuuuuaucacugugguaguguugguaugaacauuuuuaaagagguauuuaaugcauucccuccuggguugcaagcugugagugagugcuaaguaagguucuuagccuuugcuccuaccuauugaaaguaugagcacuuuuuguuuguuuguuugcuuauuuuuugagacauaguuucccuguguagccuuggcugucuuguaacucagucuguagacuaggcuagccuggagcuaagagauccaccugccccagccucccaaggacuagaauuaaccugccucagccucccaaggacuagaauuaaagguguucgucccuccccacaagggaagcuaucaagguuuuuuuuuuuuuuguuuuuuuuuuuguuuuuuugguuuucugagaauggguagcccuggcuguccuggaauucacuuuguagaccaggcuggccucgaacucagaaauucgacugccucugccucccgagugcugggauuaaaggcgugugccaccaugcccgguacacuaucaaguuuuaaguaggacacauuaucaaguauguuuuagaaggaugcucacaauguagccagccuugaacuugcaguccucuugucuuugcacuguauugcgaucauauucuaagugugugccaccaacaugauuugguaguuauuaaacugucauuguuagugguucaccaacgaauacaaugaauccccugcauuuuuucuaguuuuauugugguauacuauguaugaauaaacaguuuuaccuugccauucuuugaauauaucaucuuaacuucccccauuauuauuguuuaucugaaagcccuuucauucagaauuaaccaguguucugugagaaaugcuuuaggcuuaacauuugugauauuaucgugaggccauucuagaaaauaaaaguuuuaacuuuagauuucauuuuaauguguaauauaauuuacccuuuagaguagaaaaaauaugaacuagagaaguaguuguugcacaagcacaaacaccucagcuauaucacuagaacccaugugaaaaagccaagcauggggccagucccuggggcuugcuguccagucagccuagccuaauaugugagcuccaggccaaaugaaagacuugucucaaauuauaaggcuccugaggaaugauaccuaaaaugaccccuagucuagaugcaugcacacacauaugcacucacauaaacacacagcuguauccacauguauacauacaaacacacaaagauauuuuuaucuuauauaucauauauaauauacacuaucuaaauuugauauauacuauaucauauauacuauuuuauguauuuauauaugauauacuauacaucaaagauauuauaucuaucuaaauauagauauuuagaaaaauaucuaaaacaaauguguuguuaacaaaguguggaauacuuaucaucuucuagaucaaauauuaggacauugucaccguuuuagaagcuuucgguacuuaucacuaguccacuccuacuuuaucgagacauagccacuguccugacuuauaugggacucauacuguaggcugccucuucuguagugagacagaaaauuccaccugucagcccagcauuuaggaagcugagacaggaguuagagggcacauuggacuauauaauaaguuugaagacuauauaauacguuugagguuuucuagauacgagauuaaaagcauaauucacuaaaagaaaauaagacaauuugauguuuauaaaaauuaaaaauuuggccagguguggugguacaugccuuuaaucucagcacuagaggcacagggacagggacagguaggauagguagcaagggaggggcagaggcaggugaauaucuguaaguuugagaccaaccuggucuacauaguaaguuccagggcauauagaauuacauagagagacccuguuuccccaaaacaaaaaagccccaacaaacaaacaagcugaaaguuuuacucuuaaaaugcagucaaaauaaagaaacaaaauaaaacaaaugacaaaugggagaaaaauacuugcagucauguaguugauaaaggacuugggucuuuugcuuagaacauuauucuuauuuuuaaagauuuuauuuuuuugugugaguacucacagagaggagaagggaucauuggaucuuuuggagcuggagcuccagguguuugugagccugacgugggugguaaggucugaacucuggcccucuuacagagcaguaagcacucuaaauuucugagccaucucuccaucuaaaugcgagcucccuugcauuuagaacaugugaagaacucuuacuaauaagauaaacaagccaagagaauaugaacaaaagacuugaauagugccuucacugccaugguaauaagcaccugggcaagauauuucccaccguuagucauuaggucagagacaccacagugagauaaccacccacacccuuggagguggcucaaaugaaaagaauggguaguguaggugaggaugugaggagcuggcauuucugugcauggccggcagcacgauuaaauguuucagauauuauggaaauaagucaaacauauuuacuguauacccuuagcuuuuaugauuaggugucuacaaaagaggaaaugaaaacauguccacagauuuguguguggguauugauagcagcauuaauuacaacagcaaaauuugggagcagguaagcugauggacaauaaaaaggaacaaacuacuaauaacguucacauaaauagccucaaaauauuaugccgaugaagaaauagcaggcuuauaauuuuauuuaugagaagcuuacagagaagucugucaaaucaguugugguuggaucaaggcauaggacugaggauugaaaagugaauauaggagccaggcugccuuagcuuccugagugcuggguuuauaggugggugccaccaugcuuggcauaagcaacuuuuuuuguguuaguuguauaauuguacaaacuuacuaaacuuacucaucaacauauacuacaaaaugguguuugacuaaugacuuaauaaaacuauuuaagauguuauuuggcugugggccugguggauuuucauuuuaaaauuggaaucaguuugucagauuaagaacuguaggagguucgggcaugauggggcauacguuuaauccuagcauuuggcaggaagagguagguaguucucugaguucaaggccagccuggucuacagggugaguucuaggauagccagggccaaaugguaaccuugucucaaaauaaaaacaaaaaacaaaauggaaaaaaaaaagauagaaagaaauguauugagcuggugaauguauacaccuuuaauccuaaaggcagaaguggguggaucucugugaguucaaagccugccuggucuacauagugaguuccaggacagccaaggcuauguagagagaccccaucucaaaaggaacaaaacaaaaaggaagggccugggugauagacagcucaagugugccugauguucuacaguucagugaguagcauagugaaauaaaccugcaggacuguggcuacacaguguagagugcuugccuagcuugccuguguuagaugcucaucacuuuauugauuggauaugaugguauaagucuucaguugcagaacucgggguacaggcuggaauaucagaguuccagguuauucucaguuguauagcaagcucaaggcuuaaacaugaacccauguuccaaaaaccaaaaaccaaaaccaaaaccaaaaacgaaaucccacuggguaagucuuagauaagguggaaggugagcaggcaccugagguuguucuaugacuuugaaagaugugggucaagacaugauugugccuacacucacauacaugcacauacaugaacccccucaaaagauaaaagaguguugagauccuaaauuagaauuugguuagacuugagauuacccuagcaagacaaugucucaaaaagcaaacaaaaaacaaguaaaagguaucacaaguugucuuguuagacaaguuggguaaaaucacaucuguaugauguggaaucuugaauuguuaaaugugauuccauuguuuuucauuucuuagaugauucuauuaaaauuacauuuauuuauuugugugugugcaagagaaagaaagguagaaacagacagagauagagaggcagacagacagacagacagacagacauggagggcugguggaggucagaagaaaacuugugauacuugguugucuccuucuaccauggggaucccagggguuagacgcagguuaucuggcuuuguggcaagugaugagccaucccaaaagccuuuuacuuguuuuuuguuugcuuuuugagacauugucuugcuaggguaaucucaaauuuauggcagucuuaccucagcugcccagaaugcugggauuauaggugugagccacugcauaguuuauaguucuuuucuuuugcaguauuuuuacacagcguuuguuuuauuaaugcuuagauuuguuuuuguauuauuacuuuuuuuuuuaacaagaccugaucucauaguguuguucaggcuggccguuacugccaggcuuaaguuacccugccaccucagcuuccuguucuagccuuccaaauagcugggccuacaagcauaugccaugguucuuggcuuuuauuuauucauuugauaaguaauaaacuuaaccccucaugccccacuauuuaguccugacuagcuuggaacucacaaagauccaaucugugucuugagugcuaaaauuaaggaguggccaccaugccuggccuaguuacuuaccuugaggaugggauccugcuuuguaguccaagcugauagcaguuuguaaugaucuugacuccauggcacuuaccaugccuuagcuucuagugaugggagugccagcaggaaaucugcuugucaagagaauuuugaaauaaaauguauuuucuguuuauuauugcuguauggaggcaaguuagaauuuucagaauaggcuguauuuuucuaaguauugccagcuuagccuaauaacuuaaccuguaaauucuuuuugauuuccauguuguauaauguguaaauuguuacuguuuuuccuuugcaguucagguaccccuuccccccuucucuggcuaggauuucuagcauugguugcauagaauguugaugagugguguccuugucauuuacuucucagagagaacguuuugucuuuaucucuguuaaguauuauaauaucaggcauaauacacacauaaggcauggccaagccuagaccugguaagaugagcccuuuaucucuuaacagaaagaagaauaagccuaauuucuggugcucuggucuuugugcuaauugucaaaggguaacagaaacauaaguguuuaauugucagcuugggggcaguccauggguaagaaucuagucuagguugcugcuuaaguggauuuuuuuucccccuggagacagggucucauauagcacaaucugacuuuuaauuccugauccuacugucucuaccuucuuagugcugggaguagaguuugugacugcgagaggaacagcaaacaguuuucagaacucaggaggguggcccacugguuagaacaaucacaaugggugugucucagagaggcagagcccugaggacuacauguccuuaguauuccaugcuguugugguguuugcucuguuugccuucgaggucauaacaucccucauagaucugugaguuguauaaaaacucuaaggggguuuccaggcccucacugggcagggucauuggcacuuagaguagcagugacgggauugaucuuuuucaagcauugcugcuggagcggauaacgacucagcaucacccucagaacuuagagauguagauuauuaguaacaauaaccacacuuagaaagaauuuagagcucuagauugucuguuuaguuaagauauuuuuguuaguggcuuugacuuagaaaaucuuggggaacaauuuaaaguucagaaaggcacacuuuugauaacugagugagggacuuuuugaggcuagggaacaagaacaaugacagccugacuaguacuagcugaugugccuuucuugcuaaagcugaauuguugaucaauacgauuauuaauuucuuguaaccaguuuugcccuugacuuccugauaugauuuaauaaaaauaguuaaugugcacccugaggauuuacaguagaaaugacugguuguuuuuauauaaaaguuuagauuuuuaaaaaagucuucuuuuuaagauuuuuuaauaugauuauuuuuuaagauaaauaauaaaaugauugauccuuucuuuguaaccacaaauugcagccugccaauaugagaaacuggcugagaaaaauaccuugcuugcuuauacuuuguaaaccuaacaaguugccuagacacgaauguauguggguucuugggaauaauguguuuucuaccuguaauauauaaaacauuucuucauguagaaguauuggagaacgugcuguuuuuuuccucgugcucauuguaauuguucacuugaagagaaauggaguguaaccacacugugauuuuuauacagcuugaaagauuuuacugggggauauaagcugugggagaaaaaaauaguuguugaaaccuugcuuuguccaccaagucuguguauuccuucccuaaaauaaaguuaagaagaaccugcuugaacuaucaagaagaugccuuucucucucucucccucccucccucccucccucccucccucccucccucccucccucccucccucccucccuccgucccuguguguguguguguguguguguguguguguguguguguguguguguguguguguguguguucugcugacuccagucuuuuuauuuaaucuggccuggccccaagguggagaugccccugacuccugcuccugugugcugggauuacugguaugccucuaugcccugcucugguagcaguucucuuuaggccuccuauccugcaugccuugggagucuuacauacaagcuauaguuuucaaagcaccuucggaguuauuucucuacagauacuucuauuggcugcuuuaguguguaccuuuuauugaguuaagaaaguuucuucuuaucuuaaaauuuucaucauuaauaguaaauggaugguuuucauaucugcugagaucaaauguacuuaguuuuaacuugugugguuaauuagauggaaguuaaaauucauguuuauuaaagaauuuaaguaguuuugcuuuaaacgguuuuaauuacaucccuucagguauuuuccuugaugauucuucacuuaaaaaaaaguuacauuuauuuauuuguuuauuuauuauuuguuuauuuuguguaugugugcuacuauucuggauggggguugucuuucaugcuuauggaguuacaggugguuuugagcuacauauguaggugcugggaauuguacugugguccucugaaggaacaguaugaacucauaacugccgagccaucuccagcuccuaugugauuguaaagcagguuucagggauuguggcuuuguucguucaucucacauguugcuauuuccauucugguacaagccugguuaggcuaccagguuauuuaaaacguuuuguauuuugugagauauuggaauuuggguuuuauggauuggaaauugugaacagguacuucuggcuuuaaauuucauuuuuuuuuuuuaauagacagggucuuaccauuaagcuguuccugcuguucuugucuaacuuggguucaacugauucuccuggcuccaucucccaaguagcugggaugacauaccaauaucacauuguaccaugcucaugauuuuuuuuuuuuuaauuuaggaugagauuugguauaaaauguaagauaauuaaagcuacaguugaauauuuuaguauucuaaaagaacaguguaaaugagguuuaggaucaagggaaggcucccuaagccagagcuugccucccuugagcuaaguugcagauuguugauauaaaagaggcucugauuagcaacauuguuuaguccuaaguaucuguuugacaagguguuugucauggugaggauguugauagaacucaccauuugcuugauuaaauugauaagaauuauugaaaccuauaaucuaucugauuuguaacugaguuacuaaucccucuauaaaagggaaaaauaauaacaguggcaaauauuaugauuguaccuuuaauaucauauuuugcuguucuuaucagagacucucuuucauguuacuaugcccuuuuguuggagcugccuuagccagugagugaucucuaguuuuuagucuacagucacgcuaagguuguauaagucaggguaaggugugucagacacacaugguuugaagaaaccuaguuuuacuaaguuacaugaggaagguguaacaaugaaugcuuucuuuaguauguaaauuucuauuuuuuuuuuaaagauuuauuaauuuauuuuauguagaugaguacacuguagcuguacagaugguugugagccaucaugugguugcugggaauugaauucaggaccucugcuccuucuggccccacuugcucaggcccaaagauuuauuuauuauuauaucuaaguacacuguagccgucuucagacacaguagaggagggugucagaucucauuacagaagguuuugagccaccaugugguugcugggauuugaacucaggaccuuuggaagagcagucagugcucuuaacugcugagccaucucuccagcccuugaugcucuuuuucuaauaauacauuuauauuuaaauuuuguguguagccauuagagacagcuuguaggggucauuuuucuccuuccccuauauuccugggauugaacucaaauguuggguuugguggaaagcacuuuuacuugaugaggugacuucacuggccuagguuuuuguuacacuuuucauauagcuaugcaacaucaccuuuaaaguuuacauuuaaaaacuacagugucaaauuacaaaacuuucagaagggacuagcaaaauggcuuuggaggugugagugcuuguuauguaaauaugagaauuagauuuggauucuuaguauccaccugucuauaaucccagaacucuggagacagaggcagacgaucuguagacaggcugcuuaccuagauuagccuaaccagugagcucugcguucaagugagagauccugccucaguaucucaguguaaauguaauucuuggggggagguggaguucuuugcccugucuuguaccugauuaauuacagggcguuucuaugccuguuagcuccugaauaaagauauagagaccagguauuuuuuauuaacaagcugcaagcacuaauagcgggacagauucugaucuauucuaaccugacuaggcugcuacuacccagccaaauuuccuugccaucuggucuugccccaguuugcucuggucccugugugucugucuccauggcagcuuucuccucgugaucucauggugaauccuccugguuucuucacaggguuucuccacacuugcuucuccuccugguccuucuccaccuccccguacccccagcccccguuccuuugggaccccuugacugagaucagaaguucugccuaucucuucugcccagcuaauggggugaucagcuguagagcuauuaaacaaucagaggugaugaaaaacaauuuuuauguaacauagagacuggagaugcuugaucaugcuaucaucugaacugcacccagauaucugggcagagaaaucagcaucugaguacacagugcacaaaacauguaaaguagagaguaaccaaggaagauaacuuacauuagccuauggcuucuaacaaauacauucauacccaauaugcaucuguauaaugcagacauuacauacaugcaaaaaucacaaaaaguucucuuaauguuuuaaguaaguuacaguuuuucaugacacuuuuaucuuagcuagccuuggcuacuugugaucugaggguuggagucauuccuguguguauaugaauauaugcauguuguguaauacugauuguauuauaugcauucuuucacaacuuacuuuucuguuuuacagcaauagacuaugguuauccacacuuuguaugucagguaaagauaaguauauuuagaguuugcagauaacauaauuuacuuaaaccaaucucuugcugaaaauuuacauucuugcugguacaaaugaugcaguaaugaacaucauuguacauugaccuuagaaccuaugaaacaugcagaaugguuuaaaaagugaaacuuguaaaucuuggguuugauucugcaugcuugugcucccagcacgcggaaagugggagaggagcaucaggacuuuaaggucguccucagcugcaugacagaguacagagauccugucucagaacacaagcgaaaaaaaaaaucuucugaguuggaaguguagcucagugguaacccuuucuuaccuugugcaaagcccuggguucagucuccacuacuauauauaaaaaaaauuagaagaggaaacuucuuuuucaagugguagcucauuucaaauugugauucugcuaaauuguacuucaguaugauuuuuaaaucauuuuucagagagcuuaaaaugaauauuugugacccuagaaauuucauagcuuuucaagaaaacagucuuacaaaaaauuuggaauauaauuuaaaauuuaagauacuuaacucauuuucagauaauaagugauuauuacagaugaguauaacuaguacagaagguuagucuagugauuuugagauuuaggccagaauuuuacuagcagugcuuuaaauagcuaaugguaguaauuacaucuuuugcaucuucuuauaaaugucucauagcacauuuaugugagccuauucuguuauaauuaagguaaguuacuauguuacucuuaaagcauuuuauuuaguuccaugguaugcuuacagcuuuuguaagaagagugagaauuaaaggguccgugcaaucucuguguacagauguacauguagacauuuggguacaccccaggauuuugauuaaguguaucugcgguguguggccaguguugacauuuuguguuuuuuauggucuagaagcuuuguggugguaugaagguggccaggcuugacuucaauuuuguuguucuauuuugagaacucauugagauuagauaauaaauaugcaaaguggaauuugaaguguuaugaaacagcuuagcaaaagaguuugacacccuuugcuguuccucuuuaaccuuucacccaaaaaggucacauuuuuuccauguauaugauauguauugaacaugugcaaacuguucuugcuuaaucacuuucuguuuguuuguuuguuuguuuuucaagacaggguuucucuguagcccuggcuguccaggaacuugcuuuguagaccagacuggccucaaacucagagaucugccugccucugccucccuagugcugcaguuaaaggcaugccaccacugcccagaugacuuacuuuaagcaucacaauuauuuauauauagcuuacucugagguagguauuauuaguggucuaaaaaaggcuuagaguauaaugguggauauguguagucuauaugcaaagccuuuuuguauaagaaauuccaguuauggaguuuugagagccaguccaucccuacccugguauccuuccaacuuuaugucuuuuuuuguucaguuacccauugguuaguuugugcuguucauauucuucuggauguugaaccacccacugaaacgugguuaacuaaagggaaccauacucagaaagaaaacugacucucccuaccccagaagcugucagcuguucguagcucuucaguuaaaggaguguguaggcuuuuaacccccuucacucagugcuagacuguggacuggcuugaucuugugcaggcaaacacagcugcugugaguuccuuaguguagugguccucucaugagaagacagucuuugcucuggguuuucccugaccuuugguucuuacaaugucucugaauacuuuuccgugaugaucccugagccuuggggaggccaggauauacaguaugucugucccauuuaggcugaguacuccacagccacuaauucucugcacuucucucaccaguagugaguuucuguguuaaccaucauucagcgcacaaagaaacuaaagaguggcagcacucuacagaugcagagauaaaauuuggagggcagugugguauuaugucuguuuagcaaaauaaucagucaguucacuccuggggccuaugaacuuuccaaccauggguuaauuggcuagauuugcaauaccaggcauguucuucuucccguggaacaguccuuaaauccaaccagaaagugguuacuuccauaacaucgaugccagccccuuuuuugcuguucucagcuugggaauauuguuggugacuuucauuuucucuccaguagccugcauagcuauagaaguaggugucggagaggacgcuuccuggucuuuaccaacuauuuauguucugugaccaauguguguaguguccucagaaaucaaaucuuaccauuaaguuuaaguucuggugggcagccaagagcggagccagcacucuguacuuuuuuccaguucuuucuuuuugagacaguuuugcuggcgacacaucagcuugguuuggaauuuguaaaagcucacauuggccuugaacuugauaaccucuugcuucaucuuccccaaugcuugggguuacaagcagauacaacccugucugucugguuuauuuguuuuguuuauuuuauuucaucuuauauuuugagacguagcucaagcuggccuuaucugccucagacucccuguagcuaggauuauaaacaugucucaugucugcuuuuauaauaaagucuguaguucuuuaugagaauaugaugaucugaugggacuuuguuucccagaauuuuacuuagaacauuauuggguauuguacaguauccgguguugauguacauuauuuuauugaugaaauacuugauacguaugcucaguguuacacauaaaagcacucgguaaccugauaucaaggagagguuucccugccaaauuaguuuuaaaaaaggggaagggcuggagagauggcucaguggcuaagagcauguucuauuuuuuuuuuaagauuuauuuuuauuauucuaauuauguguuauggguuaugugcacaugaaugcgggugcgcagagguucaguggugucugauuccucuggagcuggcuauuguacuucuaguccuccauuugaauuuuagaaucagcauuuuuaaauuacaugaaaaucuacugggauuuugugaaugaacugggagaagagcugauaccuucacaguauggguaacuuuuaacuuuuuuuuucauuauugagguaugauuuuauguauuuuaguagagauuuaaaugcuugaacauuuuuguuagguuuuagguaccuuuuauagguuuguuguuguuagcaggacuuaacuuauuuuuugaucagggucuuguguaugugaaacucagcuguagaugaagauggccuuuaccucuucugcugcaauuauugccauguaugugcugcaacauccauuaauguaguguuggggcucgaacccagagcuacauuucuucuccucccccucacucuucucucucuguaugauauguguuugacuguuggcaggggucagccucagguguugauccuggccuucaccuugguugaaauggagucuuuuguucuuuagcuggcccaugagcuucugggaauuuucccuucuccgccucccaucucaccauaggagcacugggauuucagaugcaugcuaucgccuucaguucuaccucauuucuggggaagugaccaaguguucucauccuugcauggcaaguacuuuacacacugauccaucucccuaaccuuaaccuuaagagcuacauuuucuaauuguuauucccaaugugcaugaaaguauugauauuuaaauauugaucuuauggaaauuuagcuguuauuaguucuaaugaugugucaaaguauuaauauuuauauauugagcuucucucugacuaaugcauuaaguuuuuuuuauugauucugauaauguauucaaguauugauauuucugcacugaucuuauguaauguucugaguucuguuauucaaauguuucacuugguaauuaucaguugauacucuaauuuuuaauuagaaaaacaguacauuaugaguaaucuaauuuuaaagccaugagaauacuuaaugaaaagugacucuuccccagauaaagguaacagaacaccucugagaaaaguauuuaucauuggaauauuuaauguaugaucuuuucauugcagauauggcauaagauauuucuucaagauuggacagcugcuggccugcuacuucuguuagcuguaagcugacuuuauagccauagagaaaccucacagaaucacauuguuguuuuuuucuucauaccauuucuggcaccuaaguucacccugcaaccauguauggaagugcucgaucaguagggaagguggaaccaagcagccagaguccugggcgaucaccucggcuuccucgguccccucgcuuaggucaucggcgaacaaauaguacaggagggaguucuggaaacaguguuggagguggcagugggaaaacccuuucaauggagaauauacaguccuuaaaugcugccuaugcuacaucuggcccuauguaccuaagugaccaugaaaacgugggugcagaaacaccuaaaagcaccaugacacuuggccguucugggggacgcuugccuuacgguguuaggaugacugcuaugggcaguagccccaacauagcaagcagugggguugcuagugauaccauagcauuuggagaacaucaccucccuccuguuaguauggcaucuacuguaccucacucucuucgucaggcaagagauaacaccaucauggaucugcagacacagcugaaggaaguauuaagagaaaacgaucuuuugaggaaagauguggaaguaaaggagagcaaauuaaguucaucaaugaauaguaucaagaccuucuggagcccagaguuaaagaaagagcgggccuugagaaaagaugaagcuuccaaaaucaccauuuggaaggagcaguaccgaguuguacaggaggaaaaccagguuaguuucauuuauacauuuaucuuuaugggcugaguccauguauauaaacaaaaagaggcauuccuuuuccaucccgucuuagauuucccccaucuuuguucuuuuauuuuuuuuauuuauccuuuuuacuuuagaacucuguuucuacuuucuuagccuuuuuaagacuuguuccuguacauggugcaaaacacucacacauauaaauuaaaaaaaaaaaaaucacaaagcagugacgacaacaacaaaaacccaacuugagcuggacagugguggugcccaccuuugauuccagcacucaggaggcaggggcagguggaucuuuaugacuuggaggacagccuggucuacagaacaaguuucaggacagccaaggcuacauagagaaacccugucucaaaaagaaaaaaaagaaaaagagcuugaggacugcuuuggcuacauagugaauucagggcuaaccugagguuacauauugaagcuuugucucaaaauuagaaacaaucaaacacaggacugcagauacaguucaaugaaagagcauuuuccuagccuguagcaggagauucuuggaccugucuugccuucagauugucaucaccuguauuggaauggccuuuuggccgggagauaguggugguggugguggcacacuccuuuaauccuagcacucaggagacagaggcaggcagaucucugugagccuaaggccagccuggucuagagagagugcuaaggcaaccagggguacacagagaaaucaucucuugaaaaacaacaaaaacaaaaaaucaaagggcuucuuaaugauacaguugcauuugagucaccucugccucuguaaguagccccucagucauagccuuuauuuuauuuauauugguguuagguuuugucucuguguaugucgguuugagggugucagauccucuggaacuggaguuacagacaauugugagcugcugugugggugcugggauuugaaccuggguccucuggaagaacaacuaguguucuuaacugcugagcugagccaucucucuagucccauaagagcaggauauuuuguugguuugcuugcuuguuuugguuuuugagacacaguucucugaguaacaccgggcuguccuggaacucacucuguagaccaggcuggccuagaacucacagagaucuuccugccccugccuccugagugcugggauuaaaggagugggucacuguguuuggcuccccucucccauauuuuucuaagucaccucaauaaaaaguauucauuggcauaccaaaguaaguaaaagguucauauuuuuaaaaacaauuuaaagucaauucagcacuucucucuugcuucacuguguggugugggcuggucuggaacgcuucugcuuccauccccaagugcuuagauuuauguuagcuugccugaccaccagcucaaacugguccuuucaagaguagauucauugucucucagucugacuugauuacucaguacauaaauuaaaagcagaucugguuuuaccaaauacacuauugaauuaccuaaucaucaacgugucuugcugaaaacauagccaccaauaagguaguuuuauugucaagugaccuggaaauguuuauugaggaaaaaaguuauuggcauauuuuuugacuuugaaauaaauaaagcauuucuuaauguguauacuuuaaggguguauggggaucaggagagaaaucauuucaguaucccuuuucuaguuaccaggguauauucaaaggcaaaauauuuaauuuucugagaagacaauuaugggcacuuaguauuuucugggaaaggaacaguccacagguuuuucuugccaaggaaaccauuaugugcugaagauggugaauacugcuuuaucuggguccaccccaugcccuaauuaaacgccagugcuggcagauacauucuucuugcacccacuguaauuaccacagaauucuaaaauuguguaacuuuaguccaaaaaacaaagggugcaauuuuaaagacaguacagugagauacagacacugagaaugcuaauuaauagauuauagucagcuagcagugggccccuaauuaaauagugcauucauuauccucuucuuagcucccagaggucagacaucuuucauuugugaagaagacugguuuauuagaauuuauagcaauuaaauacauuucuguauuucuguuugagccuggggauuuugguccauuuuaaauguuugaucugauugagcuggguccagaauccuaucaguauagaacauauuugcuuaggauugcugauugcuuggugggcaugacucauuauuauggcucucuuagaagcuugugucuaagauaaaauuucucagguguuucuaugucuuagacuccuuuuguuacuuuacuuucaaauaguuguugauuaagaguugugugugugugucuauuuauguaugugugaauauaaauauauauauuugagcagagaaauccuuuucuucuaaaaaaaguugugacuagaaagacuuuaguguuagcuuuuuagagaagaaugaaaaucuuccuaugggcuuuguauuguugcagagcuagugaaacuuuuggagaaguuacauuuuagauuuuauuuucaucagcuauuguacuuaaaaaaaagauuuguuuguuuauguauaugagugcuuuucugcauguaagccugcauaucagaagagggcaucagcucccauuagacauaguuguaagcuaugacauuguuguugggaauugaacuaaggaccucuagaagaggagagcagccaugugcuuaacugcugagcugucacuccaguccuuuguacuuuuuuuuuuuuuuuuugauuauguguuguaagaauucucuguguuggauuuaguuguaugcuuauuuuaaggauaauuauuuuauggcugaggagauggcucaguuguuaaaaugcaagugaggaccugaguuugaucccuauguaacagcugggcauggugauaugcaccugugauucuagcccacaaggagacaggaggacccaucccugcagcugcuggccagcuagucuuguggcauccucaaguccuagguguaaacagagaugaagaaugaaucuggaagucaucugacaucaagauuuagcuucuacaugaacacacagcuauaagcgugcauauuugcauguucacaaagcuguacauucauguauacacaugaacguauacagauauacacacaguaaauaauuauuuuaaugcucuuucacuaaaauuuuguuugaauagaauauucuguuugauauuguaggauggcaagugaacugccuuuaauuuuuuucuuuuucuuuuuggugguuagauuguauuuguguguguguguuuggaugugccugugcuguggugcguguguggaggucagaugauagcuuuugggaacagguuugcuuccaugguguguccugaggaucacccucaggcuccggagauaaauucuuuugccucuugaaccaucucacuagcucugauguuuucuuuuugcuuagaauauuuauucuuuuuggaauuggcugcuucucuuuucuguugaggugcugaagauugaaccuaagguuuuauaccugauaaacaaaugcucuaccacuaaacuauaccucuaaccuaggguuuuaauuuuauuuauuaggccuuugcaugaauagaaauauauaauugaauaugagacauuucuucuuguagaguuacauuuauuuacuuggaauguagugggauaguuggaaaauaauucagugaaucaaauaaaguugcauaaguaucugacaugguuuacuuguaagaauauuauuuuccaagccgggcgcgugguggcgcaugccuuuaauccaagcauuaaucugauucuugagaggaagaauuuaaagaaagugguagcaacuuggucuagggaguucuugaacaauggaaugaguggcauaaaugcuauucaagggcagccuuuguugcugccagcagaggugauaggaggagagauggcaggacagaccuguggaggggaaggcacacauuugugagauguucuugaagaacucauugggcaaagacuuauagcaagagggaaguguuucuggcguuauuaacaaaugaggacucagauuggagccagauuagaguaaggaauggugaauuuacuuaaauauuugaauauaggcuuuucauaugcuuuuggaaauaaugugaccaguggguaugacuuucgguacuuagaugugaauauuauaauaaguguguuguuaacauuggagaauuuaugagucuuccgaggaacacugaaguagaggcuggugugugcucaugccccugugcaggaagaaggaggagaagcuaucagauggcagugcuauacauaggguuuuuuauugagauaguuuuauuuuuugguuuaauaaauuauuuucuuuaaagguaggaaauuugagaaucucugaaaaucacuguucauuaaaaaggguugucuauuucuuucuuucuuucuuuuuuuuuuugugguggauuuuuccuagccuuucauguuaguuaacacauacauuggaguuuguuuuguuuguaugaugagcuaggaggaaauuucugaagaaaaagaaauauugcagaaaauguacuuucaguguggaaacagcuuuguauuggaaauguucuguucuuccucuacaaacaaaauuagaagugcuuuuauaaacugucuuugugcugcccuguguaucuuaaaaauacucauucuuuuucuuucugaaaucagaagguuguccuuaauacagauuaaauacuuuuauuucucuuuguuauuugcaguaauguucauugaaaaucuuccuugaagccggguguauuggcucaagccuuuaaucccagcagaggcagagacaggcaggucucuuuguguucaggucuacagagugagagcuauguagugagauucugccucaaaaaaaccaaacaacaaaguuaaaaaccaaaccaaccaaaccaaaccaaaccaaaccaaaccaaagcuccaaaccuuccuuuguguuauuccagucuauaccuaagaaaucaaguuagguuuuauuauuuuggcaguuuguggagaauauuagauugaaauguuuaugaacagcuuaauuauauacauauugagaaccuauaauaacuugguuuugaugcauacugugccacuucuuuaaaaauucuuuuaagauuuauuuuuuuaugugaauucuuuauuuuucuugagugauuugcuugcaugcauauauugcacacucaacauuuuuggcuguaggagacccuguuuuacuuggaaaacuuagguggaaucugaucuacuuuauauuaucugucaugcuagauccuaagugggaaaauugauaaagcacgagaaccaugugcuugccggguauccaugauggucagaagacagugugggguccccuggaacuggagugagggaugguugugagccaccauguggaugcuaggaacugaaccuggguccccugccugagcaagugcuucaaaugcugagccaucccuccagcccucugcccccucccucccuaaggucauuugaaugugcuuggcccagggaguggcacuauaaggagguguagccggguuggaauaggugugucacugugggugugggcuuuaauuccucauccuaacugccuggaagccagucuucuaguagugugagcgccugacuugccagcaagaaugaagccacaauaggauccuucuguacacguuuauugggagagcuugauugcagaggcgaagagaccccaagcccagaacuggugcugcuuauauaggccuaggagagucaugucucacaccuggauugguuaugcacuauaccucauuugcauguuccucaucugauugguuacucucucaguaccucacagaaccucauuaacauaccucauuugcaugucucacaucugauugguuauacucucagaaccucauuaucaugcccgggccaggcagugucuuggcaaaaaacuuuacugcauauguacacgugguggccagaugaagauguagaacucucagcuccucuugcaccaugccuaccuggaugccuccaugcuccugccuugaugauaauggacaauggacugaaccuguaagccagcaaguaaauaggugccuuggucaugguaucuauucacacaguaaaccuuaacuaaggcacuccugacuuuguuucuuacuuuuuggauuuauuuuauguguaggaguguuuugccuguauguguguauguguaccaugugcuugccuggugcacaaagaccagaaaaggguguugucagaagccucaggagcuggaguuacagugugggugcugggaauugaacucagguccucuguaagaguggcaaguacuuuaaaccaaggagcaauuucuccagucuccugugccaucuuuuaauguuuuguggcuuacauaguuccagaauacaugacaaacagggaccuuuuaacuuugaacuccccgcuguguaacugucuuagaugaauguuagguacuagaauaguccucuacaguagcaacugucaacauuuuuggcuuuaggaagaaaacuuuuuguggaaccugaucugcuuuguauaaucagucauagaccguuuuuuugguuuuuguuuuaaauauagcuguguauuauaaaacauugaaauuaagcauaugauucagauuuacaaccauaaucauaauccaguuuuuggugcugggaaugaagcucagugguaaaugguaaaacaucaucuugacuugggccugcaccgccggaaacacuccaacaacaguagacaguuuuacucugugcaccugguaguuucuuaaaguuggaguuuaaaucuuaagccauuauuggccaauuagguuuccauguauuguuuugcuaaaugcuuugguuugccuuguauuugaaaggaucuaagguuuuacuuauccccaaacuagcuauauaguguugaugacuuuggaauuugucuuuuuaauguuuucuguuaauuuaaauuuaaaaaauugaaauuauuacucugugugguguguguaugaugguguguauguaugugugcacacaaguuugaucugcaaaggauuuugcagguagagggggauauucauuaaggauuucuggacaguggagcucuuuuaccagaguaacuguuggagaguguuguaagucuagacagagagcucagcaucaagggcucugaauaguggcacgcaguggacaggagcacagugccauccucucuaguccaucaggcuuacagaguccugagccagagucgaguuacgcccaaugacuguguuucugucaguuauguuagugggauucucugagaucucacucacuaaauugcacugcuccaauuuaagaaucauucauaaaaugagguugccacuaguaagcaugauaaauauauggcuguugaaauucuuuuugggguuguugacauaaaaaucagcuuuuacacguaaaguacacucuucuuguaaguuucaccaguucucuaaggauuuauuuacuucuuuuguauauauucaugugagcaagagagcacagacaugcauaugcuaugauauguguggaggucagagaacagcuucuuguagguaaguucuuuccuucuccguuguuuugagggucuuucaagauuuuuggacaaaaaaaucugugcugugcuuuguauguauucuugcuuuguaugcgggcuucugguccuccugucuuugccucucauuucacauacagugcuaggauucuccaugccagucaccacaucugcuguuguuuuacguggguuccgaacucagguuggucagacuugcuccacagguacuuuuuaucugcucuaucaucucccuggaccuuaccaguucuuaagugaggauaaugcauuuuuuuuuuuuuuccgagacaagguuucucuguauagcccuggcuguccuggagcucacuuuguagaccaggcuggccucgaacucagaaauccgccugccucugccucccgagugcugggauuaaaggcgugcgccaccacgcccggcuggauaaugcauuuuuaauuguuguaauauuuaagugacauuaaaggaaguaggguguauaaauugaugggcaagaagcuagacauggugugcacgccuuuaauacuagcacuugggaggcagaggcagguggauuucugaguuggagaccagucuggucuacagagcaaguuucaggauagccagagauagccacauagugagacccugucucaaaagaagagaaaaauuaaaaaaaaagggguaagacugucugacauaaauauauaauaaauguuaguugauugaaaaguuaaacauuacaugaauauaaauuuuauguauuuuuucaaguacaaauguaccuuauaaucugcuacuagaaggcagucaguagcaugggaccuauaaggccuuuuagaaagugggucacaguguguaauaaacaugggagauaacuaauguggauagcaaaucagccuuaauauuccuggaggagcuaccgggaacuuugaguaggguaauuaguuugcaggguuuucaguuacagugauguucauuauuuaacauuuuuauuuccauaaugacucaucugugaauuauagaguccuuucccaaaaggaaugcaauacucuugaaaaacauuuuuuccugcucugagugugugucauauucuagcccccccgcccccccuccaugguaaagaguaucugggcaguuauuuaggaacaaaacauugcaaauaauuuuaaccauguguucuuguguagcgaaaacuuaacccccuuaagacggugaagauuucuuuacuacagucaacauucagugcuuauauuuacucccucugccauuuuaaacucuuacauuuucuacugucuuuuguuuuuaaauuuuuuacaaucuuuuuuuugccaaaaccuuguauaaaugcauaucaucgaaagauacauuaugcucacaguauuccaguuauuuguuuuauuuauauuaaaacugguauuacaucugacauuagcuugauuuuuauguauccuuugcaauguucuuguaauggcacuauugccagaugcuacuaauaacuuuuguggagcacugugcacauagagcacaguggauacuucucguucuggugcgugugauauaugggugugaagaccaaagacugagaaugaugccuuucucaguugcgcuccacuuuaguuuuaaguuuguauuuauuucuuuugggggagauuggugcaugacacagugcauguguagugaggacaaguuguaggaauugauucuuuccuucucccauguggcuucugggggcgaacuaaggacuuuaggcuuggugacgcaugccuuuaccugcagucaucuuucuggcucuucaccucacuuuguugcagcaaggucuuucauuggaccuagacuuucuccauccagcuagccucucuggccccugagcuccgggacccauuugucugcuuaggcccgcucugcccuuugcuccugucccagcuucuuaugagugccugggaucuggugcuugccugauaggcacugcagcccuuccugaugcuucucuauacagucauuacauuuuuuugaaaguacauaauuacguuuccccuuuccuuccucagucccucccauacacccuccuuuuggucucugucaaauucauugccucauucuuuaguucuucauauaugcaaccuguucaguucaguccaaauaauguucucuguauguauaggaucugagcuggcuacuugguauuggauaaccaauuagagggcccuuaccugaugaagacuacuuuuauuacuuucuauaucccccauugucuguauguaguucuuugucaaagauugaggccccacaaaguuucccccuuugauguucauauccauugguguugucaguguuuacaucuuguuaggcagccauguugaugggaccuaaugggugugagagcuaacauuuuuacauguuuucauuucacagcaacuuccuguuugucuggcuuuuacaauuuuucugcucucauuuucucaauaaucccaauaaucccuuagguucaggauuuguguuguagauguagcagcugggacaaggcaccacagaaucucuuauucucugcauuuugauugguugugauuugcuuuaauagucucguuuguuucaaagguaaguuucugugaugaggagugagaagcacauuuaaggucaaauauuucgaaugugauuaggaguaaugcugguuuaguaaaguggugguugguuguagguucaccuccaagauccaugaccuuaccaacccuggaguguuggauagauuuccaguaccaggcauguuuuccucuuguugagcaaauauguuauuuuuaaucuuuacaauaguccuguaaauagaugauacugucuguauuuauagaagaaggaauugaaaauccacagagggacauguggauuuuguauaccuuuuauuucugguuaauaacagauauuugccuauuuacaaagugaacuaaagugugauuuuggucuuuuuacuucaguacaauagagcagaauguagaugugcguuuaagauacuuauuaaggcuggagaaauggcccaguuguaaagagcacuuguuguucuugcauagacccugaguuugguucguagcacccacaugguggcucacaaccaucccuaacuccaguuucaagggagauaauaucuugucugaacuccacagguauucaacacaugugugguguacauauauauauaugcaaucaacacacccauacacaaaaauaaauaaauuaaaaauuaaaauaauugcuaaaaaaagcuuuaagaaaguacucauuaaaugcaagacugauuaaaagucauucaaauuuuaacuuuagaagaaauuccaagaguagaauuaugaguaugacaggagcucucccuccagaagggguucacauugagaaguugagaggcuagggcaucuguugagcuguuggaguggaaguggaguagcuuauguaguugaacucugugggcaggcugcugucacagcacugcuuccucuuuuuucuuaagacuuccauucugugcuuguagguacauggacaccagugcaggagcucccagggguccagguuaauugagacugcugguccuccuccaggaucacccuucuccucuucuucuuucagccuuuuccuaauucaaccacaggggucagcugcuucuguucauugguugggugcaaauaucugcaucugacucuuucagcugcuuguuaggucccuuuuugugaucccucuacagccucaguaauagugucaggccuuggaaccuccccuugaguuagaucccacuuugggccuguugcuuggaccuucuuuuccucaggcuccucucuccauuuccaucccuguaauucuuucagacaggaacaguuaugggucagaguugugacugugggaugcccgucccccucauuugaugcccugucuuccugcuggaggugggcucuauaaguucccucucccuacuguugggcauuucaucuaaggucccucccuuugaguccugagagucucucacuucccaggucucuggugcauucuggaggguucccccaaccuccuauccccucagguugccuguuuucauccuuucugcuggcccucagggcuucaguccuuuucccuuacccaauaccagaucaggucuuccccucuuaccccccaccuccacuuucucucccaggccccucccucccuccccacuugugauugcuuucuucucauucaucacuuaaugauaugcaaacauuuguuuuguuuuuauuuaacucuguggguuuuccccagaguuuuguugauugaguuguacuuggugauguucuacuuacugcacuuuugaacaauaaauauauaauuucugaaucaugaaagaccaguuuuuauaucauuaggauaauaaauaaucgauuuggaaaacggcuguaaaaguaacuuuuauuuucccuuacuaauugcugucucugaggcuuauugcuucagucuguuaaucuaggccuaguccuggaagcuucuaaccuccauacaauuuuaucuaggccuagacuguuuucagccucugagacuuacugcugaauaagcucaccccuucuuaguucuuucugaacucucgcuggcugguucaacucagcuguucuggcucacauuccucuccaaguugacugauucaauguggcuucucccucccccucccuucuccugaauugcucugcuuggccucaaacuaauucuggcagucuguucuaaucuucuggcucccuuucauuuucuugcucauucucacuucaaccugucucuguaaaacugucccaguaaaacugccuccuuccuccuuucucugcacugcuauuaagaagcaucucuuuccucugucucucucugugagagaugggcguauccuauucugucaaagcaucauuuucaaacauggcugcuuccuucuacaaacuaacuuaacuucauuguuugggauugaaggugugugcuaaggcguguuuguauuccagccggagggauuaagggugugugcuguggucugagccacacuccaacuagaaacagguuuuuuauucuucuucuuuaaacguaaauaacauaaucucggguucauagugugauaagauagccugcaacagaagguaacuucuacuccuccucauaaguugacaucuuuguuuuaugauuaugauuauguuuauacuuuucaagucauuaccuuaaacuaaauguauugaaguauauucaguauauucagaaguaaccagaaaauaaauuuuuuaacuugacucuguuuaauuaaaaauucuuauuuucauagaauaggugugcuuuguaugcuaagucuaaaggagacgaauuagguuacuaggaacuggauauuuagauggagcuauucaaacaaaucucuauuuuccuuuuuucuuuucucaucuuuaauuauuuacugguuuauugacugauuuaauuugugguguguacgucugugugugugucugugugugccauggcccuuguuuggaagucagaagacagcuuaggagccaauucucuuuuauccugggcucuugggcucaugaacugagcuuggcaccaaacauucccguucaccgggccaucuuaggagucuaccuuuuuaacuuugagaaaauaaggcuuuuaggggagggggcuuuuagggaacagauuucaaaaacugcuugaaugaaagaauguuugcaaauaaauuagaaucauagugauucuuauuuuauaaaaaauguuuuuaaaaaccauuuuuauuuuguuuuuuagcaucucagcccaggaugagccaggauggucuuugaacuugaaaucuuccugccuuaauauuuauagaguacugggauugcacauguaugcuauuguucuuggcuuugauaauguguuuaaaggcaacucucaugcauucuagauaccuuauacauugcugacuuaaauaaauagaagucuacggggacuggagagaugauuucuaucuuagggguuuacugcugugaacagacagcaugaccaagacaacucuuauaagaacaacauuuaauugggauuggcuuacagguucagagguucaguccguuaucaucaaggcagaggcauagcagugucuaggaaggcauggugcaggaggagcuagcugacaguucuacaucuucaucuucaucugaaggcuguuaggagaagaugcuuaggaggaggaucucaaagucuauccucuaagugauauacuucucuaacaagaccacaccucuuaauagugcuguuuccugggcuaagcauauucaaaucaacacaauguuuuaguggcuaaaagcacuugcuacuuuuccaaaggaagaguucucaguucucagcacccauggagugccucacuauuccuaacuccaguacuaggguuucuaacacucucuucugaccaccaugggcaccaugcacacauggugagcauauucauacauggaggcaaaaugcuaagacacauaaaaaagaauaaaaaagaaauagaaauagaaaaaaaauagaagucuaauagccuuuucuauauuaaaguguacuguacuuugagauuuaaaagugauaggaguuagggcagggguaggguacuuggaaagaagacugcugcagguguaaggcuaaucugggcuucauagugagagcucagccaguuagggauaaauaacaggaccaugucucaaagagcaaaaaccaaagagccguagcaauuaacguucauuuuagcguuugguuuuaccuuuuuaaaguugaaaaccuaaagaaggacuuaggggcuauugagagaguggugaacaguguuggaguuuuugauuuguggcuucaguuuuuaccuucuucuucgagaaguugauuuauugaacaauuuugaaaaauuuagaacuuccuuacaggcuugaaccacaauguauauagaaaacugaugagaagaugagaaguugaauuuguuaguauuggcagauuucuaauuuuuuuauaauuuuauuauuaauuaauuaacuaauuaagguuuuuuuaggccucacacuuuacauuucagguucauugagucaucgggcucaacugaguguuuucucucucccuccuccauccuuucucucccucaccuacucuuugcuucuaggaauugcucuuuucaauaguuaggguuauauuguuguuguuuuuccucuuguucauuccauucauaauuuaacaugaauaaauuugaaaacuacuggccauuacaacacacaagcacaauuaaaaccuaaaacuugauugcuuagauugagguagcaugcuacaguucuugugacagauggcuuccucaugcuccuuccuccucugcugugauuuuuuuuuuuucccagagaaaaaaaucccaugaguucccauuuuggcucuaguugugcucugcccacucauuggcuucagaggaacucuaauuuggauguacuggcuacuggcacuauaguaggaagugguuacaaaguguggcuccuuaugccaaguguucuuuuaucagagaaauuguaguuucauaaaguuaaacaucuuaaucauaccgacuaaagcuaaauuuuacucuuccaagacuauuuacuuuuaauuauuuguauauaugucuguguguagguauaugcacaugagugcaggugucugugguggccauaggugucagaucccccuggagcuggaaguauuggugguugggagucaccuaccuuggguguugggaacugacccaguuugguucugggcaggagcaguacaugcucuaagugcagcacugugucuccagcuccagaauguguuuuaaggacuguuuauuacacuuguaguguguguguuuuugcaugugcacaugccagaguguggguguggacaguaaaggacagcucccuccacggugagggccugggauugaacucaaguugccagcuugggaacaggugucugcccacugagccuucuugcaggacauuuagcauauaguuuucaguugauguucuaaacuaaguauuuuuaguggcauauguauuacaaaacagguuuuuaaaaucugaauuucacauaaucaggaauuuauaguguguuguacugcaauguuuguuccgggcacugaaugaauauacauaauuguacugagauuuuuuuuuuuuggguguguguggagauaaucuuguugugcgcuuuaggguggccgccuucuacagucuucuugccuaaacuuucugaauucugggauacagguguauacuacuaugcccagccaugacagaaauuuaauaucacagagacuuaauuauagucauugaaccugucaugucuaguauugaauuuuauauuugaucaguuacaacacgaaugcaugaggauuugccagacuuuaaaguuggaccagugagugauugcugcuguugcugcugccaccacugccucuucucauuuuucuuguuuacaauuuacauuauuuauuuauuuuaaaauuauuuuauuuauuuacauuccagcuauugagacaggauaucucuauauaucccuaguugucuuggaguucuaccagcaucugccuccugaguguugggaauaaaggcuugugucaccauaccugcccucucauucuuuuucuucugucuuuucuauuguuaugaagaaagaucaugaccaagagaacuuauaaaauaaagcauuuaauuuggagcuuacugggcaggcuuagaaucuaugaccaucuuuucaggaaacauggcaucaggcaagcaggcaugaugcuagagcaguagcugagaacuuacaucuugaucugaaaguuggaggcagagaaaugggggugugaaauaggaagauguucacuaugcauuacagggaacauauaacguguguguguguguguguguguguguguguguguguguguguguguuuauccuggaaguaguauagcuuaauuauagcacuguuuuaaagcacagacuguggauucaguaagcuuagagauacugauccaaggaauguagagagaucucugaucuguacgaugaagauaaugcucgaucaugagaaggauguagggguuaaauaaauuaagucucagggagaauuuagaacuggggauuuuguuuaguaaguaccaguucuuuguuauugucguuucacuuuggucucucuuguaaaguuaauauugacucagaaacucagaaagaucuauuugaguguguuuccucaguguaggauuauugauuaacauuauuuuguuaauacuuuuucuucauguaaugaauguaaauuugucacauaauaaaaaacauagugaagacuaagauuaaaucuguacauuuguaugucauuacaagauaaaauacagaauuagucacuuggaauucaauaaauauuugaaugcuauugagugaacuauaauacuuguuuagaauuguaaaugugauaggugggaggaaccuuauagaaucucuuuuucauauuccuucauaguaccccuuacaaaucauguaguauaaguauuaaauuuacauugauuagcuguuuguucuguuuaaaaguaauuguuuuuuguagaaacuuuucaucauuaagaaauguuugaaguagcuugcuuuuguguaauacuugauacauguauagcuuaggaucugaauucagucuggaacuagguagaacaaaucuauuucucuuuccagaauaauaggauaggguuuaugaaauagaaauuuagugguccaaaaaauugcugguagggcuggaccacuugacuucaggcuugcuucuguaauacuaauaagaaacuugcacuacugugagcccagagcaguugaaaucuccugcagccccaccccucugcagcaucuguucuggcuaaagaagacagagccucuuucuucaugucacccagguccacacuugucuucuaugcuuuuguuuaacugguagucuggauccuccugugcuguagcuacaaggcuauguaggaauuugugaguuuccacucuuaccuuggggaagcaggacucagagcggauguguaaauuaggaucugauuuacguguuugaauauuuugcaugugcuuaugaacauauacuauguguaugccuagugccugcagaaaucagcaaaaggugucagaucuccuggaacuguagcuagggaugguugugagccaccaugugguacuggaaacuggaccuauguccucugcaagagcaacaugugcuuuuaacugcugagccaucuauuucuucagucccugaucuuaaguuuaaguucaacuucagcuauguagugagcugaagguuaaccuggaauacuugagacccuuuuuaaaaaauaggacaaagcaaauauugcaaccuuaauguauugcaucuuggauauuuuuguuuguuucugagacagaaucuuaccauguaauucugcuuggcuuagaacucacagugauccuccugucuccaccuuuugaguauuggaacugaaggcuucuagaugguauuguuuauuugaaagacucuguaaucacacuuugaaaaauaguuauauaaaauaauuaaaauagggccagauggugguagcacauccuuuuaaucucagcacuuuggaggcagaggcagguggaucucugaguucaagaccagacuacagagugaguccacagcaauuaaggcuacacacagaaacccugucuggaaacacagcagcagaaacaacaauaaaaacaaacaaaaauaauaauuuaaaugggaagcuccuuuaaaauaaaaguuguuuuuguuuuuuguuuuucaacuuggaagagaagcucuugggauguaugcuuuuauugggguauaaauuuaaauacuucugaauuauaacccagauaaaaaucaaaacauucuuugugauauuaaugccugcucuccuuuaugggagaggcacuaaauuauuuuaaguuuuauuuugcuuacugaaaaggguaucucaauuacuaaauugauuuugcaacaaauuuuauaauaggugaguuuaaaagguaguaguuuauaauauagguguuuuuucagguacauagaagcugucaguuucuauaaaauuuuacuuuuagaaagcuaggaauaugggagaugauacucucaauauauaacuuuauaaacaaaugcuaauaaaaaaacauugccuuagaagauugguuagacauucccaggucauuguggcugcuccuguaaauaaauacugaaaaugcauaggaaaaauuaguagaagugucuguuugcuguacugagacagugcagaggaaggugugucuugaaguguccaaagaggggaaugguaguccuggaagugguaugcaguuuuaaucuucuuaagguaaggaugauaguauucuugauaauguuucccucuuuuguuugcuuuguuuuaagacaggguuucccuguguagccccggcuccugaaacucuguguacacucuaggcuaccucugagcuucagugcucuuccuucucccuuccuagagcugggaucgcaggugugcuacaugcuuggguuaaguguucuugcuuuuaugaagcagccaguccagugguguuucuuuacuugcggaaggugguaauucuacaucugcucuuuguagauccuuggucuggaaaauugcuuaggaauccacagaauucugguuuaguaaguuuucucuuuaccauaguuaugcaugaacuaaugcuauuacagaaacaaauuugagagcaaaaacgacuguuucuuuuggaguuugccucuuuuguuguaucuuuaucuuagucacugguuuuuagaguaguugccagagcugguaugucaguuugacauuuugauuucaaagauccuauuauaaucuugcuccaaugucaagcaguuccucagugauagacauaagccccccuucugcuuuguuagaugauguaagacgguuuuacagaguccuugguguuaugucccuguguggagcuuaaaugaggacauuuauagugccuaauggagcuuuuauuuaucgauuucagguuauuggcuaaguuuugccucaugcugacuuugaauuugauuauccuugagacagaauaggaaagcaguuuuuaaagcaggaugauuuuacauacaagagcaaccaaaacuauuacuuaauaguauuuuaaauguuccauauuaguguauguuucaguggucagcaacuuucuuaguguccuaguguaacuuagccuaguaggcucacaucuuggugaagccaaagccaaaugagcagucaagacgcacaagaguggagaaagauuuauuaccugcagccgggcaacagaccuggggaguaacuuucagagaagggcccuccuccagcaaaggaagcacaugaguucacucuucuagccuauaaguauucauauaggcgcugucccauuucuccauauguucaguuaggggcacauuccugagcauguucagcauaaggucaugaagcacauguuuagaagauuaaagugauagacaagagugcucucaacuuguucuggaaaguuuuagcugaaaacaguuuaacgucuagguuaagaaaauaagagucugcuucugacagggucugccuugcucacuggcuagcacuagcaauaggaaacacauuuagcuuauggaauguucaccuaguuguaaugaaugugucuugaccagagaacagcuugauuacugaggaguugauuuugaagucuucagaaggguguguccuucaagaacacugagaagaguauugaucugugcuuguuagaagaacguuguaucuaguuuccuuuguuuuauaagcacaauugugucaucuucaggaagcagcugauguauuuagcagccuugcuucuccauuugccaagucgauaauacaguaaugaguagaacauauuuucucuuuguaaaguaauauauacauagaauauagaaaaaguuuaacuccaauauuucucugaugcagauguguguauauguguaugagagcaugugugugcaugcacacacauuguauguacaaacacacaguauacaauauacuuuguaaugcgagggaucagcagggcauuagguaugcuaagcaaguguucugccacugaguugccuucucagcagcacauucuuuuauauuaguucuuuuauauuaaaacaaaacaaaaaaauaacaggcggcuggcgugauugcuuauuguuaagaauguauugccuuucagaggaccugaguugucuucccagcacucagguuauuggcucauagcccucuguagcuccaggggagccaauccuucuggcuucugugggcaucaacauuugugugcacacauguacacacagacaugucaugaugcuauacuuuuagccaccuuuuauuguugcuauuaauauuuuucuuauguaauauuucuauggcuaucuugguuaguguauuuugcaucucugugcuuucuauaacagauaauuguuaaaaaguuaaauguauuugacaaagaugaccuaaaggaauuagagagccagaauuuauuacauacacuguguauucuuuaaaaguuuaacaucuauaugacuuuuaguuuguaacgagaggaaaagucaugaaaacaagccuuuaaguuguuuuaguaacugcuuuauuuuagaaggagaaacagcaugucuaaaauacaguucuugcuuucuuaagguguuacagcugugcuuauaaaaccaaagggguugggcuagggugcaucucaguuguggaguguuugccuagcguguacaagguuuuguacauacagcacugcaggagugggggaguacaugcgccuguaugcaugggugcggguucagugguccucgccccccccccccccgcccccaucacuuugauucagccuccuccuccuugagaagaaauagacccuaguaccauagacaucuacuuuauggagugaauucuguuucuuuugugcaucugaauguccuuucuccucuucccuccucuucccccuuuccuuccccucccccucuccucuuucccuucuuuuuaguuacucaagugcuuaucuauuauuaugaaagcaagccucuaaguuuuacacauauggaauaaauuauauuuguuuguucuaaugguaggcuuguugaauuguuuucauaguauuagauuauuauaaguuuaugguuuguauuaauugcuuauuggugauuggaagaaaaacuaccaaauaugucuauuuugacaagcuaacuuuuaaaacaguuuuucuuuuuauuucuucagugcuaaauaacaaaauuuucuuaauuauuuuaaugaauucuuuuaucuacuucaagaacgauauaaauguuuuuaugaaacauguggaaaagaguuuuagauguaucuugugugugugugugugugugugugugugugcgcgcgcgcgugugcauguacaauugcaugugcucuugcucacauauguggaggccacaggaggcuuuuggauaucuuccuuuaucacauugugccauguuggccugagacagggacugccauugagcugguguguuggccugucagcucccaagaucugcuucguauugucucccuccccauuucacugcugggauuacaggcaugggcugcucuguccagcuugucuauggcugcuagggauuugaacucaguccucuugcuugcacagcaaguacucuuaaguucugaaccaaaagacauauuuccaaagacauauuuuauuuuauguuugccauugaaguuauugacaaauuauguucagauauuaauaugacaguguuuuacuuuccagaaaaauuugugcuuuucucuauaaaaucuacaauuguuacuauuuugauccccaagaauguguuaauuuuuuuuccuuucuaacacaaauauaauuaguauuuuacaagauauaugugcuggcuaguuuuaugugaccuugacaagcugaagucguuuuggaagcgggaaccucaauuuagaaaaaugucuucaguagauugcauuugggcaagccuguggugcauugucuucaucgaugugggaaggccuagcuuguggugggcaguaccacuccuggccugguggucuauaagccauacugagcaaauagugaggaauaagccaauaagcagcccuccuccaaggccucugcaucagcucuggccuccagcuuccugcccugacuuuccucagugguguacuguaauauggaacuguaagcuaaaauaaacccuuuccuccccaaguuguuuuugaucuuggugcuuaucgcagacauagaaauccuaaggcugugcgugaauguuuaccacacaucacaacacuucauccugagaguacugucaugguuuacaaagaaauuaagauaguuguauuagucauguuucucauuguugugaccaaguaucugacaagaagcaauguaaagggagaggacuucuuuugccuauuguuuuaagauuucucuaucaugaaaggcauagccuuucaugaggucaguaucuuuuauucuuacuagguuucucuuuucucuuaauuacaccuuaaagacagccuauuuaauaaagggugcuggcauaugggauauccacaugcagaagaauuagauauaucaucucuuacuguauaaaaauacauucaaauucgaucagaggucuuaauuugaaaccugagaugggccaggccuauggguauauacuuuuaauccaguagucagaagauagaggcaaguggaucucgaaugaguuugagguuagccuggacuacauacagaguuccaggccaggcagagcaacacaaugagacccugacucaaaaauaaaaaggaaccaaaaaauucaaaccuaaaaugguguugcuacuaaaggaaaauauagggaaaacacuuuuggauauagcuguaggcaaaauuuuucugaauauagaacccuaguggcaaaggaaauagccagcccuaagaauugacaaaauuguagagcuucaucuuaguaaaaaaacagucaaaacgaacagacaguccauaaaacaggagaagaaucuuuauaguuaccacaaacaagauauaauaauuagacuauauaaagagguacaaaucccuucugucaaucaguaaauaaacuaaugacugacuagauaguucuuagaagaagaaauacagcugaccaauaaauaucuuugaaagugccuaucacuuuucaucuuuagggaaaugcagauuuuaacuccuugagauucugucucacaccacucagaaugacugucaucaagaaaacaguuacaacaaaugcugacaacagugugggaaauggaacccuucacucaucaaugugaaaacugguauaaucagagcuuucccaaagaacuucaaguagaacuguaccguguguccuuccuuuauugcucuugggcauauaccuaaagacuacaaccuaccacggaaauacuuggacauuauguucauuguuggucuguucauaguaagaaggaaauggauucagcuuagguauccaucaagaaaugaauaaagaaaguauggcgcauauauguacaauaauauucuuuuauucaucuguaaagaaaagugaaauuuucagaaaaauugacaaaacugugagauaacccaggccgagaaagagaaauaccccaaguucucuuucauaugcugagucuagcuucuaaauguuaaguguaagcauguagguggagugagugugggagaggccaggaagcuagaaagggcuggcccacaggaugaggacaacaggaaucuguaaggaaggaguguggggagugaaguagagcaaauguucuaugaaaggggaagucggggugggguggugggugcagaaggugggauugauguguggguuggggcugggcaggggcaucaccccaagagaaguagguauguaaaugcacuaaggaaaguuaguaguuuguaaguuaauuuuaaaaaagaugauguaaaagaaagauuuuuagaggauuuguuucuguguagacaaauauacaguuuucucuguugauguuuuuaaauuuuuacuuuuauuguguaggcauguucacaggcaguaguaugugcucucaauuacugagccaucucuccagcccaguauguugaucauaaauucgcuaaucuuauugugugcuaguauugugaacacacacacacacacacacacacacaucucuuuaaaagccaucacauguggccugcuagacagcucaguggguaaaggguuaagguaccugcugccaagcgugauggugcugaguuuaauuuccagauccaugugguaaaaggagagaaucgauucuugaaaguugucuucugcugggcaguggugacgcaugccuuuaaucacagcacuugggaggcagaggcaggcagauuucuguagccagccuggucuacaaaguucguuccaggacaggcaggacaauacagagaaacccugucuugaacaacaacaaaagaaauuugucuucugacuuccaugcuuguaccauggauacaugcuugugcuuccccuccccccuuuucucucgcacacagaguaaauaaaaauauaaaaaucauaaguaguagccgggcgugguggcgcacgccuuuaaucccagcacuugggaggcagaggcagguggauuucugaguucgaggccagccuggucuacaaagugagcuccaggacagccagggcuauacagagaaacccuaucucgaaaaaacaaaaacaaaaacaaaaacaccauaaguagugcuaagugcaaaaugacauaauuggaaagauuuguggcacacacagaaagugaauguuuaucuugcuaauaaacauaaagaaucaccuccccguuggauacucacaucuuuacuuauuuuauuuaugugaguacacuguagcugucuucagacacacuagaagaggcagcagaucucauuauagaugguugugagccaccaugugguugcugggaauggaacucaggaccucaggaagaagagucagugcucuuaaccccugagcgguuucucuagcccggauacucacaucuuaguuacuuuucgguugcuauggcaaaauaccccaacaguagcaauuuaaaaaaaguacgggaguuauuuagucuuccacuuugagguguaguagauuguggggagggaaggcaagacagcagcgggggcuugaaacagcuggucagguuguccccacaguuggacagcagagagagaugaauauuugugcugggcuagcuuucuuuuuguggagucuagaauucaaguccaaggaauggugcuucucacuucuacuuuugggucuuuucuccucagcuaaccucaucaucauaauccuucacuggugugcugauguuuugucuccuuggugauuccaagaucauuugaaguugacuguuaauauaaccuccacuugucaauaaaauuuaaaugauuaguacacgggccagauguauacgagaauaucauucacagaaucaaagaauauaauguuacuuugccagggauugggaaaaggaacuaaggaaagcuacuuacuaguauccaugaauuuucagugaagcagaaguaagcuguagagauagauccaguacagcauuguccccgcagucaacaauagcauucuagaccuuacaauucuuaugaagauagaguuuauguuaguucugcuuuuugaguaguauguaucacuuggcuucaaacuugagauacuccugccucacucuuuaaaaugauauuauaggcauauacuauuauaccugguuuugguguuuguguguguguguucaugaguucguauguauguuuguguguauauauauacauauauauauauacacauauacacauauauacauacacauauacauauucacauacauacauauauauauguguauguaugugaauguuaaauuguagcuaaaaaguuauguauaaccacuuauuaaauacuaguacuugcuaauuaauguuuuuaauaauuaaaagucauuuuguuuuuugauagacuuuuauguuuuggaauuuuguuuuucuacuccugcugauuuagagucuucucacucccuuuaagauaauuuccauuaaauuuugagaugucuagauuuucuuguggcuuauaaaguaaaggacugccauacuucuuuuccugaguuggggggaauaagcacaaauuaaguuacugacaauuauagauuauuaccaugguuuuaaaacuugaauuuaaagagaauaagaggaaucuuuauuucugaggauauuucugagaauccuuacagcuauuuuuagcugccugcaagcugcucugucuuugcuaauugaggggaaggcugauuuugguuuuucuuuuuguguuguucucagcacaugcagaugacaauccaggcucuccaggaugagcugcggauccagagggacuugaaucagcuguuucagcaagauagcagcaguaggacuggggagccuugcguggcagagcucacagaggagaacuuccagaggcugcaugcugagcacgagaggcaagccaaagagcuguuucuucugcggaagacccuggaggaaauggagcugaggauugagacucagaagcagacccuaaaugcucgggaugaguccaucaagaagcuucuggagaugcuccagagcaaaggacuuucugccaaagcuacagaggaagaccaugagagaacgcgacggcucgcagaggcggagaugcacguccaccaccucgagagucuuuuggagcagaaggaaaaagagaauaauauguugagagaggugagugacuaccuuuuuaguuccugauugucuuuuucccuuacuaaucagaaucuugcccuagauaaauuuaugugcucugcugugcugcuggauaggaauuuugucucuuguguuucagcacuucagugauuuccuuuuugauuuuuuuucuugaacagaaugcaucaccuggcauauauguuacucaauaacagccucaccccugucacccugcaugagauucuuagggguuccugagugacugaggggauacaggguuguuucaguuuguuacucgcuucuguuuguucguagagacagaacagcaaaaccagagucaggcgcucaauuacaaacuacuaguaaccagucaccucugcucacccaugccugcagcacucaagcaguaaugggugucuccucugguuucccuggaaacgguugucuuguugugaaagauauguguuaaaaaucaaggcguguagccagaaggaguuauguagagacacaugauuuuauaugaaagacucaaacuggccugugugauuagaccucacuuucuguggcaaugacauuuuaagaaagcauuaaggaagaauucaucuuaccuugagcuaauuuagaagcuguaauacauuuuauaugucugauuucuuaggguuucuauugcaguuauaaagcacugucuuagucaggguuucuauuccugcacaaacaucaugaccaagaagcaaguuggggaggaaaggguuuauucagcuuacacuuccauauugcuguucaucaccaaggaagucaggacuggaacucaagcaggucaggaagcaggagcugaugcagaggccauggaguucuuuacuggcuugcucagccugcucucuuauagaaccaagacuaccagcccagagauggucccacccacaaggggcccuucccuuugaucacuaauugagaaagugccuuacagcuggaucucauggaggcauuuccucaacugaagcuccuuucucugugauaaccccagcugugucaaguugacacaaaacuagccaguacaagcacuaugaccaaaagcagcuuguggagaaaaagguuuauuuuacuuacaguuuaaaucacaauccaucacugaggaaagccagcccuugagugcaggaaccugggacaggagcugaugcagaggccaugcaggggugcuacuuacuuucuuguuccccauggcuugcucagccugcuuucuuuucuuuucuuuauuuuucuuuuuuuuuuuuuuuagauuuguuuauuuauuguauguaagcacacuguagcugacuucagaugcaccagaagagggagucagaucccauuacggaugguugugagccaccaugugguugcuaggauuugaacucaggaccuucggaagagcagucgggugcucuuaccugcugagccaucucaccagccccagccugcuuucuuauauaucauuagaccaacuucccagggauggcgucacccacaaugggcuggguuuucucccauucuccauucugucacuaguuaagaaaauauacuauaaacuugcccacaggccagucuggagcuguguuggauuuucuuaauugagcuucccucuuccaaaaugacucuauacuauaucaaguugacuuaaaacgagccagugcuucugguuagauauaaaauucuuuuuagcuucccugugauuauugggaugcaccgcuauaaccagcuaacuuucacauuuugauggggggaaguggggauccucgaacuguuaggaugagucugaauaaucccuuuuaaacaugauuugggaagaagaaaauuaaaaacaaauaaacauauucaacugagcaugauagaacauggcuuuaauccuagcacuugggaggaacaggcaggcaaaucucagugaauuguaagccagcuugguccacauagugagagacugucucaaaugaacacaugaaaacacccaagaaacuaacaccaacacaaaacuauggagcuacugaguguggugguacaugcuuuuaaucccugcauuuuggaggcagaggcaaaggcagaggaaaaggagauggaggcagaggaggcagaggaggcagaggaggcagaggcucagugagucggaggccagucugguugacauggugaguugcaugauagucagggcuacacagacuuuuuuuuuuuuuuuuaaacuguacagcaccucaaaaguaaaaauuccagguguguauugaaacaaauacaaacuuggugaugucuuuuuuccaauuauaauuuccugcuuuaggaguauuacguuuuugcugcuucugaacauuucaaccuauccuaguaguuuaggaacuaauaaaugccaaauagcuaaaggauacgggaagucacaguuuguuuauuuaugaacaauuaggaucauauugagcucgaaaauacugaaaaaaaaaacccucugggaguuuuagacuuuuuuuuuuaaauauaagucauauaaauacauuuuguauaugauaaaagaaaauauauuucccugugaguguaccaucaaacaauucaaggcugccauuuguagcauauugucuuauaagaaauauaaucaugcuacuucaaauuacuugaaagcaagugggcacaguggcuguggaaauccuuuucuuccuucaagacuuaacuuccaucaguucugcauugacggucaguguguaguguugcauguacaugcaguagcagugaccauguauauuuggcaguagugaucaugugaguagaaguauccaaagcaauuuuccuuuuugagauggacgcuuacuaaggaguccuggcuauccuugaaaucccuacaccccugacgauucuagauaaaauuaauaacucuucgccuccagaccaaauaaaugcuuaauaaaacaagaacugaaugauaguuuuauagucuggcuuaagaaaguaauagucuaguaaauguauauuuacuagaaagcauucugcuuacuagucacauacugaaguaggaagagguaaagaugguuguguuaaugauauuuaagagcauucuugaaguuuuaucuaauuaauuugauaagaguagggaagagaauaaauaaugccauugauggaaaagaugguacucgauuucauuauugcagaaacuaauaugcaaaugucauuucccccaauuuaucaauuuaaugcgucuauacugggaauuuucugguaacccuugggggacuuauguagguagaucagaauacauauauuuugaauccacuggugauauguaucuguaaaacuagcaccugggaaacagugacagagaauuuaaaguucaaggccagcuugaucaaagaaaaacauaauagagucuagaaauauugcauuguuaaguauauggccaauauuuugagauaaugccaucauuucaaaaauaccuaguuacauaaaauuaaauucuagaugaauugaagaacuauuuaaaaagauauauuagaagaaaacauaagcaaaaaaaccuuuaaauauagucuuuggcauggaagacucauugguauagcgggaauauuaauaaacauaucuauuagagguuguaauuaacaaagguaaaaugguaacccugggcagauuuuaacacauaccuugaccuuaccuguagacuacuuucuaaagcaguaagaugccccgaagugccugcuccuaccuuuuuguucucguucauccccuuccucaacaguuccuuauuaagccucuaguagguauugaucuugugccauagauaaacauuuucacagucuguguccuucuaagacucccagauuugggcuggagaguuggcucugugcuuaagagcuucuuguacucucacuucaugcauucaguacacauacgagugguuugccuuacaaucacugguuucuuagacuuaguaaauagcauaauaguaaaauaccaugugugauauuacucauuacaauauucugcuucauuuaugaacaugauucuguauacccccauauuaaaauuaauauuugauaauuauauuuugugucaaggucuuauuaugguuggagcuuggguuuucuguuggucaugggauuguuucauugcugugcuguuccaccuuccauuugauagaugagcgaggacaucuguuggacgcacaguaaauugcaugccauguuugcuuagugcuuugggcuuggacacuuggaguuguaauaaacuuugcaagugauugcuauacagcaaacuuggagaaauaaauuaugagucucagugucuugguaaaggauauugaaguuggcucuggaauuuuuauuuauuuuuuuuggguuuuuugagacaggguuucucuguauagcccuggcuguccuggaacucacucuguagaccaggcuggccuugaacucagaaaucugccugccucugccucccaagcgcugggauuaaaggugugcgccaccacucccggcuggcucuggaauuuuaagaaacucuuuauuccuguguguacaaaacauugcaacucaguaauauauuucagaccucuauuucucucuuuaaaauguugacagauguuugccuucuuuuuuuuuuuuuuuuuuuuuuuuugggugggcuuuuuuguuugguuuucuuuuuggguuggguguauugucuuguuuuguuuuugagaugaggucuggcuguuuagcucaggcuggccuaggacuuucuauguagacuaggcuagccuucaacuuauugagaucuaccugccucugccucccuaguguaggaaugaaaaguuuuauccaauuauaccaggcuacacuuuuuuguaaugaauuccauuacauucuauuuggcuguuuuguuuguuuguuuguuuuguuuccuaugacauuuuaaucugaaucuuguuaguacagcuuuucauguguuaggguuuauguguuugagguuaaaaguacuaauauuuguauagauucuagccuaugaauucugaauuuuggcuaguauauuagagaaguaucugaguuuucuugacagugagaaguuauaagaguaaaaaagcaagagauauauagagaaauagauaguggacuagggauauaucuuagaugauuuaaucucaacacugcauaaaccagugggaagcguaggcagaaggaucaggaauuaaaaggucaguugcgucuacauagggaauucaauaccagccugguuuauaugagauccugucucaaagaggaaaauagcagauagugaauagaaggaauuggaauaaaaaagaauuccaguauuaguauguuuggcauuuuguagugauuuuggaaagugaggaccauuaauuauguuguuuauucagauauuuucuccugcucuguuuuuaguaugucauuuucuuauuuccauuuugucaagaagauaguuuccucauuacaguguagcugcuacagauggcaaagggcuauagaaccacacuguucaucauuggaugagagaagguaccaaacaaguagugaggagccuuuuuauccccccgcuucauuuccaucucuucugugaaugcaguacucuauucuagaacuuauauggaggauugacuuugucaggggacuucacaaacauuugaccuaagagcaagcagggcucaaacuuaacauuugaaaaaagagaaauuucagacuuuuuuuuuuaauugaaauuuuuuuauuacuuuauucccuuuacauuccaauauuagcacccccucccaguaccuccucaaacagaucuucuccccaucccccacccccuucuucucugagaagggggagcgcccccuagguaucaccccccaccccucuuggcacaucaagucauugcaggacuagguacauccucucccacugaggccagacaaggcagcccaguuagaggaacaagacucacagguaggcaacagauucaccaacagcaccugcuccaguuguuggggguccugcaugaagaccaagauacauuucugcuacauaugugcagggggcuuagguccaguccaugcucuuugguuggugguucagucucugggagccccuaaggguccagauuaguggacucacuuggucuuccuguggagucccuguccucuccaggucccucaaaccuuucuucaacuuuuccacaggacuccuggagcuccauuuaaucuuuggcuaugggucucugcauuucuuuccauuggcugcuggguggagacucugagaggacauuuaugcuaggcuccugucugcaaacacaacagaguaucauuaauagugucaggaauugguucuugcccaugggaugggucucauuugguccagugauuaguuggccauucccucugucucugcucuaccuuugucccugcacaacuugaagggaggauauaguuugugucaaagauuuuguggguggguugcuauccuuaucccuccacuaggaauccugccugacuaggcuauuucaggguucauauccccuacugcuaggagucucagguagagugcccccuauagauacccuggggccuucccucucuucccaucucaggucucuggcacauccuagaggugcccccgccccgaaauuucucuccugcucuccuuauacuugaaccccccuacugcccucuccuauccaguuccuuauuuccauuauuuauuuuguuuacccuucugagaaagauucgggcauccucccuuuaccuccuuguuauuuggcuucuuugggucuguggauuuuagccugguuaucccauacuuuauggcuaauauccacugaucagugaguauauacaaugcauguccuuuugugacugucacuccugcauaauucaugauguccuuguuuuuaauagccagguaucccauuguguauaugaaccauauuuucuuuauccauucuucaguugagggaaaucuagguuguuuccaguucuggcuauuaggaauaaagccgauaugaacauaguuugacaaagaagccaaaaccucacaaugggaaagggagaacaucugcaacaaauggugcugcucuaacugcaugucugcauguagaagaaugcaaauagauccccgcauaaaacucaaguccaaguggaucgaagauuucaaugacaaaccagauacacuaaaucuaauaaaacugaaagugaggaacugccuugaacacauugguacagaagacagcuuccugaacagaacaccaauggcucagacacuaagaucaacaauuaauaaaugggaccccaugaaacugaaaagcucugugagucaaagucauuaagacaaaauggcagccugcagauuaggaaaggacaucuacauccacaucauucaccccuacaucugacagauggcgacuauccaaacucuauaaagaacucaagaauuuagauaccagcaaccaaaccagcccuacugaaaaugggguacagagcuaaacagaauucucaacagaggaaucucuaauggcugagaagcacucuaaguguccuuauucuucagggaaaugcaaaucaaaacaacucugagauuccacuuuacacccaucagaauggcuaagaucaaaaacucaaaggacagcacaugcuggcgaagauguggagcacggggaauacuccucuauugcuggugggagugcaaacuuguacaaccacccuggaaauaaaucuggugguuucucagaaaauugggaauaguuauaccucaagacccaucuauaccacuccuaggcauauacccaaaagaugcuccaccaucccacaaggacacaugcuccacuauguucauagaaacuucagaacuuuuauguguuacuuucagucauaaguguuucuuucaauaauguugauauggucagcauauuuuuauggcauuggccuugcacaugcuaggccaaaggcuguaguaugauuuaauaauaauauacuauuauuauuagaguuauuauuuuaugguuauagagauugaaccuaggaaacaaugcaugcuagguaaguccucuaucauucagauaaguccccagccucuuuacuuuuaaaaugaaagaaacuacugaagaaaagaagcacaaauuguuacuaauuuauucucaaacuuaagguuauccauuugguaauuagaggagauaacauauuucuuauuuauauuagaaacuaugugauguuauuaggaaauucaaauaguauaucuacccauauguuuuuuaaaaauuaaaaauauauauacuuauuuugaagauagggucucacuguauagacaggcaggcuuuucauugagauccucuugucuugacuucugagugcugagauuaaaggcaugacuucuacccauaauucauuuauuuuucuuucucuuuucuuuuucccucccuccuugcccuuuucuucccucuucucccucccauccucuucuucccucuccccucuuuuuuuccuuuucuuuucccauuucugucccuucuccuuuucuucuuuucccuucucccuugccccucucuuccuuuccucuggcccucuccuuucucugcuccuuccucuccccucccccuuucuuuuuuccuucuuuccuucccccauucucuucuuucccuuccuucuuuuucccuuuuccuccucucccaucuccgccuaccuuuucucuuuccuucuuccuuuuccuuucucacuccugucucccccuuucucuuccuuucccugucuuucccuuucaugcccgacucuuguucuucguccuguccuggccuauuucucuguguuaguccaguuauacucgugucucggcaaccugagugcuggaauuacaagugcacaccaucaugcccaagucuaguuugcguauuuaugugugugugugugugugugugugugcccaaaggucagccucagggguuguuccuuaguagcuguaaccuuuucuucuuuuuuucuguuguuuguuuuuuuuuguuuuuuuguuuuuguuuuuuauuuucuuggagacaggaucucucucucucuagcucuggcugucccugaacugguucuguagaguaggcuggccuugaacuuagagauucuccugcuucugccucccaggugcugggaauuaaaugcaugcccaccuuucccagcugcuuaguguuuugagagagagucuuuccugaucuagaacuugcuggguaggcuaggcuuuggacauauucuaggacuguauuuagauccuuaagcuugcauaggaaacgcuuuacugagcuaucuugacaaucccaaguuguauuuauuuuuaaaugaaaaauuucagccaguagggaugaaaucaagugagcaaauagcacauucuucuucuuauacuuguuuguauaguaacuuaguuuuauuuccagagucucuccuguuaguuacuuacagugugugagccagaggcuugauuuacuagguaggaaaggggaguuugucagcucacugaauacaggauguguucuuaugagcuucaguguguaggccuguggguagaaaugugcugugauaggauucagguuuuucaaugggaggguuuugugcuugugagugaauuagacugcauucuggucaucucuuauuacauguagaaggauuuuuaaaauucaaauaguuuuguuuuucuuagucuguuugcuaggguuuaaaaauaaaauuauaauaguuuaccacaaaauggagcauugugaauuuacuuguuuggaaauagauaauggagaagagaugccauaaaauuaguuggacaccuaaauuguaaaguaguucaaagaaauucagcuucaauacuuacaaguacuggagcaauaaauaauccauguaaguauagauuuuagucuuauuggcugaugaaaauugucuauaauuaguguaguucauuuuauguuuauauaaucaaaaaucucacacuuauuuguggagcaaacauccucagaagucucuacuauaaacucaagugagcagcuuguguacacuuggggaccauagcuucugaacaagcuacagcuagugaguuugcuuuaaugcuggugggagacuaaucuggacugaaugauguuuuuagugguggaauggaagaaaacagaugaguucaauagauucuaaaacuuaagauauaauauagagagugcugugggucaggacuggagaugucgcucagugggagacccguugcuugccacaugcaacccuaggaccucagaauaacaguguaaauaguuguguagcuuaaagaauuaugaaauaugcucccuucuaauccccaucacccaaauauagagagggaacuuuaaugcccaucaucgucagagacucucuuguuccacuaagaacaacugugaucuuggcuuuuaugaucacucauuugcuuuugacuaaacuuaccguaucucuauuccuaauauuaaaacauuaucacauuuauguaucaguaucaauuaauggcaauacauaucauggcuuggcuucaucugauuuucuuuuguuuuaauuaaauuuuugauacuccuuuuuuccccuuuaaauuugcauugguauuuugacuguauguuugucugugugacaguguuggauacucuggaacuggaguuagagacaguugugagcugucauuugggugcugagaauugaaucagguccucaggaagagcaagcagucagugcuccucauuucugaaugaucuccucagccuuccccuuuaaaauucuaaugaauuacuuuuuggagacuguuuugucuugguguugaauucacuguauacuggaggguagacuuaacuuuuaaucuuccucuaucacuuccaguuuuauguaguucuaggaaucuaucacccagcugagaacuaccuaugguguugugcacacuagucaaguacacuaccaagugaccuggguuuucagcucuguuuuucaagaguacucuuuaaaguuuuaauuauagauuuuuaucuuccauaagcuacuuuuuagcuuacgggcuagaauaauaauuccauuauauuuguaauuucugugcacauauugacuuacuacauacacacauacacacacagagagacagacagagagagaaggagggaaggagggagagggagaaaauaauuuaaaaaaagagguugcaagcaggacaguguuuuaguuagagaagacauuagaacuuggacacccauaucgacuucuccauuauuucuauccuauauaacaaauuacaguuaccaaacacacaaggcaaggagucaagcuuauuacaggagauaggcauucauuuauucuuuacuucaucaaauaauuuaaaacacuauccuagcaugguaauuuuaccccuccuuucuuuaguguguaucuauuaacugcauggacuuuuugucuaaacauagugauaccaucacagcgaauccacuuaaaacauuuaagagacauuugaguugggaacagauggagguaaagugcucaguggcaugggagaugggacagaguucagcagcccaguauauuuggggaacagcuagguguccagugugacugaaguaaagugacugagggaagcgggaagacacaaagugugacacucucucaagaagacaugucacauggggagccucacaggguuuugaguguggagggaggagaugaccuggguuuuaaaggaguguauugagaagaugcaguaggggaagcaaacuguaggaacuuguaacgagaagugugggguuuuagauggcucauguuagguaggaguauuaaaaauguacaaaagaguuuuuggauuuggauguuuugaagguacauauaaguagauuuccugacuucgguuuaguggagacuggaagguaugaauggcuucaugugugauacaaguuuaggaugcugcugaagucugaucuugaaaaauagcuuuugaaauguuugauaaguacguaaguaugauauccaguuaaauacuuaaggcugaaguugguuguagcaguguauauuaauuaagauugagucugucuucccuuaaauguuugagccagaauuuuuucggguugugagguuuuugggaguuuggaauauuuucauagacauuagcaguugaccauucuguucuaaaaguaaaaucagagaugcucuaaaaaaaaaaaaaaaaaaaaaaaaagaaagaaagaaaaaaaugaauauaguaugaaaacacuuuuaaaagagcuuuucuuucuguaagaauuuuuuaauuauuuauuuuuauuucauguguauugguguuaugccugcauguguguuugugugaggauguuugaucuccuggaacugaaguuacagagcucacaacucugccaugugagaccugggaguugaaugcaggucuucuugaaaagccgguugaacucuuaauugcugguccaucucuccaguccuguucuguaagaauuuaagaaaaguugaucagugagcuuccuggucaggcaacagugaguaaauuaggagaaagaaauaaccaaaauauuauauuauggucuuuuucauagcuuauagguuuguauauagccucuuaguauagagguauuuucucaguugaggcuccuauuucucuaaugauccuuucuuaugucaaguugccauaacuugugccaacuagucagcacaagugaccccuugucaaugugaugcacaaacacaucacuacuaagcuacaaccuuuacuuuuucauuuauucccaagaucacauauuaauaaagacaucacggcacaacacguguuauagacuuaaagaguuccacagccuuacaaauucaaacauguuaaaaguuuaguuucuuuacaauaucccgucucuuuuagaaagaauucugggacuaaagacaugugccuuuaacaugcaacguuuucugauuuugaacuacauagaaacuuguccaacagacuuuuucugccucccuggauccccacuggagguuuucaucauagguaacuaggugguuguuacucuggagguaaaugcuguagagaagauguugucaacagagguaauuucaacaccucuaugcagugcacgcugguuauaguggccuuuaucucuucuuuuuaaaaggaucuuuccuauccaccccuccucuuuuuagaucauuuguauuuuugguuucaagucuuacugauauaucaaucuauaugguagauuuuacuauugcaguaguaguuguuauuacugugucuaauuuuaaauagcuaguuagagccagggauccuccaggauguaugcugaaucagucuagauucccugguccaccaguaagguuuuugacaaaagacgugguggcacauaucuuuaauuuccagcacuuggucugguggauuugcgugaguuuaagaccagucagguauacauagugagcuccaggcuagccagagcugcaaauuaaagcccaaaggcaugagaauuaaaggcagccacugacucucuuccgcuuuuauuuaggagaugcaccggagauuugaaaaugccccugauucugccaagacaaaagccuugcaaacuguuauugaaaugaagguaagugggaaucucaugaagaaucuuggagucaccuuuuacucuuaacgguuagacacuccgugcauguguagaagggguaacaguacuuugcucaguugggagucugagaggaaacuguaauuguuuccuuuaucaguucaaaugucaacacauuggaaagauucucaugucuaguggacuccagaagugaaaaauaguaauaaguuaggaaucuccaggaguuauaagaguuugcugucugaguuaaauucuuuugauuuaaaguuuagcagauauuuuaucagguauaggauaugaagcaaguuccuaaccucuuuauaccucagaucuugaaagaaagaaagaaagaaagaaagaaagaaagaaagaaagaaagaaagaaagaaaggaaggaaggaagaaaguaaguuuaacauguaaaauguuuagagcaggaccuugcacauaguaaacaguugaugucaggugguguugcuaguguuuuuauuagacacaugguauucugauuuccuuuauugugacaguucagcuuacaguuucacauuaugguucaccauugcagggaaguaguagaggcaggagcuugagacagcuagucauauagucucacagccaggggcagagagaagcagcuguagucuugcugccuacuggaugacucucacuuagcuuucuucugccuuguacaguucagagcucaguucaugaccuggagccacccacauuaagggugaggcuccaccccaccucaguuacugcagucacaacagucccugcacagacauguucaaaugccaggcugaugauguacauaauugcucauugagacucuuccaggugacuucuugguuguggccaguugguauuuaaaaguaaccgccauccaugguccuccuuuccucucccugugcccuaggcugaguuugaacaugcggucuuccugucuuaccuucccagugcuaggauuauaggcaugugcuacauuaccugauuuauguuuuuucucauaaaagcccauuuaaauagaacuuauccucuacuuucuuuaauuucuuuagaggcuagaagaggcuugauuuguauuauaccuccugccucuuuugauguguguguguguguguguguguguguguguguguguguguguguguguguguuuugaggcaaagucucauucuguagccuuagcuagcaacaacuaaauuuggcuugcagugauaaaacuuugcucaaauuauguauauuuuuuucaguggguuaaggauuuaucaaacaaaguuuaaauuacuaguuuauggguucuuuggaauuaaauaauuacaagguugaauauaaucuuacaggaggccuuuagaauggcuuaauuuuauggcuuucccuuagucacacaguauagguuuguuugugcauguuacuuccucaucccuguugaugccuaaggauaaaacaugaacucauguguagcuuuuuuccuucucuucuucucacagaucaggggugugugauuuuguuaauuggcaguauguauauuuuaaguuuugcaggcuuauauuguaaaaugagauucugucaaccagggucaaguggauggugcauugguuacuuuucucauugcuauaacaacacacccggcaaaggugacuuaauaaaagauggguuuauuuuggaucauggcuugaguguguagaugaggcagugagcacgugaggcaucugguuacgcuguucacaguuaggaagcagagagaggugaguauuggcuccauuugcaucuccuuuuuaauuuaguucuggacccucgcccauggguuggugcugcucuuguucaggguuggccuucaccuuaaccaccucccuggauaugcacgcccucacagacaccuccagaagugugcuuuccaggugguuggaagcugcucucuggccuuacaaaaugagauuguucaggguaacuagaucuguaaggaaagucaaguuuugcuugggaaaggagacaaccuuuggaauuggaaaugugguaaauaucucaagguguagauccucgagcgcccuguaggaguggcugacagugaagggggaaaguggaagggaaugcacugaccugcauuuuuucacauagacgugcagaagcugacugggagagcuguccucacaaaaccucuugguaccacuugagcuuguacuaacaauaacuaguuguucaaccugauuucagagaguaaauggguagaucuuccccuggacaggccauguuugccuugaaguuuucacagcuugcaguaaugggcuuuucuagaaagaaguuuuugugcuguguguuugauaguggguugauuuuguccuguguuguugguauugguggagaagaaguaaggcuuuggguaaaggccuuguagaaguuguacaggucgucuacaguggauggacagagcuagggcuuuuacucugcaucucuguugucuuuuguggaucaaagcugugcuagagauauguucccuuuuccugucugcucauucccucuuguuacucuuggauguggguguagcaacaaaacuuacauuugacucucagcuauuugugucugguguuuuagucauuuuaaagagaccauguccugauacuugcagaacauuuuauauuaaucucaaaagugaauuucagauaguacaauugaaauguaggcuaugggcgaggcaaggauaccucuuuccccucagcucccccaacuggaaaauugcugguugaaguugucuugugacagauucuuauguuuuaucuuucugcuucaggaauuauaauagccaacacggccaaccaagguaucuuugauguaaaguuacaaaggaagucaguuuuaaaauucaucccaaaauauucucucuaaagcuccaaauaaaauaaacuuuuuaaaaguuccuaucuuuaaggcaaauuaagcauguucaaucacacauacaaaauuauuuuaugaagaccuuuugcuguaauaaucacaauugaaguuaguugaggauuauucagaugucacaaaugaaucaagaacuuaagacuagaaaaaugcaagauauuugugguaauaguuuauaagaagagugauugauuauuuaacuauauuuugagauaggaggguauacuauauugccuaggcuaucccugaacuccugggaucaaguaauccucuugucucauucuuaauacccaggacuauagacaugagccauggaaacauuuuauagauauuucaaauauauuccagaaguacagagaauaagauuucuaaaauauaaaaaguaaccauugauauacucacuuucaaauuuuucugcaauuggaaugcuagauaauuauuauuguaugcauaauuaaaacuucauuguacaauucuuuaaaacuuguauucauuucucuuauuuauuggcagaaacaugcccccuaaaggucacugaguggugaagcguuagaacuagaaaaggcuuuaccuauaguucccccaaccccacuagaaauguauugauacauuuaguauccaucgcuucugccucuuugguuaacuaugucugcuugagauggaagguuguaacuguaggaagaaagagguguggccauugugaggguaagucuuccucuucccacaugcugcccagcagcuucuguauagugacuguuauuaauuucugaauuuuugagagacaguuauuugucuacuuuuaaucuuuguaaauaauuuaaugcucaacucuucuauuguuccuaggauucaaaaauuucuuccauggagcgugggcuccgagaccuggaagaggaaauucagaugcugaagucaaauggggcuuugaguagugaggagcgggaggaagagaugaagcaaauggagguguacaggagccacucaaaguuuaugaaaaauaagguauggagcggauucuccaguucccagaggccugaacauuuauguauacuuuuccauguuaguguuaguaaagaucugcuuuaugauuuaauagacuuaaagguuuguuguuguugugucucccauguggaaauguccuagaauugaagucagaauuacugguuccauuuacuuauugcaagcuuuuauuuaaguaagaacuaaggacauguuguuacaguuuaacuuuucguuucuguaagaacuucugaaaugauuugauggaacuuuguucagaugaaguuuucuuccuguagaagacagcucauucauuucuuccuguagaagacagcucauucauuucuuacuguagaagacuacuuuuuuggguauuuuaagucaaaccccucagauucguuuuuuucuaaaucaaguuaaauuuuuuucuuuuagacaaguuccaagaguaaagggccuuugcucuccuguagugggguucauuugguaccaggguuguuguuuccuaugugugcgccucaggcccauguaugguaagacaggcgcacggaggcuuggcagugugguuucaaaucagguuuucuuuagauccaaagucauuuacuuugauuuuuauaaaccauuuaaagaaaauugaagaauuugguauauuaugguuuaauuaaaaauaauuauuauaaaaaacuggacaugauggcacacgccugcagucccaguccuugguagauagaaauagcuagacugcugcaacuuggaggcuagccuggucuacauagugaguuccaggcuagccagggcuacauggugagacucugucucaaaauaaacaaauauacaaauaaauuauauuaacaaugacauuuuaucuagaaaaguauuacucacugcauuucccaaauguguacagcagcuguguucuuuguucuuuggaaccaaaaaccaaaacauccccauacuugacugucgaagaaugacacaggugugacucccugcccuguucuggcuucuuguuguggugucuguuaccagguuuaugucuauagaauuuuccacuauuaccaacgaggcuguuagugaugauuuaugcuagucauauguuaauuuuuaaucuaaauugauuauccaacuuuuuguuagugugaauuuucucccuugaaaauuuuagggcaaaauauacugugucauaauuuauauuuuccuuccuuuuugaugaucagcauauuccaguuuaauuuuuaaaaguuugugagauagagacaauauaugccuuugaaaauugaguuaggggaacagcuuugauuauuuuauguaaguuauuguuauuucagaggucacuguggcucagaaucagauaauaugaagacccgaguuggcacaugagugaaaaacaauaacaaugucgugacagguagagcaacugaaggaggagcuaaguucgaaagaugcucaaggggaggagcugaaaaagagagcggcuggucuucagucugaggucuuugcaguaagauuuaccucuuugugugcaguggucccacagugggacccugcuggcucuggcuucuggguggcuuacacuuucacucuauauggauggcagcucugcccauucuuagcacuaaccagccugcucugcucuuuuaacugacauuuguucaccaguuugacccacaugucacugugcacacugagacuguauguauucuggaagccuuacacacugggucuguauuguuuugccacucuauggauggugucuauaaacucuccuuccucauccucuuguugacuagauauacauugauuuauaugaauguuuuccuuccauucuuuuuagguacaggaauguguaaaugucucuaggcucagcaccuacaacuuuccugcauuugaaauucuugagaaacugcuuuaguucuacauggagacaauauaaguuuucauuaggagacuuuguaacaaauggcauuuucuuuaacauagcuguauagagaguaauuagccuauuuaaguuagcucauagauuagaacuagugugauaacuuauuuuaaauuacuaaaucugcuuuagcuuucuguguagugaacuuaaagcuguauuucuaagcauuuugauaaguaauaauaauauaauuuccacuuagauacuuacuaaaagcaucuuauaaccugguagagugaucuacacuaauuuacaaaugauguccaggaagccaccagagagaggugggguggggucugauugacaccagcaaucugauucuagaguuuuucuuguaauuucuucacuaucuagucuguauuguccaugcguaccuuccucaaagugucagaugaauggaaaaagugcucuuaaggagugaaguagacuggaauucaguguuaaaaauacauuuuguuuauuuauuuauuaacaaauacacuuauggccuauuuaaucuauuaaucuauuuauggccuauuuucuauuguagguuaaaaaguaagauacuauguuuggaaaagaucuaauuuagguuaugguguuaacuauauguugucuggaggagaaauugguauauaacuuccuuuuuucuuaguuacuguuacucagauauauguaucagacagcaggccaaguguaucucuuacauuaugcuguugaauuccugaacaauacgaugcuuugguauaauuucuccauugccagcuagagaagugcuguuaccacugucuucagugacgaagggccacugugugcuucucaccagguucucucuccuggguauucuagaaggaagguuugugcauccaagcuuuucuucuauuuaaaauguuuucuucucuuucucauuuaauaaugcacauggcagggaaaagucaguccugugcaaaagugaagucucucucuguguguauauaguauguguacuuuggaauuuugagaaaggaccuuguuauguaagauagucaucaaacuugugauucugccucagccuccuuagcauugggauuuuuggguauguaucuccaugccuagcuucuguuuauuucugaaccauguuuguaaguauccagaaauuuggauaccuuuaagccacagcucuuugcugagaaaguuguaauacuuugacuauucuaggcauuuauuuauagaacaaauaugcuuuuuagaucaaucuguguauuacagauagaguaauacuaauaagcacauauaauuugaaucauuacuauaucaguaaauaagaguuuucauguguguagaaaagugcuuaucuuauggaaaaagaacccuaaguuauuuuaaguguuucuuacaagucuaauugguuuucuuucuuuucuuuucguaccggugggcuggggugggagaguucaaguauaggaucucauacauguuaggacacaacuccuccauugagguauguucucaaacuagaagucuaguuuuaugauaaacuuuauuucuuccugugaaauugcuucaagaaaaaaaaaaaaacaacccuuuccuuuacuuaagauuaauguggucaaauaaaauacuguagaaauacuuuagaaaacuuuagauacucaguuuucuaaaacucaaggauuuuuguuucaucugcugugaaaaugccugacuuaccauauuuauguucaguaguuaauaucuuguagcuauuucuuagaugguaggccuaaaaaaaaaucagaaaaugucuaaagucagcuugcuuucuuaaucuucuauguuuuuuaaaguuuaauacuucaagauaugaaagaagguggcugggcaaaguacuaaacacccagcacuuaggaggcagaggcagguggaucucugugagucugagaccagccuggucuacagagugaguuccaggacagacagggcuacagagagauacucuugucuccaaaaaccaaccaaccaaccaaccaaacaaacaaacagaugaguuccuaggaucuggacuggguaagaaagcucugugaguaagagcaguugcuagguaagugugaggaccuggacugaaaucucuguaacuccuguaagaagccaggugggacuuggugacagaaggaccaccagaguuugcuggcugccaaccuagcuucacguucaguguaggaccagucucaagggaggaaggcagaaagugacagagcaggacaaccaguguuggccuuuggccucuguaugcauacaugcaaacaugagcauacgucacacacauguacuguacucacugguguggcugcacacauacuuuuaauccagcacuuaagagacuaggaaagaagaucaggaguucaagaccagccuuggcuacauauuuaguuugggccagccugggguacacaagaccccugcccccuugcuuuugcuugaguguucucucucacuugcucacuuucucacucucacacagacgcuuggaaggaaaagggauauaaagaaagugcuuagaaggaaauauuuguuggugcuaagagagcucuauggagauugcauuguauuuuuauauaugaguuacacauucagacugauaaacuucaaacaacuuguguagauucuuucagagugaaaccuuauacauucuucauuuaacuccaguguuuauguucuaugaugugcacauaguugauaaauaggugauuuuuaaaaaacagaaaagaaaaagaaaacaucucucuaaugccuucacacugaaagcagcuugguuuccuccuauuuucaugauacagggccucacucucuacagaggcuggcuuggaacucaaagggauccaacaguucugccuggaguaaaggugugcacugccacacccagccuagcuuuuuagcaugaagauuucaugaaacuuuugcuugaaaaagaaagacagacguguacagcuaagauuugaacuuacugcaguagaaauuacuuucccccuuaugcuucauguuuacacuaauccugccugggacccauccuguucuggagauggaugcuugacaaaaugaagugguguuuaggugaugaaugcugccuggucuggcagaacuacaauuuccuccuucaucucuaaccccuaaggcaguaguucucaacccguggguugcagccauuggaaaaccaccuuucccauggucuuaggaacugagacgcuacuuagcagcagaauuauaauuauuaaguagcaaugaaaacaacuuucugauugggggucacuaugacaugaggaacuagguuaaagggucauggcauuaggaagguugagaacuaauacccuaagggguuucagaaacuacuuugaaacaauaaaugaagauuaaaaauuuguuuguugaauaagcuuaguucuugguaaggagcauccgguauuagauggugcaaaaaauuaguauuguccuaucuuacuuguuugcuauuugaugagccugggagcucaagacugcuagacacgugcuuugccacuaaagcccuccccuucucuaccuuaucauagaguuaauguugcauuuaauuuccuauauuaugccauaaaucugccagagguccagcucagagguaguuguguaauuucuuucuuccucacaguguugucuuuuguuuuccagauuggccaggugaaacaggaacuguccagaaaggacacagaauuacuagccuuacaaacaaagcuagaaacucucacgaaccaauucucagacaguaagcaacauauugaggugcugaaagagucccucacugcuaaggagcaaagggcugccauccuacagacugagguaaagaguuuuugugauuuguguagaauccaguccauaccuaguuucauuuuguuauauauuuguuauguuuagagucgugugaucaauuauuuuaauaaaacaacauuuucuguuagaucuaauuaaaacauguuauuucuuuacauuuuuuuguacuuggauuuauaccacaucuguacuucaaacuuuuaaauuauucaaaucagaagauauuacaaauaauauaccugauucauuuagauuuggaagcaguaacuuuuauccaugguaaaucaugacuauaugaauuauauauauacauauauguguguguguguguguguguguguguguguguguauguguguguguguguguguguguguauguguacaugugcauguccugccaccauaaucaaguguucauacuagcacuucuaccuugggagucaucucgccagcucuugugucauguuuuuuuaagaaguucuguucuuucauaguuuuauugggcugaauuuagauauauuuaaagaauugcaaauaugaaauaguuuagaaaauauugccuucuucauuuauaaagaggguuuucauuuugguaacuugaauauucauugacacaaaaaguucagaacuuggugccagugucuuaaagguaagccucacuuccacuuugcuacuguuagccugggauccaagccauugaucaagcaguugguugaugccagugcaaacauuuaaaagcuugucauggucugguaaacagcauuucuucucugucaauccucucuccuguguauucagcuugaauacaguauuagcugagucuuacauagauggacuugugauugguuccuucuaccauggaucguaaaggcugucuuaucccucuugaaugguuguauauuugccucauauuuguauuauauguguguauuuaauagcacuuacuuucaaaaaauuucuguaaugacauuuaagaacaguuuuucccuagcagcuuucuuuuguaagcccaauaaaaugcaguuuguaccgauucuuugaaagcuguuauuuuauaucuuacuuuuaauugauuuuguccucuuuauugcagcaguuugaucugauguggaaaccaaugaauuaaacacaggaaaaagaacagggaucauggagcuuuauaaaagcucguaugcuuauguguaauauguguucauguggguauguuugugugugugaauguauguggaggcagaggccaacuugagguguuguucuucaggugccauuuccuuugguaauuugaggcuaucgccccugcccuggcgcuugcugaugaggcuaggcuaacuggccagcaaguccuagggaucuucuuaccuccauuucuucaggggauuacaaaugcauuuuggaauuuaauucagauccucaugcuuucacaaacaacguuaaugagugagcuaccucccagcuccucaaugaaaaauucuucauggaaaaaauugaucuguggaaagaucuguuugguagccccuuguccuaucuuuuggcaaucuacaguaaggacuucuguuggccagcuuguauaauauuauugaaauuacuucuauucuauaccuuucucuuguaaucuguugaccuuugcagaggugaucaaacuuugguagaaauaaugauugaaagagauuuaggggcuggggagauggcucagcaguuaagagcacugacugcucuuccagagguccugaguucaauucccaacaaccacaugguggcucauaacuaucuauaaugggaucugaugcccucuucuggugugucugaagagagcaaugguauauucauauacauaaaauaaauaaauaaaucuuaaaaaaagaaaguagagauuuagcugcacacguguaagccugcccguagccccagugcagauguggagggagcccaugaaacucuccugcugacugaggagcuguugagagcuguuugaaaggggugugccugcugggagguugcucaugcucagacaagugguacuaauuggacucaauagauuauuaaaaaaauaaagaagagggugugaaugggggagggagagugugaaaggaaaguuggguugauaugaucaggaugcauuguguguaugugugaaauuauaaaauaauaaaauacuuuaaacauagagguuuggggucagaccuaggauugaugcuaagccucugugugacuguaucugaguuguuuuuuuaauguuuuaagccucucuauucucauuacuaaaauaaggauacggauacuacuaacuucuugaguuguuuuggguagaguagauguuuuauuacguauuucucuucuggacauagacucuuaaguauacagguuaaaaauacuuuauaauaacugaucuuuugcaauaccuuauucauucauucauucauucauucauucauguuuuucaagacaggguuucuuuguguagccuuggcuguucuggaacuggcuagcuucaaacuuguagugaccugucugccucugucuaagugcuggaauccaaggcauguaucacuaccaccuggccuacuuuuuauuuuauuagcuaaaguugauguuuuaguauguauuuuccuucugaacauggaagaguccuuaaauuucuagguuaaaauacuuuacaaaccuagucuuucauaacacuuauuauuucauuuuauuuugagucagagucucuaucuagccccuaguuauuccauaccucucuauguagaccaggcuagccuugaacucacagagauccaucuguguuucccuccugagugcagaaauuaauggugugugcccuucugucuggcuuauaacauuuucauuugcuaucacuuguucuauuugcuccugcauuaguugcuuuaguuucacuguggcccuagcaccuaacagaaagaauguaauagaggacagauuuauuuuggcucauggguuugaagaguuucaguucauucuguuggagaaagcacagugcgacaguugaguucaugguuguuuaagcauauguuagacaaggaucugggagugcaacgaaacacaggcucccauaugaucauagcacccuacuucuacuagcuaggccuccccucuuaaagguccuaaagcccccccccccaauucuucuccuagcuugggauguggguuaacccuuucagacuuaaaccauaacauucuacuucugcccuuuaugccccccagccccacccucagagcuuuuggccaucucaaauauagaauacauuuaguuuaaucucaagagucucucauagucuuaacaguuccaggauuguccaaaggucuacugagacucaaagcauucucuuaguuguuacaucagcuaagagcccuugaaauaucaaaaggagagguuuauaaaccagguguggugguuguaccacuaguccuaguucuugacugaaugggcauuaggacugacaggaguucaaggucaguuuagguuacauggugagacucagaaaaacaaacaaagagaagccaugggcaucuggggacaccagaauucuaagauggagucauugauauaaaagaaacugauggaugaugaauguugagcuggaaaugcugccaaucuggcuauugaugugggauuuuacuuccaaagguuuagaguaugucagagagaguacgauuggcaucacagcauguacguuaacaugaggaaagggagcaucaauggggccagugugguacuggcagcccagguacuugcguuuuuuacgagguacucaaacaugagugauaagacaaauaccacugaagaggagccaguauuggggggaggugagugcucucgauucccaaacuugacugccugaccaacucccaucugaagaauucaguuaagucuaaauuuuuucauauccugaccgggaacucuaauaaauggagacagguccauguaaaaaaaaaauccaaacaaauaaaguuauauacuucuaccauucaguggcccauaguaagcauucccauuucaaaauggagaaauggggacauaagaaagagggauaugaccaaaaacaagaccaaaacccagggaggcaaauauuaaaucuuauagcgccauagccaacauuuggagcaacauuuggugauagguucugagcccagguuggccuggagaugacaccuugcaugcccauacauagccucuuucaaggucuggcccuaguuugugcauagaucuuacucaacagaugucucacaucuccaucaucuugauguuuccauuguaucucaguuuacuuucagaguuucuucauuauucugucauagcucccugaagagaaucacacccugcuauacauucucauagcaggauauuggugggaaccuccaugagucuuguauacuguaugccugcaaaacaaguaccaugugguuaauaccagauucugcugcuggcugugcaguagucacaucccacuggauuauaacuucaguguuuuuugagggccuggguagcuagaauacuucuuuagguggcucagugcaaauggagcaccccagauacacgaaguuuuaaaagaagguguucaaauauguuuuuauuucuguucugaagccuuugguggguguggucuugacagucgugaagugccucuaagggagccugacuguccuggcacauaacuuggcuuuucuuuaacaucuaacuccuggucuuuucuggucagacugcacauuuuucacaguuucuguucugcuuuuugggccagauucucacuguaaaccugacuuaaaaacagcuagccaauuucccagagauaaguuagcuuuuugguuuugaauuuggacuccaucaaaauuacagcaccuuagcaaaguguagacaaagccuuugcaggaacauagcacaaauguccuuuaguccauucugcaguauggugguuugaaugaacuauguccccuauaaguucauguguuugaacccuuggucuauauuaugcgaggaagguuauggaaccuugugaggaggaagcaugccacugaggaaagucuuuuuggcuucauagcuuggcccacuucauguucucacucucuguuucuuguguauggguaacaugagguuuguuuguugauuaucaggauggcuuguaccccugcuacaauaacuucucugucaugauggccugacuguauccucucuggaauuguaaacuaaaauaaacacucuucucuuuuaaguugcuucuggucaggauaguuuauagcagcaauagcaaaguagcuaauacuuguacagucugcguucucauuugaagccuucugugugcaaucuuuauugucugcauucuggucucccagacuccuacuugaauaucccauuaugcucugcuaguaguauucuagggcuucuccuggcuugcaucucuagacuuuuuuuaacucuccccuccaguucaaaagaucccugaaccacauggucagcccuaauucucagagccaguugucuguaucuguaguuguugugucacugucauaggaauggauagaaacagcuacagaggagggaagaaucaugauggcaggggggcggggcauagcagaacagcucgauucuagcuugaggacucuuguaaaggcuguucacaugguagcaggcuaugaaacugaacaugacagcaaccaguggccauuauagcuucagaugcuugccccuacagaucugcuucucuucucugcgaccuaccucuuuuucuuuuuuuuuuuaauuaaaaaaugugauccauccaauagcugacugugagcauccacuucuguguuugcuaggccccggcauagccucacaagagacagcuauauauggguccuuucagcaaaaucuugcuaguguaugcaacggugucagcauuuggaggcugauuaugggauggaucccuggauauggcagucucuagaugguccauccuuuugucucagcuccaaacugugucucuguaacuccuuccauggguguuuuguucccaauucuaagaaggugcaaaauggccacauuuuggucuuacuugcaccaucagccaggggauaagcauucaaaacuugugccugugggaguccuucagauucaaaccguaaauguucaaauacaugcaccuguggggaauauuucccauugagacugccacacuguggaacucgacaaagggcauuuauuuauguucauucuagcacagaauuugucuacccuuugccaggguccugaaaauuugauugaggcuauagaguacuaucaugagcuagauaagauacacauuuugucacuuuuauagaggaggcuuagaugaauuauuaauaugcuauguuugcuugacacauguucucacucucacugauacccuguuuugucaguaauucuuccauuuuauuucugcuuguuccugaaucauggcacuaugccuaucacugaauuuauuuuuuggaggacaccucaguguauggaacagaguagauuuuauugauacauugaaauaaugcagaucuuaacugcuucagagaaguaguuuuuccccuuugaggaaaauuguauuuuagccuuuuauuuguaguguuauuuucaucugcacugacgggcaguuggagaagguugcuucucuuuacauggguagaccacagauuuagcauucaguccaaguaaagaacucucaggcuuccuguguuagaggugagauacaugcuuuguuugacaacccaccuuuggcuaaccagcaaugcuucccuuaaaaauacuuuguguuugugugugugugccaggcacacagguaccgcagagggcaacauugggugccuuucucaauugcuuuccacuuuauguuuuugagacguggucuguggugguuugacugaaaauggucccuguaaccucauguauuugaguguuugggcugaggauguaggucugugaaacuccuuucuagcacaccacacccaccuagagaaucaaaaugcaguauguaaguuuggaacucauagcacaguacucacuuuaucugguugagagcaggaaaaaaauaaggagccaccaagaaauacgagaguaugaagaccuaaaagcagaagacugaaguucaguacaaagauugagagaggagauacguuaguuaccuuucauguaacuguggccaacuauuuaacaaaaacauugaaggaggaaaggauuucuuuugguuccugguucaaaggugugccaugguucugggagggaauggugauugaagcuucaagguccaugguggcagauaguaauggugguugguugcauuguuguagugacaaacagagagcucagguucgaggagucucugugucccagaguuucuguagccaaaacagagccaccagguagggaccaaguauccaagcaaaugagacagauguuggggugugagguguggauggacuuucacauugaagucagaagaggcaguaaauacaaaugagcugaaguuagaauacacugucaaacucaguugcacuaaaacaggguucugugcuuuugccuauuagaugagcagaacaacagaguuaaaaaguauagcaccgacuuugacagcacacacacacuaagacugaaaugauagcaagacagacuaguaauaccuuugagcagcuaugacccauacaguaaugaaguaguuuucauguuugaugcuaacauagccaauaaaauaauaaggcaauacaaacauuuuuuuuuuuaaacacacuguauuugagcacauggauguuaagguugaacggcuucauguccuuugucauuacuugcuuacucuguuccuugcagauuucuuugagcuauuccugcaaacacaguagauagauacuuuucugucugcauggguagaggaaaacccuguguuguuauuaagguggccuaccagauuuaacacauacuuugaugcuugacaaacaagguagcccuguguucaauugagguggacaaacagggccuuaucuuccugcugggagugugguaggguggugccagugugccuuuugagggaucuuuuuucuguaguuugcccucucuguugucugcuuuucuaaugcaacacaguguauacagcagacacaguguaaccaguagccacuuauuccugccacccuaaugaacuguauccauucuuaaacugcagacaaaagaaaccucuucucccuuguuuugcuauucuguuacagcaagcagaaaaguaccuaauaccaucagggagauuccugcugagcuuuucacauuaaaaaauacuuucuugaguuuugacagcuauuuguaucuuguagacagaaguauuuugaaauauaauugauaauuucuaaauauuuuuccucaucuauggcuuguccuuucuuugacuguuauauguuaggaagucuuaauaaccauaguaggugguaacacuuuccuauugaacuuuauuuuguggugugaguaauuggaaaauagcccuuuuuaaagauuuuauuuuuuauguaugacuauuugaccugcaugugugucugugcgccacacaugugaaguguucaagaagagugcuggauccuauggaacuggaguuacagaugacuguaacuugucauguaggccuucuggaauaacgagccacugcucuuaacugcugugccaucuccagccccaagauucaguucuuuuugucguuuuuuuuuuguuuguuuguuuguuuguuuuuuuuuaaaacagugguucucagucuaugggucacgacuccuuuggggucaaauaacccuuccacagggucaccugagaccaucagaaaacacagacauuuacauuacgauucuuaacaguaguaaaguuacuguuacaaaguaucaguaaaaauaauuuuaugguugguugucaccacaguaugaggaacuguauaauagggucgaggcauugggaagacagaacuacagguauacaaaguaccuuuagucuugacuuaauccccucaccccaacagauacacggucauuaaaggguuugagguacuuuaaacaauuaugcuauucuuccuauauuuuaaaaagauacauguuuuacauaaaaaguuuaaauuuauuuuaugagcauggguauuuuuuauguauacguaugugugacuuucaugccaugugcccacagagaccagcagauggcauuggauccccgaaaacuggaguuacagacaauuuugagcugccacaugguauugggaaucaaaucugagacuucuagaaaagcagcaaguguucuuaacuguugugcugucucucuagccucauacagauauggaguuacuaccuuaaauuaacaagcaucuuccugccuguaucuguggagagggcuaggguugcugcuggggucuuaggugaagggcaguuaucuagggguacugcugaguuugccauagaaagaagauuaugcagauacacuaaggagggccacuggcacaggggauggcgaguuguuuuuaccagaaagugaagauggcaguugaggaucaugugucacagguuaagugaacaugacuguggccacagccugaaauaggagugacagacacagaaccucagaagagugaaagugacagagauugagaaggcugcaggggaaaaagaaacccucccucaaauggaaaagcacuggcaucagagagggaucaaaaaagagagagaggaaaaaagauagacuuuauuagaauagauaaagcucccaucaagggaaugggggaggugagagucugcccagggaggaccauggaggaaacugcuauagauaaugugacacuggggacugaacucuccgugcucccugagggcuagggaagcacgcacagcacaagugaguauaccucagcccugaagcuauucucaguuucaauuuagagucugauaaauauugacaguccagcuucuaaaagcuccuuagagccuuuuguaacuuggaggagcauugagaagcugcaggaucacccaguucugagcgugaacuguguagcucuauuccuagcacugauaugcuucagggucuuccagaggaagagcugcccaguggggcgugcaucugugccagccucaggguguuuagcccugagguccuacuuuuuaucucccaagauaaccggggagauggcauaccucuuacuauaugccauuuuagacucauggucucuucauuuucagucauucaugaauuugugucucuccaugugcacacuuguguauguucaugugaguacucaucuguuaauuuuaagaaguuuguuaaagguuagcaauuuggaauguuuuaucacaguuuguguuuuaaauuuaauagaguccuccacaaaucccuuucuacccaaacugcagauuguggcauauuuagauagacucguucuuaguuacuuuucuauugcugggacaaaacacuauggucaaggcaacauaagaaagaaaguauuuaaauggcucaauuuuagaagguuaaaguccaugaugauggugcaaagacacaguggcaggaacagcugagagcucacaucuggggggcagggagggagggagggagggagggagggagggagagggagagggagagggagagggagagggagagggagagagagagagagagagagagagagagagagagagagagagagagagagaaggagcuccuccaagaagcccuugaucuuucuuaaauaguucuaccaacuggggcccaaguauuuuaaacaaaucagccuauagagcccauuuucauuagaaggcccacaggcauuuugcagauguguucaaggccaagauuuuccaggaauguaggacaggcagagugggucccauccucagagggagcuuagcccuacagacaucuuuacucuuuagacccuacuuagccuccagauuugugugggaagugguuucuguuuaaggcagcccaguuuuugauacuucauuuaauuuuuguuuauuuguuucuuugucaagagugaguuucuuuauauagcuuuggccauccuagaacccacucgguagaccaggcugguccaccugccucugccucuugacugcugggaucaaaggggugugcucuccacugccaucacccucauggcacuuuuuuuuuucccaguuauaagaaguuaaagagcaagauguucgggauuucuagcuuguugggugguacuuuuagguuauuaucauguaugucaguuauugucaagcagauuguuaggaaauaaggcucuuguuuccuuccauaggugaagcucacuagucuucaucagaaagguagaagcuuaucuuuggcucuucucucccauguguccuuuuuauaggcaauaaaauucagacuucgagaccugacccuggugccuccuuuucugugacuuccuaccuguuacuagccuuaagcauucuguguguagcuuagugugaaguuacuaucuguucugaccauccuuauuuauggcaccuccacucuguaguuucucccauuaucuuccucacuguugcucuccuucauaaugcuccaagcuucaccagcaccuagucacagauaugugugugugcacgcgugcguggguguaagaggacaacuugugagaguccguucuccuauuguguguucuggggauugagcucagguugucaugcuuggucauucauuacccccuggaccaucucuccaguccuauucuguacuuuuagaaaacacuguacucuaauuuccaugcucccuguaaaauacuuacguuuuccaugcugcugucuuuucuauuagguucugaauucuucacaagggcgaaacuaacaaaugucuuuguguuccagugaccagaguaguauaauuuuucuagaacauauauauugacuauuauuuuuuccuuacaaaucuuuuauugacgacuuucauuugcaaacaggauagaauuaaguaccuuauuuggcagcugguuuaauauguuguuuuguuuaucucaugucuuucuuuugcuuuaugcucagccaucuuaagugaguuaacuaaaacaugcuguguuggauauuuaaguuucaaaauauucuuucuuuuccuaaaauguguauuucacuuucuguuucauaucuaguaaggguuuauuuguuacuuguuacccaguucaaaugcugguucuuucaacagucuuuuuggcugauaagcucuuuagaggaaggcuacugacuccugugcacugccuaugugcuuuuuaguuaauauccuuugaauauggugaauuuggaaugcuuaaguucuaucauuucacugcuuauuguaauuuuuaaaauaauuuaauucucccaaaucccaguuuucguaucuuuaaaauaugaaaacuauuccaaggaauucuauuccucuccuuucuguuccauucaugguuuguaaucuuuuguucucagguggaugcucuucgauugcguuuggaagaaaaagagacuaugcugaauaaaaaaaccaagcaaauccaagauauggcugaggagaagggcacccaggcuggagagauccaugaccucaaggacaugcuggacgugaaggagcggaaggucaauguccuccagaagaagguaaggcaugggugucgugagcacaguggcccacugugauguaaccuauucucagcaugcugccacucuccuucuguuuggauuaugcagaguacuuggaacuauuguugcaggagguggauugcuaaagcugcucuguguguucagucuuuaaugaacucaguaguaucccugucuuucaguaggauuucucauccuguuucucaagugucuuagaaauugacagacuauuuggccaccugaccuaccucuacuaucuuuaacuggaauagaaaugcauuaauauugaaccuggaucaucugccccauuacuuagauggcaguuuugaggaguaaagucugcugcuguaauccacauacacuuguguggggcuuuccucugucucagccacagugcuccuuccugugagggaguguggaggcagugggagaccgacucaccucuuagaccauaacaguuauuggaaauagcuuucuuuuggaauaaaaauaaauuacugauacuuuuccaguuuuaacuuacacauauauccaaauauauaugcuuuugccuguauaaaggcuauacagauaucaggaagauaccaaaacaauguaaauagaaugagaauauauauuugcuucuccuugagcagguugucuccaaaguacagagaagcaagcagugugaauacaaagauagaaaggccacuaaaauuuuaaaacaauuagauuagcgugcacuaacaaaauaauaaaccaauauuuauaguguuucaaguuuuacaguuacaagaaguaaaugagaacaaaugaauguaaaaugaaaacaugagacacaauucucugcaaauaaaaaggcugaaucaucuucaaguucagcaagacaguucuuuguacuguauguacuguggacaagcuaacaugcccauagcuguuaccucaagguucauuucaacuuaaaguuuauuucuguugaaaugauagauuugcaauguuugacauuuucauaguuuauuauuaacuagcuaucaguagccaagaaagaaguagccaugagcagagaugauagucaucugaguucucugggaaguucaacuggggcucugugguugacagagugaacaacugugguaauugacagauuguuugucccuugacugagcuguccugguucuccugugcuggauugcucacucugagucuucgaguucuuguguaauauucacgucuguauauacugugaucagagaagacagucggcaauaacagauggccaggguucacaguugauugguacugggcuccugcuuucuagaauuucccuuaaaggaguuuuaugauagaguaucuuuacaacaaauuggugagcuuggaaaaaggugaauauucagaucuuagcuaccuuguuaaauuuguauaacuugcuggaugcauccuguugucuuuuguauuuuguuugcacaaauguaccaggaaucccuucugcuuacuuuccuuguuugcuuauuuugucuuggugagaugaacugaacauuuuuauuuuaagcaaauaaaguaccuuauuacuauuuccuacacuuucuaauuaagaaagucucaaaaucugugauucuuugaauucauuugcucucucucaucuuuucuuugguauuacagaaaacuccucuauuaacagauaacuguauuacuaucucaaaaauaagccugugauggauauagguuaaauaaagggcugccuagcugccuuauagaaauccuuugugguuucuuugaaauuaauaauuugugugcaugaguguugagccauggcacuacuauagagguuggaggacaguuccagggagucaguucauuccuuccuccuuggggcauuuguaggucaaguuuagguugccagccaggccuuugcacaagcaccucucuuggugaaccucucucuccucccauacuauguuauugaguguguaugaugacagacucuuaccuaagaugucuuggauaacauagcgcuucuuuuucuuuuguuaucaauaaaacuaugaauaucuacccugggcauuugaaaaugugacaaagguaaagcaaaaagguauaaaaauaaguuuuuguuuuaagauuuucuuuuaagauuugauuuucuuuuuaacugugaguauugucuguguguugaaaucugaaugugugaaugcaggugcaaguggagucuagaagacaguguagguuccccuggagcucgagugugguaguugugaguugccugacaaggguguugguagcugaucucagguccucugcaagggcagaaagggcucucagccucagagccacuuccagcugcuaagcuuugcucuuaaguugggaaaauauuggucauaucuuuaguaaauguucuuuuuaaauacagagguaaguaacaaacacauuucugcaucuuagcuuugagaaugugagcuguaacgguugccugucccccccugguggacuguuugcuuuagccaaucuccuuuggcuuuggcuuuuauacugacuuuguuaguguuauaaauaauaaaaugaaguuuuccuuuuggaguuuaagccuagguuguugauuuaauuauuuaagaaacaucuggguuuuuauuagaucucagguguuuuuucuguguagccauuaagaaaacccgaaagcauuguuucacacauagauaggcacugagcagucucacuguuaguacuguaagcuguaugaaguuuuaaaaagauauuucuauuauuuuguauguauaaauguuuugacugccucuguaucugcguaccacaugcauacaugguaaguauggaggccagaagaggacauuggauuuccuggaacuugaguuauagacagcucugaguugccauguggguguugggaauugaaccuggaaaguauuuguaaaaaaaagaaggucaaggccuuucugauuggugggcuucauuuuaauaaauuuaauucugcuuaaaauagcuuguggagguauugucaaagcaguucucaaguggucccggugauugcgggaagugcuuugggauuucuuugguagaggaagucucuccucgguagggauuagggcuucuaagggagaguacccaguuccacuugacuagacuuauguggcuuuauauccacucacaagucacucagugaaacgugauagcuccugacaacugugcaaugcugauaaaaaccaaaauaaaggauguaagucaauccucggcaguguaugauugguauguagagucagugaauuccucauagagcauugcauuuaguuuugguuuuccucugguaucaguuuuuuucuuauaaaaaucagguagagagaagacaucuuugcauaauauauuuuauuucuaacuuaauaaaugugaugauuagaaagguuguuuuaaggaauaaaauuuuuugagaauaacuaauuuaaaaauauuuguauuuuaauucaccuguguuagacuuucuguuuagaauaagugcuuguucaauagauaaucacaaauuuuuuucucaagccaaaauuggaugcaugcuuaaauagguacuuacugaauuuuuucuguaacagguagaauauauauaaaaaguccgugggggaccagggaggcuugccucugaaccuggcaaccugaguuggaucucuggaacccguaugguagaaggaaagaacucagucuagcaagcuguccucuguucuccauaguuacaccauggcauaaguguacccagacacccacauaauaaauaaauuaauguaaaaaauaaaucaacacaggauuauaaaguaguccaccuucuacagcaguuugucuggauacugucuauaguguggaaauauuugacagauagaugauucauguuccagacagggcugcaugagaguuacucauacuacuuggagcaguaugcaacugaaaguuucuaaccaccccuuccuagaguagguauuuggagacagguucuuuaauauaacacagacuggauuugaacucaugcuccuccugccucaguuuccugaaaucccaacuacagugcuaccauaccuggcugaauaauugcuuuuucccuagaauauuuuaucuaauauuuccccuaauauaucauuuaacccuagguagcuagaaaugcagaguagaaaucaaaaccaugcaaaagugguaggcuaucgucuuugucaguucuuuagucugcaugucucucaauaaaaguaccaucuuuauaucucuaaagccacagaagagacaccacacuacaaaaacucccaguguauaaugucugcccaccuuuauaccugcuuccucguuccccuugacuccuugguccguaauagcacauuuucuggcuucagguccuuagcacacacacauaacuugagguuauuucacuugaguucuauguccauccauuuuucuggaagucacagaaucuuguucuucauacugaguaauaauguuguuuacauaccgcauucuuucaccuauugucuggcacuuaggcugaguccauuuggcaauugugaauuuuacaguaagcuuauaucuaucuuuuauaugcugauuucauuuucuguuuaaaaacucagagaugggaaaaugauaugguaguucuaucuuuaauguuuggaagagcuuacauauuguauugcacacugggauuaucaauuuauguuccuaacaauguauaagggcuucacuucccucaaauucuacuaacuuucugaaaaaauaagaucaauuuuaacuguaguaagucuuuauuugccugauaacuaaaugaauuuuuuaacaguauugacuauuuacauuucuuuuuuugugucucuucagauuuucucauccuugagcuguuuaacuguguuguuuuuuuuuuuuuuuuuaaguaguuggagucuuaucuaggaaaucugcccaugucaguauucugaaauguucccucaggguuuccuguaguuucagauuaaauuuuagaucguaaagugucuuguccuuguagcugguguuugucuucucugugaguucuuuuuccuuccacucuucuccaccuuucccccaccauuuuaaccccaacacgagauaggauugaaaaagaaaagaaaggaaauggaugacauugucacucgacuacuuccuguugaugagggaucuugaguuccuuggggcaaguuugaucuuugcugucaggauaucuaauguacucuuguuuaacaaacagugaccaacaguaacaaaccuacaacccagcaacugaccucuugggacccuagcaguauauaccuacccucugaaaaaucccgagguuuccacacauaacacagugcagaaauuaucugcaguuggcaaaucaugcccccgauagagcacaaggcaaaucaugaucagcugcuggggacagucugaagcagcccacaucccacaccugggauuaaaaugagaacauagucuuacacuucuguguuuucuuuuaaagaaaccaaaacucucagcagccuuuuuuuuuuuuuuuuuuuuuuuuugguagacuaagauaagggucuaguguugauauccuauauguggguauccaguuuuuaacaccuuugauugcgauugagacucagcuaaaaaaguaccugaugagucuauuuguguuuaucugguucaugcucccccuucuccccuuuuuaaaugccagucccauguuccuuuuguuacaguggucucaauagugccuccaguauugcucuuugcguagguauuuuuggcuacuuaaagauuauuugugugcgcucuuacaugaauuuugguacuuuuuucuaguucuacaaauucuugcuaugucacucacuguuauuauauuggcccuaauuuuuuuuuuuuuguuuaguggcuuuuuuuguuuguuuguuuuaaauaaaauuuggugcucuuccaauacuugguguauauaaaauuauuauaucucauucuaguuuucuuauagcuuugaacauguuuuucuauaucuuauaaauuugaugaucuacuguguugauacuauuucuuuauuauuucucauugaccuaucuauuuuucuaguaggaguuauucaugcucaguuuuguuuuguuuuguuuuguuuuuugagcuuuggcuguccuggaacugucucuggagacgaggcuggccucgaacucuccaugccauuacugccuguguucuuaaugguguuuacuaacuucucuggugaguguaggauucccuuaagccucauccaagugcaauaaucacaguaguuauuuucuuugaggacugaaauacaucauuccaugucguccgaacauguagaguacuuucuaugaagacuuccauuggucuaauauauuugccuuuaaaucuuacuuggugugucucucuuucagagugaaguauuccuucuuaguccuauacuuuuaauaauucaacuauaauaauuuauaguuaauaauuuguaauaauuuaacuaauaaaggagaaguaaaucauaaagagcaaauguaaagcccaaauuucuggcucauuuguauacuugagggagaagaguuggaggcauagaaagcuucuucaauaagauaauggcaaacuccccaaaaucuugggacaaaugggacaaguccaggcagcauuuagaccucaagcacacauggccauaaauauacuucaccauauuuuauaguauuugcuuuaauuuccaucugucuuagucaguuguccauccauccauccauccagcuugaccaagaacucuugauucuccugccucuuuuucccaaagugcugaaauuguaggcacacacuaccaugcuugguuugucuuaaucuuuaguucauauaaucucuuaccuaagcaaauagaaucccagaauuauuuaccaagucuguguggaaguugguuuaaauuucauuuccacagccaugaaaauuauuuaaaguugucagcucauuucuaggauugaaaccucuauguauucaaaucucucugaaauucagagucuguuccucaguaggccaguaagcucaucuuuacucacguucaguuucauaaugggccacucuuucucucuucucaugucauauaguagaaguggccucuucauuuuucuuaguauucucagugccuggcauauuguaaggaaauuaguaauugucuacugacauaggacucugaaugugucagagucagguuaguucuuggguaggagaaauacauaauucuuuugagaaaaugaaugcauuuaagugugugagaagaaaugaaugaacacagcaagaaguuucacugaaaauacucguuguauuaauacuuguuguguaaguguauaaaacaguuguaaacacuaacauacaaagacaguuuuuucuuuauacaaguaauuugguuuucugugugauucuuuguccuucaguuugcuguacacaauggcaucuuagaagugauuguguuucuuauggauccauugcagucccucucagcauucugacuuaacauugaaacuuugugccucaaaacuuaccuagggauuugccuaucuguucauuggauguuuguuuuuucuuuguggugguacaaaauuuuggcugcuguaggguucagcauauaauuuugaaacaauuaaguuuaaauuauuucuacagagaacacauauacauacccacaucauaauuuguuuaugucuuaaauaauuuuuauugugccuauuuguacccuuuuuaauguuuuuuuuuucucccuuaaauguauauguauauuuagauagaaaaucuucaggaacaacuaagagauaaagaaaagcagaugagcagcuugaaagagcgagucaagucucugcaggcggacaccacuaacacagacacagcucugacaacuuuggaggaggcucuugcagauaaaguaagugacuggccugacucuucccagaccuuguguucuguuuucucauuauccuagaauuggcuauaacuacagaggcaauccuuucauaggagcuuccaugcugcugugcauaguauaaaguggaaagacagucuaguuacucuuagaucuuagcaccaacuucugggcaagauugguuguacaccaaaagaccauagccacauuuccucaagauucagcacguguguccuauuuuucugcuuucuaaaggaaacaaaaauucauuauuugauuagcuagaugugcaggagauucgacauugaucaucaggguguuauaccagacuagcucugcucuguugccuucccaccauaugacauauucauaaauuuuauucaugaauguuacauauguacucauuuucuagcauuggcuuacuccuaaaauaauuuuuaaauuuugcuuguauuugugucugaccaucacauguguaccuugugccccaaaggccagagagggcauuggauccccugguacuggaguuggagacaguugugagcugccagguggaugcugggaacugaaccugaguccucuggaagaguggucagugcccuuaaccacugacccaucucucuagcacuuuggcucauauuacauuguuuuaucuuuaugagcauacuugacauuuuaaggaaugaaaaaguggugagaauguauuuuagagaaucucuuuaugguguuuuuuuuuuuuguuucuuauuguucauuuuggaggggguauuguuuugugaugaggucucauguggcuuaggcuagccucaggcucgcuauguagcuccgugucuuagucagguucuguagaggaacaagugaugaauaaaucuaucauccaucugucugucuauaucuauauaucuauauaucauccaucuauauaaugagguuuuauuagaguggcguacaggcugugguucaacaaugagggucuaccaguggaagguccaagaaucuggugguuuucaguccacaaugcugaauguuucagguggucuucaguauaugccagaauccugaagaagaaauggacuugcuagugagagugagaacaaguaggaaaagagagcuagaugugcccagccauuuggguuuuaguuaauuccagauguagucaaguuggcagccaacacuagccauuacacacaggguggccuuuaacucuugauucucccaccuccaagucccaaguguuggcauuaaaagguuaucucaugaugcuguacuuucuuugagauauuuaauuggauuuuuuuuagaggcauaaggcaacauuuguuaggucuuuuggacucagaaugcuuugaucugcuugcuaggaugaaugcauguucucugaguauguuuagaaacauuacccagaacuauacuuaaauugcuuuagccuucacgcuuccugaguagaaguuuaaaauuuucuaucacuucucuauccucuuaucuaagaucaguuuauccuagcucccccuacuuuugauauauggguuaugaguaauuccuauuguuuuauagguagucugugucacuauuauuauagugaagaaauauguguuauuuuauuguccuagggacauacacauaaguuucuaguuauuuggaaauugaauuuuaaugaaaauguuucaagagaauguguuagugcuaucuaaugauauuucaaaugauuagaaacugacucuugguauuuaaaaauaagcaaaguuggaaauuacugguugcaguaggaaaaaugaguucuuugagaacugaauccuugaagggcuuaccauugucuuuuugauagaugauaguaguguugaguuugucagaggaaucagagcauguucacgauguaaguacagaugggagcauccucaugucuuggugugcuuucuuuuaggaacggacaauugaacgcuuaaaggagcagcgggacagggaugagcgggagaagcaggaggagauugauaccuacaaaaaagaccucaaagaccugagagagaaagucagccugcuacaaggagaccucucagaaaaggaggugaggcucaccaaauuagucguugcauguuuauaucuguugcuggcugcacagugcagcacggaggaaagauuuucuuaguguccuguggcagguguuccagggacucaggaagcugugagggcuacagaagauuggcucauuuauuucauacucuuuuacugccuuguucuccguucuaagaguugguuucuuucuucuucuucuuccuuuuuaguuuuuuuuaaauuaguauuauuuauuuauuuuauguauaugaguacauugcaacugucuucagacacaccaaaagagagcaucagaucccauuacagaggguuguaaaccaccaugugguugcugggauuugaacucaggaccucuggaagaguagucagugcucuuaaccucugagccaucucugcagcccaagaguggguuucuuaugggaucccaaucuauaugcagauccuagaauggcugaagcccaguuacauuuggagaaacacugcuaacaguaaggaaggugacagaaaaggaggaaaucuaaucagaaccacuauuagaaacaucauagccuauaacuugauucacuucgugaguuuuguucuuauuuuuuaauaauccuaucagaaucacuuaaguagcuacaaaguucaauguuguguaaugacaaauccaguaggucugucuaauuacuguagaaaguuuguagaaguaaguuucuacaagaacuuccugcuaagagagggaaaacaugcaugcucaaaucaguguaguuacugaguuuggcuacuucuguucuuaaagcucauuccccuuuaccuugggagaauaagugcaguggguuagagccuuguucuguuuuugagacagggccuccuguaauucaggcuggccuucaacuucugauccuccugccucuaccuccugaguucugcagcuacagguguguucugugccuuguuuauguguagcuggagauugaaccuaggacguaaugccuacuaggcaaacucuuuaccugaguuucauccccaggcguuuuuaggacucuuuauuaguacugaggauccaccugcuuuuaacugauaucugaaagcuaagccagugucuggaaguuuuauaguucauggauguucuugaaauggaaacguccaaauacuaugaauauauguuaaaaaaauuaaauccacauuuuauuucacaguauuuauuguaacuaugccuugcuucuuuuaggcuucucucuuggauaucaaagagcaugcuucuucccuggcuuccucaggacucaaaaaggacucgcggcucaagacccuagaaauugcucuugagcagaagaaggaagagugccuaaaaauggagucacaguugaaaaagguugaagaaaaaguuaccauuauuguuuuucuuuacauaggaacacuguagauagcucugagugccuuuuuuuuuucuuuuucuuuuuuuaaaguuaaggauuuauagugacaauauagaauuuagaguuauuuuuauuuuuuauuguuuuaagguauugcaguuauaaccaaauaccuaagauaaacaguacugaaguaggaaaagauuuauuuagcuuuguaguuugaaaaguuacaguccaagguuagaugauuccaaugcuucuaguguuuagugaggcagaacauccuggccaccaggaaagcagcagauagaagcgaggacaaaguguucaucucagaucguguccuuagugaucugcuuccucugcugagaucccaccucucagucugaccccucagcggugccaucacagugugguucagggauuaacccacagauuuggucagaugugcugucucguuuccaaucaccccaguaaugaacacuggcacaucaagcuucagcacacggaggaggaagacuuugaucucggggauggggugggggugggguggcuucuagaagguuccugcagacugcgcuuugcuguuucucuuucccuuugcucauaccauucuguaguuuucagucacuccaauuaggcuagacauuugauagugaauuaacauccuggcuuguuacuagaaucauuuuugaagucugugcuauuuuaacaguuccauaauacauauuguacauuuugauuacugucaccuucucucccauuuucauuuuuuuuacaugccccccaagucccuuucuugaauucagcuuuuguuguuguaauuguugcuguuguuuuuuguuucuuguaugacacugaguuuaaagccaggugucuuaguuuacauucuguugcugugauaaacaccuuggccacaaacaacaugaggaggaaaggguuuauuucgaaaagcuuacaguucaccaugaugagcaaugagggcaggaacugaggcagagguuauggaaggaugguugaucuccauggcuuauuauacaaccaucugcccaggguggcacugcccacauggggugagccucgccacaucaagaauuaguuaauaaaguacuccauagacuguagacagccugauggaggcaaucucucaauugagauuucuucuuccuagacgcuuuuaacuuguguuaaguuaauaaaaacaaaccagcacagcagggcugugugaccaugguuugguguuaaugaguggaacauguugagcucaucagugcugaccacaguguuugccacucaccugaaaucuauucaguagaucauaguauagcaggauggacuaggaccacauaggacccuccacaauucccaguugacuguugacagcagucccaucuccuggaagccuacugcugucagccacaugagaucaugacuacaucaugcccgcaagguagcauuuuuccugcauaugucucacccuuacauucuuaauaccuucucuucaguuaugcucccuuagcccgagagggagugguauauguuguugagggcugagcacuaaaccaucaccuuuucuuaguaucuugagcaaccaugagucuuuugcauuuugccauuucucauuccaaagacaacauuaucugauuaagacagagaguaauauacauggguauaauuauagauauuuagaaagcagcuuggcacuauuucaacuuagcuaaagaccagcacuaaguuaccccuuaaauaauacuaaaacccuaguuguuuuaauuguguuuauagcauuagaaauguuaauacuuauuguguagugggcccccaaacuaaugauggaguucuugguuguccccauaacaguagugucacuauugcaccgggggugggggguguaucuugccuggcaagugguguuaaaguucaucggguucuuagcuagagaagagcauugcuuuuucucccuuaguagcaugcagugcaccauccuugcuaugaaagggggcuaguagagaggacacuuucagcucaguucugguuuguuuguaucccuuuuacuucuuucucuuauugcuguguccaggacuucaaguacuauauugaauuuuaauguagaguggacacuuuuguccuauuucugauuauauugagaaugcuuugaguuuuucccccacacaggaucauauuguuuauguuucccauauauaguucuuacuagguugagacaaguauuuccuauaccuaguguauuaagaauuuuuaucaggaggggauguuggaucuuguuuaacacuauuuugaaucuuuugagaugauuucuccucuguucacaguauuuuuauguuuguuugcauuuauuguuuuauuuaccgagacagggagggucucuauagacuuugcuggccaguaacuuguuuuuguaccugugccucugccuucugaguguuagaauuucaagugugugcuuccugucuuagguuuacaucuugaauuaaauaugcuacucuauuugcaaaguugacuaguucacuuauuaagauauauucucaugacguucccaugacguuccaacuaccuccgccugucgagugcuuacugggauguaugcuaccaugucagcuuuaaaauuguuuuaaauaaguguuccuaccauuggcuugguaaaucucuuuuuuugaguuuguguguauauauagauauuaaaguuguaaaggucuuuaaugugauuuaauauucuuggaauuccauuuuaaaguauaagugaacucagcagaguuuagauauaaaagccugacacagaauuugcuaugauaguaagugaagguucaugcuuguagcaacuuucuucucuuuuuccuucuccucuucaucaccuuccucuuccuccucuuucuucucuuccuccuccucuuccuucucuucaucaccuuccucuuucuccucuuucuucucuuccuccuccucuuccuucucuucaucaccuuccuuuuucuccucuuucuucucuuccuccuccucuuccuucucuucaucuucucccucauucuccuccucuuccucuuucuugucuucuuccuucucguccuccuucucucccuuucuucucucccuccccugcuccuccucuuuuuuccuucuaucuucuucuuggggaguuuucuauacaggggucucugugaagccuuagcugccuuaaaacucacucuguagaccaggcuggccucaaacucacagagauccaucugcuucuguuucuugagugcuaggauuaaagguguguguguccccugcccggcagauugauuuucuuaauguuuauuucuuguggaucauuggcuccugaguuauauuuaacuuugcacuucuguuuaguuacuugucauuccucuccucuuccccaguuauucuucuuuuccuacuauucauuccuauggacuguauuuuuuuuuuuuuuuuuugaguuuuugagacaggguuucucugugucuccuuggcuguccuggaacucacucuguagaccagauuggccucgaacucagaaacccaccugccucugcuucccaagcgcugggauuaaaggugugcgccaccacugccugguggacuguauuauuuuuauuugacuuuaaagguauauuuuaaagauuuacuauuagggcuggaggaauggcucagcagcauguauugcucuuucagaggacugagguuugauuuccaacacccacaucaagcagcuuucagcuauuuguaauuccaguuccagagauccagugccucuggccuccgugggcaccuacauucacaugcacaaacuggcgcgagagcgcgcacgugcacgcacgcacacacacacacacacacacacacacacgauuaaaauuuuuuaacaaguuuuauuauuauuauuaauguauaugcuuguguaucagagcuuacuggaaacugaauucuaguccuuuggaagagcagcuagaggauuuagcuacugagucaucuuauaugcuuuuugacuguuuuaaaucaauagaaauuaucuugagugucaucuuauaugccuuuuuucuguuuuaaauugaaauuaucgugaguguauuauacagacucauuuguucagugauugaguuucuguccuaugucaguuaacagaauggauaaugaggauguggugacagacaauauagaacugcccauagucuucagagaauuaauaguuucuguuagggaaaauagacacuuagccagcaaagucaaguaagucacaugguccagggugcagagaagcuauccauggaacugacacuuaacuaacuggugaccucagagugaggguauucuaccaugugcgaaccuagcacacugacugguauuuauacuacaaacaauagccauaguuaaauguaauuggauuuaucucaggcauugauuagaagcugcuguuuuuugucuuuugugacuccccucccccaaaccucuuuguuuccuauuuccuauuuauuugugugugugugugugugugugugugugugugugcaugugugugugugugcauguguguaguggggauguuuuuauucauuuuugcuuuuguuugcaucuucaguuucuuuuucuucuucuugauauauagauaugaugaacagucugugaaauagcuccuguccucuuucuugcuguuagacacucuauauuaacagagucacuguagcuuucuccaguccaugagagaaugaucaagaaaggaauuucccuccuucuuuaauuacauaaacaaugugaaacaaacagauuucaguagguuggagaacagugaucucuuuuuacuccucaacaaugcauaguuguuucugauuacauuaaaggacagauagugaguguuguagaaaguaaaacacuucccccacugggaauggaaccuggaauagacucgaugaagcauucacucucagaaauguaaauaauauuuuuaugacuuaauuuacacaacauguucucauuuucuuagacuacuuuguaucauauuuuucuaaaauguuuucugaagaauuuaauauuguugaaauauuuaaagagauuaauauauuuuucugcuuauucaauaagaaaaaaaugaauguuuuuugucuuuaucuucucguucagugccuucuuuauauacauguggcuuuagacauuugggagaaaggauauuucagguugcuuugagccauuugaagcuuggucuugagcugguaguacuguuuuggcagguacagcagcuuuuaaagugaagucuggaugguaggaguaggucacugagcccuuaggguuagccagguuguacuucuaccugagcucucugcuuccuaucuguccccaacauguaauggggccugcugaguacucucagcucacacuaccauggcuggagccccaaugcugguccuuccccaugauaaacuuuaccuuuaaccaccaguggaaacacccccucuucccucaaguuucuucuuuucaggaauucuuuacgguaacaagaaaauuacaaguaauugcuuggaaauuaauuuuaaauuaaggaaauuuuaguauacucgaaaguuuauugacauuauuggcugcauuuuccaacagaacccugaacaauauauugucuuaguucuuagagugagucuugcuuuuuaccuucugauugucagucccagguuucuuguaaaauucugaauuuuuugcuuuaguaaaauacacuugagaguagcuguuucucuuuguuuguuuguuuauguuguuuucaaaacaacuuacuauguagcuuuggcugucuuggaacucacuguguacaucaggcuggcuuugaaaucacagagcuccaccugcuccaaguacuaggauuaaaguguuagccauaugcccaguuagguuucuguucucuuuaccucgcuccauuuucccagcaucaguuauauccguugauucugaacaguguaggucauaugauuuauguguuuggucaagcuacguaaagagaaggaaaugcgguuagggccuauuggacuaagucucaccguugauauaagaggagugagaucaggauucagagcccucccaugccuucuucauuagucucacucuaaagcaucaguuggguuaugaugauuuugggccucauaauaaauauuccaagguaaaauagcauuuuaaaagaaauccauuuguaaacuacuaguauuuucacuaugugauccaugaguagagagaagccauuuaaauaguugauaacacuauuggcauugaaauagaaauaguucuuuggguguggauuaccuacuuccaauguucggacuuugaaaacuuuuuuuuuuuuuuuuuuggguaggcgcaugaagcaacauuggaagccagagccaguccagagaugagugaccgaauacagcaauuggagagagagauuuccagguacaaagaugaauccagcaaggcccaaacagaaguugaccgucucuuggaaaucuugaaagaaguggaaaaugagaagaaugacaaagauaagaagauagcugaguuggaaagguaaggaaggggggcuaagcagugcucgcugggcagcgaccauguucuaccucuucugaagcagcguuuucaguugcauguacaguggagcuacuguguuacccacuuacucucccaagucagugugaagccugggcuacggucccuaaaggaugacacgggauagggauaaagugagaaacuaccacuugaacaucaucgacaagagaacacauuuauugcugaagggcccaguuuccuccuagcuauguucuagagaguccaaagagauccuuggcuuuauuauugcuuuguguaaugagugagugguucucaaguuucaaaaguuguugagcucguacucuuuugggcugugaauuuuuagaauggauaauuuagagcaugggaaagcaaaucaugucaguuuuaaauuagaagggacagugugaugcuaauguaggagacuuauaggugagucuuaccagguuuuaaguuugaaaucuucacagugaguuguauuugaacagaucuugacagagauagcucucuuggaauauugcuuuucuuuuauauugaagaucaagcauauagucuuauuaccuuuuccuuuuauauggucuauuuaacauaauaucccaaauacacagaaacaccuuuuccaguagaacuucggagucaccauauucuucuagacaccuagaagucacuaauucguauagauuuugaaaaaaauguuuaaggaauaauuuauuuucuugaaagcuagaaaaaguuucugacagcaucuuuaaauuauuuacuaaaguuuaaauuuuggaguuaguaguaggguuaauauuuuccuuucaaguuacuauuucuucuauuccauguuuguagacuuugauuccuucagugaaccaaaaaugcaaauaauaggguuucucauuccugccuauacauuuugguuugguuaacuauauauucuguaguucuugauaagauuuauuuauuuuuauguguaccaguguuuugucuucauguacguguaugcacugugugugugugccuggugcccuuggaggucagaagagguuguuggauccccugggaguagaguucgaaaugauuguaaguggacuggaaagauggcucagagguuaagagcacuggcuuuucuuccagagguccugaguucaauuuccagcaaccacaugguggcucacaaccaucuacacugaggucuggugcccucuucuggccucaagcagaauacuguauuauauauuaaguaaauaaaucuuaaaaaaaaaaaaaaacgauugugagccaccauauggauuccaggaauccaaccugggucuucugggagagcaaccauugcuuuuauccauugaaccuuaucuccagccccuuugauaaaauucauuuaaucaaucuuguaagaauauagauugugugcauuuuccuucauguuggucuuuucacaucuccuuugccauagcauguuuguauguacacacuuacauacuuuuugaggagcuugaaaucaucaguacugcacuugcacuaagaugccauacuuuugaagaauguuauccuacuguuucaacaaagacauuucugaauaauauuccuuucuuguuugauuuuuuuaaauugaaagacuucauuugaaguuauuguuuucuguuguaugcagcuagcuuuaaaaaugauucauuuuuagcuuaauacugugugugugugugauggacacguugcgaaagaaaauaagaaguagggcuaaguuaaacauagaagauugaaaauuaggaacacugugugagagggaaugugugagguguuugucuuucuaaaucugauguccucacuuaguauuucuccagucucauccauucucugcauuucaugauucccuuuuccuuauagcugaguacuguucuguuguaucugccacaucuuccuuacccauuaaucaggugaugggcaucuagguuaauuccauuuccuagcuauugggaauaaagcugcaaugaacgugagugugcaagcaucucuaccauaggacguaagguccuucagguccaugccuucgagugggaugagugggucaugugguagcuuuaaaugaucugcuucuuccgcgacuucauuuuuuaauacauuggaauacauuguauaauuagauagagguguccauucuuuggucauacaacuuuguaauauuguuugaagacuacaaaauuucuugcuuacaaacagcuaccaccaucaccaggaccaugaccacaaccaccacauacucaaaaaacuucaaaguaacaaaaucccagcccaauuggucuugccucagcccucuuuggucagaauacuuauugaaggcuucucaucucgaugggaauugucucugugcuuauauuuaacccaguaucuugagcagaaguggcuuuguacuguaucacgguuugcugagaaacuaagguagauuuuauuuccuuucaguuuuggauuccauuuuuauaaacugagcagggcuuguuuuuggaguugguccauguacucucucugagauagcugggguuauuucagucuuuguucccagacuuagugcuggagagugugccuguggcuguuguaucugacugagguuugcuucuuguauggcccuuccuuuguuuccuauauguuuuucuuuuguuuguuuuauccuguuccuguuccgcugggguuuauguaucuuaauguugcaaugugcauguucucucuguaucacugccauucucagauagccagucuuucauaaauaaugcugccaucaccagguuucugugucugcaucguucuggguuaaguguguguauguaaggcucagucuucugagcaauuguugcuccuguugcuggauuuuacuugaucacaauuacagccaucaauuugagcuauaccucuuauaugcucucugcuuuaaauacaaccagccugcgcucucucuugcuagguucuaugugcuaguauauugcacauaguuaguuuuuuuucucucucuugcacaagaaucuuugagguugauguuucuauguugggacacuuguauuuggagacacgaucucauguaguccaaauuggucauaaacuugcuguguagcuaugacuuucugauucuucugccucuauuucuuguguguugggaguauaguuguaugccauuccugguuuauguaguguuagaaacugauccuggggcuuugugcauauuaaaaaaaaaucagucugccauuugaguugcauauccauugugggauacucuuuuaaguagccccugauagaucugcaauuccaucuuguacuuuagcauguacaauuuacuucuagaagguauucaacacuguuuaaacugaugaaauuuaaacaaaagaaaauucuuugauuuucguauuacuucuuuaacuuuaaaaaguuaucagaauuauucuuuguggaugaagguaauaaaugaacaguuccuuucccauguugguucuuaagaaaauuguuguguuucuuagaagauguauuaaugggauucuuucgauuuaguguaguaacacucuuugaccaacuacaguuuuuccaguugaaacuaaucacuuaccaguucacuuucaauaagagaaaugaaggugucauaggaacaagagggguagauauuaaaaaaagagauugucuuacauguuugugaugauuuuagaggcugguuaagcaagucugaaaucuaguuccaggaauggagguuuauaaucuggauggcauuuguagaggcacaagccaaagcagggcuccuuugucucucauguaaccucagcccuguuuccaacaccuaaauaauucaucguguucacucagguaauauccccuaguauagugacuaguguguguguaugugugugucugugugugugcacaugucauacaugguuacacccaugugugccagaguucaaugucaggugcuuuccucaaucacucuucaccuuauuuuaugugacuuuuuauuuuaucucaucgaaccugaagcucucuggucagcuggccucacuggccagaaagccccaggaucugugcucuggcccucauguuugcauagcaagcacuuugcuggcucgcuguggccuuggcgaguuaauguucauggaaaccaccauucaguggcuauggauagucuccauagagaaaacaaagugaagaauaagauguccuagucugaauaaauagauuuagauuaccucaugcuuuuccucuccauugcugugauaaagcacccauccaaaccagcuuggugcggaaaguguuuauuuggcucccucuuccaccccauaguucaucauugagggaagccagggcaggaagucaagcaggaaccuggaggcagaaacugaaguagagauauaucaaagaggaacacugcuuucuggcuugcucucagguggcucaguuuccauucuuauacagucuagggccaccugcuugggggugcuacuggccacaguuggcugaguuuucucaugucaaucauuaaucaagaaaaugccuuacaaacaugucuauaggcuaaucugguagagguaauucuucagugaagauucccucuucccagguaauucuagucugugucacauuuggaaaaaaccacccagcauaccucuggaaacugaauacugcuacuaaaaaugugucuucuauacuuagcauauuaguuuccauauagaucuauaaauaauaggcuugucuauggcauuucaugccagcucacaucuagugucucuuggucaaucucuugguccuacucuuucccuacuccuuccacucuguggucucuccaaguccuagcacugggucugcucuccagcucugcccacuuaagggaugugaaagcugauccagccauguuuguuguggaauaugacuugaaauuugccaagauguccuguccacccuauaccuggguuugcccagaauaucauuuuuagguuauagacaacuuauuaggauuuagcuuccuggauauuuuugucucugacuagagaggaagaauauauaucugugaccucagaggcguguucccacauccuagcacaguguccccacucacuuacccugcuaccucuuuaauagaauugacaguaaaaacaaucucuaguuuucagccacacagagcuggcuuucaguugaccccagcacauguggaagucauaggucaucuucccuuuugcucucuaauaauuuuaguuuuuugagaccaggaaagucuuccaucaaaccugaggcuccaaauuugggccagggugguuagcugaugacaugccuguuucuguucacaaacaaugcgguuacagaugugugucaguauucuuagcucuuacaagggcgcuagugauaugaacucagacccucuugcuugugcagcaagcuucuuacccaccgagucauuucccaaguacccaccuucuuuauuugagucugagucucuuugaagcccuccgcaggcuuugaacucuugaucuuccugccucaaaacuacaggugugaaccacuggcuucuuuuucuccccuccccucccccuccccucccccuccucucccccuccccuccccccuccccuccccuucccaccuccccucccccuccccucuccccuccccuccccuccuaaauuguugaucacacaugaaauuuuauucauuuacuuauuuacuuuuuggucagaugugaagauaaagauucaguccaccauggcagggagccaggguaguaugagagguuguucacguugcauuggcauuuauagagcugauagaaagaaauauugauucuuugcuuucuuuuccauuuuaaaaaaacauccuucugcugaagggguuugcagccccauaggaggaacaacaauaugaaccaaccaguacccccagagcucccagggacuaaaccaccaaccaaagagcacacaugguugggacucauggcucuagcuucauguguagcagaggauggccuaguaggacaucaaugggaggagaggcccuuuguccuaugaaggaucuaugccccagugugggggaaugccagggccaggaagcaggaguggguggguuggugagcaagggaagagggguuuacauagggggaaggguguuuuucagaggggaaaccaggaaaggguauaacaugugaaauguaaauaaagaaaauaucaaaaaaaaaagcauccuuccuuccuucuuuccuucuuuucaucuuuucuuuuuuuucagucuguaacucuaaccuauggauagaucuuuccuuuucagcuaaaccuuuccucacaaacaugacuguaaaucuaaucacauugacaauaaagauuaacuacuaucauaugucuacucccuugucaguuuaaguauauauuuaaaaucagaauguuccaucccuguucuucaaaggcucaugaauaucucacaaugcaggauacuuuuauuuuaccuauacuaaugaccaaaaucucaauaguucuaauauugcucaaaaguccuauguccaaagggcaagguagcucaguggacaaaggcugccaagccuggcaacccgagugagaccccaggauccaaugguagagggagagacuucugccaguugucuuucuuccuccauacaugugcuauggcacacacaugugcacacauagacagacauacacgaauauuuuuuaaugaaccaaaacuaacuauaaagccccuugaacguaauaugggaagauggacuaaaguaacacugaaacccauuugcacaaacaccagauguuacaguucuauuuguugcuggcuugugauggaaucauugggacucccacagccuuagguagccccacccuuuagcaccccuacuccccuaacuacacucugccuauagcuuuccucagucuaagucucacaauccuggcaucuuagaugucuuggagucuccauucuaacuugcuuccuaccuauauagcuuccuccuuuguccuuuuaagguccuucugcaggcaguccaacucugcuguauacuguccauccucaguguuucucuggcaucuuagugcaagccucuaggacacuaccucacuugaauuuuguuugccuggaagccacauggacagugaugccaaguucugcugcacggacaauguguagcucauccauggcucuaacgcuucuguguuuuggcagcugagccugggaaaccauuucccuagguagcuguuauucaguccuuuuauuuccacucucaguucagucuccuccuucaaaugaaugcauuuuugcaagcucuggagccuuagauagugaggucuuauccucagggaaccuuuccuauuguuuagguaugaauuugagguuuuuuccuuaggugcauuaaucacuuuaauaauugcaccuacuuccuccacucucaucuugucuguaacuuugaacucacuuauguuucuuuccuugccuaagugcauauauuuaagaaauauauucccauauauuuuugcucuguuuuacuguaaauaugaggaaaucagucuauauuuuaugugaucuugaaauuucuggcaaacagcuuaguccauuacuuuugaauucacucucacuuuaguguauaugacaugguggaacacaagaaauuuauuuuugccagaauaugaguggguuaaagcccacucuuugauagucguaauuucccccugaaaccuuuucugccaggccuuuacuguuugcauuucuauuggcaucugggucuuccaaacucuuaccagaauggcccauuaaucuuggcuuacauucugggaccccgcuaagcauccugcuucaaacucucccacauuacucucacaagucagcuccaaacgcuaaagcaccacauggucagguuuauuacaucaacagccccacgccuugguagcaauuuacuguaucaguuacuuagcugugguaaccagauuucuuacaagaagcaauuuaaaggaagaaggauuuauuuuggcuccugguuugagaguguaguucaucauggugggaaggcauugugguggaaaugagaggcaguugguuccaaugugucugccuuuaggaggaagagagagaugaaugcucugcuuuugauucuuaaaguaaaaauuaggucaugaaaacaaucauggugacauugggcacuauaaaucuuaacugcggaggaaguaguacugacuucccucacacugacuacuuuucagaaaaagaaaccugccuauuaucaaaggcagugaugacucagaacauuuguucauggagggcuguuaaacauggcuauuuuguaggucuuaaugcuggacaauguugcaaauaggauuuuuuaaauagagccauucuuguucauuauuguuguuagauuguuuuuacuuacucaaagacuuuagcagauuugaaaugauuaauaugaguuaugauuaaggaaaguuugacuuugagaauuuuuuuuucaaauucuuuuaaggauauuaguuuuauaaucuaagaagaacaggagcugucagucuugggguuuuucccccauuuuggugacccaaguccucuucaugaaauaggauguugagggagaaaccagacuuaagggggaguguaaaaaacucaacugacugaaugcugaugucucauauaaaaccucuaauggcagugccagcaagccggcucagcugguaaagguacuugccaccaacccugauaaccugaguuugauccucggaaacccacaugguagaaugagaauagacuccuacaaguuguccugugacuuucauacacaugucauagcauguuuacauaugccuacacacauacauacaaaauaauuacaugaauuuaaaagccaacccacaacuaauuccaguuuuagcuguuuaaaugacagaauugacaauauccauccccauuuaagaaauuugcucuccuuuccccaagaaauggucaauguuggacaaacguuuuaaaagaguuuucaucaaaguauuaaacucuaauaggaaauguauccguugcgaucucaaauucuaauuucuagcuccugugaagaaucugcaugcccccguccucuuuacuccguguuuuagccuuaccccauucauaaacguuagcauuuuuaaguauuguccuuauuaauucuuucuaacuuucucuuucacguuuucuuccuggauuugcuguucucuucagucucaccucaaggucaguaugcuugcuaaaaauguacaauuacaaagagaauguaauugaggcucauuuacuaaccuuauuuuccauuccaauaaggacuaaaaugauagaauguauuucaggaaagugaugcccauaucuaguucugagcauacaaaaugucaagaaaguaagcuuugcauagcagcaaaugcaaacuuuuguucuuuggaagauaugagaauguucaggaugcaggacugagugggguuuuacugaaagaacugaagauguaaggagccaccaggggauagauagcacgggagagcuuguucaucuugauagcacuuuacuagcagugccuuggguaagaacuuaagcagggugaaaggaauaauaaugauguaaauugaaguaaaaaaguaugauagaguuaaaauauaagcuuguuuaugucauauacauuaccuagcaauuuucuugucauaauaauuaagugauauguuguucuuauuuaugaaagugcccaucucuugauacuuaguggcuagcaguaggcaggggagguuguuauucucauggggaaguaggcacaaagaaaugauugcccuggguucaggcagccaaauaacaauauuuagcugugaccuuuugcuuuagguuugauuuuucccagacaggguauuuaaguagguaacccauauugguuuuacauuucugaucuuccugucucuuuauguuauaugaacuacagauugaaaaguaauccuagauuauuugggcuuucauaggcuucugauguguaaguuuugcucuauaaaauugggaugauuaucacauguaaagauuaaaugaguuacucuaaguagcacuagagcguagggcacagggaaaauggucuuguuuucuuggcauuuucucacaaguacuuagacuucccacaagacuacauucuuggauuauguuccaaaaucaacccaauugcuuuuuauuucacuuugauauuugauuuguugucagcuuucuucacuguuguuugcuucuguccucuguuaguaguagagaucauaaccugaaggaaaacuacccauugagugggggaaauaaacuuguaaaaaccuuccuaucucuucacauaauaaaauagaaacacaaaaacaguggaaaagcaagcuaguagaaagcucccaacgccuguagcuccucaguggcugcaaccaaagauaauaaaauagugggaucccaaagaauucaaaauaccacagcuagaaauuuaaagaagauucaaaaagcaaaugaaugagguaaggaaauauauuugguaucuacaagaacaccagugguauggaugagaaauugaaaaacauagugagaaaauugagauuuucaaaaaagagaauggaaaaaagaacuaaauaaaaaaugcaguggaaaguuuuaucagcauacagugucauguugagaaaaauaucaguauuagaacacaagacaauagcagccaagaacuuugggccaugaauaagaaagcaaccaaaugaauccauuugcuagaaaaguaaacugagaaaaaaaauugaggcauagaauaaacauuuaguuaaauaauaugagaagauuuuuacauugagggaaaaauacagacauaagauauuuagagccucagguacacacaaccagaagaaaaccaugccaggagaugcccuaguuaaaugugaaaacugcagagcaagggaaguuauugaaagcuuccagagaaaagcacaauucauguacaaagacaaauucacugggauaauuucagaguuuccaacagaaacccuaaaagcuaggaaggcauaaaauucuguucuuuaaauccugaaaauaauugucagacaaaauuauauauuugcuaaauacauaucuuuuaauugauggagagauaaagacuuuucaagaugagcagaaaugaaagcaauuaaugaucacaaaacuagcacuauaaaaaguacuuaaaggaauucuauacacaagaggaagaaaggggagagagucgcagcucuagaauacagcaguaaauaagucuggugagaggacuagaguagcaaauaagaacuagaaaagaaucaaacauauccaucuaaguaaaccaguauucaccuaagguaaaccuccuugugcucugcuagcaaauuuuaugucagcuugacguaaguuagagucauuugggaagaaggaaucuuacuugaagaaaggccaccaccagauuggccuaaugggggauuuucuugauugaugauugaugcaggaaggccaagcuuauugcagaucaugcaucucuuagacuggugguccuggauacuguaagaaagaagucagaguaagucaugaagaauaagccaguaagcagcaccccuccaugauuucuaugaucucugcuuuaguuucugcuuccaggugccugccccugacuuuucuuaguuuuagacuguuaccuagacauuuaagaugaaguaaacuaucccccacaaguuguuuuaggucguacuguuuaucacaaaacagaaacuaaaauaccaaccaagaaaauaaucaucaaaauuacagaagccagcaaauauucuuuuaguaguaccccgaauauuaacgcucccaguuccacaggaaaaagacuguaaaccaaugagugaaucaaaauucaagagccaaguacuagagggaugauucagcaguucagaguacaugcuccucuugcaaaggacucaggucccauuccaagcacugguguggugguuuacaauuuuagauaauuucaguuccaagggauuugauaauguuaucugggcucuacaugcacuuaacacauaugugcuguauauaaauaaaugaauguaaaaacccauacacauaaaaagaaaauuuaacuccucucuccuuaauauaaagaaauuaaaaucaagcaagcccuucauuguuuacaagagguggacauuauuggccaaauuauacacagaauauaaguuaaagaauagaaaguuauaaguaugcaaagugauuagcaggaaauggacaaaaaucgccauucuauuuauuuauuuauuuauuuauuuaaucaaucaaucaaucaaucagucaaucuacauuucaagucuuaucccuuuaccugguaccccccacucucagaaccccccuauaccauccccuucccccugcuucuaugaucguguuccuccacccaacccaccgccucccaccucuccgcccucaguucccuuacacugggacaucuauuacaccuucauaggaccucuccacccauugaugucugacaaggccauccucugcuacauaugcagcuggagccauguguacuccuugguugguagcuuagucccugggagcucuggggguuucugguugguugauauuguuguucuuccuaugggguugcaaaucccuucagcuccuucaguccuuucucuaacuccuccauuguggauuccgugcucagugcaaugguugacugugagcaucugauccuguauuugucaggcccuaguagggccucucaggagacagugauaucaggcuccuuuccgcaagcauuucuuagcauccacaauaguguuggaguuugguaacugugucugggaugaauccccaggugugacagucucuggguggccuuuccuucagucuuauaucugacaaaguagauuucaagcccaaguuagaagagauaaaaauaaguuacuacuuauuuauauaucaaagaugaugauauaaugauuacaaauauagaguguugaugugcuuaguuucauaaaacaaauaucguuggacauacagggauaguugguuccagacaagggcagagggagggacaaggaaaugcuaagggggcagggagagagagaauuauaaaaguaaguauaaaauuaaaaaguauacagaagauaauaaggauagauucucaugaaacuugaagaauuguuagugaauacuuugaaagccuauaucacguaaacuggagagucuguugaugguuaagguucuguacacagaauaccuaccagagguaauccaguagcauguauacacaacugggacaucuguagugugcacugaugcuggagucaugauggaguaucucaaguaagaagcuaccagauaaugaaauaucuacuagacaguugaaguuaagguuuucugcauuuucacccucccacacacacauugauuaccacucuggcugcauugugcugauucugagcuucuucuaagcuauuaauuacugccacuguguccuuccagcugccauuaaugaucaucugcuaggaccuucucagcugugacuguugucugauauguaugugacccauaccugggagaagacaugguagucagaugacuuacuuauugguggaaauaccucugcugaagucugagggcagaguuucagaaaauacaguaaucacuggcuggauagugucaggaaccaucauuuguuggaaaaaagcuugcaaaagagacagacaagaaguaccucaaagauuauauuaauucacccaaaaagccuaacacaaagacuuagaggguaagaagggcagaacuuuuuaugucaggugauucagaaaaaaucaaacacauuugugcuaacuuuagcaacugccauguauuuuuauugguuaaaacauaauccaagccaggcaugguggcgcacaccuuuaaucccagcacuugggaggcagaggcaggcggauuucaaggccagccuggucuacaaagugaguuccaggacagccagagcuaugcaaagaaacccugucuugaaaaaacaaacaacaauaacaacaaaacaaaaaaacaaaaaacaaaaaacaaccccccccccccccccaugaauccagauagcauguuugcucuucuggacuaccaugaggguggugugacuccauauaggauuuucuuauuuuuauuuguuuuuaauugagacaagguuucauucuguagucugaucuggaacucacuauguagaaugggcugaccuagaacagacagagaucugccugccucugucuuuuuuugugcugggauuaaagggguucaccaucaugcccagucagauaugauuuucuguuaaggaucauuuagaaauggaaaaauguuagugaacuguaaaauuucuuuggauuuuuuuugaucaccagccugcauagcuggcugcaacuugucauuucuagaacacuaggcuaguugaucucuucauuuugaucaugauuuauuuggaauggagacauuguuucuuaaaggacaaaauaaugucaugcuucuccacuaaaaauaaguguguuuaaacuuaguaaaaaaaagaugaacaucagugcuuuccaauucguucuaugaaucagaaaaccaaagaacacuagcagccuuauuuuaugaaguuauuucuuacacugaaccaaaucuagauaaggacagaacaggaaaagcgacuauaguagugucuggagcaaugggucgguggguaaaagagcugauggcacaagcaugcugaucugagugugaucaucagaguccacaguggacaaagacacccagcuuucagaaguagccuucugagcuccaccucuacccaacaguaaggggaugcacaugcacagacacacggauaaagaaugguuuuaagaaaagaaaauuagccagacagugguggggcaugccuuuaaacccagcacuugugaggcagaggcaggcagauuucugaguucgaggccagccuggucuccagagugaguuccaggacagccagggcuacacagagaaacccugucuugaaaagccaaagaaaaaagaaaaaaaaaagaaaagaaaauuauagagcaguuuccuuacuaaauaugaacucaaaaauucuuaauagaaaucuuaaaaccauauucagcaguaucuuaaaaguucauuuccugggaacaaauuggcuugcuuccagggauggcugggugauuggcauguauauaggcuuuauuacauugaggcauuucuuucuauuccuaguuucucaggguggggauccacuaucauguaagaaugcugaauguuuauaaagauuguuuucugcaccaacugaaauaaucauguaagucuacaugcuauauguauugauuuccggagauucagauucaguacuacaaaaucuguggccggaauuaugucaguauauccaauuuuggcuuuagacucuaggaaggcauuuucuucuaaaaaccauuuuauuuacuuuguguguguguguguguguguguguguguguaagggcuuuagcagccugguggcaaacaucuguaucugcuaggccaucuugcugguucucagaaaccacggucaacagguuagguaagggcauguacauagaucacccuaacgcagagacaaaugcacaaggagauuuuuacugguaugguaguuaggaggccaacaguaguuauggcuuaauaaaaggacccaguuaaguuuugguuuuaagagguagggaguuggggcaauaauagcaaacauagggcacagccacagugugggaaauuggcaucuuauaaauucuuuggucccagggaucauggagaauaaacauguauuuccuucaucucuuuguguuugaccuucuuaggcuucuguuugcucccaucaugugauagugcagaguuaugucugucagugauuaucucacuguuuauugucauccugagaaaugaucaguugugacuuuuaauaaaggauaucauauuagucacacucacuucuuuucugcuugaaaaaugauaaaagauaugcauuuaccuaaauuuaacucagguuaauccaaguauaacugaaguccgaguuuuaaaaaaauucuuacaaaacuauuggaauucuuuuuuuccuaguacauuauggauuuucuaacauguuuggauuuucuuguaugcuaagauuuaagcaaaauuauuuacuguuuaguuuguaggggggaaaaaagaaugaaaauauuccacaguucuuacguuucauaauauauauuucuacauaucuauucaauuaaaugccuucuauuucgcuaacauauugugaaguuggguuuuauguaccauacuaagaaaguaagugaaaaggguguuuagugaggcagaaaacuccaugggcucuccucgguugucguuacuuugggauacgcuguguuuacauacgcccaugcucacucucaccgugcauacaagccaaggcgggaaaggucaguggagagagaugucagguaaugcuuauucuuagucuuuagaaugcaacagcaauggacgcaaacuaaaacaaaggguacugagaaugaaaauagggaaccauguggagauguggacugcauccgaccauuaagauguaacuagcuuauaguuagaaagaaguuaaaaaucauuuguuuagacaaucaagaaaaagacucauaaagacaaaagcagacacccgaucuuuugacaucuuccuugugugugcaugaacagucauguuugggcacauucucuguguugcaagaacuuuuuaacaccuuuuugaguuaauaaagucauaugaauguuauagcaaguauuuugaaaaucagaauguaaguauuuuuuaaaacauacauaaaugagguauaggguagguuagauuaugagcaauggauuucuuaaaucuuguucugaaauugaaaacugugaccuaguucuguguuguaaggaguaaauuuauuuucuuuuacuuuaagauauaauuaugauuuuaaaaagugcugaaaaguagcguagcuucgauuggaucagacauucggccuguaauuaugccuuuaaccaaaaacuaaucuaguggucuuaaguggguuccuuauuuugugugucacaaugccuucaauaacuaggucuugcuacagacaucacuagcugcccgcgccaucuggaauaacucagauaaaaagugagaggaauuuauguauauaauaugugaaaagucuaagaagaguuuugaaaauaagcuguaccacucauaaaaacugaacuauucuuaguuucuuugacuuuucuaaugugaagucuccaaucucguuguuguuauuaauugguagacuacuauauuuuggagaugcuaaaacaaaauuaugaaguuggaaaaucaaauguaaauguuaucuuuauuuccuuugauggugauguuuuuauuguguugucuguggcagauaccuguaaauaccucauaugacaaagugaagcguugucuuuucaguggugugaauucuaccacaggacaccuuuuaucuuguugucagugccuuucgugcagcguuuccucuugacuccucucccucagcagacguuaccuccucacgcgcagagcuucccaaaggggguggcucuguaagcucucuccuccccaugaugcaugcugauagguaggccuacuuuuuauuuugaggcagagucucacuaaguuguccuugcugaccuugaacccacucuguugucaggcaggcucugacuugggauccuuccugcucagcuggauggcaggcccgcacaguucuuaaaggauauacugguucagggucuuacuauagaguagaaacuguccugagauucacuauguaagccagauuggucucaagcuugugaccuguucuuucaucucagccucuaggcugcucaugugguacuguuuuuagguuuuuugaggaucugccaaaaaaauuuccauagugguuacuucaguaccaggauucuguuuuguccacauccucgccaacacuugcuaucuguuguuuuuuuauuauagccauuacaagagaugauauauuauaagaggugcuacuuguaggcuugauuugcauuuuuuauaauguugaauguguuuuccuacguagauacaguuauuccuuugucuauagaacauuuuccccauauaaaaauuggugguuuuuuuuuuuuuuuuuuuuuuuuuuuugguuuuucaagacaggguuucucuguguagcccuggcuauccuggaauucacuauguagaccaggcugggcucgaacucagaaaucugccugcuucugaagugcuuggacuaaaggugugugccaccgcugcccagcugcauuuucuauaaaauguuaagucuuuuguucauuuuaccacacaccuccaaccuccaaccccaccuucuuuaaguugguugcuuuuguauauuguuuggacuggucuuguacucacaucauuuuuagacuucagccuccaugaagcuagcacguguaugcaaucguccgauauccuuuccccauucuuuacuuuuuuucucuuagugaaaugaacuguuuuucacuaaauuguauauuaacuccuuauccggcuuguuuucugguuugcaaauauuuucugccuuucugucuauaagauucucuuaacucuauuauuugacauggaccaguuuuuuaguuugagagaaucucuuugcuuuguagggaguauuuugaaacaaaagaagguacugcuuauuguuacggaauuccuuucuuuauguuucauucucuuaauuuuuggcuucauauuuaaaucuuuaauauggcuuggguuaauuuuauauauggugugaaaauaugggcucaagcccauuguucuucaaguagauccaauuuuucagcacuguccauugaagaaacuagucuuuccucacagcguguuccuagccccaucgucagaacuaauugacuguaaauguaagaucuuuguauguggucuauuaugauccagugguggcuaaauacaggugcaauauaaagcaauuaaugaaauagcucauauguugggggaaaauauuuagacaacauuuaagagaucugucauuacagagagagagagagagagacagacagacagagucacagagacagagacagagagagacccuugaaaggcuucacccagcaacuaaugggaacagaugcagaaacccacagccaaacacuagucagagcucucagaaucuuguguaagagggagaggaaggauuguaggagacaugugugucaaggacaccacaagaaaguccacagaaucuccuacaagggcucauagggguucacagagaaguccauguaggucugaccuaggcacuuugcauauguuauaguuguguagcuugaugaguuugugugacuccuaaccaugggaacggggcauuguauaacucuugggccuguuuuugggacccauuuccuucugcuagguuuccuuguccaccuuuaauguaaggggugugccuagucuuagugcagcuugauauacuguguuuggucgauaucccugggagaccugccccuuccaaaagggaaagggggcaguaaaucuugaggaaaaggagguggggguguggggauuuagaggaaagagggaaaacuguggucuggauguaauauaugagagaagaauaaauuaaacaugcauacauacaacaacaagauaaaacaaagguguccuaaccaauggaagaaauauguuuaggugacugauagugguggaaagaggaaaagccagaaacuauaugaagggcgguucaaccuaauaaccaagaggcugccuuuuagaacuugaacuggcuggccugaggauguagagcagugguagaagcuuaccugagcauguaugcaggacccuggguuucaugucagcuuuccagccuacccuauaaaaaaguccuacacuugagacacuguguauauaacgcuaaguguuaguugauguggugacaugugacagaugaccaggcauuccuaugagagaaauuguuaaagacgugcuaugugaccuggaccuauccuuuggacaaacucuuucauaguucugucacuuuguacugaguagcauuguuugccauagcaaaaaaguugcccauuacuuugagaauggaguaaaagauucuaggcguuguuugauauuauagaagaaauugagggauuaaaauaacccaugcuguuuucacugauaacucugagucuuagacaacacauugaaaguaaguacuuaaaaaucuuauaacauuagaaaaugugaagcuaauggagucaucuauguauguguaggagacauguaacaaaagaauuuucauuuuuauuuguuugaaaacaucauauucuguacauuaagacuggccuagaacucauuauguagcguaggcuguccuuaaaaucccagcuguccuuccuaacccuugcaaauacugagauuguaagcaugaauagcauucuucacaacaggaaggccacuuuaaacauaaaaucgaauuuaauauauuuuagacuacucacagugaaggauagagugacagcguaucaagauaauacagagcugcaaaaauagaguauucuguuuguucuccuaaguuccuagcugcuucugucguuauugucauccacacgaguauuugaaguauuuaauaagcauaugauugugaugguguuccaagaucauaucuuaaucagucaacuaauauuucaguauauugaugucaagaaacugcuucuguguuucacccccuccugcgccuuucuuuuauucgacaauuucauugugugugcuagaauacauuuccauuagaaaacugcagcauuauuauuauguacagcuugguaccuuggacaggaaaaaguuggaguuuuugaaaagaguuugcaucaggagcaucuuguugcuauucagaugcuccuugucacaggcaagcaugucaguaaacacaccuccugugcacacaugaaaagcuuugucuuccuuuuccaucaacaggcaagugaaagaccagaauaagaagguagcaaaucugaaacacaaggaacagguggagaagaagaagagugcccagaugcuggaggaggcccgcagaagggaggacagucucagcgacagcucucagcaacugcaggucagagcccagggcugaaggagugcacgccaagagcugguccuccauuaucugcuguuugcucugccucuguauccuccucuuucucucucuaacccugcuugcugccuuccccuuagacucccugguaagcaaaaaaggaauggcuuuuacauagaaaaggcaaguuuuauucuacagcuaugugaggauacuucagcauaggagucaucuugcuucaaguugaucacacuuaauugguaaguucaaugucagacaaugaguguguuacaguaaagcuucaggauuguuugcacaacugucuggcagaucuauucauuaaagugcguuggcaguuuugguuugugugggucugucucccucgacccccgacuuuguuuuuuccuccuauuuuuuuuuuaaaguuuaaaaauuauuauuuuauaacaguaaauuauuauuauuauuauuauuauuauuauuucacauguauagguccuuugccugcauguauauguacuacuuuuauaugccuggugcccucagagggugucaaaccuccugauacuggaguuacauauagcugugagcuaccauguuggugcugagaauugaacauagguccuuuggaagagcagccagugcucuuaaucacagaaccaucacuccaguccccucuuucuguuuuuugguuuuuuguuuuuuucucgagacaggguuucucuguauagcccuggcuguccuggaacucacucuguagaccaggcuggccuccaacucagaaaucuaccugccucugccucccaagugcuaggauuaaaggugugcgccaccacgcccggccucuuucuguuuuuuaaaggugugcacccccuuuuuaauuuaucuuuugauguucugcauauggguguuuugccugcauguaugaguguggcggucagagagagcaugacauugcacacagcuugaguuacagaugguugugagcugccaugggggugcugacagucaaccccaucuccucugggagagcacaagagcguaauuauucacaccuuaauuaaacuuggucuuaucauaauaguagcagcuauagugugauaagugccaauuagauucuuaguauuuaacuuaggccuaaagcaguuggggaguugaaugcagaggcacuaaaguacuacaaugccccagcucccugacugacucagcagugauuguaaugugucaucgccuauuuucuguagcauggccuguuucucaugggcauaauacuuuagaaagaaggcuuggaucuuagagaaugcucagcauuugcuauguccccuugaaggcagcuaagcugcugccaccuugcuguucugaccucucagcuuuccuuagguacggugcagugugugcuguacaguugguaaucacagaguuuucacuguagagauguggaggaggaaauauaggcuuuacagugagugacuuuauucuagacauaaguuguucaguggguauccuuuuuuucuugcucuucauucauucuucauuuacugcuuacaguucuuagaaaauuuuuucacucaguuauaccagcuuuugaaaauguaccuuaucaauuucucucacuucauaguggcaguuuuuuccuuuucuuuuacuucucccuuuucaaaaugugaauaugauggauggaaaauacucauuugggggaauuucuuuuacucuuacuaccaauaaucccgaguaaaauaaauccagaauacaguuuuaauuagaauauuuguugcuguauuuccucuucgguuguacuuaacugugggaggggcauuugcugggcgggggcuguaagauggggaacaugagcugagcacuggcaugcaucuauugcugcuucugugauuguggauggaguuugaccgucugcuuccacuuucugcugccuugacuucuuugccccucucugaaccuugacuacauuguagcucaaacuaugagccaagaugaauucuuucuccuucaugcugcuucuguuagauauuuuauuacagcaguagggaaggaagcaaaggcagcaaugcaugaaagcaaacagggcacucugugguuggacaccaagucuaggaagugccccuagaaaagucagcccuacauuaaagcagaacagcaacguaaauguaaagaguggagggaauggguuuaguaaggguuguucucagggugaaagccgcccguccaaccuguaguagguaagguagagugugcaggagagggucagaucacuaaggacuuuagugaccacaguggguuuacagugaaaggaugacagauccaguuugcauuuugacagcauuagaguaaaacaaaugaguguaaucaauguguacaguaucgagugcaucuauggcugcuucuguggugguggauggaguuugaccgucugcguagaagacagagcagauugcuccuuucaggagcucauucuagugccuguggcguaagagugggaaugacagugaguacaaacaauguacauggaaggaaugggcacgcagauggguuaguccuaggaucuuggccuagauauuugaauauauaaugguaauaaauaagaugacagagccugauaaugauaguuauuugagauagccugggaaaaagaacaaguccauuuucaacaguuauaguguuugugagauagcccagugaagacagcaaaagaguuagaugugggaggauaguagagaaaucuggaagugaauuuugaaaaugaucuuaaaaaucaaauguauuacaggcaggccguggucuggcuaauucaucaguggcaucuccugacagaaaguccaaggguuucacuucuugaaguuagauaucucagcucaucucaguagaauccuaaagaaguaggaucuaauauuaacaugggaauauuucagcaaugggauagaugaacuugccagugagaggaaggcaaguaagaaaaagccagcacuuucuucuuuaugaugguguaacccaggcuuagggucaggcuucccagcucaaacgauucaaucaagaaauccuccaggcauauccagccguuuggauuguaggauuccagcccuagucaaguugacaaccacgauuagauaccuuaacuuugauaggaucuuggguaagugaguggcauucagcagcggugauggaagagcaggcugucgggacacuuuacagucuuuacuuaccugagauccucccugacuggauuugguaugaucaacugcuuggaagccuggacccaugguuguuugagucugcaugcaaaugcagacuaagccugaaaaacuuaagaaggacucucccuccuaacaagagaucaaguuuuaggauaguauaaugguuauacagugcagggagauuucugguuauuugugguucaaagcuuuaauacuccuuaagugauuccuuugaccuuuccucaaauuuauaaucuguaaaucuccaucauacuucucagguaggggucagccuuccuagugcucaggaugaguuucuguuuguaaagagggcugucuguuaggcagccaugauaggaaacucaccuuauaacucaccacauuuagucuuuaauguaaagaguggaaaacauagaaaacaguaaaaccuaaaggcacgggaagggcaccagccuguccuguccuuccuuuccuugccucccugagucauuauagggaaaagugaaaacaaaagucaggguaccuaggucuugggaggacagaaauaaaagcaggccacaguucuggaauagaggagucuugagaaggagaagaauacucuauuucacuuguagaaaaacauguagauaucaugcagaaagagcaggcguuaagacagaacauccuacaucucaagccuccuucccaagccaagcacuugcucuuugccuccagcucuuguaggugcccgcugacaggagcuugccucgcaccuggaaaucuauuccuuugguuucccuugguaccugugcuuuccaaacacucagcucuaggcugaagcaaauuauaucugagcuuuuggagucuagccauuuaaaagugucagcuaccauugauaccugguaguguugggaguacauguugggaaaacccugaagugcccucuagaaaucuguaaauaaaucauguaaaacgaugugucaaaauuaaaacaaaacaaaacaaacaaacaaacaaaacagcauggaggccugguguuuucucuuaauuucauauaaaauagaggcucacuagcacugggaaguuuuauagcuaucacuguuuggguuuaugaaaugugguuacauuaaccaagaugccggugaauucauguggccuuugccauguucaugauaucaauaaccaagaugguaccaugucaugugacugucuacauuuuaauaacaucauuagccaagaugguagcuacaucacaugguuccauccaucuugaugggguuguuagccaagaugacaaccaaccacaugguuacuuuuuuguuaugguaaacucuacuacauaauaaaauuagcccaacccucaucagggaacaagucccuaugggauucauuaucuuauagauuaaauaugcauagccauuaugggauuuauucauuucauagauuaaauaaggauagucaccccuuuuaccuuaaagucaccugaguuagguuaccauguagguccaaaauaacaaggcaacaaaauaggaaauuauuccuugguuucaaaauaagaacgaugaguccauuacccuaucacgcaaauccuagcaguggaugccaagcaaugucaucugaaaccuguuugacuucugcucaguuccugugcucaaguugugccacaaaaggaauccaugggccauuuugucccacuugaucaugguguggguugaggucagcagggucugugacucucaguagcuagaauuuuaaaccauaagaaaccaacuuguucuuaauuuaaaauguuaauagcuaucuguggcauuuugacccaguuagaagaggagcugcuugggagagaagacagggcauuuaaccuaaguuuugugacauuuaugucugucugucugucugucugucugucuguccgucugucugucuguauucauuacuuacuaacuuauuuagcauugaucaacccaucuucacuuaggauagagaggagaauauugaacagaguuagaaagcugcuugcugaccagaagaauuugguuugcuucugucugagagaaucccuugucuuuuguuguuguuguuguuguuguuguuguuguuguuguuugaggcucucuguaccucucucuccuuacugccucaugaagcccugcuucccauuccucuuucuagaugauuucacauccuggccucacugccuuucaugcauuacaaguuucagcauccagaaugacuugccugacuagaggaugcugucccucauagcauuucuuacccuuggccuguucgcacaugggccugguuacaguggucuuuacacauuuggacccuuugcuguauuguggagaaaccuuccauacugggguaauugcugauagaaaaaaauguauuucaccagaaacccuggaagccacugcaguuggaaagggccaugucucuccuuagggagggaaucugaacacauuccaguuggguuugaacucccagaaaagcccccaauucuuagcaguaaucuuggugucccauaaaagaauacacaaagcaaguguauuuuagcaaggauauauuuuuugcaaaagguguguccaagaauccaaacugggcugacaacacagacuacuucauguccuuucuuccugauguaggugguuacugugucucaacgcacugcuggcuuccugacuucagucugacaugauuagcuauccacccaaagaggaaagacaagguucaggaauagccuugcuggguuagcuaccuuacauuaaagcaaaacaaggaaacuguuucucuuccauucugauucuaugacaucaacuuuuuacauuccauaugcucaguuuagcgucauguacuuagcucauuucaguuaacuugauguccucugggguuaucgucauaauggaaaacaaaacuaacucucucucucucccucccucccucucccucccucucccucccuccuuccccccgacccccgcucccuguuugguaguauuccugguguguauauacagcacauuaaaaaaaaaacuauugaacuuaaagaugauuuuauuauuaauguuuuaaaaaucucccuaucagguaagccauaaauuuuggcaauugccuggaccagggagauagagaagaagaagauagaaagauagaaagucauacaaucugaguacggauggcauggagaaccuuuuucuuuuuaaaauuauuguuguuuuuguacaugucuguaugauaaggggaaauaccgugauaugccaugugcuuguauggaaggcagaggacaacuuuguagagacagcuuguucauucuucaugcaaguucuagggaauugaacucaaagcaucuagcuuugcugguugagucaucucacuggcuggaagauagacuauuuccucauccauucaucuauugauagacacuuaggcugauucugguccugacuguuguuuagccaugagccgucauguggugcugucguaagacuggucagguagauguuccugcagcccaccaauauccuuucauuucaauguccaggaguggaacugcugacucaugcaguaguugaguguuaguauuuugaggaagcuccauccugucugccauagugaaugagaaagagucccugccugcauccucaugaguacucacuuccugucuuuuauagugauccaaaaggacugaaauauaucuuugugguuucuaauuacauuucaucaaugacuuguaacauugaagaguuuguuuucaaaauuaugugucauuuuuauguguucuuuuaagguaucuaugcaucuccuguccuuuuuaugaacgaguuggaucuuuuucuugcuguuuaguucucauuuucgaguauuaacccuugucagauauauaguugggaaaauuuacucucuucuguaaguguugcuuuguuauuuugauuauuugcuguaaagccaagaauguuauuaucugagguaaucacaguuguuugauuuuguuucuguugccaucacuuuuugguuuuauuuuuaaaagcagaacccaaaccccacuauccccaacccacugucaugaaacacccccugcccccaguuucuuaguuuuguuuucuucuucuuucuuccucucucgucuuuuuugagacugugucucacacuguaguucaagauggccuugaucucauggacaaccuccugccucagccuuacgagugcuguuguguagguaggaguuaccaugccugguuuuagcuucaguucuuuaguucauuugaguuaacagauacuaagagauaagggcuugcuuuuauucuucuuuguaucaacauauaggcaaccuuguuacucauuuucauauuugaauacaaaacucaaguaucaaauauaguacuguguuccaaauccuuugguuugcauucccccauccccuuaauaaaucaaaaagaaaaugcuuagaauagucugagaaauccaugguuccauucuuggcuuuuucuuuuaucuuuccuacugcuauacuguccuugagauccuuaagacuaauaagaguuuugcuacauagaugaaaaguaacauuacaaacuccuacuagaguguauuacuugcuuaacuaaauugcucauucauauucaaaccagugguauucauagguauauguauacauauguguguguuucuaguuuuuucaggagaaggcaaagucucacuuuauucaaauguuaguaagcauguuccuuuuugaaaagaaauguuucagaaauugucuuuaugaagcucgagucugucaucuaguugugacuuucaaagggagauagucuugugguauugacucuaaguacagacuccaucagagcuggcuuucagcccaguuuaagugguagguuuuaaaaauagcuuuguauuuuuaaauaguuaaccucuuauugcuuaugccaucuaacaccagcacuuccuucucucuguugcagagagcaaacccaucaugucugccucgcuucacuaacuuuauccuaugcucuuaauaacagacuucagcuuccuuuauuucucuucuucccuuguuuaauucuuuacucuauggaggaaucuuucuggccucaguuugcuucugaauagaaggauguuuaaugauagcucuuccuugauggguaggcacuccuugagguaacugaguaaccuacuucaccgggucuucaucguuuuccaggacagucuccguaagaaggaugacaggauugaagagcuggaagaagcacugagagaaaguguacagauaacugcagagcgugaaauggugcuggcacaagaggaaucagccaggaccaaugcugagaaacaggucugcgauuuuauguagcuacuagcaaugcugcuggguaaacacaagguaaagccagugcaguuucaggugacuguuagaacugcuucagaacugcugcugcagaacuacuucaucaagugguaaugguuagacuuucagagugacuaaaauauaacugugcaaggaucggcucaugguaacgugaggucucugcaguaaucauuuaggaaugcuucauauauauucauguaguaaaagcuagugaagugugacugacaaaacaugcaacauguauguucuuuacaugacugcaaaaccccagcuuggaugugaaugagaacauaaacaugucucaauuagaaaauacuuuauuuuauaucauuuuucaaggagccuuugcaguuguagaggugauagcagcucugaucagcauguguauaggugcgguggcacuccacugccacacggcccuugagagguucugcuauugcuggccauggccuuuguuucacuugcuuccacuucucucccaggucucuguaugcuugcuuuugacucuauuagaugaagaauaagugaagaugggagcuguaaauugaaggaacaguuuuaguaaaugaacgccguaaucuugguuuacagcuugaaaauuugacuugagguuuuaaauccaccuaccacagauaccauaauacuuaauuuuuguagcacccuauuccuuguagcccuuguuuaugugagagaaugauaaauacuaucuaggugucuuagguuucaauuucuaugauaaaacacaauaacuaaaaguagcuuggguaagaaaggguuuauuuccguuugcaucccaguccaucagugagggacugcaggucaggaacucagaugggguagggaucuggaggcaggaggccccuccaugcaggggccuggaggagugcugcuuacuagcuuccauucagcuggcuugcucagccugcuuuguuauauauagcaccccagguucaaaugcccagguggcuggggccuucaauaucaaauaaggaaaugcaaauuggacugauuuucuguugaggguuacucuucucaggugacuuagcacaugucaaauggccacacaccuaguccaagacacuagguaaguucaguggcauagauguaggaaucccaugggcuagccucccuccugagaagcugcuguuacugggaacuaaggaaaucaaacuguaaaagaagugcccacuucagggcauauauacuauaguagguaccucauagaguccauuuauagcugugguagcucagucauagucuuuagugcuguugugucccugagugucugacaguauuuauaagauuggcuauaucaaugccuggagcauauaaguuuauaauuguccuaacuuuuugacugaucacuuuauucauaauuaauggcauugucucuuuauuaauuuugacuugaugccaucucuuagaagcgucugacuuaguuaggguuacugucuagugagccccagcauucagaucgucugacuccucccagcuuuguuuugcaccccaguucuuguggugaagcucagaucccuaggcuagcacugcaggugcucugagcaucccagccccgcccucuucucuuugacuuuguguuaaugccuuccaccugcaacuuuuguccagcuagccugacgugcauguuaguaagaucauauuccaccucuaugaacuaaacuuuauuuacucccuagauaugugauucauuacuugaaauaugauuuacaaaauguacagcuuaaucuuaaaacaagguacugacaguuaccgguuaucuuuugucugccaacucccgagauaagugcuuuguucacccuauuguuuaaucaucuaaacagcacaucugggcagaaaaacgagccuuuguacucacugguccucucguagaacaguacagaauaguuucauuucuuagaguacuagaucucucuacuugaagcagcaucccuauuuguaacaguaggauguagccuacuucucuagaacuucugugaccuuucaggucugaggcaugugucuuuauagagcuuuugaauauuuccuuucacuuaccucuguuuuguaaccuguuauucuuagcuauuuauguaauguauaauagguauauuacuugaaaauacacccacuaauuucucuaguagaauaugaacucccugggcgcaggagguaugucuguguacuguuauggcuuuggcagugacaaccuccugggaaaacaguggcauuaagugagcaucuaagugacauaauucuauuucauuagugagggaaugaguggaguuucagccugaccucugacugcaugccugaggacugcagucacucuaguaacuaaacauccuggaggauaguaauauuucuaugauuuugcaauaguuaucaaagcaguauuuuagaauauuguauucucugauucagcuaguuuuuuaugcugcauuuacuaaagcucuucaucugaacagaauaucauaauuucaguuauauacuuaaauucuuagaauagcuauuuucaaguaguuuacauuccuuaguucuugauuuuuaaaagauuauagcuggaaagcacaaauaaaaccuacaaaucaauauuaucuuuacucuaagaguaggaaaguauaugucucaacauccuagcccccuguugcuugcuauuuuagcuaaggaaagcuagcaugcaagacucagguaacagcugguucucaguggaaauaggaagugguuuguaaaacacaaguauguaugaauucagaacuuucagagcauuauaaugucauguaauauaguguucauuaaaugaaaaucuuuugguaaauugauuuuauuuccuuuuggauaauacuucuguccuuuguaaauaaguuugacauuaggaguuucaauauuugucucaucuuuuccugccuuagaaauagguuuuuaauguuuuaaagacuaguuuuuuuauugugugcuuaauaggcuacauucaaguuuuuaaaaauucuuuacauuuauuaauuuuguauggggaagaauacauaugaaagcauacacgugaagggccuaggaccuuucuucauucuuggguuaucauacauuaaauuccauccuugcaugcauuuuuuuucuuuaagcaagguucugaauaaaagugaaaugacucauuugaaacuaucuugcauuuuguuuaaaaucauucuuaguuuucuuucuccucuuuucucuucucuccuuuucuuuucuuuucucuucuuuuuuuuuuuuuuuuuuucuuuucucuucuuucuugagacaggguuucucuguguaguccuggcuguccuggaacucacucuguagaccaggcuggccuugaacucagaaauccgccuuccucuuccucccaaaugcugggauuaaaggugugcuucaccacuccccagccuuuguuaucuuguaaauaauuucaaaauaauuauuuacaucuuuauauuaaaugaaaguguaucucagaguuucagugaaauuauugauuauuacuaccaaccaucuguaauguuaacaaguaaagagaacagcaugauuuuaaaaauaauuaucauauuaguaauauuaaaggauaugacuuucugaaaggaauauggaggaaauugucaaaugaaaucagaaagugcuguaaaaaauacagaaauugaguauguguuagguagugagacugagcaugauguagacuuuaaacaucuuuaagccaauggcauaaucuuucaguguguuggauuuucuucacugaauguauuauaggaggauucauuagauugcuucacauuuaucuucuauuauugcauuuaaaauuuaucuugaaauaaaguauaaaccuuagaguagucaagagugagucauuguaucucccucugucacuuugccagugggggucaguagauagcuacagcaggccugauacugcagcaggccugauagcaaccacaucaggaccaacacucaaaaucccauugcuuucuaauaguaauuuuuuaagguaugcacuuagacuuguuuuuaguuauuaugcuugcuuuuaaacaugcuuuuaaaaguucaaaauguuuuuaaauaguccuugacauucugaaauuauuuaugacuccaaauuuaggcuugcauuuuaauuuuucauugauauuuucuaaaguugugauccaaugaaaaauuaauccaaaguggacccaaaagaaaagauuggcacuccccagaauugugccuuagagaugagugucagagccugugcauacuguuaucaugguaggcauguuuuauacuuuugucuuuucugugugaaaucuacuauacuagagagcauuuggggaauacagcauuggacguauaaucuguuuauagugaguucuugagcacuuuggguuuuauucugcuaucucccacagagaagucuaauaaacccuguuacugaucauggcaguaguuaucaagguacaaugaucgggccugagaaucaggggcagcuucuuacugguuucugugugcaauugauauuguuguuagguacaucguacugaauguuugcaaugcaauguauuuuccuagagaaaugugacuccaccguauaauuugucuuacccaguagauaguucuuguauggguuacauccuaaauuuuaguuugauaauuauuucuuuuuccuuauaagcuauuaaaaauacacuggggguuaguguaaauuguauuggaucacaaaucaaauggaaugaauuuuauuccuuauucuguuuucuaguugugacuuaguaaguucccuaacuucucucagaggaaagaaagccacucaugucucacacugaaauaaccuauaaagacucccuucgaacacugagccuuauuauggcuucuguguguguguuuuugggaggacaguagugucugcauguaagccucuguguguguaggcuuguacauaugcacuugauacuuagaaauucccuuucugcauucuuggguugucagacauuaaguuccauguuuugucuuucaggcaaaguaaacuucuaguaaagugaaaugacuaauuuauuuuuccacauucguuuaucugaguucaauucccagauuccauguguuauuaggaaagaaccaacuccaaagauccuacgaguaguccccugacuccuauauaugccauacugugccccucaccaaaagaagagggguauauuaauuaaaaaauaauaguugcugcuucuuuguuagugcuauuugagaaagaaauuguggccuaguauuuacauuauuucuaacauuuuuuuucuuccaaaaguacagaaaauuaaaucuuuuuaauuuuucuugagcguugugaaccuguuuguugcugaagcaaccagacuauagaagguacuuagucauacaaacauaagcaaagaaaaagccaguccgcugaaacauuaauuugcaggguauuacuucagauuacuuucauuuucguuuggaagcuauauugccaaauuuuacucuaauuguccacaauuaaacauuucucuucuuauggcuucucuccaaccuuggcaacagaaguccuggcagcagggugauagcugcugggaacacaugugcccagguauuauugguggcguuugccuuuucaggcuucacuugggaguguugaaugaugauuacagaguguaucuaccuacgccucugacuugauugaaaaauuuuagaaacaggaaaacugagauuucuugaaagaagcauuucauucacacggacguuuucuaucucuucuaaaguuuguccaguuacggaagauuaguuagauuagaaccaugaagaccccagagugaagguguagccaacaaguguuccauccugccaccugccagccugucucagcugcacucauacuucuaguucccuugcuguuacacaagugauguacuuuagagauggcaaaagcauuuuauaaauucuucacccaguugagcauauucacuuuuuaagucauuuacuaaauucucuuuugucaggauauaugacaguauugauuuaaugggggaacugcacaauguauaaaaagucaaaaagucugccaagacucaaaguuauauuauaaaaagguguuuucuuuaggucucuugucugugacucuuggguucuucauagauaugucugauagucuggagccuaacaaagcugagcuaguaucagguaccauuagcauaugucaaaacucaauuggaauuuccucaauagaaauuucagugaacagaauagaaaacauauagaugucccuaaguuacacacauguaccuuuagacagagaguacagauaugaaaaauuaaucucuuuaauggcucugauuuauuuugauuuccugauccacugggacuagugacuaucuucagauaaacuagugaaguuugucucagaaaaacuucccuggaaauaagcccucuguugugagcucugccuauuagguaucaucccauuggguugugcuuucuugacuuaaucuucccauaccuuucaucucuccuguguuugccuucuaagucauugaacuucacaacuguaucagcauguuuccuguuccuguugaccuucaugccuuauauuuuuguaagaagccugacuugugaaggcccaugcauucaucugcagcauugaaggcuuucauugaagcccugguaagaauaucuauguccuaaccauccguaacuguuuucucaguuucuggaccacuggcuuuugcuccuagugugucuuuucuuuccagcucaagcauccuaaaccuugcuuugaucuaguuugaucuagucugucuccaccuucacccacucucaucauuguuccuugccuugcguuccucauacaccacgcucucacuuccauuugauuguaguucagucucuuuuuauuucaucuuagcccauuugucuugcucucccuucugucucuauucucuuccacuuucuugcccaucauucugauaauugucuuaaguuucuaaauccuuguuccucuguuagaucccuuuguuaccucccuuucccccauuaacauuucaaauggcagaggggucucuuaauacagcccaagauccuucuuugucuauucuuucuucucugucacgcuagcaucuuuacuuccuuguucuggaguuucugauauucugauaauuuaauucuuugggguauguuuucccguguuacugcuguuguacacagggacaacuauaaugcuuuuuucuuccccaucuuagggccugggacaacaccaggaccuugugcuauauauuuucaugacaucuuguacucuuuugcauaguauauucuuggcuuacaguuaaguuuuguaauuggugacuguagcacacaguauagagauagucuuugaugcacagcaugguaucuuucagugguaggagucaaguauuuuuuuuggcaggagaauaauggaagaaagauaccuuguuggauguggggauaugccuaggaauaagucaacagguauaauuaauuguagaagccuguuggagagcauuucuugggagugccaaugcacuuuaguagagcaagcuaacuggggggaagaccaagucagguggcagucaacucugcuuccucuggcaaagaacuuuagccacuaacccuuuuucuuccauagaaauuauaaugauagcaguaauaccuauuucauacaauuccugugaagcuauaguagcuaauacauaugaaagauuuggaacaaggccuuucagagcaguuaaacaaaguaauauuuuccuauuagucaaagaagcaccucgcauuagcaagaaguaauauugggaaaauaauuuguaguguaaauaauaucauaaagcucuguuaguuaaauccccauuaguaacaacuauaagaaaccuaaaguaguagugagggagggaggagagagacagagacagagaagggaggggagagagagagaguuuuuaucuccucucucucucucucucucucucucucucagucucucugugugugugccugugccuuuauuuuugucuguuuuuuuuucuaaauauuucagauguuuaucagccuuuaacuguguacuuuucuugucuccagcuccuccuaaauuauacaacauguugaaucucucuuuuuuuaaagacagggucuuaaacucauggagauucuccugcuucagucucugaguguugggacuaaagguuuacaccgccaugucuggcugcagguuacuuuagaaucuuguugacauugagaaagcuaauaggcuuuucaugggacugcuuuucacugcgccucugcaggccuuaggccaucuugagggcugccuuuugcuucaguuuuguuuuuaccacuccucuucucuucuagucauuuucuucuuuuucaagcagauuuauucuuccaaggagguccuaccaugauucugcauaaacaauaugaaaacuacaaagucuccuuugcuuuuagcuauggagcagaggaugaugggaaacgaugcugacuggaagguuccccauugcuuugcuuucuuaaggaaaauagucugugguugagucauacuuugcucccuuuuuguuuuguauaaaaguuuauuagcuugugauuuaaacaaaccaucugguccuguuggcaucacacacugucagaccugagcuuucgcccuaauuuuacuguagacaguuagguuauaugcuugaauuccaguucuggcagggauuuuugaauguuuaucuuaaaacuucugcuuuuuaaaaauggcucuguuacccaaagcacauuuaaaaugauggagaauuucuuaauuguuuaguguaagauuuaucucucuguuuccucaguugucauacuugcauuucucagggacagugacuccaaauuuuccaacagccauugaugagugauugguccuggauagcagauucacuaacugaauguguucuuuuggguugcagaaaggaaacagaaaacaggauaauucaaauugacuuucaggguuuuuuuuuuuuuccugacuuguagcagacagcaaaucaagugauuagcuggaaauccugguuucuggguaccauucuugcuuuguguauaacauucauuacagcuuauuuggaggugccggagugauggcucagcauuccugagcauuugcugcguuugcaaugauccaggugugauuaccaacccccacaugacggacggcucacaacuguccacaacuccaaaucugggcgaucugacauucgccuccucaagcaccaggcacacacaugcuacacauacaggcauguaggcaaaacagucauccacacuuuuaaaguuuuauuuaguuauuuauuuuauuuaaaaaauaaaucuaaggaaagaauaaauuuacuuggauauauguaugaucagaggcagaaauacuuuauuaaccuacacucaaaugcauaggaaauugggcauucuuuaagaacauuguacuuuacuaauacaggaaacucaagaaguuaaaguuuugaauucaaguagaacauauucaacauggugcacuagacacuaggaaaacaguugaguguuguuaaaauacauacuuuuguuaaugagaagcuaggggaaauacaggaauaagaauaggcaggguucaaaaguaauacuuggaaaacucuuaggcuugcauuuggggcuuuaauuugacaauaagaaagaaacagcccagagcagcccaaggaggacgagcaaguaggccacgacaccuaacccugcuuuuacaggagagcaaccacagcguccacagugguucuggugagcuuguuaggagggaauguacucaguagaugggauuuagaaugcuuguauuuucuaacuacuagucccucagcguuaaauuaaaacgauaggugucuuugccaguaauuugaacauuuagaguaaauuaucaaugccaaguaaaauaguacuuggcaacgcuuguuaaauaugagaaugaaaaccugaaaaaaugaaaauuaaaacuuucccacaaauuucaaguccagagauuuauauuggugucuuagaaaccuuaaugggaacauggcucauuugaggacagguuugcggucagcaguuacuuugaagacuguucauuuggcagugccaaaaguagucucagccugugucacaucagcuaacaauccauugcucaaggcagcucaaacaaccuagccaaagucaaggucuucuccaagccaggagaucauggcagcaguguggagguacuauaugugguuucuauagaacaguaguucucaacccuucacagggguaacaucagacauuuacauuacgauguauaacaguagcaaaaaaaaaaaaaacaguuaugaaguagcaauggaaauuuuaugguugggaguucccacaaaaugaggaacuauuuuaaaggguugaggcauuaggaagguugggaagcuguagaggaguggauaauuggaaccacuaauucaaucuaccagggaugccaaguaggaaauaaccugugacauuuuguaaaguaaggauuuauaaaaccgaacauagucauaaaucuuagaauauauucuugauaaauuauguuccaauacuguaucaaaagaugcugagacaaaaguaauagaugcgugcugaacugggauaagugauuugaauccuuauuuguguguagcucugugaaauuaagaaaauaacagaaacaagcaguuagggguaaauuagacuugggauuucaagaaauaaacuacauaggugguccuuaaauaauuaaaauagcuuuauccucacauauuaguauuaagauaaucauacaugggacuggaaaauggcucaggugauaaggaugcuugcuuccaagucugaugaccuggguuugauccuugggacucauguaagaacugacuuccucagguauccucgaguccauucacacaguguagcauauuuucucucagaaaauaaagacguuauuuuuuaaagaagauaauggaagaaguuccuaaaagauaauugggaaacuauauugcaacugugagucauagguaucuccuuuugacacaauagaaauuacgugaucgucucaugaugggacacuguccgaaaauaacaaaaagucaaagcccagucuuuggaaaucuuuaggcuuuaaaguuuacagggaaucugaauauggaggaacaaauuaaauuacaguguaaggaaacuaccaagugaauccagaaaguguugcagguuguacaggacgaggguaucauauugucaggacuuucauagcauggaaaauuaaaaguguagaugacuuuaccuuugucuuccgugaauugccuuagcaguaaucuuauaaaggaaaagagggcgauggaggggaacuccaaacccauugaccauaaaaguuagcucucauuucugacugugcuuccuuccuuugguugacuuguccaccauucuauccauacuaacccugcaccuguguuuacaguggaccuugaaguuaagaaggaagagucaccaauguuuccuuucuuuuccaugauaauuuugcauuuacauuucuuucaugaaaugcauagcugugcuuuucauucucuuuaaugcuguuuaaauuaaaucauuuaauuuuacuguauagcuaucccaaaagucccccauacccucccccccacuucccuacccacccauucccauuuuuuggcccuggcauuccccuguacuggggcauauaaaguuugcguguccaaugggccucucuuuccagugauggccgccuaggccaucuuuugauacaugugcaguuagagucaagagcuccgggguacugguuaguucauaauguuguugcaccuacaggguugcagaucucuuuagcuccuuggauacuuucucuagcuccuccauugggggcccugugcuccauccaauagcugacugugagcauccacuucuguguuuguuaggccccggccuagucucacaagagacagcuauauauggguccuuucagcaaaaucuugcuaauguaugcaauggugucaucguuuggaggcugauuaugggauggaucccuggauauggcagucucuagauggucuauccuuuugucucagcuccaaacuuugucucuauaacuccuuccaugggugauuguucccaauucuaagaaggggccaaguguccacacuuuggucuucguucuucuucaauuucauguguuuugcaaauuguaucuuauaucucggguauacuaaguuucugggcuaauauccacuuaucagugaguacauaucauuugaguucuuuugugauuggguuaccucacucaggaugaugcccuccagguccauccauuuggcuaggaauuucauaaauucauucuuuuuaauagcugaguaguacuccauuguguaaauguaccacauuuuuuguauccauuccucuguugaggggcaucuggguucuuuccagcuucuggcuauuauaaauaaggcugcuaugaacauaguggagcauguguccuucuuaacgguugccccacaaauuuauaaucucuuauucuuuauuacgguuuuauacauacauguauauauaauauaugaauauaucuuuauauaaauuuauuguuuacuauuuauuauuuagauauuuauauauaaauauauuuauaaauaaaaccuggaugaguucauuuagucuugcccuguguacauacuuuuuggccucauugcuugggacugaaugccuaucggagacucauccuuggagaagacugggucuccuucucucagcagccauguauugccugaaguuaaucuguuucugucagucaucuccauuacaguguuaaggagaaugaugaaagcagccacucuagucuuagagggaaagcauucaguuuuuaucauaaaagucuuugucaacugaagaaguucuagucuuagauuuuauguuguuuuuacccugaaaguguuaggaauuaucaugcugggauuuuucaacuaucuauauauaaucaucuauaauauauaauauagcauaauuaauaauauguuauacauuacaauauaauuauauaacauacuaauauagaaucaucuacugggauauuauucuggcuuguauucuacuaacaugguauauuacauucuuugauaauaguauguuaagauacuaccuugcauucuuuaaugaagaccaauuuugagaugucucagucuuuauguuugauuuuccagcuaaguucucuuuucucuauaauuuuacucuguuccaucccucuccucuucccucuuagcaucucuugguuuuaggccuuggguuuucuuuuacagcaauccuuauuuugcuugcuuuuuagcagcaaagaacauuuguccauuucucacuccaaauuuggaaucagguuccuccacuccgagcccucagugaaaaggagccugucauguuagugcaaacuacagcaacaugcuucuugguugucuccgcuucuagcucaugugcuguaaugcacaguuauuucauucuugaucuuaggauauaaacucaugguuucccuuuuggaaaaagagaaaaauaaaaagcauauggaugaaacaagccagaagauucuaauuauucacauuuaugaacuguaaaaguagacagugauuuacuuugaaauacauucaucuuuuuuaaaaauguagguagguuggcaaaauggcuuagcagguaaaagagaucacugucaagccugacaacuguucauuucccagaaccuauaugauagguuuguguguguguaugcgcgcgcaugcgugcguguaugucugugcauguacacagauaugucauaaaaggaggcagagacagguggaucuaugaauucaagaccagcuggaccuuaucuuuaaaaacaaaagaaaugggggaaaagagagaaagauagaaaggaaggaagggaggaaaaaaggaaggaagaaaagagaaaagaaaagaaggaaagaaagaaaaaauguagugggcauggugcucuauaacaccagcccaugagugguagaggcaggaagauuaggaguucaagcacagucuuaguuaaguugugauuuuuuuuuuuuucaguccaccgucaaacugucucagaaaaaggaggcaggcaggaaagaaauuguaggcagccggcgccuaaaagauggugcuggucucagguacaccaucucuguaaacaacaccauugcacaggugcuagcccaaaucuggugccaaccccucccgagcggugcaugcaaauuaaggugccggcagacugaccaaucccaggaggacacauagcccuccccagugcugggguguauauaaggaguccucccugggugcccgggguucugguagcauugaggcguaccugcaguaaagcuguugagaagaauccgaccauguuguguuuuccuuggugggugcaacaagaaauaauacagauuaagaauguggauuacuuuucagggauguaggggaugcaaugaaauaacuccacuuaagcuguuuagggauagguaugaagguuuucuacuacaugugggggauucuuaauuugucuccaauggaugccugaaacugcaaaccauacuagauauauauaguaaaauuuaguguaugaauuaggcacaguaagagaauaacaauaauaaaaucauuagaauggcauacugcauuagaaguuauguagauauggccucuuucuuagcacaucuuauuauacccuuuuauuuaaagaaagcccuugaaccuucucauugucaacaucacuuugcauguuagggccauuacgaagaaaaagaaacacuauuugagcacaagcacuauaagagcaagucaggguuccaucccugaggucgcuacugaagaaucugcaggcagacagcacacacaaauaaucgacaagcaauaauucuugauuauucuugauuaucaugauaauucaugauagaggagcagauuucaucauacuccuuagacugcuguacaauuaaaauguuagaaauuguuuauuuuuggaauuuucuauuugcuguuuuuagaugauagguaagugaaauugcaagaagcagaaccaugggugagggauaaauaucuguuuugcuguuaauucuggaaagugacauaggcacuuggauuuuuauaaagacaaaauauuuuacauugcuuguuucugaaauuugaaaguaguuguaugcagugaggcacuuguuuuuccaacucuauguaguuauuccuuaucuugccuaaaaguauauugggauuuuuuuuuuaaaacaugaacuuaauuuuuugugcugugaaguaaauuagauacauauacuuauaaaaauuuaauuuggacuauugcagcauguguuuuauaaaucuauacaugaaaauucaagaguuuauaaagacaguguucaucuaguauucuaggacuuugauguagacagaauaauacaaagggcacaaaaugugccauacagaagaaauaucauguuuauuaaguucaacucaauuugaauauuuucuuuuaaagcaucauaaaauaaguguuaguguuuucucaaagaagaauauguaauuuugaaauuuacagaaguauaauuauaugaucagcaaggauggauuucagugaaaaauccagauaauuguaugcuguauaauuccauucgcaaagucaaaacaguugagauagucaaguauggaaaaacagaaugguagaauacuuuucaucugcauagugauauagaagcaauuucugaguugcugacuauauucuguuuauuaaucuacaugcuaacaggguacauugacuuggaucacauuuuucaagguguauauuuauuauguaucuuucuguauuuugcaguucuguaaaagacuuagcaaaauguguuuagcugcaaagggguauauguagccaugucguguagagaggaagacuugaugcuuucuacaugcucgcuguguguauguaagcucuuuagggcggguaagaaaccgauccauuugaugucuagggaugcugcaacacaggaagcuagggagacuuuugaaucugucuagcuauggcagcacaugcuagugaccugucccugcucuuguguguuagaacaccugcacaugggguguggccaccagugauuuugugcuuaacauaagaaucuccaccuaacauaauuacucuguuuuagaaaaguuuugcaugaauuaaaugaauagaauuaacucuauuggcgguuuccggaaauuugagguuaauauauaucccuguaaaauuugcaaacgugcuccagggagaucuacccaguagugugaggaccccauuagggcaagggucagcuugagcucuuaggaagggggguguguguguguguguguguguguguguguguguguuaauguaggcacacagauguuuaucuuggcauuuagcaccuggugugugaggcucucacuggaagaagccuguaaauagcucugguauguuuacuguagcucugucuccaaacagcucucaguuuuagcacaaaaauugguucauguaggaaugacugaaugagucccucucucuaccuacccuccuccacuucuaaaaagaacaguuauuagcaagaugagcaguaguguaauacaaacuucagcagucagugcuccaugcuuaccugugagaucgugucuugguaauaauaugcuuucauugcuauaguuuucacuuuuuuuuuuaaauaaauuuuauuaguuuaaugaacaaagaaaaacaaaaagaaaaaagggaaaaaagaaaaaaagaaaaauggggccugauccauuagccugagugcuuccaaugacacuuuuaagcuuguggaaggugccaccguuacacaaugauuaaagauaauggugaggaaaucuuuuuuuguuuuuuuuuuuuuucuuuuuuuaacuuucuuuuuuuuuuuuccauuuuuauuagguauuuaccucauuuacauuuacauuuccaaugcuauaccaaaagucccccauauccacccacccccaauccccuacccacccacucccccuuuuuggcccuggcguuccccuguacuggggcauauaaaguuugcguguccaaugggccuuucuuuccagugauggccgacuaggccaucuuuugauacauaugcagcuagagacaagagcuccgggguacugguuaguucauaauguuguuccaccuauaggguugcagaucccuuuagcuccuuggguacuuucucuagcuccuccauugggagcccugugaucuauccauuagcugacuaugagcauccacuucuguguuugcuaggccccggccuagucucacaagagacagcuacaucuggguccuuucgauaaaaucuugcuaguauauguaauggugucagcguuuggaugcugauuaugggguggaucccuggauauggcagucucuacaugguccauccuuucaucucagcuccaaacuuuguuuuuguaacuccuuccauggguguuuuguucccaauucuaaggaggggcauaguguccacacuucagucuucauucuucuugaguuucauguguuuagcaaauuguaucuuauaucuuggguauccuagguuuggggcuaauauccacuuaucagugaguacauauugugugaguuccuuugugaauguguuaccucacucaggaugaugcccuccagguccauccauuugcauaggaauuucauaaauucauucuuuuuaauagcugaguaguauuccauuguguagauguaccacauuuucuguauccauuccucuguugaggggcaucuggguucuuuccagcuucuggcuauuauaaauaaggcugcuaugaacauaguggagcauguguccuucuuaccaguuggggcaucuucuggauauaugcccaggagagguauugcuggauccuccgguaguacuauguccaauuuuaguuuucacuuuuuaauuaaacauguuuauuuaaguaauucaaauuuggcaaauaaucagaauaagugaaaauggcuucugacauuuagacuuuccucucuuuauuuuucuucuuugucuuuagcauucuguaguuuuguucccuugcacauguguuuuguuuguuccagaucuuuuccugucaaggcuuccccuugccaggagcuuuuuaaaguauagugccucuuuuaccugaucauauaguuuuaguuuuuuguuuuuuuaaaaaacucuuuagcgguauaagcaauagaacuuaguccagauguauaagcacugcucucugucuaugcuguuucuguuacucaggcuugucuguucuuuccuaugauccccuuauaaauaauuguuauuauuuuguggcuuauauuucauuuguuguguguggggcugguguaugugugauguaggggugcacacgugcuucccgugcaggucaggagacugcuucacggacuuuguggaguuauuucuccccuuuuggcucuuugaucuuuuuuguuuguuuguuuuugauucaaaggauugaauucaggccauacuucaucauuaagcuuaugaagcaaguacuuuacuaacugagccacuuugcugugccucucccuauuaaacuuuucuuauuacaucuaucuaucuaucuaucuaucuaucuaucuaucuaucuaucuaucuaucuaucuaucugggggugugggguguguauauguguuguugcuguuguuugcuaggugcuaaacuuauagucauggguaaacucuauaccacagagguaaaucuacacccuguuuauucuugauauauauacaugaucagaaagaguuuggaacuuucaaaaugaccuugugcgccuuccaguuuaacagcucaggaguugcccauggccaagcagcacucucugcaauugaccaugguguuuuacuuuuucccuuucugugugugucugucauagguggaagagcuguugauggcuauggagaaggugaagcaggaacuggaguccaugaaagcuaagcuguccuccacccagcagucucuggccgagaaggagacgcaccuaaccaaucuccgggcagagaggaggaaacacuuagaggaaguucuggaaaugaaguaagucucgcaccucuguucguuggcuccacuuaguugagcugagugugcucuuucaucuuuggguaucauccuagcacaugaagcccaauuacaaugccaacuuguuucuccuacuuccuagaacaaauuuucucaagcguggcacaaauccugcucaaagcagaauaauuuuuuuuuaaccucuuuuguacuuaauuuuacagugugcuaccauguguaucuuuggauuacuccuugaaauguuuaaauucaucugaagaagucaggucuacuggagaagaguguauugcuucucaugucuuccuaucaccucaugucuuagacacauuaacaaaguacuuacucuaggacuacauaaagugguguagcacauaaaggaacucugcaaagccugaugaccugaauucuguccucagaacucacaugaauguagaaggagaagaccagugucacaacguugucccuuuacuuuucacacaugcacuuuagcacauaaaaauuuaagccauguacauuuccaaauguacauagcaguaauauagagugaauuuccauauacuuagccauugauuugcuaauuaauauuuugccacaccagacacuuaauuuuuuacaaaauuguuacuuucagacaagcauugcuauguucuuuuucuucuugguuccuaucaugauguuccugagauuaaaaucuguaucugcuauuacauacaaacaggucuuuugagaccuuuuguuaaaaacaaguauggucuccaugucucuugaaguuccaguaguaguaguaguacuguuucauuuacauuuaacaaccaucacccacaucuaaaaugcuuuccugcucugccaaacccaguuucuggugggcuaccuuagucccagugucauguaaaguugucuguguuugugcugucuucucuguugucugagagaugcucuuuguucucuguagcaugggugucuuaccucugucaucucacucgcugguccauccucucuaacauuccugugcuuucucuagucaugcccagccugccaucuucuuuacuucaauacacagucuuucuagcuaaaauaaucauauuuccaccaccuaguacuuuaagcuauuaaugugacuuugaacuguggauacaugcagauaaaugacuaccuguauccacagguacuaccuggauaaaugcaguugauaagggucuccgagguucuguagguucugugaacguaacacuggaugaguuuuguuuugaguuccuaaacacaguugaucccuuuucuuaucagagcuuuccuacucacuucagaugguaacuuccagaaauauagaaguuuguuugcuacuggaauuuccuuuuauuauugauauuacaugaaacaauguuuuuuuaaaaugcuggaauucaaagguaauuguguguguuuguuuuguauuaacgcaguaccaaaguucauuauaaaaauuacuugccgcccuauuccaggaaaauaaauaccaugauuagcaaaacuuauuaauaugaucuugacucacgcaugauuaacagaguauagaauauagagugugugccaacagaauagaaauuuuacaaaacuugaacuaaaacacuaacccccacuguuuagggaugacucaucucuguacuuucuuagucacucauacuguauaacugccaucaaauuuuuuuaaaaaggauuuaauuauguuuuucuucuacgaguguuugcuuacacgugcagcacaagucuaccucaagccuaugaaggucagagagggcauuuuguaacugggguuacauguggguacugagaaucaaaccuugguccccccaaagugcaaccaguacucugaaccacugaacccaaacagcccuuaugaugauuuaacucugauauuucacaagcuuugucauauacauucuaccaucuuaaaaacuuuaaguguuuucaggcuuuaaguuacuuuuaaauuuccccuccuaucucugucuucauacuguguaaguuacuugucuauuacucuccuucuaacaucugguuguuauaugcauagccacuguccagaucgacuauaggaaaaguggugguaccaggccucucuccuuaugacccuguagaucagcugguguguuccucccaaugguccaaaacaccaguuaguauuccaucugcagcauaaugugaaacaccuaagcauuuuaaauguguuuuucuuaaguuuagcacaaccauacuuugauuuagaaauccucuauuaaaaacugugcauuuaaucuaaguugaauuauauacaaaacacuauaaaugacaugcuaaggauucugauucuaguaaauuuucaguuuauuuucacuagcuaaccaaaguauacuagucaggguucucuagagggauagaacuguuaauaauguauuuauuagagaggcuugcaggcugcaguccugcuuguccaacagcgcuuauuucauagcagaaaguccaagaauucuauagcuguucaguuuccaaggcuguaugccucagcucacugcaguauacauuggaacccuaaauaauuagguucuaauaccacugaaggaugccucagcaagaggaucaaagaguugccagugaaagagugcccucauucuugaggacagccaaaagacaaaaucuuccucuuuaguguccuuuuuaggcugccacuagaaguuguggcccagauuuacagugugucuuccuacuuacugccucaaaugguuuaaaugguggaguggagaguguggugucuuccaaccuaaaaggaucuggacuuaaggugugcucagcugcuuggguuuuagugacuguagguggagucagguugaccaagauuacccgucacauagucagucuucauucuguuuuggacuccuacucuccauaugcugggucaguucuaaucauccuggcuguggugucucuuguuuguaagacuuugcucaggauguacuuugugauuauuaaugaauaugaggcugaugaugugugucugguuucagugacacagaacagcauaucccagcaguaaaagagcccagaccucaugcgcucaccggcucuguggcuucagcacguuauucagccucuucgcucaggaacauucucauuuuagaagugauggucuuucauaagaaaugaucaguggauugcuuacauagaauugagaacagcaccuuguacaguaagcaauuaauaguaaacuuuuuuuuuuuaguuuuuccuggugaugauucauaggaaaaacgagauucuuuaagccauuaaauuaaauucuuaauaauuaagcaaacaaaaaagcuuuuccauguaacuagagagcaugaagugccagagaaaugcagaggauugccaugggaaaugacaugcggaccuaaccaugcuugcauaucgcucugcacccagaaugagaagucaucuuucaccagaagacagcauggcccauuuacacauaaauucuucaguaaagcacuacaauuguccaguuuucuggaacaauccuggccucaucagaccaagaaagaugacugacuaguucuuuuccaucucuagcauguagaguuagaacuuuggagcaucuguuacagauaaguggcagccaugaguuugggcaauguaaaacggugcucuuggggcccugccagugcuucauuaggaacguuugagcugguuaaccaaccuaaggagaaggaacauuuuuuuauuuccaaaucccacaguggucuucuuucccuuuauaugcugaaguuuuuuuuaacuaugauuuuuuuuuauuacccuuauguuagacucuuuccuucaagaaagaaaaaagauuggaaggagacuggacaaaauauaaaauaagaaagauaaugacuauaguaauuuuaauuuuaagucaaguuaaagugaagauucagacaagcugauucagucuccucugauuuuaguuaguggucccuucuccuuaauagucaaaacaaagcuuagaaaacacguucauuccuuuuaaacaagauuuuauuuuuauuuuucuuguaauaugagugaguacgugucacgugugagcaggugccugaagaaaccagagguucagauuccuuggaucuggaguuagagguguuuaugagcucccucauaaggguguugggaaccaaacucaaauccucuggaagagcagcaaaugcuuuuaacugcuaaacucucucuccagucccuucucauucuuucuugauagauauguuuaucaggcuauuaauuuuuuuguuguuguuguuuacacacuuuauacagaggcuuggggaaagaugguagaaguccaugcugucugcuguccugcgcggggcagaccuuacagcaguccccgucgauaagaucaggcuauuaauuuaauaguucuaagaauugauuuguucagggaagggaacaaaaaaagaacucuguaguuacuugggaaucuagagccgugcauccuccaucagucaccugccucugccucccaagugcugggauuaaaggcaugugccaccacugcccgguuggcacauacuuuuaaucccagcacuugggaggcagaggcaagggcaucucucugaguucaaggucagccuggucuacauagugagacacugucucaaacaaaacacacuccaauacaaucacuuuuuucuaaaggucuggcaccugguggguucaucacacuccaguggaaggccacacauucaagaguauaagagcaaugccaacuucaugauuuuugguguguguguguguguuuaacaaaaaaggacaaagucagguugauaggugaggcagguggauauggcaggagggaugaauaugaucuaaacacauuguacagaauuuucaaauagccaaauuuuuuaaaaauuucuuuuauuuuguacaguccagucauuacccaccucccagucuucccuugcacaguuccucaucccauuccuccuccccucugucuccaagaggauauccucauauccacaccccaccccuaccaggucuccccauuccuuagggucucaagucucucaaggcuuaggcucaucuuuucccacugaggccagaccaggcaguccucugcugugugugugucaggugugugugggggggugucauaucagcuaauauaugcugccugguuggugccuccgugucugagagaucucagggguccaaguuaguugagacugcuggucuuccuauggggucauccuccucagcuucuuuuagccuuucccuaauucaaccacagugguccucgacuucaguccauugguuggguguaaguaucugcaucugucucagucagcugcuuguuggaccuuuuggaggacagccaagcuaggcuccugucuguaagcacaccauagcaugaguaaguaucaggccuuggagccuucccuugagauaggucccaaguuaggccaaaaacuggaccaccuuucccucagucucuuuuccauuuuugucccugcagugcuuuuagacaggaacaauucugggucagaguuuuugacugugggauggcaaccucaucccuucacuugaugcccugucuuucuacuggagguagacucuaugaguucucucucuccacuguugagcauuucaucuaagcauuucccuuugaguccugauagucucucaccucccaggucucuaguacauucuagaggauccccuaccucccaaccuccgagguugcauauuuccauucauccugcuggcccucagggcuucucuccuauccugcuccccagcccccauaccugaucauguucccccccccccacuuuccuuucucccaccuaggucccuccuucuuucuuccucccaugauugcuuucuucucccucccaagugggauugaagcaaccucacuugggcccuucuucuuguuaaccuucuugaguucuguggauuguauccuagguauucuguaauuugggggugggguggggcuaauauccacuuauuagugagugcauaccuugcauguccuucugggucugaguucccucacucaggaugaaauuuucuagauccauccauuugccugcaaacaucaugauguccucauucuuaacagcugaauaauauuccauuguguaauugaaccacauuuucugaauccauucuuccauugugggacaucuguguuguuuccagcuuuucacagauaaggccacuaugaacauagcggaacaugugccccugugguauggcggggcauuuguugaguauaugcucaagagugguauagcugggucuucagguaggucuauuuccaguuuucugaggaaccuccagauuaauuucuagagugguugugccaacuugcagucccaccagcaauggaggaguguuccucuuucuccacauucucgccaacaugugcugucaccugaguuuuuaaucuuagccaucaaauagcuaauuuuaaaauggaaaauuggagaaaaaaaacuccauuagauaaaggacaguuucuccaauaacuacuguggggagaguggauauccauauguagggguugaaaccagacccuuaucugauucuucuuuuaaauaggcugugaccaugaaaccuacaacagauuugaaaauacuaaagacacuugagaauauuccuaaagacaaagauuuccuacauaagacuccaaaacuguaggaagugaaagcaagaauugaucacuggaauuacauccaaagguuuugcccagcaaggcagguguagugaagaagccacuugcagaaucauacagaggauucaaauauguagggaaucccgucuauacaguuauguuaaugcugauagauagucuauagcagguauggaaugaaagggaaaggcagauauaugcccacacauuuguaguaaauaaaggggaaccuagaaagcaguacaaaauagaguuaccaaagcauauuguguaguaagcucaguagaaguuguauucagugucuauauauguauaugaaauucucaaagguuguuuuuuaaguauaaaacauuacuaaaaguaauuaaggaauaucugaugaaauagauguauguagcccauggugaaucagucaaaccuuuagucaccugauuauaauccaacuuauauuuuuuaauaccauccuacucaaaaucgcagugguuucucuguggauucugagaaacaguaggaaguagacacucaugcagaggccacagcaggcauagaguauuugaggagaaacaguaaguucacguuuacaaauggcguagucaggguuucuacuccugcacaaacagcaugaccaagaggcaaacuggggaggaaagggcuuauuacagcuuacacuuccauacugcuguuuaucaccaaaggaagucaggacuggaacucaagcaggucaggaagcaggagcugaugcagaagccauggagggauguucuuuacuggcuugcuuccccuggcuugcucagccugcucucuuauagaaccaagacuaucagcccagagauggucccacccacaaggggaccuccccccuugaucacuaauugagaaaaugccuuacagcuggauuucauggaggcauuuccccaacugaagcuccuuucucugugauaacuccagcuugugucaaguugacagacaaaaccaaccaguacaacaaacaugcaagaaauuuucuggcuagaaauacugcuguguuugagagccaggugcuuaguaguuagcagcaucaacuaacacucuuaaccuuuacauguagcuucuguuucccagguaacaauguagguaggggucugcagagaaccagugagaauggucuugcuucuccagaucucuuggggugugucucugauuuaguauuguccuuguuguacccuuccuucaguacacauggacucugcacccucccuugccugccuggcuuagcccuuuauaugauugccauuuguugcuagguuuacagcucaacuuugucuaaugcugaccacuagaauucacauuuaaacuuguuagugagagcaagauaguucucuuagagaaagugauccaggcauggguguuauuuugauaaaagacaacacacuggaaacccucaacccuccuuccccuuccuucuccucuuucucuccccugccucugcucccuccuuuccuacacacuacugggcugcacuggguagcccuggguagcuuggaacucacagaaccccaaaugccagcacagaaagcauucacuaccacacucagcaagaaacauacauauauaucauggcuuccucugcuacaacaggaacuauacugaagucucauuuaauuugcauuuauuuucacuuuucaucuuugaaagaauaggucacauuacugaacugaauaaaaguacuacucggacagguuugcaguacgcaaguuuagaacaguuuuuucuaacaaguuguuuguuaaaauaaguuucucacuuuccuugaguaucuaaauguaauuauuuuauaaguauuuucaggaaccuucagaaguuccauguuguaguuuguccuccagaauuuugucccuagauacacuucugacuuuuaaaucugcacuccucaaaauagccuauuaugauauaaccaaguuaucucauauuuccucccuuuacacuuuuuuguuuguuuguuuguuuguuuguuuguuuguuuuaaacuguuagguguuuggaacauuuuuuguaauuuugccuuuuaaagcccuuccacuuucuuuacucuggaggcucacaccaagucucauuaccuaccuuuaaaaagacuuuuauguucuguauguguuugccuucauuauguugugcacaucacaugugugcaguacccugagaggccagaagagaggaucagaucucccuagaauuacaguaagcuaacagguugguucugggaaugaaacccaggucuugagcaaaaacagcaagugcucuugacugcugagcugucucuccaucuccagcccacugguucuggacucacugcaugcccccaaaauccugagaaggguuaugaguaagauaaacauggguaaacaaauuaagaugcuaucuucccugcacuuaaaguguuuacacacgagcacacugucuuaugaagaguagccgugcuacacagcaaaacacccgguuuuuuagcugaauacagacuauauagccaccgugagugaagaauagcuuucaggaaaucauccuggaggaggcaauacuaauuuaauaaaguugccuauacauguuuguuuguauuggguuuauguauuuuaacaaaaucacucauauguuacaguugauauucauaguuuauaaaauauguacuggggauauuuggcauacagaaaauuccuuaguuuaguuuuccuuauggaaagccagucucauuacagcccuaaaguauuaggucuccugugugcccaaguagacugggcaucucaguauaguuuuucauucaccuguuagccauugugauaguuuguugcuguuguauuuacucuuguaaguucccuuguauaguagagcaaaucucucuucaguguuccucgccagagccaucuggaaucuuuacacucuuucaugauacugaaucguucuuugaaggaguccuuaggaaauuuuaauaggaauuugcaucgauuuuacagacuaauuuaggcaaaauguggucuuuuauagcauggagucucaucccggacugcgucuguuugguaagcucuccuuugugacuauauuguguacuuuccuuauugcucacagugaagggacgguucaggaaggcccugguggcaggggcagaagcagcuggucacauggggaagcaggaagggaaggcugcugguguugggcucacuuucuccuuuuugugccgccugcccacguuugggaugggcccucacacaccaguuaaugcgauuuaggaugucacaguuacacccagaaauucauuuccuaggggagucuaguucuugucacauugguaguacuaaccacacacggugacuuuaauuaacaucuugugcauuuuucucagcaucacucuuaaauaugugcuagguuuauuccuaaauaaccucauuugguccuaauaugacacaaguuuuuuuccuuuaaaguuucuaauuauguuacugcagauacauagauagaaaggcugcauugaaaaacgugcugugagaaaaugaguaguagcucaguugguugagagcuuugcuguacucauugcaagcccucugcugguucuggguuuuccaguaugaagucucuuauuuccuguugaaacuuccauuuuuggauuuaauagggagugaaauccaggguaacucuucagcuaacuaucauucacugaaguauacauacguauacauacagaugcacacauacacacccccaucccuuugaagugcuuuuguugcuguugaaucucacuuuuuuucaguagaagguuauuucccaauugugaggaaauguuuccgcacuacuucccguucauuucagggcaucuuccugcuuacucugugauaacccagaauaucuaucucuucuggguuuuccauaguaguuucuguucacgagacuguauuuuguguauuugaauuucacaugauuuuccacccaucgucugcguggaccccaggaccagcuuuagagugcucacauuuuucuaauauucucuuuuuacaacauuugugacuuucuuuaauauucaucagaguuagauucaucauuccuuaccugaugguguuucuguguuguguaguaguacuguguucuuaccuuucagaacacaugggaggcuuucugugucaccugaauucacagugucuuucagaaauguuccaagccuaaaguaaauuuauuuucuuuguauuuucccacuccauuuccccaguaaaauuuuugugccuaugacuuuauacauuuaguuuucuguuuugaagaaugaaacauucauugagugaguuugguuccugaauuauagagagaguaucuguuguaaaaauuuugccauggcauaugggauggauaaaucgcagccccugugaagcagcagaaagacaacgaugagagauggacuuuacagccucguuauauuucugaaguguuauuuugugcucuacguuucgacaaggcuuacuucugcuuaaaacuuuucccuuuacuuaaacuuuaugugucuuguggaauaguuuauuuauucaguauucuuuaaaggaaaaaucucuuaguguucccagccugcucauaauguccagcucccguugcuuuggcucagaguucuaguccaccucaugauaaacaccuucguaucucauuauaucuuaaacuccauaagcucuaggagcaggcgcauagagggagcguacugugcuuuuuaaaugagccauggcaagccugggaguggagcucacugcugggaaguagaccagguggcauuaacgggaccauuccaugugguaauugcuuaacacauuaauauugaaguagaacuggcagcccaaagagcaguccacuugcagcuucucauuuccugggagggagaacagucagacgggugcauauuugcagcucacaugucaguauacaggaaguugugccuuuuuauuucuaggucuccuuguuuuaauuuauuagcuuauugacaagauacugugcuuaaaugcuuuaauuuuuucaauucugauaccaugagauaaacugaacuguugucauaaagaagccuuacugugauaaaauaauguaguguggaguugaccuagucagaagauuuguuggcaaggacagauagauauacaugcuacaccaaaccuauaguaacuuaaaguauguuaauuauucauuucaugguuauuaucaugguuagaauguauccagguaacuacauaauuguaagguaguaugcaaaucucacgcaaacaauagaacuaucucuacaugauuguaguuggugauuuugcacuaagauaauguaagcagacgccccguccuagcaggcaccacacuugcaaguccuggaggcccuucugaccugcccuugcucugaguguucucucugucgugagaagauggcugcuuuugcagaccucagguuugcucagcuucucuagauuaucuugaaaagaaagauaaaaaucaguauuuuuuuuucuugacaauaacugucaggccauguuuuuuuuuuuuuuuuuugacuaauaaaggaauaauuaaauuuagaaaguacuuuuuaaaauaacuuguuugugauuuuacucuugaguuaagauguauuuucuuuuuucaaacuucgucucuuuuuggugcugugcagaauacuagucucuauacuucauguauuuuucaguauugagauauaucgacuguguguggaauuugaugugaugcgcuucucugugccugcguucugcaggacugucgauuuggaagguguuuauuuacucugguuauauuuuggccucuaaucccucuuuguuuucugugcaucuccauacccugcuaaugacuacauugucacuuucuaagcacaaggagguuccagagcuguguuuuauguuuauuuuaaacuaauaacagaacaucuuuaugguaaucagucacuguuuagggaagauucuggcucguuaaaauucuuuaaaauuagaagcaagcauuuuuauaaauugcuguuccucuuagauuugugcccacugcugucuucuuccucuauccuaucuuuuaaaacaguguuguaaaaagagguuuuucagccuacaagauacuguguuuuucauugacuagaauggaauuaaaucugugaugagaaaagcaugguaucucacuguucuauuguagaugugaugcagcgugaacccugccaacucuguucacucuaguucuccccucaacacuaaaagcaaggcagagaacaucaggaaauaaaucucaaaggucaccgggcagugguggcgcacgccuuuaaucccagcacuugggaggcagaggcaggcagauuucugaguucgaggccagccuggucuacagauugaguuccaggacagccagggcuacacagagaaacccugucuugaaaaaaccaaaauaaauaaacaaacagacagacaaacaaacaaacaaacucaaaggucauuauuguguaggccauugugcauggaucagcuucaagugcauuaaauauaguaguguugcuuuuacgcagaauccaagccugugacagggauaccaacuagcuauagaauuguaaauuuuaggucaaaauuguauuaauucuuuagcuguaggauuguguggggaauuguaguaauuguuuaguaagcaaauuucccuuggauguuagaauauugcaaaagagaaagacccagaauggaaaagccuguguguguauguggggaggguaaugaccaguuacauuaaagugaggaaauuuuauuaaaacucaagcucuuuauagucuagaaguacaauaauaauacuuggaauuucugaacuuuuacgugauaagcuaugucauauuguuuuccaaaggaaaaccguguuuuuguauuaaaacacaaguuuccagaaacucuugauucuagcauagucagcaaaguucccaugauuccuuggccaaaauaaacaccaaacauuuccuaacaguacuugguauuuaaauaugcccuaacaguuuuguaaucauuuugaaauacagagaugcauauuaauaauauacugaaagaaaauccuuucauuuuaaaaauuacuacuuaaauacuuacugagugcugcauaguuuuuaagccuaugcauaauauugaacacucauuucuugauccacauugauuuuuguucauugugggacugaacauuuaaaauucuauuucuacaaucagaaugccuguacuccuaaaucauuauauugaaaucuucaccccuauaguuguaguaauaggaguggguuucugcaagggauaaugcugaugaaaugcaugugauuugcuccuuacaaaaacccaaagacucuguguauccuuucugccuugugagaaaaucagcaagaaggcagcgccugugaaccagugggccagucugugaucuuaugcuuuccugcuuccagaacugcaaacaguucauuuuuuguuacuuaugagauuucuggagcuuuuauuuuguugggggcuaugauucuagagguuaaaucuagggucucaggaaugcugggcaagaauuaugccacaucuucagacaccauacuuuauguugaauuuuuuaauauuuuauuagauauuuucuuuauuuacauuuucuauuuuccccucuaaaaauccccuauucccuccccacucccccugcucaccaacccacccacucccacuucucuuggcauuccccuauuuggggcauagaaccuucacaggaccuagggccucuccucucauugaugacugacuaggccauccucugcuacauauacagcuagugccacaaguuccacaauguguuuucauugauugguaguauagcuccaaggagcucuggggguacugguuaguucauauugauguuccuucuauggggcuucagaccccuucagcuccuuggguacuuucucuagcuccuucauuggggaccuugugaucuguccaguugaugauugugagcaucuacuucuguauuugccaggcacuggcagagccccccaggagucagcuauaucaagcuccucucaacaggcucuuguuggcaucugccauagugucuggguuugaugguuguuuaugggauacaacggccauugaaaacuucacaaagauagaauaauguagcauaauccuacauugaaugggaaauuuguacaccaucugaucuauuacuaugcuucaccaaauauuucaaauauucuguaguaacuuuuuggaaacaugcucacauuauagaaaugaaaaugaucuaauuguacauauccaugacaguuuagaaguuauuaguauaucaaaguguagaagaaaggauuagauuuuguaucagucugaucuuggaucuuuaccugcuuguauggagacagaaugacauauugauuaaggccagugauuuccaguguuguguuguuguuguuauuuuuuuuuaauuuugaccccauuguuuguuauauaaugucacacacacaaacacgcaaagaugaauagauacauaauaaaacgcuggcacacuggucagcuccaauuacugcugugaaauacuugagagucuaaaggagagguuuauuuuggcucauggguucagagguuucagcagccucuguccuugauuccuuggcuuaguuccucuaggcuccugacgugauaggguggagaagacauggcagaggaaaggugccagaauggaaagagaagaggcuucaaggucucagaaccuccuucagggcgcaccucuaauggccucccuuccccaccagaacccccaccuaaaugcuucagugccuccuaacagcacgaucagcuggguacauucccucaacacaugagccuuuaagauguaacaguaacaaaugcucuggauucauagggccauuugcuuccccuuucuucuuucucuacuuccuuccuuccucccuuuuucccucucuuccacccucucuucuuucuuccuuuccuucuucccuucaguugaagauaauuauauuuuaaagcauuacucuuaggacucaccuaacugaaagaaacuaauucaggccacagaacucugggucccaacuggacucuaaagugggcuaugaaaagggcuauuaaaagggcugguuucuaaggaaaugaaguuguaaugauuuuucuaacauucuagacaaaucaagauuccgcuaguuaagcccucuuuaggucagaauuucuuggaaaugguagcugucuaugacauucaauuuguaaacacuauccacugucuguccaaaaaugaauaauuauuucauaagguugcugauauuccucuggcuauuucacuugaccaguuaugcuuuucucucuuccuguggagauaaguuuauauaggaaaaaaaauguuuuuacuuaugaauggcaugaaauuugauuagauuugaguaauagaaaagcuuuuccuuuggcugcagauuauugaauuuauaucaugcagcacgaaaauauuuauguuauccuagacucacuauuuggaaacuacuuacuuucuuccucaacagcaucuuuugcauuuuagacgggguugggggcacagaauaucugcuccuagguggggccuuucugcuguuuacauuccuaucaauagccagaaauggagcucuugacaucugcuggugcugcccacugcccuucuugcaccuugaauuugaucuuaaguagcuggcaaaaagaaauaguaaagagaaggaaaaaggagugcucuccuccgaucuccuuaaaggagugcucuccuccgaccuccuuaaaggagugcuuuccuccaaccuccugacuuugaucuucaugguccaauuuuuugucaaggaaguagaacaguauuuuugacuuauaaauauuucuuaggcugucucugguugcuccuuuucucgauucuaagguuucuuugacucaguuuacuuuaggcugaggcgucacuggauugaugggcugcuccauucuuccacgugagucuauuagacguucacguucaguuaaacacuaaggaagcaaagcugucagccagugaggagcuaaugaaaugagcaauuuuuaaaagaaaaauuacaaauagcuaauaccuauucaaaagugcucaaauucccuaguuaugaggcaagauaaaacuaucaucauaaauaaguccaucaucaagaaaucugaauagaaacauugaagaaugugaaagaagcccuauucacugcuaguauaguacaaauuaauacaguaucgaagucaguuuggagguuccucaauaaauugacccagcuuaugacccagcucuuccacaccuggguauauacccagagaacuccauuuauaguucuauauugaucgcugcuuucuguacaaggaaauagaacagccaucacaagccuaugugcacaucuaacuuacuauguccccucucagucccccagauuauauuuuaaaguguacaguagaguauuuauuugucugcugcugugguaaaaaagcacaccaaaaguaacuuauagaagaacuuauuuuggcuuagggacccagaaguccaucuuggugaguaacaauggccagaaggagcaggaagcugagcucacgucuuuuacugcagacacauagaaauggggcaaggcuaugugcucucagagcuugccccuagugacacguuuccuccaacaaggcugcaccuccucagcucugaaacagcuccacaagcuggggacccaagugucaaaugcucaagccuauggugggcauucuccuuccagccacuguagacacagauagguaacuuuguuucuuuuucaaaacaguguuucucugugcccuggcuucucuggaguucacucuguagagcaggcuggccucaaacucacaaggucugccugcuucuguuucccggagcucugagauucaaggugugcacaaccacuacccaacuagguaaauuuuuaaacuaaaacguauaugaguuucuuucuguucauuuggguuuuguguguguguguguguguguguguguguguguguguguguguguaucacguacaugcaugauaacuugcauaguggucuaaugcuuuaagauucuuuuugucuacugucaauucaauuuuaggcaguaaacaccauaccuaguagcugcuuuguuuuuuuucccaaugcugaggauuaagccaagggccucuugcauauaggcaaauacuuuaaggccccacaugguugugcauauuuaucucagcacucaggcaggaagguugccauaauuucaaccugaugcaucuacuuggagggccaaucaggacuacauagcaaaggccuaacucagaaaaacugaaaaaaacaacacacacaaaaauccacuaagacucagcuauacacuaaaccccugcuucuacacucuggguauuuuuaaacaugaagagugccucuuaccaaauuuacauagacucauuacuuuucuacugcuguuuucccuaugcaauauucuguuuguuuauauucuagucuuguguguacuaaaauagaagagaccguuaccaggcuugaauuuauagaaugacucugugaaucuugaccuuucuugucacuuauuucaaaugguaacaaacacauaggacccacagcuucuaacgggaaacaucucuuacaagcuaauagauacuuuuagccuaacucaguacugguucaugugacucuguuauguauuuaagaaguucuuuugacaaacuuuuacuuaaugcaugaccagauugagaauuaacaauuaaccaauugaugccuggcauguacuaaacacaguuauuugauuacucaaauaagccauauguuaacuuguugaguuggguuacuuaguuuuguuucuuuuuucuuuuuucaagacaggguuucucuauacagcccuggcuguccuggaacucacucuguagaccaggcuggccucgaacucagaaaucccccugccucugccucccgagugcugggauuaaaggugugcgccaccacguccggcuuaguuuuguuucuuaucaaacuuuuuuuuuauucugcuuacuugugaaacuauaauuauguccuuuauacuuguaugaugccaauaaugaccuuauaugaaaagauauauuuuuaugaaacuuaaugcugaauguuuuagaaaagaaauauggguaagccauuagaacacuacuguuuugacagcuagguccaaguccuggcuacuugaaggcugaggcaggaaaauggcuugaccccgggagcuuaaugugauccuggcagcaauacugaaacuucagcaguagggagcuugcuuucucugaguuagagaacaguaagagccugguacuuugcuucuaagugcuugaaacuggaauuacuuuuaaaugccuuuaagaugauugaaaguuagauguauuaaaaaaaaauauggccaaagcaaaacaaaaacagugagcuugagucauuggguccuaugaugugauauggaccauaccagccauaagcaaagcagugcacauucauguguccuuuggcuuuguagugagguuauuagucagcugguccauuuacauaucaaguaaaagaguagccuacucuuucauaguuuguuaguucuucauacacucaaagauuuuuuuugauaaaucauauggauauuaugaauuauucagggaaauaucagagaccugauugucagguaguaaauaauuaaaaauggcacccuuucugugaugugauagauugaguuuauugauauagauuugguuauuauuucaaagaaacaugucauagaauguuguaaugugugaaaagaaaaaccaacccuagaucuacucccacacacucccuuucgccagcugacuccgugcccugggaaaguagggcagccgcauggugauguguguugugccguguggugauguguguugugccguguggugauguguguugugccguguggugauguguguugugccguguggugauguguguugcuuggauuuggaguuucacuaagacaccugccagauggaauuagagcuuuuggagcauaaccaacauggacuaauuauuagcuuaccaugucuaaauacaaaugaaaaccccuacaagauucuguacccaaacucugaagaaaaaaaaaagagcuguuuuuuggacuaaaauuucauagcuuuuguggcuaaugaggcaugaaauaaauuggcaagcucaaacugcuccaaguacagugguacagugugcaugcucugaucccagcccuugggauuccagcaaaggucacaaauuaaacagucaggauuaaucaaaacuacaaucaaauaaaacccaaucauuaaucgucuccugaguuacaauggagcaauuguguaauugugugaggcgcacuggagagagcucuuuuguccuguauaggaaaaucaacacugaggugucaagcagaaaaaugaaacccugcaggugaagcugucucuggagccaagagaaacuggcagagcauuuggaguugcgaauaagcccucagaguauuggggggcccuggcacugagcagcagagugugugggugucuccauggggcccuccacagagguuaguuuaugguccagcaagccauuugcugagcaguucaguguuggggguaguggcaguucuacgcacacccccucucuucaagguaaugccaagaauuuacugugugauucgcagcuuuguuauguagaaggcgagguuauagaaaagauuuuuccagaaaacuccauccuuaacaauggaggggugguagcaaagaaccccccccuugagcccuuguuccuguaacagugcuuugcaauacuugcccuauuugugauacuguuuuauauuccaaaauggugauuuuuuuuccuucauuuuucuuucuuauuaauaguauuaaugucaauuccauugccucucuauuuaaaagccaacaacaauacuguccaguggcucuaugaucauaacuggcacuuuugagccagguauguaaucccagcacucaggaggccaaggcaggaccaucacaacuuggaggacagccuggccuccauaguuuggguuugguuuuuuuuuuuuuuuuuuuuuuuccuacucccuaccccagaacaaaacacacaagcaaaagacucuguuuuuuguuuuuguuuuuguuuuauuccacugcuguauauggauguguuuuacauguacuagaguaucugccccuauguguuggcuuucugucuacuaugcuacauauacauauggacgucagaggacaucuugcagaagucagcucuuuucuuccaccauguugguucuggggguuaaaaacagacugccagaucuggccuaacccugcgccauugccucagcccccaaacagaaaaguuuuagacaacuuacucugccugacaucucguaacugauuugaagcaugggaaguuugaguguaaauauuguagaacuugaaagauguggcucagaggcagagugcuugugcuuagccugcaugaaggccugggcuugaccuuuagcaccacauaaaaacaacagcaacaacaacaacaaggugggcuggcgucauacuuuuaaucccagaggcagggagaucagagaguucagggcuacaggcucagccccugagcuacaugagacuccgucucaaaaauaaaggaaguaaaacuuagagaaauaaauaaaucaaaauuuguuuuuauguuguuuuuugcuguuuauguacugaccucucuuuacagaaugcuguuauguccuguguagaacauguauucuuuuauuucauguagaaacuaaugcccauauguaauugguuuaguuccauaaauucauguugcuaaaaacaucacucuggcuuuauaguaagauuucacuauaaugguauauuauuuuggacuuugucuuuucauuuaucaaaaauaaauaaaaucuuggguucaauuuuuauggaaaauaaggccucaauauuuugagaauaguuucuguacuuuguaccaucacaaagaugugccuugcauguuugaauucaaucuauucauauauacuagauucauuccuaaaguaaugaauaacauguuacaaaugggaaaucauauaaacauguauauauauaacaggauuuuuauauuucuuuauacauuuuauauuuagcuuuauaugaauaaaauuauauacauaguuuuccaauuuauuaugaagaauaauugaguuuuaaauuuuuccuuagcauacaaaauaauagauuucauagugacauuuccauauguaugaaucauugugcucugcacaugcacacauuacacacauacacacacauagaaauacacaccauuaacaaccucucuugucccccuucuaacuugucucuuccucucuucauguagcucccuucugcuuucaugucauauauaagaauauagauaaauauguauauuucacauggauuccuggugccucaagagccagguggaucccugagucucaggucagccuguucuauaaaggcucuuccaggccagccagggccacauaaugaaacccagauccaaacagugacaagaaaaaaaaauuagacuccagauguaauaugguauguuuguccuaugucguccuaccguccccacaacaccuuuucuuaaucccccuccuccccuuccccuguauauuagucauucacuauagaugugauaaaacaccgugaccaagacaacucaaagaagaaagguuauuuacacuuccaguucuggagguuugagccauugauggcagagcaaggcccuggcugcaagaguacucacaucuggaauuggaaacauggaccagaggucuaacuugaaauggcuggagucuuuagacucucaaugcccaacucccagugacauacuuccuccacuaggacuauaccucuuaaaccucacaaacagcucuaccaacuggagaccaaguacucgaaugucccagacuaugggcaacaacucuuucaaagcaccauacccuacacaauccccuuacaguuuuauuuuuuuggugcauauuuuuaauccgaauuuuguaguuugucaacuugaacauuuacacucugcuuauugacaaccuuuuguuuugguguauuacaguucagagaaugucauuauucuugcuuuuuuuuuuuaacauauguaaguauauuucucuagcauauauucuuuaauagaauuugcuaauaagaacauauacauuguuuguuuguuuguuuguuuguuuguuuugagacagguuucucugaauaaccauggcugucuuagaacucacucuguagacgagacuggccucgaacucagaaauccgccugccucugccucccaagugcugggguuaaaggcaugcgccaccacugucugacauacauacuuaacuuugauaccucuuacugaauugcugccaauauuagucucuccccacauaguauuauagaauuuuauauucuuauauguacuagacaauauccauaucuacuuacuaaauuucugcugacuuagguuuacauuuguauuauccuucuauaucacaguuaacucuccuaucuuugggaaugguauuccauaauacauuuaacuguucuucccuugguaaauaauuaaauuacuuuuaaaauuccucuauuauauauguuauuuaguaaaaguuuauaugaaugcagauuuucauuagcaugaaaauaaucuuaagccaaagucauuucauauguguacaucugcagaauaaaauuugcaaaguagaaccauaagaucagaggacuucaaguccaaguugauacuuguuucuguuugauaucugauuucagguauauaucaccacacaaaucuucuaguugauaccauuaaaugaaaauaacagcaugggaauguuauauacuacuauuuguuuuaaaagaaggaaauuugaagcugggcauauaaugaccauuaaccuggggcaguaagaacaagcaugagugaagguuuuuuuuuuguuuuuuuguuuuuuuuuuuuuugucuuuuaacuauaaagcacaauauuuugagacagaaucacaguguauagucuaaagugcucuugaaucucaacccugcugucuaaguucccuccacacuaguaucauaagcaugcagugucaugcuuugacuacguuuauauauucuuuauacuuuuugaaaaaccguaugaaugagaccugaguuuauagucugacugguaaaucacaugcguagcuguguuaaaaaucuaaucugcauggagaaagguggggagugaauguauuaccuauauaauauuuuaauauuauguuucuuuaauauagcaauaaaagcaugaguuuucaacuuagaauuggauuuaauuauacaaugugugacacugacauuauugugcucucauuucauguauauaaaguaguaaaugucugucucauaaauuugugagaaauuacuuuaaaaguacagaauuuacaggccuacucauaaugcauaauuaagcucauuuaaucuauucugccaauuaugaaauaacuuagcccaguacuucucacccuuccuacugcgacuuuuuaauacaguuuuuuauguuguggugacccccaaucauaaaauuauuuuuuguugcuacuucauaacuguaauuuugcuacuguuaugaauuguaaauaucugugcuuuuuccuuuggucucaggugaccccugugaagcaaucuguugaaucccccagggcuggcaaagcacaaguugagaaccacugccuuagagcuuaucuuuauacagauagcauuuaacauagaauacacauugucuuuuccucucuucaaauugaauguggaggcagaagucuuuguuuuacuaggaaagaggccaugacccugacuugguuuugugacagucacuucaaaagaagucauaaaaauauuugcagacaguggaaaaguaaacacagcuugggaacugauccaugucgagaugaauauagaagugaacugguauaaaguuucaaggugcaaaauagcuguuuggaagcugugacucaugcaguuguucucagacagaguucacacauuuucaggaugagcauacucuugaacggccugaagacacgggcauguguagcaugcaguauauucuuauaagccagaauuauuagccucugagagcgucugagggacuccugaagaauacauuuggcaguaaugauaauggagacacacucacagagauauagcaacuuuaaacuuauuuuaugaaccacaguggaagagcuucaagagacccucucuuccuuccaaauucauuaacugaguuuuuccaaguaauuugaaucucaaagauuuuauuuaguuguuuuuuuuuuaaaucaagaaugucagauuagaaagggcuagaaaguuuaaucccaaagguuucuguaauaauaaccaaucuacccuggagcuccuaccaacuccagcgauuuugaggaauuuucuguaucaucuuguugucugguugguuuaccuauaaacauuuuaguuucugcaugcaauauacagcaagcaaaacuaaaugguauauaauuauauaucagacuuacauuccauacuaccuauauaauauaaaacuauucauaaaacaccccaaaugagguuuuuauaguaacauuaaaauuacuaccugaaauaaaauguccccacuucuucuaaaauaacacuagagcuuaucuuuaagcccuuccucuauucucaagaauucugguaccguguccaguccaugucugcuugauuucuucucuugucuuuuuucuugucagaaccauaguugugcuuuauaggugauucgcaggcguggggauacuuaccugccccuaagugacccucccgucuuuacugucccuauccacuuaccucacagcccucucacaccccuucuguagugugucuucuucuguaugcacccgugcuucauuccguguauguguaacaguagcucauuuacacuugcuauguugcauuccauccugugacuauaccacaguuuacccacucaaccauaaguagaaaucugagguguuagcugguuggagaugguaucaguucuuucauuccacguuugcuugggucccugagcucaaacucagguagucaggcuuacaucauaggacagcaagugaucucuacccacugcgcggccucacuagcaagacaguuuggcgauguuacaaauaaaaccuugucuuuuauuuaccucucucauauuuugggcuuauugaaagcauacauuuuuuauguuugucauuuugaugucuagugcauugaaagaguaggagagaagaggaagguagacauaacaauuuagauaguaccauugccuuucuuaaaaugauaauuuuauguuucucuagaucuuuucugcaguuguguucacuauaguucuuuguaauggaaacucgaacucuuaaguacuagcuaguaaacuguuggaauuuauuaagcaauaauguuuccaugucucucuagccaaaucuucugcuccuucagaaugacuauuaaauaaacuuuuauuuuuaacuuucaaaaaguugacuauauaaaaccagugauagauucuuaaauaugaaauuaagcauuuacaguuguaaacugauaauaacugcaauuaggacuucauguuuccuaaccuuuuuaguuuuggguucuucuuagagcuuauuuuagagauggcaaaagaguuuucauaaaauauaaccucuuggaauaaagaauuaggaauuguaauuucuuguuucaauuucuaaauuuaguuuagauaauuaaacccaugauuuauuuuacauguucuauuuaagaguuuacaauauuguuccuaaugcacaguuggguauguccaccuggugauagacucacuuuggguucauauacaaccacauugcuucuuguccaaaacagcaacacugucagggaguagccugugucauaccauggucaugcuaaagaaaguaauacugauuaugggguagaagacaaauauuugcuuucacugaauacauuuuagaaacaaguccaguugauccucuauuaguaaaagcucuauuugugaguuuacucgccgcuaaagcauauuugcaaccccaaaccaacacuugggacauguucaguucuucacaucuggacagaguagcaaacaauuugagucauauuuuaauuuagagacagaaaagguaacacuuugucuuucugguuuggguguuguacuguagacagcugacuucacauggucuuuagcaccaucuuucccacagguuugcaaaaacaaaaaacaaaacuggggaucuugcaaagcuuuaagccuagggcuuguaggguguacaggguccuaagucccaaaauacuaagcuauuccuuacagagaauaucuaauacuuguauuagauaaccuucaccaguguauuagauacauacagagcuuuuugcuaugaguuuguuguaugucuauuuguuauuauauaaaauaagauuccuuuagguagaaacauacauagaacgagauuugguugucaaagugcuauggccagauacuucugugaaccuaguucuuucauucuucucuugauucucuucucagaauuugcuaauucaguguucacaguacuuuauagcuaucaugaauagaaaacagugacucuacuugauggccuucuacuuaagguauuaucaagccauauuucuuauuuucucuaucacuuauuacaaagaacgguuggccuucauucacuacagguagagauuuaauuuauccaagcuuaaauguuuucgugcugugaucuuagcuauuaugugcaguacaggugucuacuacaaaaguaaugacugucuucuguuuugccauguacuguggcccccaaugacauugaagugucuaaucagcaacccagucaguugucagcacugcaggugcagcgucuggucugaaugugcuucacuucuaaguaaagaccaaacaacuucuccuuugaggcuucucaaggucauucucuuccugauggaugguauaucuaaagucauuucaagauaaaaggucuuuuacauauaguuuuagugguaaggcauccaguugguuuagaaagcuuuauaagugauacauggaauuaauauaauaaaugcugaucuuccuuaaccacuucuguaaguuuaugcaauugguuguacaguuacacaaugugaagcaugucuucuuuuugugcuaauaaaguuaaaugaaggacuaaaaguuacuagcauauucaauuaaaaaaaaaaaagaggcaggggcuuacucuaucugcucagagcauguacagcagacaguaucauuuuagaaucaaucacucaaacacucuauagacuuugaugcuuucaggacucacuugcuucuaaguuuacucuuggagaugggcacauguucugagggcauuguauccuugaaguaauacuguccuauagcacuauccaucaagaaagacagccauugucuucaucggaucagcuguaccuguuugcagaaucucaucauagcugggcuuguugacaggggauauucgaucagaaaaggaaaggcuggauggaaaggaccaucagcucuucaccugagauuccagcaguaguuccucccagccauuugauauuuuucugcccugauugaacauggccccugagucugcaagaugguagcauauauugacgguggaagacuaacaaaggguguuugaucuuugcagcaauagggaagccaucagacaugcuggguacagaccuucagugcaucugcuuuaaagccacacaugcuccuggccauagcauagcccuucacccauacaaugcaagucaacuuaauaaauucacugaugcuccuggaggaacugugguggaagcuaacuuugauuugucaugggugccuuauaaggaaccucucuuauauccucuuugucuucaauucuccccuuuaauccuuucaaaaguccucuuuuacucaacuaccguuuuguuguuuugguuguuuacaauuguuccucaccuagcuacugaccuuguaguacagcucagcuguucuaugguagauguauagcuaaugugugcuaaagugagacuuccuguucuugaggcacugggucgguucucugaccuugcugaguucccguccaucauucacugugcaguuguccuggggcuauagagacuguugaagggggagcucuggacucaggcgccugccuagacccuagcaacaacaguggcucaucuccaaaaugcagcaagggaacacaaucuuggaucuaauuuucuuucuucucuuuuccuuuuccuuuuucuuuucuuuucuuuucuuuucuuuucuuuucuuuucuuuucuuuucuuuucuuuucuuaaacaaaagcaacagauugaguuuucuacucuaagaacaucuggucuuagaacuagcccuggcuugugaaaggcacuuaggagccaucguggucucucacuucagcuguuuauauugacuccugauuccuaccuuacagauucguuaugcuucuuaauuccugcucuucugauacuagacuuccuuccacacaguaauuauuggcaagucgguucaguaaaccaaacuccugccggggugagucucagcuguuugucauuacagacgagcugcuaccagccugcucauucagcuccuuguacugucaccucuauugucacuucccacuacucuuacagcaaauacauauguaaucuaagggagagaguuuuuauuuuaaucuauuacauguauuuauuauggaggggggagcaaaggacaaucuagagucucuucucuccuuccaucauguggcuucugaggaucaaacccagaaggaagucaugaggcugagagcaagcauccuuacuuauccaccaccauccugcaggcccgagacgaggugagguguuuguuuuguugguugguuguuccuuaucucuuguggcuugacacaucuugcuggaaauggaaccacugaaguaucaaugaggaagcaauauuuccuaaucauagugaaaguauuguccuuugguuuagugacacauuaaaauaauuauuuacuagaugauguuuaaaaucuugaaaaggcaaacuaacacaagguaaaaucgagugugcaagauacuuuguacaacucaaaaagaguggcugaggguaggucagagguugcacuugaguugcuuuuaaaguuguaaaggauuguuuguuuguuuguuuguuuuguuuuguuuuugccaguagaaauaaaccacacuuuaaccuugcagaggacaugguaaaagcagacaauaguuagugguugaggaaacuuucuuuucuauaaauggaucaaugugcuuaggaggaaaguugaaagcagaccaugaagacauucaugugcacuuugaaaauuuuuaccuuucucuauuuauauauuaaaagaauguaaaaauaucuaccuugucacaccccuguaauccuagcauucagguagugauaugagaaguauugugaguuuggagccagccuggacuacacaacaaaauccugucuuagcagugaggagugaucuagauauagcaaaugagucuucuaauaucaacuuucauuacuuaaaaaaugcauacgauauuaccuccuaauucuugguggaguucuaaguacaaggaaaguaucaaggcaugagaguaaguggggguguagugggcucucggucuugcugcugucccugcuuuccauucccucagcuacauuuaaggaagccagcauucagagugucuuauacgcagaauuuacaggaaaguuaauaagagauuagaaccacagcauucgauuacacugggcuccuccacaguauacagaacacccuacucacuucauuucaguuguucaaaaauaagcagaaacuguuguuucaucuuuguucuguugugguaagaucuagcucuuagaagaauuacuaagaauuaggauuaauuacgcuaaaguaagcccauucagggacuugaguguggaguuccaguauagcacucuaguugcaguggugagcaguugguuuggggcugguuugguuuugucuguggccucccucagccgcucuaggccaucuuggcauguuuugcuuccucucauuaccagagucuccuguaccuugccuugggagugucuuugucuuguuaaccuucuuuuguucguuuuagggcagucuauucuuuguguacugaguugauucaguuaucucuuaacauuuauuuucucgcuugauuuuucauagacuuauuggagaguaaugaaagucuauauuuccuaaugauaacugaaaaaaaggaaaaacaaaauucuggggaugaggaugugacugcaugguggaauguuugucuggagaagucccucccuggguuugauccccuguacugcacaaaccagguguagugguucaugccugcaucccagcacuugaacgaaggugggaacaagaggaccaggaucacagaaaaaguuuaaaaguucaaggucauccucagaauauagaguguuugaggggaggcugggcuacauguuucaaaaccuguuucaaaaacaaacaaacauaaaaacaaugaaaauucuugaauagaguuguugaaacccuacuuccuguacgucuguucuauugccaagcugcuuaucacauaagagggaaauuuuauuuguaugaagucaucguaggucuuacaagccucacuuuaacauguucugacaaauaugucacccucugacuucaucaguguguggcugucaugggguuuuccccacaaacuaagauguuuacuagcuaguaaauuguguguguguguguguguguguguguguguguguguguguguguguguguaugugugucugugggguagacaguagaagacaacuuaacuucaguuaccuccuuccuccuuuacaugaguucugggaaucagacucagauuaucacauuuacccguugagccauuccaccaguccauuguagaacauggccuuugagaaaagucacuuuaaccaaacuauugguaugcagcacauaacuguuuuggagggaaugaagugaauauuagcuuuuuuuuucuuuugcuuguaaacauaauauugggggggguuguauguuaguucaagaaugggggguucauguggaggccugagguugccauggggugucuucuuuaaucucuucacuuuauuuucuaaaacaggggcucgaacuaaagcaagaacuggcugacucagcuuauuguagcuagcaagcuaagaucucuguccugccugcuaaauucuauaauuacagguggauugccauaccgacccagcuucuauguagguuauccaaaaucaggucugcccacuuugugccaagaacuaucuauugaaaugccucccuaccccaaauaguaaacuuacauauuuuuaaaaaagauuuaauuuucuguuauauauguguuuuugcaugccuguaccuauaugcccaaagaggucagaagagggcauuaaagcucuugggauugcuguuguggaagguugugaguugccagguagauauugggaaucaaacccaggucuucugcaagagcacuaaguacugagccauugcucuaggaugucucugccccaauauuuaaacuuccugacaaauuauucuagacaguauauaugcaguguuuaaagcaugaguaauucucacuucauugucaaaagacuuaauugggaaucugaauuaugagauuaguuauagaagaaacacaugcagccgaagguauggccuuauaguuacuucuucucaaauauuagcuuccuucuagucaguguaguugaacuuaguuaacuuugaaauaguuguuuaaacguuugaaaauuucaaaguacuuuuauacauauccaguguauauaaaacuaaaauuacauuucacaacacauaaaugaucauauugccauaccauaugaagaaggcuacaaauacuauuuaucaguauugugaguauugcucagaaggagugauugcuuuuguuuuguuuuguuucuguuucuguuuuaaauguguaauauaagccugccccugugccugaagccuguguaguuaguuguguccuucuccuguacuuacuucuucuacuaggacucccucccucccucccucccuccuucccucccucccucccucacucacucacucccucacucccucccucccuuccacucgaaaugugaggaugaccaugaacuugugauccuucugccuucaguucucaauucugagguucaucccacgcaguguucaggaagcccuggggacugaauccggggcuggugccaucuagacgagcacuccaaaacugagcauccccaacuccggaagucucguguguugcuuuuacccuccaagcauccacacccuggcagacuugacuccuuguuaguacgccauggguccacguucccacccucuuugccuuggcuuucuuggucuugaguccuggcagugcaguguauuagaacaaugccucuuuacugucauuaucuacugucaguccuuccuggucuugccuaacugagccaguaaauuagaacuggcaauggauacauagggguaagaagcaugcaucuguugugaauuuccuuuugcuguggagaagccaaaaggcuaggcauuagugacugcuucagucuucucucaugguuggcagcugacaggcucacugaugaggugauaaugaacucaaagucugcccugcuggcugggugggaaaaaaacuccagacagcaagcauaccucacucgggagccugccaagaguuuccuuuauuauagaauucauuucaaggagguucacagguagacuuuccuggauacauuucagaauuauaacuuaugauuccaaagaauauguauuuugcuuucaacauagcaagucagaggucuuagucucaguuacuuggucacaaaagaacugggaaguaagacuugaacaacguucauuuuugaaaaauaaguauuucuuuucauuuaaaaaaaucauuuuuucgauauacaggaaucagaauucuugcauuuuuagcuaucccuguuuauuugauugauugaaaguuuuucugaccaucccaaacuucauuaucaacucuugucaguacuuacaguaaagcuggggaguggcccagugaguaaagugcuuguuguauaagcaggguuuuugauccccagcccccauguaauaacuggacacacuggcagacauuaguaaccacacugaugggacacagagcucauaggcagccagucuacccuuuccauugacgugaggugcuuaagauucaguuagagaccuuguccucaaaacuaagauggagagcagugacuucuggcuccaugugcacauucagguaaauggacagacacacuuuuaaauacuucaaggaaaucuaguuuuguuuucaguuguggauauugguaaaucaccuauaauuucaaaugcaguucaauuccacugcuguuaggggcugacauagcaaaguauauaggguccucuugaugcuaaagcuauugaguacucaaguccuucacaucaaauggcauacacucugcaugcaaacuguaucuaugcucccuuauacuguaagucaucuuaagcucaauaaaugucauuaaaauguaacucaguaaauaguuacuauaauagagcacgaaauaauaauaaagccuaauguguaugggugcacuauagacuaaaaauuuuaaaacuacuuuccacccaugguugguuggguucugauguagaccccacagacacagguaguacaggaggcaucuuaauauuaguguacaaaauguuuuagauuaguuacuagaguugugcuaaauauaaaauauuaaaagaaccauggaaaccuuuaacuugaagcaugacuauagcagaauucucuuuacucagaguucccuguguucaaagaaagcugcucagugaugcuccucagcuucaggcaaacaugaaccuugggaauugauaaaaaaaaguuguaugauugucuccauccaaguuucccuuugucucugaccugcaguaauuuucuagcacuuaagcagcuucauaaggaagaaacugaaggguaugcuuguaguaagaggaaugguggagugugccaggagucugcauuguuaucaccaaagguugccagauccccggggccuguccugguuagcuucuccugaguuaaggggagccucuaaucuacuguuuauaaugaguugaagauugaaccgauacucaggguuuauguucaguaauugaaucaaagcugcuaauuuucaguuggcauuuccuaugcaguaagaaaauaacucuggcagccaaggcacgugacuuuguuggugaacauagggaugagaguacaucucauaaaucugcuaguuaaaauuaggauaauaguuggaaaagacaguuuaauaaacauauauaaauccauuuuucaguuccauuacuuguuggaaacuuuaagguugacuacauuaauuauuuaucuuuauuaacaaaaucaaaaacaaucaaauaaagugcauagauauugaauaauccaaguuuuauaguuuuaacucaguuuuucauucauuaauaaaauauauauccuuucuuucauaauacaguauauacaaauugcucauuuauuugugucucauuuauuuaauuuggucauugguuguuacuauaugcagccacuuauuauacaaacuccuaccaaaauuaaucccuguuaguuugggaaucuucuugcaguaugaaacuaccagucuucuacuuccauauucacaguccaaaauguaauucauuccuguguagaaaaugaggccaagguugcgguuaguagugauguuuuccuugucgacaagucuuuuaucaguuuccccuuaacccuuauuuucucagaguccagcagaacaguccuugcgguccuugcuuucaaccucugacaguggaacaauuuaaagucaagucaaaauauuuuacucaaaguucauuauuugaacagggagaaacgagucucuggccucucaaccuaaauaacuacuugcauuaaauucuaccuucccaucuaaacuguuuuucaagugacaaaacuccucagaugugccaggauugaaguuccuuagcuuaaagacauuuuguaacaagcucugccuuggaagcagaaaagcaguuccuggggugaagaggaagcaaaagaacuuugcccugcugauggcgcagucuccagguuauacuugagcauuuuuaacuagagucagaacagugguaggccaggaguacuugggacccaugugccucaggucuuaagaaagcugcuguuuccaaugcuuaagagcccgaugaccuguaugccaguccuauacaggcuguccuugauaucuacauacacacacaccauggcucauucauauuccacacacacaaacaguaaauccaugccauuucaaaaucacugauuugugaauuuuagggguuugaaaauuuuuuaauuuccuuauauuuaauauugaaagucaauacuuuaaaauuauuuugucuucugucuuaaaggcuuguuuugauucuaacucuucugucucaaguuuauuacuugcuaucuuaauuuaaaugugugugaucauauucuguuuccacaaaaguugcuuucaguauauaauuuagauacguuaguauggcaguggagccucugcauaaucugauccuuccuguuggucacccgucccuagcacuuaaagucuuucuucuuccacacaccacuccucuccccuucacugacuauauauuauuaucagguaauauugcuucucuuuuuuuuacauacauuguugucccugaauucggaaggcgcuauauaccugcuggcaguaguaaguaccaugauuagggcggucucugcuuccaaggagacaaggagucuuuguugucuuugaucuuuggacucuguagaaauuaccugauaaauguaaaaguuaguuugguuucuuuuagucuuggaaauacccuuuuucuugauuucuaauauaucccauaucucaaaaauaacaguuuaauaguuugaagaaaaucagccauacauguauuuaaugauagacuuuuauagcugagauucuauuuagaauauaaaauacaccaaauaaaacaauuacagugccauuuucuauuuuccgaguguguaugguacuaacuuccagaagccucacagcagcaugcaggggagcggcugccuccaccacccacucacauacauuugagggcggagguaacugaagcuguuagacaaggagccauggucucugucauacauccacuaaguggaaggagcagacuugcagcuggauuucuuuugccacccaaugcuguucuucuagaauuuacucaccugaaaggagaaaaaaauguguauauuuaagaugccccaaaaagugaauguuaaaguaauuuggaggaagcaaaugaaugaggguuaagucgagguggagggugaagaaauauugaggaaguggagugagcagaagauuuaauggcgaagaauauauggggguugcaggaaaggggggagcuagagagaguuuaagcuaaaagcucccaggaucucugaccucugucuucuucucugccucguuucucuuuuaaagaaauucuggagaauaguuuaacaguucccacuggaugacgcagucagagcugaggugaauacuugcacuguggacccagcagccauggagucaacccugaagcucugaguaguuuccuuuguuuuguggcuaugaaccaguaucccuauuauuuaaguagaaacagcaacuuuacauuuuuacaauuuuuacuaacuuuucuguuguuucucugguaaaauuugaaaccagcauaauccauagcgaaaauagaaaaugagauaguacagaaaggccuguaaggaagggcagugcugcuccuacccuuccgcccaggcucaccuccugggccacaugcuucuaagaugcacucaucauuugagaacaguaucgacuuguccauccagcacugcugagggcugcugccagcucgccucacucuguguucuacuuuguguuuucuaaaguuaaaagcuuagugguuguuuucacugacaacuugagaaauuucauaaaugagaagaugaaaaucacguaugcuccuuccuaaaacugauuaucugacgauaugagcuauauuuuacauucacaucaagauuucccccuacccacagugaauauuaaaaccuuucuaaaucaacuacugacaagcuguaguauuagcuauggcaaaaacauucugguuuacugaacagcaugccucacguuguuucucaggcacucuuuuguuaaggaucugauguuuguccauuucuuagauuuuaaaucuaaacuguauguccccaccuuauucugcuacucuaagucuuccagaagaacacauacauaguuuuaaaacuaugauuauuaauauuuuuauuuuucccucaagccuccauuuauucuaugcuacaagaaauaugacaagccagaugcugaguucuagaaauagaaacuugacauuaagucauuguucaaugugugcagucauuagaacagucagugugcacucugucagcugccgaucaagaauagacuuccuuggaguucgcuaugcacauacuuagauuuuugguaacuuguaguuuuaguuuuuauuuuuaaaauaagguauagaccaggcuauuauagaacucacagagaucugccugccucugcaccccccucucuuucucucucugcuucucugccuccaccucugcuuccugaauaccaggauuaaaagauuaugucagcugggcauguuugugcacaccuuuaaucccagcacuuggaaggcagaggcaggcagguuucugaguucgaggccagccuggucuacagagugaguuccaggacagccaggacuauacagagaaauccggucucaaaacaaaacaaaaaacaaaacaaaacaaaaaauuaugucgccauacccagcucuuguucuaaucaucuucuuggacuguuuauuaguauuaugcauauuuacacuguuaugcaacaaauuucuagaacauuuucauccugugaacugaagcucugaacccauuaaacaauuauuuuccucccuccagccucuagccaccacuauucugcuuuuucuucuauaaccauggcuacuuuagaaacuuaacauuauuggguucuuuuuauuuuuuucccuucccucacuccuucaauugaacauugucuuuaagaaagucuaagguuuauccaguauucuaaaauagggccucagauauaauucaggaugguuuauccugccugagccccccaagugcuauguguauacuaucacauccaacuguauaguuuauuuuuuauuagauauuuucuuuauuuacauuucaaauguuauccucuuuccugauuuccccucugaaaaccaccuaccccauccucccucucccugcucaccagccuauccacuccugcuucccugcccuggcaguccccuacacugggacauugagccuucacaggaccaagggcucuccucccauugauguccaacaaggcuauucucuacuacauauguggcuggagccaugggucccuccauguguacucuuugguuggugguuuagucccugggaccucugguugguucauauuguuguucuuccuauggggcugcaaaccccuucagcuccuuugguccuuucucuaacuccuccauugggaaucccgugcucaguccagugguuggcugagagcaucuaccucuauauuuguuagucacuggcagagccucucagcagacagcuauaucagguuccugucagcaagcauuuguuggcauccacaguagugccuggguuugguaacuguauaugggauggauuccuagguagggcaaggacacaugcuccacuauguucguaacagccuuauuuauaauagccagaagcuggaaagaacccagaugucccucaacagaggaauggauacagcaaaaguguuacauuuacacaaugaaguacuacuuagcuauuaaaaacaaugaauucaugaaaaucuuaggcaaauggauggaacuagaaaauaucauccugagugagguaacccagucacaaaagaacagacaugguauaaacucacugauaaguggauauuaguccagaagcuuggaaugcccaagauacaauucacagaccacaugaagcucaagaagaaggaagaccaaaguguggauacuuagguccuucuuagaagggggaacaaaauacccaugggaggagauacagagacaaaguguggaacagaaacugaaggaaaggccauccagagacugugccaacuguauauuuuaauugcauuuauuuauuuggguggugugcaucuuuaugcacacaccuuagugcacauauggagcucagagaacaacuuguggaagucaguucucuccauccaccauaaguuccaggaaucaaccccaggucaucaggguuaaagacauggaccuuuaccuucugagccauauuguuugccccuugguauguuuguuuagucagcaaagaauuugacauuuugagaucuagcugucauaauuugcauucauucuguucacaguucuuugugaaucacuuugaauaguuaccaaauuuuaaacuuccaaaaaauauacaugugaauuuuguauauuugugaacaauuuuaucuauuacuuccuuguuuggggaauucauagaugagaaguguuaacaguaagcugguuaggguucucuuagccagguagucaagaaggagcucuucagcggccagccuuugggaacuuuuguuucuauggauucugacagcuuccauuggaagccacaugcauagaacagcagcucuuugggaccaucuuguauuacaauuuuuauucagguuuugggccucaggaccguaccucuacagguauuacaguuaggaagucaggguugcucagcccuuaaccacagccaauguuguggcucuaaugccaaccugggaaauuagaauucuuuugcccuuaaaacgagccaguauuauugcauuguuggccaaagaaucuaagaugcugccuugccaucuucucagcuugaccacugucucagcuguagcugccauucuguucugcuauuuuguucuuuaugguaccagcccaggaugcacugcugauagcaaggaaagacugcuggaguagaguuggucucugucuugcaagaccagaggauacagcacaggagacuuguguucuagcuaacuuaauuaacugaacccaagaagccugcagacagccaaagaaaggguguuuggauaaagcauagaauauuuuacacgcaauuaagguuuguguuugcaccgaucacagucuugccuguuuagcagcaucaaucacagcagucccucuacuaaaccacuaggggaagucaucccccucuggccuaagugcaaauaguugcagucagcuagaguuaauggaggcuuugguagcaaaaagggugcuacagaccauuugaaauacccuuagcugacacugcauuuucagaagccaggagagucugcugaaucauuacacaguuguuucaaggugucaguggaauguucagugcacccagugauggcaaaaggaucuaccauugacugaaucagucaaagaauccuauagcugccacuuaaggaguuaaauuguccagcccccaaagucuuaacuuuuuuuuuauuagguauuuuccucauuuacauuuccaaugguauuccaaaagucccccauacccuccucccaacucccguaccuacccacucccacuuuuuggcccugguguuccccuguacuggggcauauaaaguuugcaaguccauuggcccucucuuuccagugauggccaacuaggccaucuuuugauacauaugcagcuagagucaagagcuccgggguacuggcuaguucauaauguuguuccaccuauaggguugcagaucccuuuagcuccuuggguauuuucucuagcuccuccauugggggcccugugauccauccaauagcugacuguaagcauccacuuacguguuugcuaggcucuggcguagcuauaucaggguccuaucagcaaaaucuugcuaguguaugcaauggugucagcguuuggaggcugauuauuggauagaucccuggauauggcagucucuagaugguccauccuuuugucccagcuccaaacuuugucucuguaacuccuuccauagguguuuuguucccaauucuaagaaggggccaaguguccacacuuuggucuucauucuuccugaguuucauguguuuugcaaauuguagcuuauaucuuggguauucuaaguuucugggcuaauauccacuuaucagugaguacauaucauuugaguucuuuugugauuggguuaccucacucaggauaaugcccuccagguccauccauuugccuaggaauuucauaaauucauucuuuuuaauagcugaguaguacuccauuguguaaauguaccacauuuuuuguauccauuccucuguugaggggcaucugaguucuuuccagcuucuggcuauuauaaauaaggcugcuaugaacauaguggagcauguuucuuucuuacuaguugaaacaucuucuggauauaugcccaggagagguauugugggauccuccgguaguacaauguucaauuuccuaagaaaccgccagacugguuuccagagugguuguacaagccugcaaucccaccaacaauggaggaguguuccucuuucuccacauccuugacagcaucugcuguugccugaauuuuugaucuuaaccauucugacuggugugagauggaaucucaggguuguuuugauuugcauuucccugaugauuaaggaugcugaacauuuuuucagguguuucucagccauucgguauuccucaggugagaauucuuuguuuagcucugagccccauuuuuuaaugggguuauuugauuuucuggaguccaccuucuugaguucuuuauauauauuggauauuaguccucuaucugauuuaggauagguaaaaauccuuuccccaucuguugguggccuuuuugucuuauugacggugucuuuugccuuacagaagcuuugcaguuucaugagguuccauuugucaauucucgaucuuauagcacaagccauugcuguucuauucaggaauuuuuccccugugcucauaucuucgaggcuuuuccccacuuucuccucuaugaguuucagugucuuugguuuuauguggaguuccuugauccacuuagauuugaccuuaguacaaggagauaggaauggaucaauucgcauucuucuacaugauaaccaccaguugugccagcaccauuuguugaaaaugcugucuuuuuuccacaggaugguuuuagcucccuugucaaagaucaaaugaccauaaguguguggguucauuucugggucuucaauucuauuccauuggucuacuugucugucgcuauaccaguaccaugccguuuuuaucacaauugcucuguaguaaagcuuuaggucaggcauggugauuccaccagagguucuuuuauccuugagaagaguuuuugcucuccuagguuuuuuuguuauuccagaugaaauuuuaacuucuuaagaacaaaugaacaucagaaaguguguuuacagaaagaauuuauaauuaagagugggguugguaaaauggcucagcacauaaaaagcucuugucuuuagccuguauacaugaauucaauccuugggacccacauggauaaaggacagaaccuacuccugcaggauguccucugcacuugggcagauuguguacauacauacauacauagagaauuuuuuaaaucauuuauuuuaacacaugcuaacaguaauacucaccaccuguccauugucccaggaagaugaagccuccuuaucuguuucacagaccauggguuugaucuucccuggagggaaaacuaaaagggucuucaguagggaaauacauagaaacagaaaacugugauaguaaguaccaaggaggucugagcaggugucagugggauauuauagacaggguagaauccaugucuaccugggaacaugacagucaccacuguaguuccauuuugucccucuuaaaaagucuaucagagggcuagagagaugacucagcgguuaagaacacugacugcugcuggacaugguggcgcaugucuuuaaucccagcacuugggaggcagagccaggcggauuugaguucgaggcaagccuggucuacagagugaguuccagggcagccaggacuacauagagaaacccugucucgaaaaaaaaacaaaacaaaacaaacaaaaaaaagaacacugacuacucuuccaaggguccugaguacaaaucccagcaaccacauugugguucaucaccauccuuaaugagaucugaugccuucuucuggugugucugaagacaacuacaguguacuuauuaaugauaauaaauaaauuuuugggccgaagugagcggggccgaccagagcaagcagagguccuaaaaaaauucaauuccuagcaaccacacaaccaucuguacagcuacaguguacucauauuagauagauagauagauagauagauagauagauagauagauagauagauagauagauaaguagauaagaaagcaggcugggcaagccaguaagcagcaccccuccauggcuucugcauuuaaaaaagaaaaaauguaucagagacgggagcacugaaaguaugcuuuaaaaagaaaacagcauuugaaagucacagaacuauggcauauuaagauauauuuggggaauuauuaguagcaauagcuagagcaaagaauguuguaggaaaauucugaagaaaucuggcaggacuuuguaugccaggccccuaaaauuuuauucuagaggcagaggggccagggaagcaauaggguuuaauccuuauuccugaaugcccaggcuggcucuguagggcuggaaaaagaaugggagagacaacagcagaagacuuggaagugauccuggcaugaauguagacuuggaaacucucagaguuuaacauugaagcacugaaguguagguagaaguugggugaagcaaaugccagcggcaguguuguuucuuuuaccugucccgugcacugucauacaaauccuuucagcccccaaacuaaucugaccugguguaaagcaacuuugagauauguauuaggaaaauagcaguuuugacagacagagagagcaccuggcauaaaaccaauuuacagcucuuuugggggggugagaugggguggggaugggggcuccugugagcaacaggaagucaauagagccaucugcaaacaagcuucauaagcaauggacaauuuccauuacaacuccauuucucagagugccauuugucacaaguuuuauuucucuguucuuuauuuaaaaguaacugucucauauuuaaaugaaauuuuaacauuaaaauauagcagcuuucgaguucuuuuuucuuucacagguucagaguuguacuguugauuuuuuuuuuuuuuggcauaaugauauucuauucauucaguuguguugucuuccuuugagcuccacuggggaacgcuguguccaaaaaacaaaaacucguguuuccuccuccuggaaggagauucucauggaacuugagaguuuguuacauugguggugcccucggcccuuuuuagcgaggcuggcaguauucaucacucacugacugccccugcaaacaucugugucaugcaucaucaccuucugcugugucaauugcuuauauuucauucuuugcauuacuagaaagcuucacacaugauuccuguaauuccuuuaauguucucagcagugugcagauaugcugaaauaaguguguguguguguguguguguguguguguguguguguguguguguguguguguguguuccuaugcaagccagggaucaggaaagucaauacauuccagugacccacgaagguagaaagacacuaauacacuagaccccguaguuucucaucucacuguaaaggagugaccagugcagcagcauucccuggucugcagcuggcugcaugugcccagaacacagucaucaaauccucuuuaucaugucaauuugccucaguuguguccaggaagaccaagguauuggauuuacucccuuguucauaguaguaaauccugcacuucuuuuccuccaagcuacaugagaagaagcauaaaaccgugcuagcaugcagcugcucuuugacuuagcaucuucaguaaaacuguagagcaaaaacagcaugaauacuugguucuagcuggaaacugggauuuuugucuuuaaaggaguucuuuugcuucuaagaaacauaguucucuuuguuuuagcugcuuuuaagaauuuuauucaaagaguugaaaauauacaagacagcuuggugauuacucuuuguccucaaguuguaaguccuuaaaauucaacaaacacaugaccuuuacaacagguuauuucuccuguuuuccucaaaacuagugcuuuuacugaucuugguuugagauauaaucaacuuaugugauauuggcuguccuguggucucuuuaccgaguauacuuuggcggguuggucugcaggacuaaauggggaaguggauauauggaaauugcuuucuacugugggacguuagcgaagagugggagcauagagauguaccucagcaccauaguaaccuacgcacauggaccuuuuguugaacacagcacgucacacagggguaaaaggaacagucucgggcaagugcaggacagcccugagaaacaguacuugcuuaaggcccguuguauuuuuaaguagucucggggauguccagguguccugauuuaaaggcaccacuuuuuaaaucaggaaacugugucuuguucugaggucugauguaauaaaauacauauuccuaggggauaguacggcuggacccaugaaccauguuacagccagugauuuauucacaguguuaaccacaguuaauggcaaauauguaagccacacauggucucaggguggccuuuuaacuggagcacagucauagauccauggaguaggacaaaggcagaacaguuuguguccugucuagaaaagcucuccuucugcugugcgacucaguaguaguuacucguauccagcauucucucuggagcucagccacgggcuguugaugucuuguuuuuguuuacccauucuuuacuucauugcucacagugccaaauccugcucuaagaugucuacuauuuucacucauuucuuuucuugcauugaauuuuauaaaguaaaauugacuuuggucuuuuagauguuaaccauaugauuuuaaacaguuuuuauacuuuagugagcuacuaaguugguauccuaauuugcuucacuauugcugugacaaaacacugaccaaaaccaacuuggggaggaauuaauuuauuagguuugcagggaagaacugaggcagagccacagcgcagcaaugcuuacaagccucuucccuuacggcccaggcccaccugcccagggccagcaccacccacaaugggcuuggcccucccauguuaaucagcagucaagaaaaugcccaacagacaugcucauuaggcuagucugauggaggcaguucuucuguugagauuuccucuccccagcuuuguugagguuugugucaaauuggcaaaaucgaugacagcuacggaucauucuuccucuuucuugucucuguuaaaauugccaggaccauaucuccguaagaaucuaacucccccagcuucaguguauuacagagaacuaacaaggagguucuuuuagagcuguacuuaccauuuguacggaauauucagauuucaagccaaaauguacauguacuuuauucaggugucacguuuccuuggcccguauuuccaugauuuaguagaguuuaaagagguguuuguuuguuuguuuguuuacuuauuuugcacaccaguuguucguuagauacaucuuuugcaaauauauucuucuauucuguugccuauucucuugauuuuugaaaaauuuaaaauacuuuuaaaauaaucuuagauacuauucucuaauaaaauuucagaauacaaagauuuuuauaugauuaaacagcuuaagauccuuguuuucauggaaggacauuauaaaguaaaaacuuuagauauacauggcuaaccugaugaauaagagaggauuuauuuucuaauuuugcuuuauaagcgucacuaauagcuaauuuagcaggagagagccagccccuaugcaccuccaugguuuaacaguuccuauauaaaccauaauuagaagggucuguacuccauuagaccucguguuuuaacccagcauugucuguugaagcuugcuaucuauccaucccagaccuucaaaagucucaggacuugccagccccuugcucaccaggaucuuuuagaacucaccagacuucaggguaacauucaagauucauuccacauuuagcuuucuuggugcuuguagccauggccacagagaaagcauuuaggaaaaagaaaggaaauguguacugaacugagcugaaccagcagaugggacaggggucagaagacugucauuguaaguacaaggauaaaauaguuuccuuugagaaaggaagaggcagcauguaucuguggaacacugaaaauguucaaauaacuggagcucuugacuggaaaaguuauacaggaaacagcaguuugaaugucaucguaucuuuuucauagaaugguaagguuuacaguuaggauguucuuaaaauucaucuuauuaauccauaaaacaucaaauugaagucuaucaguaaaucucaaauacuuuuuuguugucacagucuuaacucuucagcaagugccuuauagucugauucagggaugcauaucucucaucccagacuacuuaggaaagcaaggcaggggagcauuucaguaguucacugcaggcagcaggcugagauaccaucucaagagagacaggaaaaaagacaggucccuaaguguauucauacaaguccauaguggccuuggaaauuuaaaaaguaauauuccuaauuaaaaagugucucuuuuuuuaaagcauaacacuugcuuuuccuuacucuuuguguuguuuucucucugcuucuuucacaauuccuacaaaucucucucucucucucucucucucucucucucucucucucucucucucucucucucucucucucucgguuuuucaagacaggguuucucuguguagcccuggcuguccuggaacucacuuuguagaccaggcuggucucgaacucagaaaucugccugcuucugccucccaagugcugggcaugugccaccaugccuggcacaaauaacucuuuguuguaacgcauguuuauaguagaauauaggacuguuguaaacuugagauaccuuuucuucuuugcauaagaguuuuuaaugguuuacuuuuauuguuauacuauauauauauauauacauacauaaauauauauauugcaaauaugugcucacaugugaaaagaggccagagucaucagacccccuggagcaggaguuacaggcaguuaguuguaagccacccagcacuggugcugggaaccaaacucagguccucugcaggagcagugugugcccuuaaccuugagacacuaucucuccgaccucagaauguugccucuuuuguuuuuuuaaguuguuguuuaguguuuuguuaguguuguguuugugugugugugugguauuggugccaugguacuuauauagaggucauaggacaauuagugggaaguccguucuuucuuugcaccauauccugggaaacaacuugauaccaaacacauuuacacacugggccauuucacuggcccuuaaaauguaguuuuaaguauuauuuaagcauuauguucaaucuaaucucuugguucucauuguaauaaaaaucgcagggcaugaaaaguaaucuacuuuucuuaccuagaagcauguuuagguaauaaaaacaauauauuuuauaaauuaagaaaucaggaggcuuuacuauauuugcaggcacuuucaauaauuuuagcacaauuaaaaagaauccacguaugguggcccaugccaguaggacaugcucaaaaggcagaggcaguagaaucauggauaugaggucagacuuggcuauacauugucuuuucugccuuuaacauuaauaaaaaggaauuuuuuaaaguuauccugaauuccucuauacuuauuuaaaaaguaaaaaaaauguucauuuucuaaauuauauauggaauuugacaagcagcuucgagcauaugagagggaucagggcuugcugaucaagcugcauccuccucaaccacggcagcagaggugcucacucuagaugcuaacgggcguguucaggagaagcugaggaaaccucgagguugcuaaaagcaaacacuaugauucuucuuccuauccuaaugagucagcaauuugucauucaucugcaucaguuugcuagcaggacaauguacuacaaguucaaagguuaguugucggguaugucgggcgucugaggagauggaaacgugcggagcugaaccugugacccaaaccugaggcagugcccgcuggagaacaggcaagggcguguccucagaagauggcguggacagcuggugugagugugccauccauccaggguugggaaggguugaguaaacagugggacagugacagaguacagggauuaauggcugaaagcauucagugauucuuaaaacagacauugaaguaaauggaggcauucugaagcuuuaguucugaggaacgauauaagaaaacuuuccuuuccuuuggaaacaaacuuccugcagaaagaggacaagauaaauggagcuugcagccucaagugcacuuuauauugaagagacaugaacucacauggaggaguguaugcugccauuucuuauagauguuaagcuaucagugaggcagagaauaaauauuguuagaaaagaacacuaaaaugaaagaaaauuguagugagcuguagugccacucacgaagguuuaucucaugaagcguauacuuauaagccucccugccccaaggcuccagugcagcgggaagacguaauaauucagcgggcgcuugaccagauuugacuaaaaucaccaguaaaaacucacccacucucucucucucucucucucucucucucucucucucucucucucucucucucucucucucucucucucuuucucucucucucucucucuucccccccuccccguguguguguaacugguucugguuuuccaccaugagucauggauaucaaaaucaaguccacacacuuggcaacaaguacccuuauccacugagcuaccucacagauccucaagcugcuauaaagucagacacauaaaaagcagaggggaccucaugcccuuucuuuucuuuucuuuucuuuccuuuccuuuccuuuccuuuccuuuccuuuccuuuccuuuccuuuccuuuccuuuccuuuucuuuucuuuucuuuucuuuuuuugacaggguuucucuauauagcccuggcuguccuggaacucacuuuguagaucaggcuggucuugaacucagaaauccaccugccucugccucccaagugcugggauuaaagguguguaccaccaugcccggcucucaugccuuuucauacagcugcauacacaccaucuacuguaggaguacuaggauugcuggugugugccacuacauccagcuucuuuauggcacuugcaggggucgaaugagucaucaugcuugugagauaagaagccucuuacucacugagcuguauguguggcccucuucuaaucucuggacuucaguuauacuuugcauucuucuacauagagucuuuccacagacuguuguagauuccccagacuaaagcugucauaaaauauuuuaccagcuuaccuaccauaauugaggcacuagguucaaccaccgcacuuuagaaagcaaguaaaauauuuuauuaaaggcaagguauauguucacugcuuugacaaaacaguagagugcauuagauguauauuuaugucuccuucaggugagaaugcagacugguauaauuuccugagguugccagggcuucagagucccuggagugacuccauaacauugucacugcaaacacaggaugcggaguacuagggccgcuucucuguguuuucugugaacaacuaugaacuugguccuuuucccugcuguuugcucugcaggaccucaugugaaguaaaggugcuccuggaagggaugguagccagugauuuaggaguaggugcuuccccugccuagcagcuaacauggaugcucugcacuucagccaguagggaauggagaagaggaagguacacaauuucaccacuaagugcuuugaucaguucuuuucaaagaaaagaugcuuacagaucaggaacaaaaucuggacccuuagucagcaaaagaaauaguuuccuuugagaaaggaagaggcagcguguaucuguggaacacugaaaauguucaaauaacuggagcucuugacuggaaaaguuauacaggaaacagcaguuugaaugucaucguaucuuuuucauagaaugguaagguuuacaguuaggacguucuuaaaauucaucuuauuaauccauaaaacaucaaauugaagucuaucaguaaaucucaaauacuuuuuuguugucacagucuuaacucuucagcaagugccuuauagucugauucagggauguauaucucucaucccagucuacuuaggaaagcaaggcaggggagcauuucaguaguucauacuugagauaguagauacuaucucaagagagacaggaaaaagaaaagaugcuuacagauaaggaacaagaucuggacccuuagucagcaaaagaaaucaaugauaaaacauuguuucugaauguucuguugcucugauguagucauaaggauugagcggcuuagguguaagguauuaaaacuauuuucuuuuagaaagaauggaaauucaauauccaacugagacucaaaauauguaccaaaacaguuuuacacauaauccucuagagcugauaucgguaaauauacauguaauaucuuucuuggaauguuuucagaaccaguuuaaaagaugcccuaaaagaauauguauuuguuucucacuaugaucugaaaaucuguccuccugauucauucugugagccacacuuaacaaaauucuuuuuaacaauaauaauauuuggaggcucaauauauagcccgcaugucuaaggccauagguuugaucucuaguacuguauuuccuaugcacauguaacacauauauguauccagaucuuuaacgaauauaacagugggagacuucaauaccccacuugccccaauggacagucauugaaacagaaaguaaacagagacacagugaaacuaaaggaaguuaggaaccaaauggauuuaacagauaucuauagaacauuuuacccuaaaacaaaagaaugcaucuucuucucagcaccucaugguaccuucuccaaaauugaccauauaauucuucacaaaacaacccucaucugauacaagaagauugaaauaaucccaugcauccuaucagauuaccaugcccuaaggcuggucuucaauaacagcaaaaacaauagaaagcccacauacacauggaagcugaacaaugguaacuuggucaaggaagaaauaaagaaaggaauuaaagauuucuggcauuuaaugaaaauguugacccaucaaagccaaacuuaugggacacaaugaaagcagugcuaagaggaaaauucauaagugcccugguaaagaaacuggagagaucuuacacaaacaacuuaacagcacaccugagagcucuagaacaaaaagaagcaaacccacccaagagaaguagaaggcagaaaauagucaaacucaggcugaaaucaaccaaauagaaacaaagagaaccauacaaagaauaaaaaaaaaaaaaaaaaaaaaaaaaagcugguucuuugagagaaucaacaagauagauaaaccccuagccaaacuaacuaaaaggcccagaggcaauauccaaauuaacaaaauuagaaauaaaaaggaagacauaacaacagaaauggagggaauucaaaaaaaucauuaggucauacuauaaaagccuguacucaacaaacuggaaaaucuagaugaaauggaugguuuucuagauagauacuacauaccauuguuaaaucaagagcaaguaaacuaucuauacaggcccauaucgcacaaggaaauagaagucauuaaaaaccuucuaaccaaaaaaagaucagggccagauggauuuagugcagaauucuaccagacuuucaaagaaaaccugauaccaauauuccucaaacuauuccauaaaaagaaacagaaggaacacuaccuucaugucuuccacuauguucauaguggccuuauuugugauagccagaagcuggaaacaacccagaugucccaugacagaagaauggauacagaaaaugugguucauuuacacaauggaauucuguucagcuauuaauaaugaggacauucugaguuuugcagucaaauggauggaacuagaaaauauucugagugugguaacucagacccaaaagaacaugcaugguauguacucacuaauaaguggauauuagcccccccccccaaaaaaaaaauacagaauacccaauauacaguccacagaacucaagaaggucaagaagcugaagugcccaaguuaggacucuucagucucacuugggagggagaagaaaacaaucacaaguggggagggagggagagaccugggagggaaaguggauggggugggggggagugaggggaagaagggaacaugaucugguauugggugagggaaaaggacugaagcccugagggccagcagaaagaauaaaacgggcaaccucaguagauaggacuuuggggggacccuccagaauguaccaaagaccagaagugagagacucaggacucaaagggagggaccuuagaugaaaugcccaacaguagggauagggaauuuauagagccuaccuccagcaggaagacugggcaucaaaugggggggggggggaggcacggcaucccacaguuauaacucugacccauaauuguuccugaaagaacuacagggauggaaauggagaggagccugaggaaaagaagguccagcgacagguugaaagaacucaaggggaagucccagggccugacacuauuacugaggcuauggagugcucauaaaaagggaccuagcaugaucacacuccagaagacccaacaagcagcugaaagagucaaaugcagauauuugcacccaaccaauggacagaagcagcugaccccuaugguugaauuagggaaagggugaaagaagcugaggaaaaaggcgauccaguaggaggaccagcagucucaaucuggacccccgagaucucucaaacacuggaccaccaaacaggcagcauacaccagcuguuaaugaggaccccaacacacauacagcagaggacuuccuggucuguguucagucagagaugaggcaccuaacccucaagagacugguggccccaaggaguuuagaggguggggggugagggggguggggacauccucauggaaacaggaggguggggaagagguaugggauguggaacauucagaggguggacugugggcagagaggaaauaaagucugaaucguaaaaaaguaaauaauaauauuuuuuuaaaaaaagagcaucuugaaaaggggggcagagaauauaauaaauaggcugggcaugguugugcaugccucucaucccaguacucaggagagagaggcagucagaucucucugaguucaaggccagccuggccuacaaaucaagucuaggacagccaguucuuauuacacagagaaaaucugucuacaccccacacccucccccccacacacacacagaggcuuugaagcugauuuuguaagcaccuuuaguauaacuuuauuguuucuuuuuuuuccauuuuuuauuagguauuuagcucauuuacauuuccaaugcuauaccaaaagucccccauacccacccacccccacuccccuacccacccacucccccuuuuuggcccuggcguuccccuguacuggggcauauaaaguuugcaaguccaaugggccucucuuuccagugauggccgacuaggccaucuuuugauacauaugcagcuagagucaagagcuccgcgguacugguuaguucauaauguuguuccaccuauaggguugcagaucccuuuaacuccuuggguucuuucucuagcuccuccauugggagcccugugauccauccauuagcugacugugagcauccacuucuguguuugcuaggccccggcauagucucacaagagacagcuacaucuggguccuuucgauaaaaucuugcuaguguaugcaauggugucagcguuuggaugcugauuaugggguggaucccuggauauggcagucucuacaugguccauccuuucaucucagcuccaaacuuugucucuguaacuccuuccauggguguuuuguucccaauucuaaggaggggcauaguguccacacuucagucuucauucuucuugaguuucauguguuuagcaaauuguaucuuauaucuugggaauccuagguuuggggcuaauauccacuuaucagugaguacauauugugugaguuccuuugugaauguguuaccucacucaggaugaugcccuccagguccauccauuugccuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaagauaguggagcauguguccuucuuaccaguuggggcaucuucuggauauaugcccaggagagguauugcuggauccucugguaguacuauguccaauuuucugaggagccgccagacugauuuccagagugguuguacaagccugcaaucccaccaacaauggaggaguguuccucuuucuccacauccaugccagcaucugcugucaccugaauuuuugaucuuagacauucugacuggugugagauggaaucucaggguuguuuugauuugcauuucccugaugauuaaggaugcugaacuuuuuuucagguguuucucagccauucgguauuccucaggugagaauucuuuguucaguucugagccccauuuuuuaaugggguuauucgauuuucugaaguccaccuucuugaguucuuuauauauguuggauacuaguccccuaucugauuuaggauagguaaagauccuuucccaaucuguugguggucuuuuugucuuauugacggugucuuuugccuuauuguuucuuucaaauaaauguuuuauauaacaaugaauuuucuuuaagcuuaccuuacuuaaagaauaaauagcuguauuucacaaaagaaggaaaguuaauaacuuuugcuaaauuaauuguuaagcaaauaucucuguauacuaauaaaaugaagcuuucauuaauuccagaauugaguucauguacuguuguacaaggcaguguagucguggaauacagaucacuacugcuaugugugauaacugcuucacagaguugaggguggggagccucaaaguaaguagagaugcuggaaucguuagggaguuaccucagcaggccuuucacaaagguuaaacagguuaaugugucuugcauacacugagaccucugcagagaagggaggaaauuauaguugaguggacaucuucagggcaugagauagaagaacaaaacagauaucccagaaaucgccuauaaucucuggauagcuagugaguuaaauaauaaggcaacagaaucaaagugcauguaauccauuaauaagagaauguggauuuccuauuuaauauggguuguugacaauuaaccuaugccucuucacccaugguauuagcaugguauugcucauggagccugaccucagggccuugaguuccaccacugaauuaaauccuuugaaaagguuuaagacaaggcaaggauguguaagccacagcaacagcuuuaaacuuggugggaucacccuugcugcucuccuggaacaucugacaggaaggacugauuacacggugagcuuaccccaugguauuagcaugcuaagccacuggccuccuucuuucaucugaucuuuuccccaaaagcuuucaggauuguggaguauauuguauauaauucugcagcuauccaacuuggaauucauacuuggacaaggaggggaugguaaacauuguugguuaugcuccuuaauucaugucccguguacuucagugugcuucuguggaacacacacaugcuuagcacucccgccaagucacuguuucagucuugguugcaguuucuuacuuacuggugcuggaaggccaauguguuaaagauuccgaaaucaucaaaggaugcucagcuuucuuugccuuugauauuugucucugguuucugaaauuugcccagaauggggaaaggaacagaggggaggucuuacuauuuccuggagcucacaugccacaguagugcacaucuugauuccauuagucuaugcaggucaaagagcaaguucagcugguguaguuuacagcaccagggacagagugacuagccacuuuaaugacuugccuuucugcugcaacuuacucaggaaauagggguugcuaaccacugaaauguuuguauccaugguugauggggugggguguuuguuuguuaacugaggaauagacucagaauagggagagugacucggcaggaagugcgcugacauuuuguccucugauccucuggggguucucccuugugucuuccuaguugcucucuuggggcucuccaggcaaacagugaggcugcuugugcuagcaggacuccaucugggggcagccucuagucgggagcacucuguugugaucaacuucugauuucuguaucuuuuccuaaaaaugaucacuucugacuuuuuuuauauucuuuucuguuucucuguuuucaucagaaaaauaguacuuuuaucaaaaaguaucuucuuacaaagacuguuuucaauagacaacaacuaaacccaguuucuuucacaacuuaacuguuuuguuucauucugauuuuuugccucugaaaacacaacauuuuaaacaaguuucaacuuuuucacagugggucuaauaagcaccuaauaaccagcucaccguguaaucaguccuuccugucagauguuccaggagagcagcaagggugaucccaccaaguuuaaagcuguugcuguggcuuacacaucccugccuugucuuaaaccuuuucaaaggauuuaacucagugguggaacucaaggcccugaggucagucuccaugagcaaagaagagggagaagcuccacaguguuuucaaggcgguucgcccaaagagauccaguuugcuccacacccaguauguguacuagcaagaggacaagcuugcaaaagagacuuuauucagcaacagucaacugugaggagccaggacaucucuccugccuccccaggacuaguaaagggagagcugugggacauagaugauaaguguaacucuccaugcuagaccugagcauagggcuuuuguccuaccagaucuugcaaggaacccaaguaaaggcuuaguaguuccagguaguuuuaaccauugcuaaauaucugaaaaccuugggaaugcauacagcagagguacuagcuacagcaaagcaguagagguguauugcugugcuucacuauauaacaucuaaaacauaacgagagugcaaagucucagguuugggcucaagagaaccccgaggcagauuguucauguaaauaagagcuugguuuauuacaagaguuauuaacaagacaggcauggcaaagguccugaggaaagcugaggcccaaaggacaaagugagguugccuucuuacaggaaagggagaguuuguaugccaggggguugaugaguccauaguaaaugcuugcaagucaggcagucucugauucccagauggcaaugggagaggauuguuucuugcauucugaggaaagaaugugucaccuuuaggguguggagaacaugaggauaaggcacccauuugguuagugugcaucuauuauauuagguguuuaggaguuggguaacucauagcuuggaaugugcuagccuagagucugucugcagaaucagcugucaggauggggagagacaccacucacucaggugugaccugagcagcaucuggaguggaucccggugaaaagcaagagaggcuccagagccuuaugcauguuuucuuugggcauuaauaguauccauugcaaauuuauuaaaauuauaacauauccaagagaacaauacugucucuaucccuaacuguccaagcauaccguuuauguaagaauuggaacucgaucaaaacacuucaacaauguggaauaauuucaccuuuucacacugugcuguucuucuuuuuuuauuacccccucgugaguauguguacaugcacacaugcacaguguagaggcuagaaacuagacaucucuccccuucuacuguagucaguuuucuccuuccaccaucaagcucaggucagcaggcuugccaccccaugagcauuuuuuauaauacaaaacucaaaucccugucauauuugaauuuguaucuaauaaagauacugauggugcuauauaauuauauugcuuauauuaauuccucauuuccuuuuuggcuaauaccaacugugacucuuacaaucaguacagacaugcagcacccucauugagagugcacgcuucucauuccacaucuuauguccugaaaggacccugaugacaaccaauaggaaguguacaguacacaguugauccagcuugaacuccuucaguuaugagggcauuucaccacuuaaaauauguguuucaaaugaugagcugauguauuuagaccaucuugauugcuuuggugcuaacuagagccuggauguauaagccaccugccauuuuucugaguuccacaguguuaagacagcagaacgugauacuaggauccaugaggaucuucucuucucuuccagcaacaaaaacuaguuaaacgaauuuuuauuuucauauuguaagcuggucuguggcucacauuuguuaguauuacuuguucagaguuuaguacaucuacucauccaaaauuaaaucucagaauauuuaaaugauagucuuccaguuuguggcuucacuaaacuuuuccguaugacugcaguugaagcucaauuaucuuaacaaaagucagaaggaaagcuaagcuucagcagcgcucagagucagcauuuccugggucaaaaccuaauagcuacuucauguaguagcucagaucuguccccuuccacgacagaugaccuaggggagauggguuugggccuguagacaguuucuucacccaguccauuccguuuauuugugaguuccuuucauguaccuccuugaucuuuacuuuuuguacauagacuagaauacuuagcagacugugguaaagaguagggugaaaagugaggucagaauuagcacaguauuaaaguuugcacagcgaaacugaaagcucucaucaaagcggacauguaacgccaagcacagaauaaguuuauuauauguaaaugaucccaaaauccaagacuauaaaagcgucaaugcuugguguacagcuugccguugagccucagcccuuuucaccagcucuggccuacuuucauuuuuagaaauguuuucuuucuugauaaacuguagcugcuucuaccacuucccuugugucccugauccaguuccucauuauaagaaaucccaauggguauauccacugaaccccaauaucugccuguaacuaaaccagugguaaucugagacauuuaacuuauuguuucaaaguauauauaaagaucauuaccaauaagucacaccccuaaauuuauuugcauuaauaagaucaaacauuuacugauauucagcaugcccuaggaacaaauggcuauguuucuaaguccacuuucuugaaguuagcaaaucaggacugugacagcacgguucaguacaguaggugaaggcauuuguacccaagccugacaaccuaguucaguucccauguugcaaagaaaaagaaagaaagaauaaucuccaugucccacaaaggaacacaguaacaaagcagacguagcuuggcaaggcaguuccuucuguaaaaacagugcagcaagacucaaaccaagcuggcacccaccaggacaggacguugccuugauuugucuucuaacacagguagggacuguuuccuuuucuccauugacugagcuucagccucacagucuuugcuguugguuaguuuuaaaagaaucagcaugaaggaaagaaguagggguuaagauuugaauaaaagcuaggggagauuuauggauuauuggcccugggugggcaaguuaccuuuaauagaaaaaaaugguuuucauacccaaaacuccacaugaacagagagaacagacucuguuuuugagacgaucucacuguguggcccuugauugcuugggacuuacuauguagaccaggugggucucgaauucagagauuggcuugacucugccccucgagugcuaggauuauuaaagacaagugucaccauuccuggccuuauuuuacuuuuuaauuaaaaaauaaaaauauaaaauaaagaguuccuacauagaguuguagcuaaauuugaaaaauagaguuagugacauuuuuguuuaguugguacaauuuugucucauauaugcuuuaacuacuuaauuccuccugcugaugaguacuauguauguaucagacuaugaaggauggaccaucuagagacugccauauccagggauccaucccauaauuagccuccaaacgaugacaccguugcauacacuagcaagauuuugcugaaaggacccugauauagcugucucuugugagacuaggccggggccuagcaaacacagaaguggaugcucacagucagcuauuggauggaucacagggcccccaauggaggagcuagagaaaguacccaaggagcuaaagggaucugcaacccuguagguggaacaacauuaugaacuaaccagugccccggagcucuugacucuagcugcauauguaucaaaagauggccugguaagccaucacuggaaagagaggcccauuggacacgcaaacuuuauaugccccaguacaggggaacgccagggccaaaaagugggaauggguggguaggggagugggcgggggaggguaugggggacuuuugggauagcauuggaaauguaauugaggaaaauacguaauaaaaaaauauauaaaauuaaaaaaaaaaaagauacuggucacacucagaagccagauuccaucaaggaaaucaggccacacaucacacauacuccugcagagacagacagacagacagacagacagagaguguuuauauacuuuuuaccccaaucccaacagaguuaagaagcuguccuaugcugugguuuuuauaguucccaacuuuaaguucuacucaguacuuggcuccuucaugcucuuugucaagugaacaauguugaacuaaaucacaugguaugaacuuccugccaccccguaaaaugauauaaaacucaguuauuuuccuuuguucuccagauuuuucuuuguagaacuacaaaaaaaguguuucagugcucaugugguuuuuuucuuccccuuucaggcaagaagcucuucuggcugcuauaagugaaaaggaugcuaacauagcucuucuagagcuuuccuccucaaagaaaaagacccaagaagaaguggcugcacugaaacgggaaaaggaccgccuggugcagcagcucaaacagcagguauugggugugcccaaggauagcagagacaggccgaagaggcccaguccucagcccuuucagacaugucugccauuucaaagauguuuuaguacccuguguuucaugacagauauuaaauacaaaauauuuucauaauuagacacauaacaggucucuggcuauaucuuaaaaaaaaaaaaaaaaaaaaaaccacagaauucucaauuggacuaggaagaccuuacaggucucaagguuuuuaaaaaacauuauaaagucacacuggucagucuuuuauucauacucacacuugacuacuuauuauguugaacauuuacuuccucuguauuugcaacuuuuggggguucaguuugcuuucauuuuauugagacgggucuugcuauguaggucuggcugacccaguacucauuuuggaaucuagguuggccuugaauucaugacagucccccugccuaaacuuacccagugcugggauuagaaguaugcaccaguguguccagauguaucuaaaacauuuuugucauaguuucuaacaagaggacuuaauauuaccaguaaaauucuguuucacugguggucaaaucagagcauuaauggacucagaacagauuagccccaagugucagaggucaggagaauccuagcuuuccuccagccuacgcugccagaucagagucagcuuccacucuauggcuugcuaauccgacucucagacuucucagcaccccucucucuaggaacucucuucccuguaucacacucuuuacuguagucaacagaucuuucuagacgcucaucugacccaaguauuaguaaaugcuaacuauauagcaagaccucuccugaaaacuugcauuacaagauaauuuguuuuauccagcauucuugauauuucaucacacaagaguuuucaggucaucuagucugacagacauauuuccuuccauuuauacuaaaaaucugagcaagaacauuuuuuauuacuuuuuuuuuuuacauccuaucagguuacuuagcaaaucucauuuucaaauccuguaaguaguuugucuuuguuucgcuauuauaaacaacugucaaguuccagagcgugcaguagaacuacagacuaagaguuuagucuucuugagaagacuaguacuuaagugcaaagcugcaauguauaugcgcagaaguucccgggagcuagcugacugucagauccuaaugcuguuaguuacucccugguggcauccugcucaguugaccagagccuauuccuggucucacugaugcuucugucacuguuaaaggcugaguguuaccuuucuccguacacagucuuaaucaggguguccccugggauuauacccaggugacuggcacagggucaggguggggucuacacucuacaguugagcauuuuccuaguuuccuauuguguuguauuuuuaccuguuuaaccuucaauaccacauuauuuccuuaccuccaaguucuuacuguaaagggguauuugauuguuucuaaguauuucauugcaauuggaggaaaugcccaucaguuuacauuaauuauuuauguauuuuguugggcacacaugucacagugugcauuuagaggcuagaggacaacuugcaggagucuuuucuagaaaugaaacuuggcuuagcaggcuucguagcaaguaucuuuacccacugagccauaucacuggcucccaaauaauacuuuaaauaauucuucuaugugguucuguccauuauguaguugccagguuuuagucucccugggaauuacugggaggacacaugacacuuuauuggcuaccuucacucuuguuuacugcuucacuauauaaagccaguuacucugacagucacugauuuagaccuugagauaggccgaaacuuggauuugaagcaucuuggauucuaguagaccucgcaaacaucuacuuaucugaaaacuaacauuuguacauacuuucaaaugucuccugaauccugcuggaauacucguucccacagugacaguugccagugcucuguccauauuccauguauaaacaagcugucugcccucaaauguauaccacucucuugacaccuucacuuaggauauuuaacucucugcucauggguagaauguguuuuuuuauuuugacuuugcacuuuucuuucauaggcuguggggccuccucuccacaaguucccugagccuugaugggaugauggagaugucacauuuagggcugagcacugaguggguguauaaucccaguguugagcaguuaagagucucugcacuaacugcugcccacuauagaaggagacuucucuggacaagguugggagcaacuuuaaagcuauaaauguaaauacuuagaaggcagucugacauuuccucuuaucaaaacaauaguaguagauuccccacuaggacuuuucaccuccuaugccaugcguuuugggcuagguuuuuaauauggaacaacuuuuaaggccaccaaguugcagcaugauaaauauguagauccuuaccuauccaguuuacuguuggcuuucuguaguacauagagaguucucuucgaaacacaaguaaaacuguauaugaaaaaaaaaaccaaaacacugaagaucuaauaugaaccaaacuuuaaagucacugauuuuuaauuaauuuucuuucucuacaaugaaaaaaauaauaauaauguuggaugaaaaaucuuucuagccagccaagaaaauagagcuuucuguaaacuaguuacagguuuaaagccuuucauuaugaauuaaauuuggaaugggagucuuuugccaauaaaaauaauggagacuaagccuuuaaagcuucauacauaauguagaauccugacuuacccucauucuuuguuguuucagaaaugaugacaagaaaagucuuuuccaguauuuuuuauccacugauuguuaaucaacagacaaggagucuguggauuuagaaagccaacuuaauucaaaauuuaaaaaccagcauguauuuguauacauguauuuauauacauuuuucuugucauuauuuguauauauaaauuuuuuuugucauuauuuccuaaauaauaccaguuauuucuauggacauaagguauauaugagacuaugcauagguuauaugcauauacuauacaauuuuuauauaaaggacuuagauguccuuacacuuugguguucauggaggaggaagucuuagagauuagaaccaauguccacugauaccaaauaacaguuauacaccacagaaaacaauuuuuuaaaauuuauggaugaaaagaauauauuucaugguauguuggucucauuuuccacuuucgguguuauuuuaauacacacacacacauacacacacguauaauuaauuuuauuuucauuuucacuuauguaccaagagaggccauguucuuguacuuucuuucacauuugcuggaaguagugagaagagacagagccacugugucaguguugugguuggugacuccuuagcagagacauucaguucauuuaaguaaauuccuauauuuugaacaugacugcacgugaugcuguugcugaaguucuugaauagggugaggaauaucuccauauaucgcuguggaaucccuuggcggccuccuuuaaggagccuguguuucacuaauauggguuuucaccaaugcucuccuuuccagcuugaguagauaugccuacugcccaguuccaaaguuacuccuagaucuucaguuucuguuaccauauaccauuguaccaguuaccagcaucaauuacucaccuucuacucuauaaaaauccccucaacuucauacaauuauuauuucaagaauucaaaauuauuucaaaaauuauuucauuuaggguccuuuauaaguugcagucaggcugauggccaggucuauauccuuagcuuacuggagagccugugacuucuuccuuuuuccucuucugguccuaaagacauuaacacuuucucugaccaauuucgaucuaagugcuggcauggaaaaaaagaaaucugaacuuuuuuauuauuauuuuauguguauggguguuuugucugcauguauauuugugcacuacuugugugccuagugcuuggaaaccaaaagaaaaugucugaacuagaguuacaaaugugaaggggaaaacauaauguucucaggauaagagucagauaguucucuucuucuaccaucugguuacugaggaucaaacucaggucaucagacuuuguagcaggcacuguaauacacucagcuaauccuccugcuuccaccuuucacagcacuaggauuauagcacaugccacaacaccccauuuuaagaccugauuuucuauugaagguuagugacuguaagccacauagagaaccaguacgacaacauaccaguggucacauaggugaacuauguaauuagugagggaaauuugaaaacagagucaacaagacuuugugauuccauucccaauacacacgggaaauaaggagccaagaguagcugaaaaucuagacuggacagcuugaagaauaaugauuuuuuaguagaugaaaggugagaccugaggaagcaaggggcucagaguguucuuccuugcaacaaauuggcaucauacccugauguaaguaucacuacagaggagaaacaugggagaagguagaagguagaccacauagucucauuuggagaguuacuguggcugucacuuuccucucugucagagcaugguuauuuuaacagucauucauuugaugccccucaggacucucugaaggagaugauacaucuuuagucugguaaacagagcauaugauaucucauaguuuacuauuaagaauaagagauuucaaccuuuuccuuuaaaacaccaggcuuauuucuauucuuuuucuauuaugucuucuuucuuggcuugaguauuuuucuaugaaauaguuucugcaaugccuuauuuaggcauuacaaugugacucuuagaacaaaaggcuaauagaauaaauacugaacuucuucuuucucacaaguauguagguaugcauuuauggcuuuaaauaaaguugcuaguuccuuccuuuacuuuuucuuuccuuccuuuucucucuucaaagcaguguuauucuuuguguugcuagaacuagauuucaucuauccugugacaggguugaagagagaagacaucugguauaaaauccuuccaugacagugaagugcuuauccccuugcauucuuaucuuaccucaagaagcacaucacacaagagcugcuccugaggagucgagugugugcugcuuugcaucucaugucugugagaggccacccugacugugcaaggaacggcuugcaucagauuucuaacagaccuugaucacgcucaugucuuuuaggaaugaagaaguaaaugcuguaucuucugucacaugggucaaguauaugauccuugcucuuucuacugaggucagcuucuugugcuuauacacucaucccaaaagcacuugaaaugcuucucugccuuagaaauggauuaguguaugcuuuauucagauugcuuuuaauuuuaaacauguccuagaucagguacgaaagauuggcuccuguuugccaggaaccagccucaucuuggaaagggguucugaggaaggaguaucuggggguggagaaaagaacaacucagagucaaaucguagauuacaagcuaauguucugcuugaggcagcuuuccaaaaaacucucucaagacagcucuaucuuaaaauuauaaagaacucucuggauagcucaucucuugcagaucaaaaguccagccuuuuauuuacauaccaacuccaucauccacccagguucccuuuugauuaccucaugaaucugcaucccaugaacccagccagcccccugauuuuuagaagaagacugcaagcacauuuuuuaacauuaaaaaugaauucacaaaucugacugccuuuguaagcacagacaaugagcuaucagggugggauccugcccugagauuaccauuuccaacauaccuagucccaaacuagcucugucccagccugaucuugaacucaggaaugugccugccuuuuaucugccugccuuuguguuuuucugacaagcuguuucauaauauagcugccucuguuauuuuaggucuucgaagcuccuuaauacaauucauauuguauccuuauauuuugcauacuugagaaauuauguacucuugaacucauguuuucagaguucuuucccacagccuugagggcuaucuugaaggucucagcauuuaccauuuugcugagacacuagccacacccuugccuccuggucuugugucaucucugaugaucauuuaccuuggcagagaggaccuuccuugaaggaagaacaugaaaauaugcacauuacuauacaaacaagccuuaugccacagcaaccaucaacacuuauggaggcccaugcucagcuggcuuuguuccaggggcaggagccauguuauguuacauggccaaacauguuuugggaaucuaauccuugcccacauucacaguaaaaucaacacagacauuccugagcacauggugguauccagaugcuuuggucauucuuuaggugugacuuuguuguuacuucuuguccuuccuugucuucugagaacugccuugcaggcuuacuagucauuauccuaguauguucaagcgaaguaucuucuuuuuuuuucuuuucauuuauuuauuuuaaacuccagauuuuauuccucucccggucuaccuccauaccacaucccauaccuccucccugcuucccugucuccagaaggauguccccaccgcccaccccucaccccaccagaccucuaaacucugugggaacuccagucucuuaaagguuaggugcaccuucucugacuaaacccaagccuagcaguccucugcuguauguguguugggggccucguaucagcugguguaugcugccugguugguauuccaguaucugagagaucucgaugguccaggucaauugagauugcuggucauccuacagagucacccuccucuuuaguuucuuccagcuuuccccucauucaaccacagcacuuagcagcuucuguccauugcuugggugcaaauauuugucucugacucuuucagcuguuuguugggucuuuucugagggcagucaugauaggucccuuuuugugaguguuccauagccucuauaauagugucaggucuugggaccuccccuugaacuggaucccacuuugggccugucgcugcacuuucuuuuccucaggcuccucuccauuuccauccaugcaguucuuccagacagaaacaauuaugggucagaguuauaacuguggaauggcaaccccaucucucacuugauucccugucuuucugcuagaggugggcucuacaaguucccucuccccaauguugggcauuucaucuaagguccuucucuuugaguccugaaagucucucaccucccaggucucuggugcauucuggaggguuccccccaaccuccuaccucccgagguugcauguuuccauucuuuuugcuggcccucagugauuucagucauuuuccccccacccaauacccaaucauguuccccucuccacucccacaucuccuuuccuucccacccucccccucccccacuuugugguugcuuucuucaacuguaauucauaaacaucaaaagaauggaaaccuaagcuagggcuucaacaguuagcaucaacggagugcuugcucugcuuugccgucuguuccuucucaaugucugcucauguggcaaaacggaugggugcuccccuuagccaccuuuagaagaagacugacuuaagacuuaaaagcucucaccucucaggcuuuccagcacuugugguaagguuucaauaugugaacuucgagccgaaacaaacauuccgacuaugugagaggucaccagaaggcauucuagaaaacaaaaauguaguaucucagucuguugauauauauucucuuucugccauaagcuagaaggacagacugacaaauauauauguguuagauuaaaauauaaagaaccugaguguucaacaauacaggauaagcaaucuauucuauaugaccagaaaaaauuaggagugagacugugaaaauuaauguuuaucauuaucagacuaauaauccuaaagaguuauuaggugcugaauuuaagcuaugccccuuucuaaaugcuuuuauucuauuagcuuaauuaaccaaccuguacuauacagucuuuuagucaaaauccaugaucuacccccauuuuaaagauagggaaauugagguucagaauuuaccucauagcaugccuaaggauagaugacuaguauauggaaguagaauuuaaacuaagccaauuuggcccugaaguucuugccccuaggcgucauucacuggauaucucuguaacuuuuuuuuucuuuuuuuucuuuuuuuuuuuuuuuuuuuuggaaauaaucaaaaugcuuuuacuucaccaugaaauguguuggagauaagcagucaaauuuugacaaagccagauggcuggaaaauugaaacaguauuuccucccagagaugaacccugcaggguagaguggaguuuaaauguauauagaaauagguaccaggugagggugaaucagagagugcucccucuuacuaguucacucccaggaggaggcagaauggaggacuuggugcauuuguuccugcccauugcuguguaacagaccauggccaaaagcaguugauagaggaaguuuauuuuggccuacauuccagagggauaagagcccguuaugucgggugagcauggcagcaggaacaggaagcugaagguucacuuuuguuaccuuaaacaaagagcagagaguuaacuggaaguaggcaguguccacuccagcaaggcugugccuacuaaacuucccccaaugggaccuccagcuggagaccaaguguucaaauaccugagccuauggaggacaucucauuuaaaccacuuaaaaugucuuaauauuguuagugauugucacucauaaaaggagucaugggggaucuuuaacguuauucuucagauuguguucaugguaaacacuuaaaaaccauacgauaugacuuuugaugcuuuaaaacuuuauuugaacgauauuuuuauugugaaccauacauuacuuuuguauauucugacucaaauaaguggucauaagaugguuguaggguacucaucuaccagcugcccauagucaggcuaccuuuguagugaagauagaggaucaaaaaggccuuuggaacauuugauuauuuuugaaaccuaaauuauuuauuaguugcuguuaaauuuauacauguaucuucuguaguaaguuacacacuuuuuaauucucuaagauuuuucuagaugaucuguuaauuaauuuauaaguaauaacuucuucccaaauacuuacagucauaauauuuauauaaaaucuacccaaaacuaaaugagcuguuuaaaauaauaaguaguuucuuagauaacauggaaaugacuccuaccuaaauauaaacuaaaauauuaauguuacaggauaucauuuauaguacaaccuauccuuaauuaucaguauaaaaaauguaguguauaaagcuuugagacuguugucuucccugcacaaaguuaccuaccuguuucagcucaagugacuacaacaaauaccauagaguagguggcugaaauaguaguuuaucuguuugcucacaguauagaggucuggagguccaagguaaaguuucugcugacuccuuuccuggugggagcacuccucaccagggcuagcuucucuguguucacauggaggaguucuuugacucauuugcucucggaacagcuacagccacaagguaggugucaacccuucgacuccacugagucugaauucauuccuaaagaccuugucucuagaagcagugacauugggguuagagcuucaguauuugaauugcuuugacuaaacccuuggcaguauccucccaaagucuguguuuaguugauuuuauuguggaugggacuauuuucauacucaugaacgucuuuaagguauuuguugcucuacgguguaucauggagaaguuaucucaauuuaaacuaugaauuucuuuuuagacacaaaaucgaaugaaauuaauggcugacaacuaugaggaugaccacuucagauccucccguuccaaucagacgaaccauaaacccuccccagaccagguaagaccaugcuugcgugucucaucuuuuuaaaaggaucacuuauauccacgaauguugugguaacauauugcaaauucuagguuauaaauuagaagaaucuuagcuuuuccucaaauaauuucaauauaggaaauucaugauucugaacaucuuaaaaguaauugccuugaugagauaaaacugagugacuccuacuuuucuuauuaaagaauugguucuguuuuaggaaagcaagacugcucaagugcaggcauggcucagaacagaaauuaauucuuguugaauugcaaaguauuuagucucuguacaucguccguuaaagguacagcugcaggcugggauuucccucaguggucaguagcuuaucaaggcucuaauuugaaugucuaugaccagaaaaaaauuaaauauuuuuugaggagugugauagaugaaauuuaauuucuuccuuucguuuccugguauacccuuucagcaugacauuuucaagagacauugcuuucagcuugcuacuaaugcagaagagacagucaugacacugaagagaauuauacugaauugcacauuuuugaaaggagaaaacaagaucuugaaugugaugaaucccuauucauggggauugggcagauuauuucauaucucugugcccaaaaucaguuucaacaucucugucacacccagucuuaaaauguauaaaagugcaaaacuaaggggaaaaauaauagccaaguaauuacaaccauauuacugcaaaaucaaggaaaacuccccugcuaaagaucuccaccaagugacaacuggggcauugucuuagaagaagccauagaaacauauagaugaaaguagcaauugguauccggaauguuaaucuaagagucagacggaaugguccuguaagauggccuuuacuaaggcagcugagacucaccuaguacuacuauagaguaaacagaaucagccuuacaucaaauggagagccaucugccugguguccccaccuagaaaccacugcucugccugcuuccugcuacuggauuaagacugucuagccucugcaugaaacaugucaggucuuucccaugcagcaagcuuggguauucgauagaggugauaggaugugggaagggcagacagagauggaaaaaggcaaccagcagacccuauagaaaagcucugaccugagaacguuacagcagcucugggaaaggaggggaguagacauggaccauaaacucauuacuaauuuguaguuuagacagcuagaaccuaauguacaaacagccaagaacuucuuuucugcuacauuauguuuaugucuuuguuuuaauacuaaccaacucuuuuucauucccaugcugcccuggggcauuguucccuugucaucucuccccguaggaugaggaggaggguauaugggcauagccaaucagaugcucuuaguucagccauuuuguucagaacggugagaaacagcuuuccuuaauuaugggaaugauuuucgcuuguuuucauguuucauucuccgugcucacuucacaucuucucuguacagccaugaacucccuagugugcucucugcuccuuuuauuuucacaugacucuuguguggauugcuguguuuuugacauagugggguuuggauuuugugucuuuuuuuucuuuuuguguuuuauuagucacauuuauaauuucuuucuguacauuuuugacagaacuuccagggcauauaacaaaaauugaugauuuuauuuauaaaucauccuaucgcuggugauuuuacaguguccuguuuaauaacucaccacgaauugaugggauugagggguggacaaacagcuauguugcuauuagccuauguuuaaaauauacuuuaugauaauuauaaauaugcaaucugauuuauauuuguuuuuaaaaagaauucugagggccagucccuaggaucuaccuggggcuuugacauuaguuuuaaaauaucaauuuaaaaaaaguuggaacaagggaguaaagauggaggguauguuuuaaauuucuuuucuuccacugcugccguguucaacagcugccaggacacugucuagauucuccuuuacaggccauuuggcuggaaaacacagugcagcuguggcugugucuuccuuugaucugaugcccuugagguuugucuaaggaaaucaguuucuuggaaagugauaauugugacuacuaagcucacacguacugguccuugcauccgcuggacacacugcccaugcuuuuguugaccucacuccuuuggagucugcucucccugaaaugucugugucuugauguuaaacugauuuaaaaaugcaaacauaucaaccucugaauauugaacacagccaaaaaggauaaaagguaaguuuuucaguggccaggguucugugugacuuuuagcagcaggugggaaauguacaguagcaaccagaaagcaugcugcacaucagaaaaagcuaaaaaucaaaggacaucuguguccugguuguucuuuugcacacugcaggggcauguauuuguuaccaugaggcacguaggggccacacaguagcuauaguuuagcagucauuuguaaaugaaugauucugccucuucuccgguguuuuggguuuuauuuuguuuuugguuuuuuuuuuguuguuguuguuuuguuuuuguuuuuuuggcaggacaagguagcuucuuggcuuguggcaagcaggaagagugccccucauauacaugaauuguuucacucacagcccuuuuucuagucaaugauaagaaaugcauaagccauguccugagucuggagucuacauuuccaggucugcugcucugauggagcaaggucuauaccaaacuuccugcucuugcacuaacccuuucuaccuguguucuuagaggccuacugugccugcugcugucgguggcucucauguucauugcagcuagcuggcuggaacuguuguuuuacaauacaguucuucauacuuucuacacucugccacagacuuuauaugguaaaacauuuuaccuaagguaaaaaaaaaaaaaaaaaaaaaaaaacacuaauaaaggcugggguuguggugugugccuguaauaccagcacuuagaaaucugaggcugaaagauuaugaauucaagaccaucuugagcuacauagcaagacccugucuaaaaacaaaaucaagaguuguaggagcaaucccuaaagcacugcagaagucuuggcuucuuucuuuccuguguuuuauuucuuuguuucuacagagaauggauuuuucuuaacaaacuuuugaauuugaauuuuaugcuuuccuaccaacuuaagaacuuaauguuuugucuaaagcauuuuauaagcuaccacucacugacgaagauugagucuaaaguagaagccauugggaggagcugaaaguucuaagcugggccaggcuggggggcugcagagccugagauuccgggugcaggcuuuugagcagucuuugcugaguccuuacaguagaaccugcuggcuggugugcucccuccacuuugaauuccucucuaagagacagugguguaagaaguagagacauugugagacauggaccuagacuacacagccuggaucuagacaccaccacuuaacucuguggccgagggcaaguaaggucaccucucuguaggaguuucugcaccuaguuguuugucagugcuuuguguuaauguaggaugcugucagaaguuucuuacauccuuaagcacuguacuuuaugcaaugcuauuacuguuuucuugcugucgaacucauuaauuuagagguuauucugagaagaauaaguuuucagugacuguuaguugcuauuauuagaaauaccaucuaaguacuguguuuauuucagagauaagacuguagggcuggggagauuugaaguugugacucggggguccuaagcauuucuguguucuaggacaagugauuaguaacuguucuuaagugguaaccaagauacauuuuuuuuaacugaauguuugaugucauguauguugaggaauauuuuccuuuaggaaaacaacuuguaggcuagcaagauugcucaguggguaaagauacuugcuaaacaagcaugacaaccuaaauucugucucuaaccccacaugugucagagggagaaaacuaacuccacaaacuugucuacugacauccauauguggaccaugguaugugugaaccacacacacacacacacacacgugcaugcauccacaugcacaguaauaauaguuaaaagaagacacuuuaaauuuuguuaaagaauuuccucuaauagauacauagucaguggcauuuucuguaaaagaauacuuuccaucaguagcaaugacauguuugccaacauaggacuccaaacaguaguacaaaucugaccaccuuggccaccccggugagagcaccaaaacgaagacaggcaguuuucugucaacucaacacaagcuagggccaucagagaaaagggaaccucaacuuagaaaaugccuacauaagauggaguuguaaggcacccucuucagugguggucaguggggugcaggggccacccuuauguugguggucucaguucuaugaaagcagauggaacaagccaguaaguagaaccacuacuaacugcauggucucuguaucagcuccugccuccggguuccugcccuguuuuaguucauguucugacuucucucaaugauaaagaaugauauguaaguguaagccaaauaaccccucuacucuuugacuugcuuuuggucaagguguuucaucacagcaccagaaucccuagcaaagacagauuuuucugucuaaauuagcuuaaaacaaguacuuuagacauugcuuugguucuguucuagugggguguccacacuguucccuuaccuguuggacacugucuuaggguuauauugcuguaaugaaacaugaugagcaaaaguaacuugggggggggcauuauucuuucacaguuacauauaacaaacaccaucauccaaagcagugagggcaggaauuccagcagggcaggaacaugaaggcaggagcugguguagaggguauagaggggugcuacuuacuggcuugcuagcugugacuugcucagccugcuuucuuuucuuucucucucuuucuuucuuucuuucuuucuuucuuucuuucuuucuuucuuauuagauauuuucuuuauuuacauuucaaauguuauauccccuuuccuuguuuccccucagaaaaccaccuaucccaucccuucuccccuugcucaccaacccaccuacucccacuuccuuguccugacauuccccuauacuggggcaucaagccuucccaggacuaagggccuauccucccauugagguccaaccaggcuauccucugcuacauaugcagcuggagccauggaucccuccauguguacucuuuaguugauaguuuaguuccuggaagcucuggggguacugauugguucauauuguuguuccuccuauggggcugcaaacuucuucagcucuuuggguccuuucucuagcuccuccauugggauccuaugcucaguccaauggcuggcugagagcaucuaccucuguauuugucaggcacuggcagagccucuuaggagacagcuauaucaggcuccugucagcaagcacuuguuggcauccacaauagugucuggguuuggugacuauaugguauggauccccagguggggcagucucuggauggccuuuccuucagucucugcuccacacuuugucucuguaucuccucccaugggguggcucuaccuauaaugagcuaagcccuccaacaagaaccacuaauuaagaaaauguauugcaggcuucuuacagccugaucuaauggagacacuuucucaauuaaggucccccucucugaugacuccagccugugucaaguugacauaaaacuagccaguaugacacauacugguugcaguagugcuacaguuuguaagucuuuaaaaucuucagaaaauuugucuguagaagggacguauuaaauaagucagcagaacuaaggaauguccaaucuuuuggcuucucuuggcuacacuggauaaggaauaaugaucuugagccacacauuaacuauaugaacaauaacaaaagcuaacagagggugggaguucuauguaauuuuuuuaauauauaaaccacuacaaauaaccaaaaaaaucaucacaugauaacacagaauuauauggcacgucauuuagucuucuacaccaugaaauaggucccaaguuugugaucuuuaauaaggaaaacaaacauuucuaauaagcuucauugaauuuuuuuauuauaaaaguuauaauguauuguaacacuaguuggauauuuggcauuauguuugagagacuaaugcauuaauaucugguuuauugaaagcacuugcaguucucagugagucuuugagguauucauaaggcauuuuucccuuaauauaugucauucuuuggacauguguguucuuacguauauguauaugcacacauaugugaaugcacacuuacauguaugcccguggaagccagagguugacauggugugucuuucuucuuccauagcucuccauuuuauuuauugagacaaaguauuucagugaaccuggagcuugcuugcugauucggcuagucugaauggccaucuccugaauacugagauuacacgugggcucccacucagguuuuaccuggauucugagguucuaaauuccaguccucauguuuauggccaagcaguuuauccucugagucaucuccccagccauuaguucccuucauuuguauauaaaaaaaaaaaaugcuuacaaauguaggugcuaccuaaaaagaaauggccugaaucacacgcaugguugcaaugagguguauuugccuauggggagauagaaucuauggaaguucaaagacaguugcuuguccaucagauugcauuucugugcauuccauuuggaaauuaacaagucaacugaauuugaaaucacagauauaucaaaguauuaauuaauuuccuggaaauauuuaaauauugcuuucaaguuauuguaucaaauugaaaaguaaggcugcauguuuuccacuguccacaggacugucaguaauauaaugaaaugcauaaaauguuugcccugauuugagcuugccauaauuucaauuccauuugcaagacuauguaacugggaacguuacauugauaaauugauuuuuaucuugaaucuguguuuuaucuugaaguaguuaaaaccauuaaaaaugccaguuuugaucaaguucuggcacaaaguuuuuuuaugaucuuacaaacaacuuaggauguuaaagaucacaaaaucuuuuugacaauugaccucaaccauccuauuucugaaaguaaaugguguugccauaaccugcaucugucagugcugugagggaauucuuagaauuggugaugauuuaaucccucggccauuaggaaacucacauaugcaguucacaugcagguuuucucaauaugagugugguggagcaaguacaucaucucccuuuaaucccacaaguuucccucaugucugccauccccaaggcaucaucauuaaaucugcaugcugacuaaggaaguuaaucuaacauaacuuuuuacugcuuuguauaaaucucuugauuuauucggucauuuuuuagucuuugcgacaugacaucugcaaaguucaugcucgagaacuacacagucaaauuacaaaaauuuuugaguuuuucccccuuuccaucuugugucacaaggauaauucagcaaccucaugggacuuuuugcugaagauacacaguacuagaaagugcauaccauacaaaguaugcuuggcccaucacaguuauuguucagugaggcuaacucaaggggauuacaaguuaaugggacuguagaaaguagggcaggcauggagacaaaggaaguauuaauauggauuuaaguguggacauugggggaaagagauagacuuaagaaaugacaguauugcacacccuacaguuguuggccuggccuucucuaaagagucacauuuaacccagcacuugagagacagaggcaaauggaucucugaguuugaggguggccuggucuacagagugaguuucaggacauucagggcuaugcagagaaaccuugucucagaaagaaaaaaaaggaggcugggaggagaagaagaaacagaaagagagggaauucaaaaguuuuccucagcuauauaguaaguuucugaccagccugagagcugccucagaauuacucccuuaccaaaaaaaaaaaaaaaaaaaaaagauuuuggugacuuuuaaaaguuauauuguuuaaagaacuuaaaaacuuaaguuaaaauauuuuaguauacuuuuuagcuacaaagcuuuuugcaaguguuuugggucccucccucucccccagaaagaaauuaggacaguaugucacccugaaccuaagcuaauccugauacuuacuaccuagcaccggcuagcaucaaccuuacggcaguccucuuaccucagucuguccagcgcugggauuacacaucucuacuccaagcuugguucauaagguaguuuuuuggauuuguuauaugcauauguguacaggccgauaggaugagaacauggguaaagggggugaaggaaauucaggcacgcuucgacuguaagcaugguuucuaaccuugggcuguguggcccgggugaucucaggugaugggaguggcaggcuucuuuaccuuccccaucccuuaacuuuccuuuauagcuugucuugguuucccuucugggacuuuaauuucuuaucuugaagguugauggcuggccuaaguuccauuuucugaaguuucuauaugcugaaccagagcuauagacccugccuauccugaaauuagaagucucggucuaaacuaagagucagggaaccaucauuuaaugagaauuuaguagaaacaaugucauuacggaaaacaucagacugcaaaauacaguuagcauacagcagaugaguuguaccuaauuuagcaccaaauauagaaggauguuuuggcaucauaauaugcuugagacauuaaucucaguaaaucacuacaguguuaaggcugaaccuggcagauuuaacuucaucuuggaggacagaaggccaaguugucagguaugcaucauguauagauccauagcagcuuacccuacucucacagguucccuccugugcucuaucagauaucaaaguccaaguuuguaagagcuguuuccauccucuuaacuuuugagcuuaagaauuagaucccuuggguuauaaaaagaaauuuaaaaacauauuuuuaguuguauauuaagaauauagcaaaacaggcacaauuccaaaaaaguaauccaaguagauuagaaggaaaauauuacaugauuacaugugauuaaaugagcaguuccuggaagaaaaggcaguaaagcaaaccaaaacauaaauaccagccagagcuacugggagguucauaaacaggauuuaccuuggugcauaagccucagcuacaagcacuguuguuauggauaucgucugugaccauucuccauauccauagguauaguauauagcuggagaaguaaguuaugggucuucuaauguccccuaacuuauuuguaaugacugccaaggucacaccaugucuucauaccucauagaaggcaaagguucuccuaauugggagccucaaagcugagacugacacucauuauugcuccagcuuuugaagcugcuuguuaaagguuuagucggucuuuugaugucagguucccuuccacagugcuuaauguacaaauauguuuacaaaguuucugguuuaucagguaugguagagaacaaaacccucauaaccaacaagaaaaaucugaucugcuaccucaagguuccaaggcaccgugguucuuaccuauauuucuugugggccaggauuucaagaagaaaccccagauaguugguuuuuaauuuuuuaagguaucauacaaagaagaggguuucauuaugacguuugucuacauauauaucaugauccuuugguucuguucaucccucuccccuacugcccuucccauggauaacaccuaccagccuuccugguuccuuccccuccuccccccaccccguacuuugaucuucuguucauuccauugcccucucuugcucccucuccuuuucuuuaaaaucuccucccuccuucugauggcccccauccuguuuucauggucuacacauacaugugcacgcacacacauauguaaauguaaaucgaaagucugcaggugaaagaaaaugugguguuuguuuuucuaauucuagcuuaucucgcuuaacauaaugccaguucaaaccauuuuccugcaaauguacggcuucaucuuuuaagccaauaaaauucuaaguauacacaggucacauuuucuucauucacucaucuguugauagauuccuagcugguucccuuuccuagcuauuguaaauagugcagucaugaguauggcucuacaguaguaguagucacauuaacuugugaguaaccuucaugcugacuucgugauggcugcaccaguuuacauugccauccccauuggauaaggaucucuuucuccccacauccuuaccaggaguucuggucauuugucuuuuuaaagugaaauugauucuuggaguaguuuuaauuuucauuucccuaauagcuaaggauauugcacucuucaaauauuuauaggccuuuuguagcccauuuguugauuuuaugauuugaaguuugguggguuuuugcagccuuuauuuaccuauuggauguguacuuggcaaagauucguuccauucacuaagcugucuguguuuggauagcuugagucauaauuucuuuuguuguacaaaagcauugucauuuuauaucauccuacuucucagcuccugaaauuaucucuuguguccagaggccuuucagaaacuccuugcuacaccuauauuuauuauuguuguuaucauuuuauucauuuacauuucaaaugcuaucccccuuccugguuacuccucuacaacccuccaucccaucccccucugccuccuccccuuugccucuaugagggugcuccuccaucuacuuacccacucccaccucaccccucuaccaucccccuaugcuggggcaucaagucuccccucccuucccauugauggcacauaaggccauccucugauacauguuacauauauaucuggagccauggaucccuccaaguauacucuuugguuggugguuuacucucugggagcucuggggggucugguuaguugauaauuguucuuccuaugggauugcaauccccuucagcuucuucaguccuuccccuagcucuucuauugggguuccugggcucaguccggugguuggcugugaguaucuguuucuguauuggucaggugcugauagagccucucagggaauagccauaucaggcucaugucagcaagcacuucuugacaucagcaauaaugugaggguuuggugucugcaaaugggauggaucccuagguggggcagucucuggaugacuuuuccuucagccucuguuccauuuuuugucccugucuuuccuuuggacaggaacauuucuagguuaacaauuuugacaucgguggauggccucauuccucaaccaggagggcguaccuauauucucuacagguucugucauccuuuuguugcauauuugaacuaaagucaucccaucuggguccugggagccucucauuuccuuugcaucugggaauuucuaguggcuacccccaguuauccaucccccacugcuacauauuucuauucgauuuccugacccucugcacugcucucugucccuuccaacaccugauccuuccccccaccccuucuuccccaccccuccucucucccucccagguccuucccucccuguaccuccucuuauucuuuugcuccuccuucuauguaggauugaagcauucacacuuuggucuuccauuugaaaauaccuguacaguuugaaauuuucaagucuugcauuaugauccuuuuuaaauggcucauuuuuuaauuguuuuuugugcagaguaagagaugaaguuuuuguucuucuacauguauauauccuguuaauucagcauuauuuacugaagaaagugucuuuuguuuaccuuucuugaauauugugugauacuagcugugcggguuuacuucuguauucuccauuucauuaaucagaaguucugugccaguaucguacaguuuccauggacccuaauagugccugguguuacaccucuauuacuguucuugcugcuuaggauugcuuuugcuauucuggaccuuuuguauuuccauaugaauuuuagaggauuuuuuuucugguucugugaagaauaugauuggugauuugauggggguuauguuaaauaugaauaucacuuuggcaauacagccauuuuguguauuagcuuugccaauccaugagcguagacagucuuuccaucuuggcgugucuucagucccucuauuccaugucuccuggagacaagaaaggaagaggccucaccauuccuccuagauacuccucuccucucugacagaaaugaccugggcuauauggaccacugugggacuuuuugcguaugagaaaacacacaguagcuuuuggagcaggaagauagaaaauaggagagaaaaagaauugcugcugaucuugauacagucucagcuauuuugcuguaucccuguccaguggugcuauuuuuucuugagacaugucauugugugacauauguacaauaaugcgccuacacuuccuacuuuucucuagugaaagacugcaucucaucuaugaaacugagaaggcgcucuuugguuagccucucucauaguguuugacaguguugaagaauggagcuuugcuuuuagcccuguguaacuguugcugcaagucacuuagcaucuuuaagcaccagagccucugugcuaagucauaauaaaacgugugcucuccuagaaaggccugcgaaggaagcaagaguucuucauggaggugagaaauacaguaagaaacuaagugggagaagaaauaggaacugcagugggggcacaugagagcaaaguaugauguguacacguaaacaugcuaagauggaaccauuacuuuguauacuauccuaaaauuaaugaaagaaugacuacaucuugcauugagggauauugugaggauuaaauguccucacucauuccauacaugucacccuucuccaggaacccagggaguacacaguaauagcuauaaggauagcauugguuguggugguuauacagcuuucgaaugguccuucucugucuccuguguccuauuauaaaauacauucuucugaucacccauaaaacuaggccugcuaaccaguuuuuucaucacgaaaauguaaucauaaaaaugacaaucuuucugagccucugaugaaucccuagagagcucagcacuagcccagcaacuccauuguuuuguccuuaaggugcugugguagguaagcuauagacauugcgcccugccuguuuaccuucaagaagcaccccacaauagacagauuuguuuccuccacuucugaaaguuucugacuacagaaaauauuuaugcaguagcaacaaaucauuaaaaauguuaccucuuuauacugugguucacagauccacccugcacucuugugguguccucuaugugauuaggggagggcuguccuuuaccucauuugauuuacugcuuagaccaaaguggccgugucuaagcauugcuaaggcguaugcacucagauucaugggcucauaucaugaugaggaguauucacuaaugaagcaucgucucuuccugcuauuauuuaugauuugggcauuuucccaaacaaccagauauccucagcauuaugugcaauaagacccuucacauccuacuugguuuucauagucaucugaaaauacagagggcuaccaaagcaguuuguaauguaucucaauggcccuggauucaauccuaucacacacacacacauuacaugugcuuugcuuacuuuuaugcaagaguaacuacuguuuucauuauucuuuugagggggauuggguuuuuguuuuguuuggguuuuuuuuuuuuuuuuuugguuugguuuuuuuguuauuguuguuguuuuggggguuuuuuguuucuuuuuuuuuuuuuuucccgagaaaggguuuuucuguguaacccuggcuguccuggaacucacucuguagaccaggcuggucucgaacucagaaaucugccugccucugcuucccaagugcugggauuaaaagcucgcgccaccaccgcccagccauuuucaauauucuuguuucuccccacacccuaaaaaguuauuaucuaaucugauaccacuugcauguaagugccugggugacccauccaauauuuauuauauuuucuagcauauuauauauuaaguucagugcccggccgcuuagcuuauccuguacagccccuuuugaugauaguuuuaaaagacaggucuacacuugcuauccugugacauuauuuuauuagguggugcuguggagggcuauuaguugacuccugucuuaucuggacccuucaacagcaguuuugucacagcaagacucuauggcacuacuucuguuaacuuguccaugacuccccacaguuauuuuuauacauccucucugguaggauucuuagguauuugugguuaaaugaacauuuucuuggauacagaauaguaucaucaaccaaaacagaagagcccuucuccugugaaguaucuuccucuuccuaaugcuaggaugagaccaagucuccagcugggccuggcaguccgucuuucugggguaaugaaaugagcagaguugauugagguguagcuggacuguaucacugcuuuucauugugccaagagaucaaagcaguguacaaauagaggcuuagucuaggaaauauucaaaacagauggcucguucuuucagugaaaauucggauuuuaaggcagaacacuuguuaacaagacuucauugaaagauggucaacuauggcuguuucuuccuagauuucaagacuauaaucacaaacuuuuuguauaaggagguaguugacaaacuuuuuguauaaggagguaguuggcaaacuuagaguggccuuuagcugcuuuuccuguggcuaugaaauaaguuauucagauuuugcuuuuggcacucuggauaucaaaugaaaacaucuugaauuugcuccucauuuuguugguuggucaguauuuuaauaucugguauucauauuguuauaucccccuggggcugaaucaggaugguaguacugugugccauguuuuaacaagguaaaggcacauucuguguacuccuuugcuguuuacacuugaguccucaguuuaacauagaaaaauucaauuaguauauguggcuuaaaguuuucauuauuuuggucuaaaacuuauugaagugagaaauaaaauuaacccauaaauauuuucuggacauauccuguguaccuaugauauaccaguuucauggggaauaaaugaaugucccaaggccauuaaacacuacaaaauggauuuuucuacaacaagaaaaauuguacaaauugccaugggaaaccucaguagagacucaguaguuaaaauguacuaugauauuugagcuaacuccuaaaggagcaguaaacaucugccagacagauugaccuuauacaagucaugaacagcuuuugcaaaggcuuagaaguauaaacgacauaauacgguuagugccuuuucuacaauaguucacuguagauagugcuguguauauuagucauuuucuuugcuaugcaacacauaccaaaauacgguaaccuaagagagcacuuaacacuaauuuauuuuaaaauuuauuuuuauuuuaugucugucagcauuuugccugcauauauacauugugugugccuugugccaaaggagggcagaaaaagguaucagaugcccuggaauuggaguuaaagagaguugugagccucuaugugggagcuggaaacugaacucagguucucugggaaagcagcagguacucuuaaccacuuagcuuucuaucgagccccaguaaacgugcauuaauuuuguuuucugggauacuaucucuuacuuggaucucuuguggaauggagucaaauuaucacugaggacugcaguuauccacaggcuugccuugggcuggaucauccaguuuacacugcaguuaaugcuaggcuuaguuccaugagguccauuuauuaauuguugcucuuagagccagugcuaaugguguucuguucagagagucuuuucagugccaaugaguuccaggcuguucccccacauucucuucagucagguuugauguaucuaauuuuaaauugagguuuuugauccauuggaauugaauuuugugcagagugguaaguauggcucuauuuggauucuuuuucaugcagccauccaguuugaccaauacuguuuguugaagauccugucuuuuuuuuccaguguguauuucugcccucauuauuaaaaaaaaaaaaaaaucaggugucaauauuuaugucugggucuucuauucaauuccauugacuaacaugucuaauuugugccaauaccauucuguuuuuauuacuauaccucuguaauacaccuugacguuggagauggcaauaccccccccagcaguuccuuuauuaugcguaauuguuuuagcuauccuagguuuuuugcauuuucauaugaaccuaaaaauuacccuuucaagauguaugaagaauuguguuaaaaauuugauggggauuacacugaaucuguagccugcuuuugguaagaugaucauuuuuauucuauuaauccuaccacugcaugaggaagagagauuguuccaucuuuugauaucuuucccaauuucuuuguucaaugacuuaaagcuuuauuuuacaaacucauuacuauucuuuuugauauuucaacuguaucaugauuuuauuuaucaguaaggauuguacuucagacauuucuuuuuaugacuguugccaaaucuaaauccucuuguagucguuauuacugcugauaacaguaauaaauaccuguuaugaauagauuuuuaaaaauaauaguuaacuaauugaugaaaaguucuaagaauuucuucucuaaugugaguuucucuguugucugagauugagcuguuguaaggauuugcaauuuucuuaagacuuuuuuauuuuuauguguaugggugcuuugucugcauauauauuugugcacuacauauccacagaggcuggaagaaucucaaaucuauugagacuggaauuagauaguuguaaacugcuguguugguacugggaauugaaagagggaccuuagucauuggccugucucuccagccugucaacuuacaaauauuuucuaaaguuucuaaauaguaagugcuuuacacguugcaaaucccauguuaucugucaggcuauuuggcuucucugucauagugcugaaagcagccauagacacauauaagcaauugcguguggcuauaaguuaauaaaacuugauggacucuaaaauugguuuuuauauacuuucuguguaacauaaaauacucuuuagauuuuucuuuuugagaauugaaaauggcaaaauaaaaagaauacaagcgggcuggugagauggcucaguggguaagagcacccgacugcucuuccgaagguccgaaguucaaaucccagcaaccacaugguggcucacaaccauccguaaugagaucugacucccucuucuggagggucugaagacagcuacaguguacuuacauguaauaaauaaaaaaauaaauaaauaaaucuuuaaaaaaaaaaaaaagaauacaagcaugcuuguugguauaagccuauaaucccagcauuuacaaggcucagacauggggcucaugaguuugaagucagccugggcuacauaggaagcaaaacccugucuccaaaagagaaaaauauauacagcauccuuaacucagaaccauacagaagcaggcggcaaugcuagaugugguccacaaacuguaauuuuccaguuccuaguuuccucuguucccucuccagucccuggugcagcugagcacugggguuugcuugacacguacuugaauccucauagaacagccaugagcaucccauuguagagguaaugaagccuggcugaugaccauuguggaaguuaacaaagcagagguucucuuugccaguguuguaggccucuccacuggagucaggcagauucuagaauucagccugcccaucugucuccaaaacuugagcuuaucuucagaaacagcauuacauugcuuaaccauucugcacuguuucacaaaguauugaagauuuuguagcauauaaccuaagugacaccgacagcacuuuacacacauuuguuuccccucugucccucucucccucccaucuccaugccucucucucucucucuuccucccuccuuccaucuccaaaccccaugucagagggcagccucugaaacugaauacccagugauuacugcaugaugucaccaagcaagggccugccugcuucugaccacuguguuuaaauaaccauuucuaaccagagccacagcggccaugcugcuugcccugaagaauguagaauacuuugcuaggcagagcacaccuagaauucuagcacuuaggaguuugaaacaggaagauugcaaguucaaggcuaucauaaacaacauagacucuggagagacagacaggcacacaccacuauuacuugugcuuaacaggcugugaguugcuggauuuccauaucagcuguugcuauagcaguguccaaaauaagugcagcucuguucugucuggguuuuuguuuuguuuuguggucaggucuuaauguguagaccaggcuggccucagacuuuuggcacacuucgucucagucucagugcccggagugcuaggauuacagguguuagugaccacaccaauccaaaucaguucuuuauuaaacucauagguuacaaagcaucagcuaaguuccuuuaauuccaggauagcuaauaaaaugucaugaguauagucauugacauggaacacacaagguuaaacugccaaguaaacagcuaugcuuuucuagagcugcaaguugucauggcucuaggacaucccagcauacagcagaggcuccuguugucucagccacuccaacacuauucccugugcugguagugaaugcauguguuuuuaguaaaacuaagagaaaauaaugauuuaucuucaagcagaauuaccauaguucuucauauuuuaaaauguacagucuuuuccaguuuccauagacaagcuuacgcuuuaacaagccguaaagcccuaucucagagaucuucagagaagcuuucuacuuuuagaaccagguauuuauuagugauaagauuucuaaucacugacugugauggcacaugccuuuaaucccaguacuugggaaguagaaacaggucgaucugaggucagccuggucuacauauugaguuccaagacagccagagcuacagaguaagacccugucucaaaaagaaaaaaagaaaaaaaaauuguuuuuucuaacacauuuaucuauccuggauccaaggaacccuggaucugcacuccuucuugucccuugucccugcauguucaguguccccucaucuccccucucagcagagaagggggaggggccagugacuuucugguccaaaaacuauuaaagauggcaguggucagguaucucuuauuaauuaauguggugaugcaaggccaucccacagauccugaggacacagauccugucuagcacagagcuaaagcccugaguccuuugucaauguucauaauauggauaacauucugggaguuucucuucuuuugugaguaagcaucaaauugaaacaaaggauuuaucucauaacuuaagugucccugggagauuuuuuuuauguguuguggaaaauaaaugcauaauggucacaguguguaaucugggaaagcuaggaggggaggggcagggcagggcgugaggggagggaaggggagggguggggcccugcucuggacgcucucacuuuaacuucuucugccaucgcccuuacgucuuauuuuuaaucuuugaaauguuagguguuuauucacauacauuaaauaaaugugacuguacuauccuuccagcuaagccuaggugcagucuagaacuugcugucauauucuauacaauauauuucuugauguaaaaacugagaguuauucuaccuucucuuguuuucuguuaggauuaguuaaggaugacuacaccaccaaacauguguagagaaucuguucaucguuuggcuuguccuucagauggcagggcucauuguuucaaaggcuacaucccagaggauuaagaauaaaaagcuuggauuucauaaacauauuugaaggcuaagucagacuaaaucucaaccaaggcaaauaauuuauuuagcaauucaaggauccuugacauugguuucaaaauuaaacaaggauaaauuucuuauacaauuuagcuauuauauauacccaaaacauuaaucacuuaucucauaaguucuuuuaauauacaguagaacuacaucuucauauauucccauugauagaauacagcauaccacucaggcguucacuaagugcuaaacuggauuuuuuuuucuuuuuauuaauuaugacuugacagguaguauacugaucgauguaauaaauauaccauagaguuuuucuguauuuuuaaaaaacucuuucauaaaugagcugcuuuaagugagaacauaauauauagcuccacgacuuugcaaagaauuuaacacuccaucuuugacuacccuggccaacuagaauauugaccaggagaaucgcucagugagaagaaauguaaaaguggugaacauuauucucugcccuucuucucucucugcugggccucuauuaaagaauuccaguaagacaggugugccugggacauuagucagucaauuaauagugggacuuuccugguacauucuauauugaaaggcaguggacaguaacccaaacaaaaaaaucaaaauuacccacuaguauuuauucaguuaauauaugaacagcaaaucugccucugacaaugucagcaaguaaaaaagaacacagugcuuuuauagccgauucagaauuguaagcagccacagaagacucuugguagauggaaaacuaauuuucuaggaagacugagaguagcugacacauauauagaaacuuuuaaaggguguggguaugugugugugagaaagagaaagagagagagacagagacagagauuacagguuccucuucuggugauggccagagaggauaucagguccccuugaguuggaauuauaggcaguuguaaacuaccuaaaauggguacugggaaccaaaugucaauuuucggaaagaagagcaaaaaauggcucgcaaguaaaggcacuucccaccgagccugcugccggaaguucaauccccaggacccacaggugaagcagagaaagaaccucucaagcugcccucugaccugcgcgugcucacugugucacaaacacacaaggaagugaacauaacuuuuaaaaaccucuuccaaacaauggaauuugaauuccccaggggcagaugcucuaguuucuaaucauuuucagccccuuuucauccagucuuuuaugauaaggacuuggguaacuucucagaguguuauaaccagcuaagcuauacucagaucagaggagaaccagguucgggcuacugaccuauaaucccagcuucaagaagcugaagcagggggaucacaacuucagcuucaaggaucauaauguacugacgcuguguguggacagacagcaauauuuauggguccuguguggcaucuccuuucaauuugccuucagaaggagucccuaucucaagacaaaacaagccaaacaaacaaaaauccccaaaaguagaguaagaagagaaaacccaggccgucuuaauuggauaggugcaauggaguagggacugcuuuuguuuauucuauccugguauuaaaaugucaaaugaucugugugucuagaacucauacguaaugaaccauacacauagaauauuguagaaucuuccuucacucucuacucugaaaaauacaggaauaguuucuuagucuuucaaaagcuuacuaguuaucuuagcuaaauggaaaugaaguuaaagcaaacacuuucacaccacugucauagugcaagcaaaagcuggccccugaaaccaguuugagaaucuauuacaacaaauccucuuacaaagaaacaacucucagcuagaaugaaaauuuuccuccugucauaauuuauauuccuuaacauuuauaacuguagaacuaggccuaguuauacaaacauuaucacagccacuucugaggcugaggcaggaggaucacaaguucaaagccaaagggcuuguuuaucauagcaagaccccuucaaaaauuuauauuaaaaaauuaagggccuaguccaaugauuggauaccucaccaauauuuaugaucucuaaguucaguuaccagcacauagacacacuccaaagcauagaauggugaaaacacauuuggauggaaccuuuuggucauaacgaauauacucugaaaaguucauuuuguguuuuuuccuauuuaaacuauauagauacacacauauaugaauauauguguguguguauauauauguguguguuugguauguuauuuuuauauauguauauuuuguguguguguguguuuauguauguauguauacacacacacagcauguuuuuccuugggcgugaacucaagcgguauaggcaauaaggaagaugugaaaguagaaggaagaacaagaagguuggaaaaucacuauuaugaaaaucuauuacauauaugcacaaaaauaucacaggccucguggcacaggagauugaaacagaaggaugauugcaaguucaaggccaaccuggagcaaccuaaugagacacagucucaaaacagaguaaaggaagaccuggggcuguaacucagugccacuggcuaauguguagaaggcccuagauuugauucucauuacuguggugggggcgggauauuaaaaaguaaccccacuguucuauauagauaauauucuaccuauaauaugaauuagauagaaaaauguucauuuauuuuugagacagggucacacugcugcaaacucauuuucuucauuaggcugucuauugcugcaacaaaacaccaugaccaaaaaaagcgaguugggggaggaaaaggauuucuuggcuuacacuuucacaguacuguugguugaaggcauuuaggacaagaacuccaacagggcagaauccugaaggcaggagcugaugcaaaagcuucaagaggcacugccuaccuuccugugcucccauggcuugcucguggaucaccagcugagugauggcaccacccacgauggguugggcccucuuccaccaaucauaaauugagaaaaugcccuccagcuacuucuuauggaggcaucuucucaauuaaaguuugcucccuucagauaacucuagcuuguguacucaccauccuccucccucagacuccugaaugcugguauuagcgguaguaaaccaguaucccaaccucuuuuaaugguuacucuucccagaugaaacacaucuuuucugaggaguugggguuguuugugaagaacuauaugaauccuucacuuucuaaacaucugcuuugacuagaacacuuuguccuuauuugauugguucuguugaucugccucucauauauagaaaaugcugucacagaacuguugccaccaaccugcugaccagaggguguguguguguguguguguguguguguaaauuagaaugauaccacacagauucacuuuucuguaauuugucuauccaggccccacuuuaguuuuuauaugauccuaaacuugagguaaagacuguaggauucauaaugaaguugguguuacuguucaaaugaauaccaggccuuguuucuuucuauuugaagaugaucuagucccuuuuacaugagaugguauagaggcaucgugguaauagaaaauaucaggcuagugcaugcagcagguacaaguuucugguguguauggucugggaacucugucaaggcucaacagcucccguggcuguucuagccgcaugcuagaaugcaaaacuugggcugugaccucacugccaauaccuggcuagaguuuuguccccaaagcugucacaugaaacauguaacagaauccauuggucaauauacuaccagagagaaucguagaaacacagaaccaauguuacaagugaggauuucggccuuggcugugagucagguacuugguguuaugcaaagaucuacuagucacuuuguacagagaaagaaugucagauagccucugagaaaugaaugaaggagccucagccaggaugagacagauuuaguaaugaguucucucaucauccgucuaagccaagaacaacacgcacccucuccagagacugaacuuuucuucuauucuagaaggcagaagaccauaggaaguauguugcccaggcuuucagaugagcaguguucucuggaagccuuuugaaagcugcucauaaagaugugcacagagcacuuguagcaucacuggaggcuuuggacaucaggaacaucaucucuguacaaacaagcuagucuggacuggcaaaaugacuuagcaauaaagguaucaccaagucugaagaccugaguucaguccccagaacucacauaguaaaaaaaauaacuggcucccacacaugccacggcaaacccaccuguauucaacauaauaaaauauaauucguaauuuaaaggacacacaaguccucuuucagucuccugccucagugcagaguucuccaucugguauugauggacucagcgauaguccuuccuuccuuccuggaaaacaacacugugaaauuguugugucuauaauuaggaagauugcaguauuacugagagcuuucgucuugguuugggagccauaaggaauauuugauuucagauuaaccuugauuuucccuuuuucucaccucagaucauccagccccucuuagaacuugaccaaaauagaagcaaguuaaaguuguauauuggacaccugacagcccucugccaugaccgagaccccuuaauccuccguggacucacuccaccagcuucuuauaaugcagauggugagcaggcagcuugggagaaugagcugcagaagaugacucaggagcagguaggucuuguucaagacguggcccaagcacacuucccuauggauggguaguguuuggggauaaggacaugguuccaguacugugcgcgcaagccugugugugaguaugugucugugucugugucugugucugugcgugugcgugugcgugugcgugugcgugugugugugugugugugugcgcgcgcgcgcgcacacgugcgcacgugcacauggaccagagacaucauucucacgugucauucuucagagcuuucggcuuuuuuuuucaugcagugccuguugcugccuggagcucacgaguuuagguagacugaccgugagcauuggggauccuccagccuccccucccaccccucccuccccagcucuggaauuauaagcacacacaaccauacccagcuuuucacauugugcugggaucagauccucagacugguacagcaaugcuuuaccaacugagcugucucuuuaggccccaaauaccauuuuuaauugauuuauaauuuuuuauuuauuuucaaaucaacagaaaacaugcauaacaucauuuuaaaaauauguacugaguuaaacauguauuauuuuuuauuuuuauuuuuggggggcuaaaaguugauuucaucaaaguagaauuuuggauuaauguaguacccugaguguucucuuccuccugcugucuguuuugcauacuccucagugugguaacagagggguggucuuuauuguaauuacagccuggauaucuacagcugagggguauaacuaaaggguauaauucuucuuuagcacaccuguuacccuagaaucuguagauuguucuagcccugucaaagcagcagcuugaagauaggacuggagugggcauugcaaggggagguugggggucuguagacucuaggguagcaacagcaggugaguaguagguaugugguagaccacaucuauaaaaugggcaccucaguucucacacaaccaggagaagggaggacagcacuuuaaggcucccagaaucuucugauccucacacaaagcacauauuuauggcuguuaugcaaagcuuucuuuuucuuuuuuuuuuauuagauauuuucuuuauuuacauuucaaauguuauccccuuuccuaguuuccccuccaaaaagccccuaucccccccuccacccgcuccccaacccaccacucccaauucuggccuuggcaguccccuauacuggggcauagaaccuucacaggaccuagggccucuacucccauugaugaccgacuaggccauccucugcugcauaugcagcuagagccaccagucccaccauguguuuucuuuucucgguucuuugugaauuucacaugaugcaucccagucccacucaucuuccccucccuuguaucugcccuccauucuugcaaagcuucuuuaucuaucacccgcaaagucaguuguaucccuguucauuucuagacauacuguguaaaagacagauuuugaaaacaaaucaguacauacuucuucagcuuuggggagcauguucaguauucaggccuuaguuugagacacaauuucuucaugaaacccagagcuggccuucauggcuaguauuacuagcaggcuugcuuaggggacccuacuuacugagcuggaagugcagguggguugucuugguacucagcacuuauguggagucugaggguccaaacucuaguccucuugcuugaaggauaagcacgauaacugcucagccaucucccaggcccacaucacauuacuuuucaugaacuauuucaagcuccaaaaacuguagacguugauauaauguucucugugguguuuuagcgaaugauucccacauagguuucaggucuuaaauauuugguccccugucagugaugcuuuuugggaagguuuagcagaugcagccuuacuggaggaaguuugucacagggaauaggcuuugaaaguuuccguucaaccucaccuuucugcaucaugcuuguggcugagauaugagcucucagcgucuuguucuucucccacaaguuucuuuucauuaucacagcaacagaaaagaaacuaauaaaagacccugucucaaaaauacaagaaaaggucagggagauaucuucauugcuaaaguacugagggucuaaguuugagcccacagccuguguauaaggcaguguaaggcugaggugguucagaggauaagguacuugccguacaaguguaagggucagccuuugcauuccuagagcccacauaaguuagcugcuauagcacaucccagugcuccugggggauauugagaagcagagacaggaaaguuccagacgcuuaccagccauuuaguccagcgugagcaguggccaacaagagaccaugucucaaacacagugggagguaaagauggauuucuaagaguguucuuugacuuugacauucacacaagcgcacacaugauagauagauagauagauagauagauagauagauagauagauaguugcauacauacuuacauacauuugacaccccacauugggggccaaauguaaaauuauuuuuaauauaaauguuauuaguaaacuaauccaucagcuguauuucuuuaccuuauucuagacucccaaaaccacacagagaaaccaggauuuauuuaaaacugcaccccaauagcugagcaguuaaaugaucuaccuuaaucucuauacuaauauggcucccagccauuaccccaauguacuugcuuauuauuauuggucuggcucuuuggacauaagguguguuucuaugauaucucuccaggcuccuuccucauggcuccaguuccaccuuccucuggcuggcggauguccugcccuauucuuucuucugcccagccacugagugaucaguauuuauugacaaugcagaagauaagugauaagaacuguuuacacaagcuuuggacaggagauucuugguauaagcauuacagugccauaucuggauuaaaacaagauaaaauuguuuuaucuugcacacauacacaauuauaaacuuaaagacccgugcuuugggaugaguagagagauggggcagcaacuaaggcauuaugcccugacagccaccacauuccagaucuggggaucugaucccuucuagccuccguuggcacuugcauucaugcauacauauuuucacgccaacacacaugcaugcacauaauuaaaugucuuugcuuuuuaucguaugucaguauuuuguuguuuaaaggucacaccucaccucuaaccucccuuugaaauauuaaagcaguucaacugauagguucuguuaaaacacuaaaauccacucacaguggagaacaaaaagguuuuuccacccuaaacgguaacgucccaucggguggaagcacacuggagugacuuuguaccaggcagcugcucugugggucacugagcuuagauucuaaucccuguucccagcacuuugucccauuuucauuuuucagaaaauauuguuccaaaacuuagcucaggccuugucuccuuagguugucuuuccuuuuguucucuccaauugcuggguaacuugcacccaucccucuuuugaaagaaguagauucaggaaugaccaugcuggcgcaauacuaaacacagagccugaaagucauuucugccacucagggcucaucagucauuggcuauagacaugacauuccauucuugccucuuggauggcuuugccugguugcuguaccacccaagugagccaaagggaugcaggagcuggugggggcagagccugagaaaccgcagagagagaaggagaaagaagaauggcccuuggugggugacagacuuuguucugguucccagucucuauuugugaucugcuuuucuucuuuuugugaugucugaacuuguuuucucagcuccagugcugaagccuuguccaaagcauugagagcagcagcacguaagacgcugcaaaaggcgagagcagccgucuagcagagaauagccaagcccugaagauaaauguguuuuccucagaacugagcacaggaaugugugcauguuguuugugucuugacacauuuaugaaaaauacacaguaugguagauucacuuuucuucucagcucugcucucacacaaucuggcuuuuucuucuuccagaguaucuugcuacuuggaugcugaaauaucuagcaaugaaaacuuauuuuuuaaaaaauaaauaaauaaaaauugguauuagggagcuaacucagcuagcaaaaaugcuugugcaacaggcguaaggaucugaguuugacccccauaccagagcccacauuuaaaagccaggcaaaguggcauacaccuaugaucucagugcugagggagacagaggagguuugccugggccuugcuaugaagaggaggacgacucuggcauagagcugaguagacugcacaggagggguucaaagcugacagggcgcuggcugcggacacuagaacccaaaccuccugcccugcuucugcgaauguuucccagcaugaugcucaggaaaugaagaugaaaugggagcuugcuauggagaauuagagucaaaaauagcacuuuugcaugcuugagauuaugcaaacauuaaauacuauuuuccauucauucccaguguaagaauaguauguuauguuuggugucuacauggaaaaauaugcaaagauacaaaacuacagguucgugcuaaauguagaauaaccauauuugugucaucgugagaaguuacaaauuaagggaccuguaaaguguaaguguguguguguguguguguguguguguguguguaaguguguguguaucuacacacaccuaucacagauaaggaagaaaauguuuccggcugaagcuguggaagcuauacccacuuggcgcuggucccagaguccuagaaccuuuggaaaugaaauuuccaguccagucaugcuguugggauaaguuaccacuaguucucucucagaguuuuagauguuuuaccaaaggcuugaugguccugaccucacuguaacuaucuagaaauugaaaucacuuaaaauucucaagauagugugucuacugugaugcacgccacagccuccugccugagcacacaaagguaacaguggcugugugggcuggcaauucucugagaaaaaacuuguguauacuuuaaauagaaauaugaauaagagcauacucuucucccauggaacuugacuucccaagacaaaaccaaaagggauccuaauacacauacaguuucaguauacacucagauauugcugccauuucccacugcauacaugaccaccacccauaaugcaaagcccacccaccaacaccaacaguacccugucagggaaaauacugacacagccucccugccugguccaaaaacuuccaacuauucuggguuacccuccauaccagccacuuaccagacauucuagcuauugauguuaggaccacugccauaaagugcugaaagccuucugauucugagucagaaaaauggguccagaucacguuuacuguccugacaugggaaguuagaacaagauauaaauggccagugauccacggcauuauauaccaacagcaaucuauuagcaucuuccagcuaaaauacaccauguaaaggacucacauagaaauuuaucuucucucacucugaaggcuggaaaucuaagaucaggguguugguucuggaaucguuggccuucugauuguagacuucucacuguguccucaaaugaucuagccugagcauccaugaugucuucucauccaaacuacuacugcuuacauacagcaccagucauacaggguagggcguaugcuaaaagccugacuuuaauauaaucucccuuuaaaggcuccaucuccaaauaaagccauaccccuagguucuggggauuaaggcuucaacuugcaaauuuuagcuggacaccgcuccguccauaaaagcaucacuggagcuacuucagagccuaauugcuguugggccacuguuucaggguuuugauuuagcugauuauuauaccagcuuuagaaacuauagucugcauuccaaauaagccuuggaguuuuugcccuaagguaaaaggugcugcagaacuuuacacccuugaguuacccagcacucccucaggggacgcaggcugcugguuacuuccacccagaaagucaagugagguacauucacuuaacagggccuuucugaaagaguuguuauagucacaaagccauaacagcgucauuucugaauacaaucaggaacauugugggguggauacagugaugguucucuuacacacagcacaacaaguguccuccugcucuuccucccuuuagugcaaaaggcuacuaggcacaaaagaaaaugcugaacauagcauauguucacuguuuagcccuaaagaucaaguucuagugaauaaaauuugucaugggguccuuaucagugagaaauaaugguuuuaauguuaucagacuaagucuugacuuuuuaaaucaaacuaugagacugugaaucugagccagauuucagacagaucuuauuuccaacuuggcagaaaagcaugugaugugauggugacuuuaagcuaguaugauggaccaggcauguugcccacuccagugauccuagcaaaaaagguuagucuugucaucauagcacgcacaguguuaaagcauccuucgucuccagauucucugacuucaugcuauuugauacauguggagucugugggauuaucucucuacaucugcaaggcugaagcaaaaccaagucugaucagcauucauuccuaaggcuaguguuucacaaauuaaauccaaaaugcagcaagcaggaggaggaaaucuuggggagauaacguacggagucuguggcuccugcugaugagacccagaguaggggcaguggaguucucaugagcugaaacuuccucagcuaggaaaagcuuguggcuuccagcugggucucauccuuugacucauuugauaaggcaaaccagcagugggcuuugcuuagucagauaucauaaagucuagaaagaauuugaagagcaccugucuccagacagcugaaaccaaagaggugaaaugccucauccaggaugggaaagccagguggcaaaugaggcuccuggcucauguauuggccacuacugcuccuugcagccuaggaaguaaauccucccagugugucaacuccagcagaaacuggcacuuugaaaugcagaacuucuugucaugaugcugcugguguagucagugccagcucaggcugagugugucucagggugcugcaguugagugcaccacccaagccuguggguccuucuagagacaaggggagaguggaugaauaauaaggagaauuggagaguuuauuuaaccccuucacuuguucccuaugggacagaaggacccugguguucugccguaaguccuaugaagugucaugcagccauaggcggugguccacagacacuggggauaauugcucagggccacaugcagccuuaucugggcucugguuuguuuggacuggccuacuaagguuacaugcagaaggauaauuccaggguuucccagucuccccuugccuaugcagcugaaucccucccugcacuucucaugaaggccaagcacaccuucucugugucuggcucccuagaaggagacuguagaagaaaagcuaugucuguucuccuacacaugcuugcauugucuucucggguuaggccaaagcucugugaguaugcuggaggucugaaugccguggcuucaucauguuucucagggaagugugcucauagcauggagagccuuaaguauucauugagccagauuagacuggaacuaucccuggaguuucuauccuaucuuucuugaccugugacaaaacuucaaaagucugagauuuaagagauuauaggaauauuuuucuuucagccccuuaaggagcuuucaaaucauaucccauacuuucuucccuuccacaugcaaaaauuaguaacaugcaacccuacccacaucuaucuccgugccagcugagucagacacaggcauucucuaucagugugugauacuuaugucucaccacuauacaugaucauccaugaauggccauguucauucagggaccacuuagaaaacccuccugacaacaaagguuggucauuauagacaccucccaugauucuguuuuacugaaccaggaguuuguaccccacuaaaggaucaucaugucacuuucucuaggaguagccauugggauaauauaucaggcuugcacuaaaauuagagggaaacucagcagggugaccacgggagccuuuucagucuuugccuaucacugacacuaacgugggaucccacauguugggaagcacaguucugggacuagguguguugugcacaugccacaguggcugcaacacuccccucucucuucccuucacuuggccagagacaucagcuggacauggagugggccucauggguucugcacuuacagcucagcugcaacaaggccuuauucuuaccacccuggcagcuucagcauuggauuuccuaauccauuguuugguuuggggggaggggcaggaggggaggcuucauccuuucccuuuugacagucuuuguuucugugagccaaacuaaacacauggggcuggccagccacccugccugggucugugcuccccagaauauuacuauuguugugauagaugucuuuagcaggaggcagguuuccuuacauuuugaaaauggugugcaagucucaguucauuucacuuagcagaugauugaaagacaaucugagguacugccaaacaagacuuuuagaauucuagauaguuggcaguguuuguuuaggccaugccacugcaagcccauauaaaacagaugucacguuuugcaacauguccuugugacugucugccccuugccucaggacgaugcuucuguucaguacgccaccagggccgacuggcuuguuguucgaaggugacaguaugccacaguuccuugaguguucuagggaccuaccuuuauaggaagugauucccauucucuuggcccuucaaaaugagugcauaggacaccagccaagcagugcgaauacucuguggaguuucuucuuuucccaguuuucucuuucuuagucaugaguguugcugugcuccuccugucgucucggucucuacacacauucagaagagagcacucuagcaagacagacucccaugagagagacggaccugggaguuguuaguggcacaguaucacagaggggacacagauuaucucaccuagggacaaauguccuagacaggaaagcauuuuagacgugucuggcucuaaguaggucagagaguaagacauuuaguaucuuagcaacacuugcagauagagugugcaugcaucuggaaacuguaggucugacuucugacccaggcuggccucugggugaugcaugcuaaguuuccuggagugaguauguucaccagccuagcacccuuccaccauaccgcuucaggccuuugucucaccuguaagguagagucuggaaccagggaucaccaugcucccucuaggcuguaaguugagauuucagaaucacuaugcuuugacuccaacauguauaagccucuuacuuuugugauuagauguuugccuggcuccgguagggugggaaggacaggaaagggacagagaccgggagauccagaguuugacuccucaguguuugauuucacucaugacucagggcugcuguguuuucagugcugugacagaggagcucuuuauuuggucuuagguuugacuugggggaggaugaaccuuuaaauggaacccagggccuugggcgugcuaggcaagugcccugguccuuaauuucuuuucaaccuuugaaaccaaauuauacaaauaauggcaaucuaaccuugaaaagcauucauccaguacaugauuaacaaauauuguguucuaagaauaaaaauccuggagaugauccuggaauuacaugauuuucaugcuucacagcaugaaguacuugcuguuucuguaugaggaaggagaaggcagacauuccuucaucucaaugcauaacuaguacuuugcggggcagggaaagggugucauuuuuaaccuguggguggggaagcuguaaaagucuucgagauuaaucuguagcuuuccuugccaucaaugcuaguaaauccuacagugugaaaacagugaccagauuccuguaggaaauggcuuccuaauugagaaaucacugugcucugaggugcccccaaucugguaagcuuuauggucuguucagaauagcaaaguagcaaaauacauugcaguuuauuccauauguuugagaaauugaaacugggaagcucauuuugugucuccauaauuccuaaacugcugcugguuuggguuauggagcuagaaaguguagccaagacagggcaauuucuacuugacccaccacuuccgggccaccacccucauuaguuuuacagcucugacuucaaagccuguguccuaggaguuagcugguuuguuuuuuuguuuuguuuuguuuuguuuuaaaauacucaaguucuugucugcuuaaagcaaacuaagcauuucuguguaauuuugugccuaccacuaaaccaucuggaaaagggacuuaacuaagucaugccagccauuuacauaguuuaucgagagaccucuguggccaugccuuucauacccaucagaggaccucucuuugaccucacagcaguuuaucuugaaauggagccaaaucuacagaauacucaacuuuuuucuuuuagcugucuuuugugaggcuauuccgggacuagcaaacacagaaguagaugcucacagucagcuauugcauggaucacagggcccccaauggaggagcuagagaaagcacccaaggagcuaaagggaucugcaacccuauagguggaacaacaauaugaacuaaccaguaggcccggagcucgugucucucuagcugcacauguaucagaagauggccuagucgaccaucaguggaaagagaggcccauuggucuugaaaacuuuacaugccucaguauaggggaacaccagggccaagaagugggagugaguggguaggggaguguggggggggggguaugggggacuuuugggauagcauuggaaauguaaaugaagaaaauaccuaauuuaaaaaaaagaaucucuuacauuugggucucugguggcucucaguuguauugugucuugucuguggcgagacauacagguccuguucuuaagucauagcguacgcugagcagauguucugggaagugcucccaaggcagccaguuuaccacagcuguucucucuugcuccauccaucccacuuauguuucuuaucauugcaccauccaugucggcuggccucugaguuacucagcacggaggcuggccaacucuauagccaacccuucccaacaguaccuauauuugauggaaacuuguagaaccccaucucugcuccuuuuauuugcugagccucccaucugugacagcagcucugugcuagagaucaaggcaccucuuucacuguacuucacauggcagacugugugcaucaccgugagugugcgcauccccauaacugugcgcaucuccaugacugugcgcaucaccaugagaauguauaucagugugaugguguacaucaccaugaguguuccacauggaaucacugcugcauuugagacucugcucaggccccuuuaaucacauuauuacuucaagaguguccaagcgggcuggugagauggcucaguggguaagagcaccugacugcucuuccaaagguccagaguucaaaucccagcaaccacauggugucucacaaccauccauaacaagaucugacucccucuucuggugugucugaagacagcuacaguguacuuacauaaaauaauaaauaaaucuuuaaaaaaaaaagaguguccaagcuagacaguugucgccagcagccacuuuuauguccuguacuugccccugcacuccaucuuuugggaauucugaacagaauggaugcugucaacacaggcaggccugucucaccaggagguucauaugauuuugauuucuuuguuguguuucucuggagcuggaacacaggcccuuccaugaaacaagcaccgaguuaccaacccgcacccuaccugagcaagccgaucuuuauaggcuccucagaggugcagcuagguagcagagcacuuagccgugugcacuugggcuugcacucagcccaacagcagagacaaaacagaaaaugucuucagaaaaauuaguaucuauuccugcaguuugacucacuggccauucuuagauugucugcucuuugcaggcauuuugcuggacagcuucauguauaaaacagaaauuccuccaggaauugaggagucagcauagagcauccuuaaaacaagacagaacaaauccugcagcaguguccccucugaauggggaacacuuuagaagaaagggaugagcuaagccaugagggaugagagaguuagagagcaugaacagaaggaagaauauucacauguggguaagagaacaacacaggcaagcaaggggugggacgugugcgcagaacaggcugcaggagcaguggcugccauaccgugucagcuaugagaggggaguggaaaaggagaaggcugcccauuccagccugcucucagaggaucuucaggagucacagaccacagccauuagcucugcugguaaauggaagagcugccccucagacaucugccauguuggaaggucaaggugguugguucauggcugugauuugcuuuccugacugugagaacagggaaaugggcucuuaguuguuuuuuuguuggcugaaaucuguaguuaaucucaaaugcuucggccacacaucacaaacuucuuuguguaacugcauccauguucccaaaauaaugacucugagauuaauuaauuaugaauaacugccuaggccauaagcuuuuucuuguucccagacuagcaccuaacuuauauauuguguuuauucuauucuaaguccugccaggugguucguugccucuccucaguuucaugcaacccauauccaucagcauugggagcaaaucuugugcaucccucaucccagaguucucuuuccuugcuggaauaccaaccuccuacuuccugccaauagcuucuuuauugacagaacacaggagauuaucccuauaucuuugaccugggcuuuuaagaaaacagccauagguguggaugggacuauggacaggagugacaacagaugaacauugacaacagugaaaauugagaagcaacaacacaauuauaauacuaggcguuuguucagcuaugcucagaaguaaugaaaagaaaaaguguguugaauauauuaaugcacuaaaucacuuagaauaauuuuuacccaacauggaugcaaaaguuaguuccugcuguuaacccuuuuauacuuuuuuaaauuuuugacacagggucucaaacuuacagucccuacaagugcuggggugcaaguguacccuaccacacucauuuugacuuuuuaaaaguuaaacauaaacaggauugcuuaagagaggguauaagaugaaggaagaacaagggcggggaggggaguguagugcuagaucacuuucugggcuugcaagggccaggagggcagcacagcgguacccuggcagggacaguagcguggaguggaucacuugucuggugcacgagggccgggagggcagcacagugcuaggccauugccuagcacauaccaaagcccaggcucugucuccagcaucacaagcagcacauggcagaggagggaaacguggcgcaggagagaaaccagaggcuauggccuguugaauuugagggccagggcuucugaaggagaggucagcagcguaggguagagugucucaggggaguucuagccguggcaguuuucgccuagcgugcacagaaaaccuaaguccacagcugagugaguaugaacggacccuccgaugacugucccaggaaggaaguaccauagcaacaccucagcaguguuuugucacaccucgacccuguccuuaguaagucaccuagcaaaucaauuugcuuucuuuuuuuuucuuccuuugucguugagcacuuccaauaucaacuguguacuguaguuaggcuaugucuggaccuguauucccuugucacuaagugauacaguguaacaacugcggcauacauagcauuuacaguggcauuaggcaguaugaguaaucuagagguaacaaugcagguuacaugcaaguacaucaucuuauuucauuauuuuuauagaaaugauaaccguggauuugcuuguccauaaggugugcaggugucugcaggaauuuccggaaugacaacugaagucuuuuauaaaguacuauuguaguuucuuggcccuuuguguuuguuguucugauguuguuacugauuuauagguguucuuuuuuuugggggggggguucgagacaagguuucucuguguagcccuggcuguccuggaacucacuguguagaccaggcuggccucgaacucagaaauacgccugccucugccucccgagugcuaggaauaaaggcguacgccaccacgcccggcuuauagguguucuuuauguauuauacuauuagucugugucccaugcgugcauugcaaacaucucccacccaucagcugcuuuucuuuccuaauaaugucuucuaagagaaaguccuuaguuuuguuuuggguagcuuucuuugguuuuguuucauuugaguuuucuuguuugcuuguucauuugcuuuguuuuaguuuuaguuuuucuuuuuguuuuucuuuuucuuuuuuuuaguuugggacauaagaccuuacacaggcaggcugacuuuggucauauuagcugaugaugacuuugaacucuugaccuuccugccuucugagugcuagaauugcaggccuggauccacacacaucuggccuuuaguuuuaauauaaauuaacuguuuuucuuuuuuucguggugaguguucuuuuguguucuauuuaaggaaucuaugcaugauaacuuuggcauuguauauauugauguuggaaggguacagagaagaccagcaugagacugauuguauuugcaaaguguccuguuuuaaccuucacauucaguaaagaugucaugcuguuuuuuuguguuugguugcuguuugguuggguuuucugagacagguuuuucacuauguagcccaggcugucuucaaacuuucaauccuccugacucagccugaaugcuaaauuuauaggcauguggcauuguggcuagcucuucuguuuucuuuuaaauaucuucaugguuuuuuauucagacauacguuuacuauccauccggaacugauuuuguguaugauugcaauauggauaaaaguuuucuuucacauagccccauguaucagaauauccagccuuuccccuccacacaggaaaugccuuugucauaaagcaaguggucauguuuguauaggguuuucccugaacuuuuuuauagacacagcugccuaagauuuggggggagggcagagugggggaauugcacugacucucugaguuaguuugagcagaauuaauacaguaucaagucucuaguuuuuggacauguuauauccuuccauuuaagacauguuuugcuucuguaaauauacuuaauaguuuuuagguagagguuucacuaaccuuccaagaaagcaaguuaggugacgaccauuugugccauuccccauaccagcugagagugcgcuuuugaagaguuugaugacgaaaagcugcagucagcuuuaaaagaugugguuucagggguucuuuucacgauggaggaaagggaccugaggggguggcccagaggguucagaaagaaggaauaaaggguacacuggggucauuuugaggaaggguauuuuguuugugacgucaccugguagcagaacuacacugucauaggcacuaugcccuugccucuaggcaguguggaaugguugcgguccggcuugcugcucuccuguacuccagucugcauugggaaaucuugguuuguuuuagcagaguacacuucgcuguuuucucugcuggagauaaugucucuauauccauucuucaguuucagucuccccuuccguuucugaguuagguuaggguuuaauagaaaacaguucuccuacacacacacacacgcacacauucuacaacagacuugacuucuaguuauccucugucuuagucagggucugacuaauacaaccuccgacaucccaaguagcuggaaccccaggugugucccaccacaccaguuuuuccauggaaucuuacaguauccacacaacugaaaggacauuuuuugaauggauauuuaagaacuucaagcuuaaguuacagaaaggucugacugauucaugggaacaaacuuaguuuugcagguuaguaaaacuguccuguucagaaauguuuguggugucuuugcaugaaaagauuuuaacacauacaaagaaaauuauguguagagaggaaguuacaagcuaccuacaaauuaugaugaacuauagaaaccgaacaaacagucacaaaagcccuaguauuuuucacuauaauauuuacaguaagggaguugguuugccauuccauaaaauagaggaugugugucagcucccuccccguaacaagccugucaucucacagagaaaggaggcaugcuggucuccgcuucagagauugcacucacgagcaguugccauauugcuguugaaccuguagcagggcagcuagugcucauguuguggcuggaguacacacacacacaaagaaaggucagcccaaagucccacaguccccugcaaaggcacagcuccuccuaggagccuaaaacuuuggaccccuuaaagguucagcuaucucaguaaugcucccaucuggugccaagcccuuagcaccugacuauagaucaagcccucuaaaaccaugagcugaaauaagucacuccuuuaaagugguuugugucagguauuuugucggggggggggggggcggagaacuaauacaaaauccaguggauacuaugauacuaauauagugcccucuagcuaguguguuuuauaguguuuuuacuuucuucuuuaacauauccuuguggaugcuggguucgcagcucagccauaguguuugcccagcaugcacuaggcccuagagcccauucccaaggucaguuaugugccagcuuuggagauuugauuuggaaguacaguauauuguuaggugaaaauggauuaguuuaacuccugucuugaaucuuuuaaagaugcacuaaggcuuaacguggucuaaauaugguucuugagccuccagaucagggucaacagucaacagaaagaagauugccagucuccucugauggcugcacuugagaaguaccaagcucauucauggcucagaaugucuagucaacaaacagugggguccugaaaacuugguucucuuugccacuuaaucuacuuuuucugggucaucuucuccgcuugauaacaguaauuacaguaguuaaccuuuuuucaagaauuuucagugcagugggcauuacccugccuuucguaugagauugucguuaaauccucuaauaaaacugcccugugaaaauauuacuggucuauccuacugaaggggagggaggucagggucacaucagccaauaaauggcagagcugacacugagauccaggcuguguuccaaacugggaccugaacuguacacuugacacucaguuuccaguuucccuccucccuccccuggaacccugccuucuacaaaauagaagcagcucuucuacaaaauauuuuagaauuugagagccauguuacccacucauuccgcgcuagcccaucacaggugguuucuguucucaugggugccucuucuguccccugugugagucugccuugugcuuacaaagcucaccccuggguguugccugcugcccacugaucugcuuuuuccuaaccuuccaagucaccuucuaagaagacgagagcagggccagugugucauuuaaaagcacaugauuuccuuguaguuugcaccaguugggguuugcgcucuagcuucucuuggagucuggcccuugccuaucucuucaacuccauacccccacccccacccccaccucacuguaggauccagcuuacccgagguuccuuugaucugccucugaucucccaagugacccagauccucaccaccuuuaguggcuucucauacggcccagagugaaguaaccaugugucuucucucccaguauguccucaagccucugugugcacuggacuggguugugacuuacauguugauguucuuguccugcugucagccuacaaggaguuucagcacagggucucgcuccucggccuuucagaccucacacagggcacuggugacgcuaguuagaggaggacaguccggggcaacugagaacagcacauugggggugugucucuccucagcagugggcuaggauaucuaucagaauaaccaagcugccugaggccccuacagaaacacagcuguuuguagcaaagggaaaucuuuguggaagagcuucacacaaaguugagauccucaaucacccaggccugugagucuggacgccugggcacagccauccacaugaagucagcacuggauguuacagugugcagccuuggacucagcacugacuccucugggccuuacuuucaugaagagagucuaggaauguguguguuuugaacauuccuuuugauacagggacaucaacucugcuugucauuucuuuccugaugaauucccacucgguacaaauaaccugaacuccaccugaacccugccucuuuucccuuucagcuucagaacgaguuggagaaaguugaaggggacaacgccgagcugcaggaguuugccaacaccauucuccagcagauagccgaucacugcccugacauccucgaacaaguggucaaugcccuggaagaguccuccugaugugcuccugacaaggagggugaccaaggagccagagagggaaccugaggaacaggugucugagccgccaccacaccagacucugccagcuggaugugccaguccggccgucggugucugucaucguacucugccuucugcuuugaauguugccugcucaagucucccuggucuccaugaagaacugcccuuggcaucagcaguggagugcugcgagcugcacucugcccuuccagaaacaggaagccagaagccacucagcucaucuggagcccacucagauuccgugcuccgggagcuuggagcugaagcuuuagcacgagugcuuucuccucagaggguuacagaaggagggaggaggugaccagggacaaagagaagaacgaauacuccucucugcgcccgcgcugcccuccuguuuaccaucaugagccccagguacaggccagcuucaugcagcuuagcucucagccuguugccugucucaccugcacugcuuuuaguugacaggagaaggauguucacaguggucacccugaucgcucuuuaaguccuuugaccuucccaugcuacauugguaggcuaaaugucugacugaagagaagagggcuuaauuuguagggcccucuugucacugccugcaguuuuguuccucagaagcuguccuggagggccaggcugauuccuccugagcaucacccacagugcucucugcucccaacaccuugccccaagcugcuguugaccagggguugcuagaguaugugauccacugcccaccuucucagcuuuacucucaagauacaaccacagagccacagccuuguaccugccuagaaacuucuuuuggcacaacugaguuugucuuaaugcacacacauucccuccuccaauucauucacucaaaaaauaguaugaaaugccuacuugugugcacauccaugugcacagugucauccuuggaaaagccucggauagggaugguguggaagcccugugagaugugcucaguugaaucauggcagugaacgcauaccuucucccuuccuucuucgcagaccagcauucuuuguucuccacccucauggcaucuaugggcuugggugagccaccucucugccuggaaggucccaugugguaggucaggaucuuugcugucaguguuacuacccugaaacauguucguuugugucagcugccugcuuaacacagccaugcacaccucaugggcuuggccaugcugcaaucagaugcagauccccccaaccccauccccagcuguagaggacagcuaucagauggagucgggcccuaagagagugcagcucaugucucauucuucaucccugaagcagacuccugacacugcugucuucuggugagaggcuaaggccucucagccugcaucuccccuucugcccaguuaacacucucaaaggaauuuaauguugcccacaaaucucucucacccucaaccuaggacaucaugcggccacuacugucacagucacagcccuagcuccccuucuucccugacaugaaguguucccuuguaugggaugcuggagagaauuccucgugaggguuggguggccucugccaugaaccucucauggaggugcuuuuggaggucccagccuggccaccaggaauauggaaauuaggcuaaaagaugauaaucauugcugcucaguucucucaauuuuuuuuaauuguccuauccauaaauccuuuagaaaaucccgguauuucaggauaggaagguuaggaucuuauuuauucucauaaggaaccacuaccuaguaacagcuucacaggcuacaguggaaaucagaaaacuuagaagaguccaggcccacaggaguagccuagcacugccacuggccagcugcugcuccagcuguucugugagggaucaccacagacaggccuccuuacauguacccauuuugguguuuauuagcagaaguaccaucugccacccuuacuaacugcacauaugaaccccuccaccccuuccuucuccaucaggucccuccagagagguugcaggagcccugcaggacaugugcuuaauugagaaggcaaguuuguaaggcagacugugucugaucucugcacuauagcaaaggcuucuccuccucagggagugauccagcagcucaaguggcucuggagacuguggagcuaaaguugaaccauaaauguaguguuuguggucuuuguguuaggcaaaguuaauaggguaucuggcauugggauccuacugacugccauucaguaagccaauaguuacuaaaugcguaacugccauugcacuguacaugucauuccaugacugucugcaugcacaugauccuuaagguagcuggcccugagagcucacugcagguuggcugagaucaucccugccucuucauuccaucgucaagccucauagccuucgcaccuaagguaaagguggccuccccccaggccuuccucauuggccuccuccaggccuuccucauuggccucccuccaggucuuugaagaagggucaaagcaagaauaugucgcuauguaggguaugauacccacaggccuaagugccagcagaccccugugucagcagugucuaccccaagugacaucauaaagaugauaguaggaaaagagggcuagaagccaaccuggggcucccagcucugcaugccuuaguagacucugucccaggcccucauugagugacugggauuagcaaguacuuacggacauuuaagaugaagaagucagagugggguuuagcaacucagcaaugcggaggggcuccugcaauuccugccagccuuuauucucccacuugagaaggccugaguguaccucuuccucgccagugggcuuuagaagagcacuggaacaaggagagcagacuggaacaagaccaccagugguguuggaggucacgcuguggcuggccguguccugucccauccguuuggccuccugggaagaauguguuggcucaauuucuuucucaggagagaugaagucaguccagaugguucucacgugcuacuguccugcccucugcuauuaacacugggacuggcuuggcaccacacccuccuaugugacugaagcacagacucauuggccucccuccaggucuuugaagaagggucaaagcaaggauaugucacuccguaggaugugauacccacaggccuaagucccaccagacccuaugucagcaguauugauaacaacucucgagucugccucaccuccugccugcagaguccagagucaugggaaaggagccagagggaugaggccgcaccacaggccuguugggcacccgccgucacugccagucucagagauucugacuguucaaagacauguucuuccugugaaccaagaggacguucagggaaaaagaaaacauguuuuaccuagggauccuucugaacaaaauggcugucuguacucuuuuuaaccagaaacuuuccaaacuuuuuagugucaaaauuguaaccaagugucuccugauucuucccgaugugcuuggcaagugcugugacccuguuguagguauuucuccuccugccucuucugagggagaagugauuuuagggguugauuggagggagccggugucugucuggcuccugccaccucucuuguuucucugcuuguugauauuguuugugugauucagagaacggggcaguuacauuguguccauuguugagaauauuaaaauauuaaaacaguaguuauagaacuaaaaaauuaaagagcuguguuuuaaaagaugcaaacccaucaauaucauguuaacaaaggaauucaagcuaugggcagccuagcuccuccccccaggucgguguggugguagccaggccagcccuugggagacacacucuccacaccugaguuagguagcugccugggaacaagaaucuggggcucagagacucucaguugugucaggguuuucucuacauccucaggaccucuggguagggguuucaaaguuggugaccccagaaccacccucacccucacauuggaucaagccuugugugccuagugcuauauuguaaccugggcuugggccuggagccccugcuugcaaggccacaggaccucuuccugcccacuuggugcuaucucaucauguccaucuaucagggcagccugggcuccuggagccugugggccaggugccguggguggcccucaagagcuuagcucucucuggcuccugauccuagauuuuuuuuuccuuugaagcuuucucuuggcuccagagaugucagaguuagggaaggaaaugagccaggcugaggcgaggagauccaccccuaugccacagugagcacaccagcccagccccuuucccgccacaccaguauuacacccauucuuuaaagcaucuagucccaccugaggcacaugccauucaguggcccagcugcccagugcagacuagaaaccuaggccggggauggggacguuucucugcaccccuacuucagaagaggcauguugcacuuuaguggggaacccagaacguugggcacuggcuuccuguagcuugagucccuguagauagccaugguggcagccugauggcuugugugaagcagcugcagcugcugccagcugugcacaugugugcagcuccuagagucaaauugccggccugaugaugacaucacaaagauguguucuguucaacuuugccuugguaauuauuguaaacacuuuguucaauuuuuuuuucuuuuuuuauucacaaacuaaauccaucaggaaauuauaaacuuauuuaaaaacugugu

SEQ ID NO: 3333 - RNA, 1379 nt, Mus musculus
caugccucccacccucggcucucggugggccagaagccccccaccucccaccuccagcagcgauccuuaccgccagcgccuucgcucccgcccaauccgggagcuccgcagggcgcggccgccggugggcucgggugcgcuggggcgggguccgcccucccgaccuccccauccuccuccccacccccggcccaaaaaggagggggagggguccccaagccucaccuacagcuccgccccuccccaggggcgcucugcccugcccagccagggccgggagcgccgagccggguaggaaacgacaaaugccucggcgccugcgaccucugggcagaucgagguuccgccugacgagcgagccgcugccgacgcggccgccuuacucuccucagggccgccgcugcugcugcgguugcugcuacugcuucccggacagccugccgccgacacuaccacagccgccgccgccgccgccaccgccacagcacgaccggcgcccgcgacgucaccacgccccgccccccgcgcacaccuagccccacccccugucgcccgcgcggcgcccucgccccgccucccgcucucccgggccgcugggcuuucccucgucccacugggaagcgccccgcuacgccgcuccacgggaccgcgcgccaggaucgacaagugcggcgcuccgaggccgcgaagguaacugggugccgaggcaggguugcgccacacguagcgccgccccucacacacacacccacacccacacccacggccgagcguccaccgggagcccgggccgcgauauugagcgaggaaggugcggacgaggaggggcggcguuugucuccuccugcuugccguaggacguggacugcuggaagccccaggaguggaguggccuuucccaaaccuggagucgccccgccccuuccuuggcaagcccguuacccgaacccugggacggccgccaccuuaggaaauaaauagcucagggcuugucauuagagccacggcugccuggacacccuuuguccaagagaaguuagcuucucucacccuuggcuuuugcgcugugaggcuguggaaggcaauaauacucuugagucaucugggcuguccaagcggucauggcaaaagacccucgccucaguagguggcuuuuuuugcaaggaucauuccagggaggaagagugugggcggaaccugauguccacaugcaguguacugugccaaaugcuucaccgcguuaccuuuuuuauuuagcccucacaccaagcaaggcgaacuacaaagcagcugcuaccuuauuuuagacagcccaguuuucugcugcugaauuucaaccuuugccuuuugucaagagcaagccaaaaaaaaaaaaaaaa

SEQ ID NO: 3334 - RNA, 1379 nt, Mus musculus
uuuuuuuuuuuuuuuuggcuugcucuugacaaaaggcaaagguugaaauucagcagcagaaaacugggcugucuaaaauaagguagcagcugcuuuguaguucgccuugcuuggugugagggcuaaauaaaaaagguaacgcggugaagcauuuggcacaguacacugcauguggacaucagguuccgcccacacucuuccucccuggaaugauccuugcaaaaaaagccaccuacugaggcgagggucuuuugccaugaccgcuuggacagcccagaugacucaagaguauuauugccuuccacagccucacagcgcaaaagccaagggugagagaagcuaacuucucuuggacaaaggguguccaggcagccguggcucuaaugacaagcccugagcuauuuauuuccuaagguggcggccgucccaggguucggguaacgggcuugccaaggaaggggcggggcgacuccagguuugggaaaggccacuccacuccuggggcuuccagcaguccacguccuacggcaagcaggaggagacaaacgccgccccuccucguccgcaccuuccucgcucaauaucgcggcccgggcucccgguggacgcucggccgugggugugggugugggugugugugugaggggcggcgcuacguguggcgcaacccugccucggcacccaguuaccuucgcggccucggagcgccgcacuugucgauccuggcgcgcggucccguggagcggcguagcggggcgcuucccagugggacgagggaaagcccagcggcccgggagagcgggaggcggggcgagggcgccgcgcgggcgacaggggguggggcuaggugugcgcggggggcggggcguggugacgucgcgggcgccggucgugcuguggcgguggcggcggcggcggcggcugugguagugucggcggcaggcuguccgggaagcaguagcagcaaccgcagcagcagcggcggcccugaggagaguaaggcggccgcgucggcagcggcucgcucgucaggcggaaccucgaucugcccagaggucgcaggcgccgaggcauuugucguuuccuacccggcucggcgcucccggcccuggcugggcagggcagagcgccccuggggaggggcggagcuguaggugaggcuuggggaccccucccccuccuuuuugggccggggguggggaggaggauggggaggucgggagggcggaccccgccccagcgcacccgagcccaccggcggccgcgcccugcggagcucccggauugggcgggagcgaaggcgcuggcgguaaggaucgcugcuggaggugggagguggggggcuucuggcccaccgagagccgagggugggaggcaug

SEQ ID NO: 3335 - RNA, 114706 nt, Mus musculus
guucaacaaaagcaaguuugguuuauuugaaugguuucauuaaauaagucuacaaagguaacaaacugaagcacaaagcgcaaucuuacagaagcgcagcccccggaguuagugcaaauguacagguaacggcugcugagaaaccccaagguuugaauucaguuuuaaacaguguacauuguuaaauaacguaaggaaaacauuuauaauucggaaaguucuuuuuaaauguggaaagauacucaaaguguacuauuaacacaaaaauaauuuaaacaguucaguagcacuagcucguuucucuaggcuucaguuauuucauccacaggagggggaaaccaacaguaaguaaaccucugugaagggggaacagaccucacucagaaugacuaaaccaaacaccacaugcugcauuuggcucccucuacugcugguaugaagcacucagucauccuguaaccugcuucacucccacaguaccucuuaccgcucccaaaaggaauaaaugagucaacacuuugguagcacgaccugaaacaaaagcccugcucauuacacuucccucuccugaaacuuucagcucucacuuguaucuuugggccucgaccaacuuaaaaagaacaagacucuuacaggaagaagccuugcuaguguggcaacuccugggaugugucauaaaguuggaaaugugucaguucccaacucaaggugaaggaggaagcacccaagaaaugaguucuacuuuuuccacuuuuccagaauauucagaucccaaacagccaauuaggucccuauugccagaaaaucagauaauacugguugguugcuguuauuuggggauauggguaugaaaaugugagaguauuagcucuaauauagaaguacaggcagcacaauagauucugacugugcaaccauuuggacagcuaggaaaggaaauaagcacuuuuuccuacaaugcuuagaaaguuagaaguggguugaauucccacaauacaguacuuaaagcagagaaaguguggugguacuugugcaacaagaggugggggcaaccgagcagguuuccuuagagcaacauuuuccaucugugacuuggcacugucauccuucccaacuuaaaaucuagcccacuccccucuuuuuguuuaaucucuucuagaucucguuuguucacuggccaagcaucacuucaaacaagcuuguccccacaucuucaguccuuaucuuucacacacagcucacaacccuccucauucuuucugaaacagaacuuuguuuucaaccacugaugccaacuucacugugcucaccuuacaccugcucuaggcaaaauugaaacgacugagaaaacaaaacaaaacaaaacaaaauaauaaaccaaaccaaaaccaaaaacacuuucauuuucccuuuggcauauccacugcuggggucauguggaccuaagauuucuuuccacauacccuuuggugaccuggggucugguaaguugaugcuaacagcagaagcaauagaaguccaaggcacuaaaauauccagcaagcaauacugggagaacagaaguauucaaguacaguaauuuauacaauuuuacauucacauuuauuuaucuaauacaauggaaauacaaaggaaaaaguuaaagugucuuaauaaguaaaggacagagcuagcuuuugugugugugugaaccuuuuaaaccuuucaaauuuuucucuuaaaacuaauguuguccaacaacauuuauauaucacaguguuuccacaucaaaacugauggcaaaguuacauguccgcagggaacguuauuguuuucccuaauugcuaaugcugcagucaaagcugcuaauaucuuuugcuuaaagcauuaaugaccuauguaagaaaggguugcaaccccaguccccugguauuuuucacuagguuguaaaagggggggaaaaaguggggguagggaucagagugggagagaaccuuugucuuaaggugugcauuguugagggaauaaggaauuugggacacaugucaaaauuaaagagcucugcccacuuacagauacagaucggguuuggcuuacauugagcucuuggggcuuucugguaacaagguucucuucuaguucuaggccuuacugagggguacaaaaacagaaaagcagucucaagcagccccuccaccagaaagcuguucauuccuucuuuuuuaacuccaacaaacggagaaggagggugguucuccauucugagggcucaaaaugguauuaaaaacauucccuucuggcaagaaauaaccaguuaaaugcagcacuaguaguuaguauauaggcuacuuccccacccccccacccccccagcauuccauuuccugcccccaaaucuacucaguuaacauccuugcugcugacuaggugguccguagauuggaaccugggggguugcugauggacuucugcaaauugcugauguugaaauuuugcaaggaugcuguuccuacagguuggaacuggccaaguggcugcggugcuggaccaccuguuccacuccacugagugccaaauggggcagguggaaaaccauacugcugugggggacacauggauuuggugaagugaccuagagagguagcagaugcugcagagauggggguagagccacccagguuugaggucaugggaacacacagcugcccaggagcagagaacuuccuugccauuccagggcccuaaaaacaagaaaguagcaaugagaauuugaugaaaaaugggugauacuauaaugcuguuguagagcugagauguucuaaucuuagcauuaucaaaauauaacgaagccgcccauauuuauuggcuuuacccuuaacaaggaggagugaaaaguaggaucugagauguguuuuaugugcacaugcagguagugcaggauguugaagaaaaaggguaccaaaaugauugcugccuuguuuucucaauaauagaauccacaggcuacugaagaugguagugguaaggauggcauaccagccuuggcuguccaugacaugucuguguauagucuggcagguuaggaaaagggaagacucaccucauaauucauguguccuuugcugccucuccugccugaaagauucauggcaucucgggcccaguugucuacuaacuugugcaggucaucugugaaugugcccuuccuacuggaagucauagcaggaggcugagccugggcagccuggcuacucacuguuccuccaacgguauuugugcugcuggucccuagaauuauaaguaacacaauauuagcauuaaaguaggguucugggauauaacuuuggggaaaggggaaaaugucauaggguaaugauuggcaagccacggaauggggagaauauuugggaagccaugcaggagaggaagauuuugaaguauuacuuauccauuugcuuuugcacaacagguagugaaaaugguuucucuuccacagcuuguagauaaggcuaaacaacauggagugauggcaggcaugaagggaagggcauuuucuaacacugggacugucugccaguauucuauucccagcaacauacugaugagggagugauaugguccacggggcuggcugcuauggaacuuugaagagagcagggccaaagaaguacugugcacugggcaaguuauauaguacaaaggcagagaucagggcuucuguggaaaagaugggguuuccagacagcauguaugcuguggcauucguucuuuagaugcucuucaaacaaauagaaauaaggagaugcuacaugcuuuguuuaaaaguuuucaccugaaaccauaaacauaaauuugaaaauauaaauuuggaaggagucgaggcuucaacuccucucuaugucccaugaauaaagaacugaguuuuggcagcagcagaaaugccugaaauucucagcuccaugaaguuaugacuucuugaggacuuggguuuuaacuggucaaggauucucaucccuucuccccauucuucccaacagaagaagcacuccuggguugaagcaacaggaaaaugcagcugaggcaggggugcagaggggagagaaggcauagagguuaugaugaaggauuucuauuucuaugguuugaugaaaaagaaaggaggagucuguguccugccugauuucgguucagcuggagggcacacugaagguuauucguagaggcaaguuuuagggaagagggaaagaagagucauggucuuauuuuugguuuuuaucccccacuuaauuaguagacuuuacauuuacuacacaguaaauaaagguuacuaauguugugagccagaagguccuaccauacucaaggaacucugggacuaaaugcaugcguuuuccugcuuuuaaaugccaaagcagcacaccagagcacagcagcacaccugaagcaacccuacugcaauccacuguugguaccaaaggguguaucuauuuuaccacaaagggaaugucucuagcuaaaagcaugucugugcuagaggaaagcuaacuuggguaaaggugcagaauaaggaugcucacaugcuucuuugguugcuguggcaagacaugaauuguugcagucacauggugccugcuaaaacugcagaggauuguuacuauacaguguaaagguagaguaauucaccuacaguauaggaaaccaagugggaaaguauaaaagcacaggaaacagccuuccuugaauagcaagugugggacaaaggugcagugggaaggaagcacaggcugugagaugggcaguuacaacagugaggaaacccagaaagcaggcauguggcaugcacgaggacuagcauccugcuagaugacaggccagaugaucgaaacaauaaaaauauccacaagugagcagagcugucgaugccagaugagaagccaaggcagggugagcacugcuugucagagagcucaugccagaggugacacuucucuagucucaugcucuugauguugugagggccuuuaaaacuaaacaccauucauuuuagucuauauuccucaauacuguauucuaaaaaugagcuuuaccguacaugugagcgucacccuacaguuagcuuuuuauuguaguuucugacuauaaaguaggauuaacaggcuuucugcggugugguuacuuuaaaauguuuucaguucccugaaagcuuuauaaaauaugauagauuuuauuuccuuaaauucaucuucuaaguuucuccuaucccuacgcugucagauuaagacauguccaucagccauuauuaauacauguccaucagccaucauauaagccauauuuacugccaaggaaucccacccauagaauuuucuuguuaacucucuauauucuuauaaccuguugaguacuaaauucuuagcauuugcgcuuuauuuuaaugagaaaccccuaggcuaaaaagccaagcucuaccaaccaacaagcagcacuccuuucccuacuagcugagcaacaacuacuacugcgcuaugaaugagaugagaacauggcugucuguacaccuagaucaucgcuggguuuccagugugaccaacaguggugggagcaugcucccugccucagagacccucuguacagauccuaggcucccuccaucacaguggauccacgacuaacccagcugggcucacaggagagcacuaacuaugaagugguuucucaaacuggaaguaguaguaauuaaauauggcaauuaagcauaucagaaaagggugcaggaauggauggaaauuaggaaacagggaguuaaugaggcuucagaguucaaagaacucauggcuuugcaaucaggaccaaaaguaacagaaagaaaagauaauuacuacagagcugguugcaaggacagacuuuuuucaccaucuucccugaagcauaaagagagagcaguguguuaaagaaauaucaguguaaaaucuuuacagacucuccaaacagcacacagaagcccagcaagagaaagcaggaggggacauagcugggugggaccugguagcccuaaauguaaauucaagucuauagauuagucaaacuggcuugaguauuaacauaauuaucagguggacucuaaagccuggaugacagaugcugaacuuuuacaccuaaucuauuucuaaacuauaauguggcacuaaggcucuagagaaggaaggaacuggucucacugcuugaauuucaaauacccaagcagugcuuccauugaucucguccuacuuccuguuucuccugcuggguuguuauaaagcauuuaaaucaguuccauuguuaaagcuuuaaguuaauuuaaacugguuguuauauuuccacauccuagguacacacacacacacacacacacacacacacacacacacacacacacacuccuacacuacacacacagacucucgcuucccccaaugugccccaucccuuccagaaacaacuuaaaaguauguggaaaacaagcaaccuuuaaauauagauaaagcauuaagccaagccgugcuuccaaacuauuuugagaacauaggauaauguauccaaaacuaguaagggucccucacgcuuucaaguaucuguuuucuauguauuuuaaaaauucugccuccuaggauuuguccagcaguuuuacacgacauaccaugaugcaccuuccauagguauaaggccuuucauuuucaaacagauaauacugccuauaauuaagaguaugcugugaaauacaaaauuaauucaaauggugcauaacagauauuauagaaggaagccuugcuuugucuuuuuucuucucaaacuuaucaggcuguguauuacaggccuggcaugucacauuuauuaauacccuauuaauaauacucuauuaucaauaaucuauuaucauuacuauuauuauuaaucuuucuagcuggacacauaaauugaaugcuuauucaaaugugcuaauaacauauguagucaaagcuacccuaauuaaaaaaaaaaagaagcuauuaauaaaugcauacccaaauuauacaugcuuggaaacuacgaaaauggacaaugcccuccagccacuuuguugaagagcccagcccuggaccacugacaugugugggaaugugguaagagaaggcuauaggcagaagcaauccauaacuaacucaggaaaaaaagaacaggggaagaaggaugacaaauaugucagugagcgaaacagagguuaaaucuaauacacaaaggcacaagaacagagcagagagcaaauucuucccaccaugaagaggccaaagccucccugagccauacuuagaaacacugauggcuuuagcacaugcauuuaaaagcacuaauaaccacuccagaaguuugaggccuucaccaauuauucaaacucuaaucaaguucuuuuucuuacuugagguuuuucuuuuauauuuuuuucuuucaauauacacuacuggccaccuacuaaguagcagauguuuuuauaaacaauaucacauuuaaauugcacaguagcccuaggaagugggcacugacuauuuauuccuuaccuggagaagacaagauagggcauuugcucuugugucaccuuauuauuagugauuaaauuagaauuuauuuuuauuuuacacauauggguguuuugccuguguguaugucuguguaccucaugugugugguguucuaaggccagaggaggauguugaacuggcauuguagaaagcugugagcugccacauggguguuggaaauugaaccugaguccacuggaagagcagccagugcuccuaacucuccagccuucuuuccagcagcacuguaccuuucucuuuggugugugcucucuuguguauugguacauguggagguuggagaaaaggcucagguguggguuuucaugacaacacccaguuuucuucugaggaagggucucucauuggcccagugcuuguuaacauggccaaacugauuugcuugugagaccugggaugcuuucuccaacuuugcugcuacuaggaucacaaguacaagccaauaugcuaagccuuuaacuuaguuucuagggaucacacucaggcucucuacauaguaaguacuuuuugagguauucuucuagcuuccugcaccuuguuuuuaaacagaaagugggggaguucuauuaauauuaaaauaacaaauuucauuugcagaucuucagcuauggacuucagcuuuggucuucaaaagaauaaaugcuuugucaagguaacuauauuaaauguucuuugaacuacuuagugucacggaguugguaaugauggaaagggauuucuaguaucuauucaacuugcaaauauucaggcuuaauugagaaggcauauuuuuaucuuuaguaagaauugguuaggaacaugcuuacugucuuucuuuuuaauuuuaauuuugagaaagagacuugcuauguaguucaugcuggccucaaacuugcaaucuuugcuuuuccuucccuaacaugggauucauggguacauaccaccacuaaugucacagaauauggcuauguauugcagccuaacaauggggacccaaacuucugaggguaacaaucagccaagccacugaguagaugaaauauaaagacaaaugaaaauggacugcgugacaaaucagauccaaagcagcagaaaaacaaggacaaggaaggaguaaaggaguuacacacaaagagccaagcagggcguacucagaaaucggguccuccugccaccagguuugaaugucaccugcucagaugcacaguuaaacuucgcacagccugugagaagggaaaaggaaagaacagagaggagaagagacaacacaacuacaagauguuagagcuugaggcuggaguggugacacacuggauggcauguagaagagcaagauccgcagggaaguccaucugcuguaugagacagagacgccagaccucacuccauuggcagaaaugacgcuuuuuuacgauuggaauaaugcuugcaacuuugugucaauucuuauuaagcaaacacauuaacuaggugaagggaaaauggaauguuuagauuuuaugcaaaaggcacuuacuuuucuguagucugucccccaacuccuuucuaccuaaacacccaauucauuucaauuuuucucuauuaauaacuccucuguuuuuugguuguuguuguuuguuuuuuuuugaaacagguuucacuacuauagcccagccuggccucagccucgaaaucaugugcuacaauaccuggcuuuccuuucaaucuuuaaaauguauuuuauguguaugaguguuuggccugaaagucugugcaccauauacaugcacugccaucagaggucagaagagagcaucagauccccugggauggcugggagccugcacgugagugcugggaauuaaacccagauccucugcaaaagcagcuagugcucuuaacuacugauauacauagucucuccuuucaguucucaauuuuaguuacuaaaagcuccaugcaguaaguuuugaauaauacuaaacaaaacaguauuuugguaaguagaguacggaucaagaauuugaucuuaagauauuccgcucucagacccugucccacucucugaaauuuucuuauuuucuaaaucaauguucacuauguauuaaaaaaaaaaaaagauguuagagcuagucauuucagaaugcugcuaucaugcuuggaaguuuaaaaagcacauuggaaaaaaaaaaaaaaaaaaaaaaaaaaaccacauuaguuuuuaaaaacugccagcaacuccuuagaauuuuguccacaagucuuggcuuagggugaaagguuaaggucuaagucuuaaaucagcuauacauauaggcugcagguauaaugguuauucuuucaaaauaaguuauuucagagcuggguuugaugacuuacaccuguaauucauguaaauucaugcuugugggagucugaagcaagaggacuucuggaaggacccagguuagccggguuccacguugaguuacagaucaguacagucuaggcuauaaaaugaggugcugucuaaacaacaaacaagaagcuauccuaucagauggcuggaagcaagcaggucagugguucuaaucccuacucaguuuuucugcuaaguucaauggcuagucauugcuuaacaacucagacucuuucuacucagcugauggcaguaagcuauucaucuuccuuuuguaccaaguauggcaauauuucuauuuuaauguuucuggaaauugguggucaguuugaauucuuaccuugaccuggagcagaaaggcuugguacugaaauggcaccaucacugguaaaggcugaauagagguugucacuggagggagauggcuuaagaggcuguaacagcugguugugcccagucucggggguguuuccugcgggauggagggucuguuggggguguaagacugaaguuccacucugaccagacagguugccuguugaaagacagagaagcauggaaaaucauguagaaggggcugaagcuauauuuuaauucaauaagcauucgugaagcauuggauuucaucucuagcaccauauacaccaggguaugguggucagcaugucuguaaucccagcacuuggaaaggggaggaagaaugauuaggcauucaagguaauccuccuuaacugcacagugaguaugaagcuaguuugggauacaugaggccauaucuucaauaaauaaguaauaaaacaaaaggaaauaaaaaaauaaacaaacaacacauaagccuuuccaaauacacuuauuguuucuguuuccuauuuguacugagugguaaauaaaauaaacccagaaaaugacaaauggacaaaaacuuuauugauaugaaggucagaaaagauaaauuuauuaacauagaguuauuaugaauugcuccucaagaaugauagcuuuagauaacauguagagcucacuaaucugagcagaauguacaguaaauuagacuaagauagauacagagcuuccauuucuacuuccauaaucacugguuucuuccuauuagaaagauggugacuauacaaacaggcuguuagucucugcuuacauuuucuaauaaauacacaugauauaagauauauaaaaaggggcuggagagaugacucagcagguaagagcacugaauguucuucugaagguccugaguucaaaucccagcaaccacaugauggcucacaaccaucgguaauaagaucugaagcccucuucuacugcaucugaagacagcuacaguguacuuggauauaauaaauaaaucuuaaaaaaaaaaaaaaaagaaaugcacuaaaaauuaugucauauccagagucugagucugaauuagccacucuccuauacagauauaaaguugaauaaacuggucaaauacacaagaaaauguuugaauaacuauaaaaauuuuuuagauaauagagcagguaagaaacuuacaaaugcuuuccauacuucaacuagaccuggagaacaaaugugaaaaucaauccacuuuccacccucucuuaacucugaaaccaauuagcugucauacacuacacaacaaggacaaaacuuucuaucccauugaaauaggcauagucuauuaugaaaaguuaugauuuuguaucuuuguuuagagucaccauccaguucuuuauucuaagacagguacaugagaugcaaaguuucauuuacgauauuaccacuuaggcacacccaagucucugacagcuaaauuaaguugauaaaauuauggucaauucacagacauuuaaaaaagaaagaauccugaggcuggagaaauggcucugugguuaggagcacuggcugcucuuccaaaggaccuggguucaacucccagcacccacauggcuacucacaaccaucugcaacuccaguuccaggagaucugacaccuuacacagacacauaugcaggcuauauagcaaugcacauggaauaaaaauacauacauacauuuaaaaaaaaaaaagaaaguaucuuuaguuaacuagacagagaauaauuuuuuucuucuaaaugcccaagggucugaucaaauguugcauuguaugaauugacagagcugaauguuuauucugaagaauaaucauaaacaaagauuguuaguaagauaaacaguaacaccaauuacauaaguaaaaauaaggaaauaaaacaaacaaaccaaaagccuacuucuauagugucaacagagguucaaaauauacgagagauagaaaacucaaagaaagaauacuagaaagcuaaacaccuuugcaauguaauagaaguuaaccaauguuuaguaguuacauacauggugagauacagacaugagaugacugacaugaaggcccaggguguuguaccugaaagcugugggcuuuuauugcccaaugagcugcugcgacuagacuugcugccuuugcuuuuagugggucuccuucuucuccccgacagaggagcagcugggggaauaaugacagcagggggaaccuugcccaguuuaguauacaaagauucaauuucaugcuucuggcgacucugcagguccugaaucucuuuaagaugucuauaaaaaauaaucagacacagauaaaaagauaaccaucuuuguugaaguaagaguuaaagcauauucuuaaaucugcagucaagugcuaaaugugagauucuacuuuuacaauucauuuuugcuggucucuauuacacaagacacauucuagcaagcuccuagccuugaugauagcauacuacagaaaaaaaugacuugaagucauaggaaggguaggcaaaaaugcuaaugugauccaagugauaguuggaaaacugaccacaauuauauauuguagugcuauuauuagauucauguuauagacuaacaaacaaccaagaguuguuaguuauuaacauagcuggagagaugguucagcaguuaagagcaguuucucucuugcagaggaccuggguucaguuugcaguacccacaucacagucaacaaccaucugugacucuagguccagagaacuauacugacuuuuguccuacccuaggcaugcauaucaugcauauacauauaugcaggcaaaacacauaaacauaaacauacacauaaacaacuuucuuuaaaggugccauaauaaaaaauaauaauauagagguguuaaagagaucccaaaaguagaaaugccaugggugcuggugaguacaggacuacccaugaauaauguaucagguaauuuuagcuuuuguauaucacuuucugcucaaaugggguguaaaauuagcaucugcauugaaaagcuauuaauaccagguaagauacuaacacuauuuuacaugaaaaaaugacuuacuuuucucguagucgucguaguucuaaccuuaagucuucaucuucaaugucggacucauugucacuacucauguaugaggaguugaaugaauuacuaaggcuuugacuuagauucuggacgggaaggcucuuugaacacaggugagggggagaguguggacuaccugagccauccucuguaccccuacuuagaaaggcagccuccaggucugaagauggcccauucaaaugggaagguucugccagcucaggcuucuccuucuuugguaucacagcaggaauaacaguuuguucugaaucucugaaaggaggagaggucacuggucccucuuuuuugagcucugugaccuuguccucaguucuugaaacagagaaacgacccacuuuguuggcuguaguugucaccugaaaacgucccaccuugguaggcuguccugcaucugacuuugcuucugggguaggugcuuugugggugcugucugggacaucuaaggagaugccagaaauacuaauuccauuaggcucuggcuuuaccaggguacucucuggacuacuacuugaaagaacugaugacucugaugugcuagauucaaaaugaaccgacuuuguaucuucugaccuauuuuuacguucuuucugggcaucauccauuguaacugaaaccugaugggaaaaagagaaugaaguauaauuaaaaaaugaugucccuggcuaggcuuuaauccuagcacuccagagguagaggcaggaagaucuccuuaaguucaaguccaaccugggcuauauagcaaguuccaagccagcuaaggcuacacagugaaaccuuuuuucaaaaacgaaaugaacaaacaauaaaaacaaaaaacccaaagucaaacaaacaaaagugagugggguggguagagaagcagaucuuccauuuuuagcagggacaguuagaaaagaaaaaucugcuggugauacagcucagcuggccaaaugcuugccucguauaaaugaggcccaugggagaaaccuccaggacuaaguaaaccagggaagguagcacaugucuguaaucccagcauacucuggagguggugucaagaggaucagaaagaaauucaaaaccacccucauauacauauagcccgagcuguagagcuuagcuuaaagaggggagagaggucaggaggggcagggaauaaaggaggaggaucaacuuauuuuccagugaauuuguggaauuucuucucuuagucucuuugaucagugugaaguaaaguggacaccuauuauagagaacacugcaucaguacugagaugcauauucucaguggcugcuaacuaaaugauucauuuuuaccucucacgugacaucacacaaauucacgucucagucaaauuuuaaugaugguuuuguaugaauagauaauauccaacaaacuucaaauguuagaaucaauaauagcaagaucauccaugccauggcuuguucaucauauaaacucagcaugucccaaacucuuagaacuuugguuugugaauuaaaaacaaaacaaacaaacgaacaaacaacauauccaacuccaaggacuaucccaaaauaauuaaagugguuuuguaaaugguuuuguauguacuaagguucaaaaauucucaccaaguagguaaauaaaauguaguaccacuugaugcugacuucacuugaaggcugaauccuaagaaaaacauccuaaauauggaagguauuuuuagauguuugcuauuacuuuccuuaguguguuggaaaauuacaacaagaaacaaaagaaugucuagguaaaccaaauggcuacuggaaaaggggaucuagaaaaguuaauuugugaagcuauagccaguuguuaagggguagguggaagaaaauaugaguuugcauuuucuuuaauuaguaguaaugguuuaugaggaauaaacaauagagcuauaaaaugguauauaaaauaaaaugcaucauuagauugauguauuaugucccauauauauauauuucuuuuugguggggauugaauugaaggucuugaauaugcuucuuaaguguccuagccuucuuuuuacuuuuaauuuugagaaaagaaucuuaguaagucuggacuugaacuuacucaguagucccaagaaugcccugaacugauggcccuccugcucagguucuuaacaaaguaucaaguaucaagcccaugccaccagguuuggccaaucuuuuuuuuuuuuauuauauacccugucuccaaaagaggcaaagaaaauggucaucuuaccugaaaucgccccaucuuaacaacaccagcuccugaacuaguugcugugacaugaccuucugugccuugagagaaaacaagaaaauaggaagacaaagccaauuaacaucucuuuuugcaauuucaucaguaaugugacauugaagauuccuuugcuacccuuugugugcuaacaaacgugaucuuucugugucagucuuccaaguauguaugaaacuacaagugcgcaaucagauacacaacauuuguuuuuauugcuaugguuucuuuuuuuuuuuuuuuaauuuuucuuuacauguuuguucacaugagugugagugauuguaagucccagagauggcggcaggccaacugaaucgggacuuacugaaaguugugaauaaccuaagauggauuuuggaaacuuaacucagauccucugcaagaguagcaaguucccauguuacugagcagucacuccagccccuuugaagcuuuaaacauuuugaauuacaucuuuuuaaaagauauuuucuuuauuuacauuuaaaaugcuaucccaaaaguuccauauacacucccccaggcccugcuucccuacucacccacucccacuucuuggcccgggcguuccccuuacuggggcauauaaaguuugaaagaccaaggagccucucuucacaaugauggccagcuaagccaucuucugcuacauggcgguuccucagaaaauuggacauaguacuacgggaagaucuagcaauaccucuccugggcauguauccagaagauguuccaacugguaauaagcacacaugcuccacuauguucauagcagccuucuuuauaauagccagaagcuggaaagaauccagaugccccucaacagaggaauggauauagaaaaugugguacauuuacacaaugaacuacuacucagcuauuaaaaacaaugaauuugugaaauucuugggcaaauggauguaucuggaggauaauaucauccugagugagguaacccaaucacaaaagaagucauuugauaugaacucacugauaaguggauauuagcccagaaacuuagaauacccaagauacaauuugcaaaacauaagaauaucaagaaggcaggcaggcaggcuaugauuucuuuaugaugugugcgugugaguaugcacuugcauguacaacagcacauggcagaggacaacuuucaggacuuaguucucuacacaggguagauucuggcauuagaaagcaggcugucaggcuuguguggcaucaacccuugagucauaucacuaggcaacaucaguuuuugucuuuaaauacacauacacacaaagaaaauuacauuuauguauuuuguauguguguaugugugcauacuuguauucuauagaauauguguggaggucaggaugucaacuuguggcaguugguuuucuucuucuaaccuugugagucucaaaaucaaacucagguugacaggcuuugcaaggagaagcuucugccugccuaaccaucaccuuucuucauauuuuuaaaguugucugagaaauagucuuuuauaggucuacauacugcaacuuugauagauguuacuaaaccaauugccacagacuuuuuccuugagucugaaaaauccaacugcuuauaaaguuuuauauuuuuguuauuauguauuuucauagugcauaccuuuaaucccagcacuuauaagaaguaggcagacuugaguucaaggucagccuggucuauaaaccaaguauaagacaggcagggauauacagagaaacccugucucaauaaccccucuccagaaaaacaauaaaguauuuucugauuuuuuuuuuuuuuuaaaaaacuuagucuaaaagacuacuauugccuccucuggguugugcaccaaacuuauuacuaacccguuucauuguauuaguaaaaacugugauuaguaauugcuuuauuuuuuaauaauuuuuuaaaagauuuauuuauuauuauucauuaguacacuguagcugucuucagaugcaccagaugagggugucagaucucauuaugggugguugugagucaccaugugguugcugggauaugaacucaggaccuuuggaagagcagucagugcucuuaacugcugagccaucucgccagcccccaaauuuugcuuuuaaccauuuuuagaaauacauuuauuuugcacacagccaugcucauucacuuacuugcuguaagucugaguauaacagaagacugaauagagacuguaugacuugaaaagcccuuuuaauaaucuuaguaucuggccuuuacaaaaaaaguuucagucaggaaugauaugauagcacacaucacuaaugcucacucagaauguggaagcacauucaggaguucaagguaauccuuaacuacauaguaaguuacaggcuacccuaggcuauaugggacccuuuauaaaaaacaaacaaauaaacaaacuaacuaaaccaaacaaaaaauacccaaaugguccuagacucugcucuagauaguuggggguaggagaguggagagggaggagaagauuaaauauuaugcuuaauuaguucaggagguuucauuauuuucaguuugccuuaauuauauagaauaggugccagucggugguugugcacgccuuuaaucccagcacuugggaggcagaggcagauuucugaguuugaggccagccuggucuacaaagugagugcuaggucagccagggcuacacagagaaacccugucucaaaaaaacaacaacaacaacaaaauauauauagaauaggcuuaugguauuuucauaccuuuuuuuuuuuuuuuuuugguuuuucaagacaggguuucucuguguagcccuggcuguccuggaacucacuuuguagaccaggcuggcuuugaacucagaaaucugccugcuucuccccucccaagugcugggauuaaaggugugugccaccacugccagacauacauauacuuuuaucagugauauuuuaugacguuuauuuguaauuuuaccuuggucuaaacucuguucaucuuggcauuauacagaugacuacauaguugaucaaaccauuuaucaaaauuuccuaucuugacaccugugaucgaaucaguggagacagagguaggaggaucucuaugagcuuuuaggccagccuuguuaacaaagugaguuccaggcaagucagggcuauguagagacccugucuccaacaaacuuuacuggcuuaaaaaaccaccuuucucagacuuuacaugcuucucuucccuguuuuguuucugagacaaggucugacacugcaucccacacuggcuugcaacucauggcaauccuccuaccuuagcuuucugaguucugggauuagaccuaguguuuucuuauuuggcacgccuugucaccccaaacccuaagugauguagauugaccccaaggauuugugccuguagauuuuauucccagcccugagauaaauaucagcuuuuauuguauauauucaauacaucuaaaauacaucggaaaucuauacuuuguucauuucuagacuuucuguacuguuguacucauuucuacuguuuuuaaugagagccaauucagaagguaauugcuuugaaaauaaaaauuauaaugucuaaacugauaaauuuaccuuaaauuuuaucaauaaacaaauguuauguacaggcucuuccagauaaacuauauuucuauauagucagugcuacaaaucauuaauaguuaucuguaaacugacuacuccuagccuuuuccccgcuugagacaguguacagcuauguagcuaagcuugcuuuaguuauauugcucagucuggucuuccacucagaauuauccugccucugcugcgacacaccaccacaccugggcuuguaaauuguuuuuuaauaauaacaauggaucuaauuuuauaaaauaacacaaugcuuauuacauguaacucuucaccccaauauaaucauucaagacucauuaguccacuaauauuuccuacuuuagaaauuacuuagcaauguucuucagucaugaaacauccuuauauauaagucaaaagugcaacaauguguccuuuaaguaguaaacuguauuaucauuuacagguagaucuggguucaguaaagcaaaaggaagaaggaggcaucucaccauccuuuugaagccgagucccugcuucuguaacuguuguugaagacaucguagacaaaggcugcaaaacacauacacagagaccacagacucuucaguuuucaucauucugacaacuuuugcuaccuuucaucuauguaaaauggacaaaaaauguagugggguuuuuucccucuccuuuuuucuuuuacaaccuaaaguuuugauaaagaaaggcagcuuuuaggaaaacaaaacaaaacuucuuuacuauucuguuaguuuucagcacaaaaaaauuuaaaauuauuuuuauucauguauauguauacaggugccagaagaggcuagaaaaaugcauuugauucccugaagguugaauuacaagcaguugugagcugcuagaguuggggugccaggaacugaacucuggucuuuuccaagagcagcacauguacuuacuuguuaagccaucuuuucagugccucucacaagauauuuaaauaguuuagcuuagauacuuauuagggaauuuuuuuuuuuuuaaagcagguuucucuguuuagccuuggcugcccugaaacuuuaucuguagaccaggcugaccuugaacucacagagauaggcguccacuagcugacuggaccguaguucuaauaaaaauauugucauagaggauuaaccuuuuccaaagcacaaaaucguaagcuugagcuacaauauaauuugcugagaggaaaauaaauaaaacaacaagcaucucugauaucuuuuuccauaguuacucuuuuaaaucugugucauuuugcugacaaggacucugaauuaagguaauaaucaccuagaugauaguuuaugcuagaagacaaucuuaagaggcuuuuuguuuguuuuugaucgccauuuaaaaacuuacaccaacugcaggugccacuguaauagucucuggacuaaguguucuucucaacugagcaucaagaucuucuagugguugcugggacuaagcaaaaacaguacuguaaguuguuuagcaccuucagugucacuauauauagcuaauuauacagauuacaucauuuuaugcucuaaaucacauuuguucuaauacugaauauaaaaccaguauaaugaaguaauauuaucuaucaaguugucagucuaucaauccuuaggacaauccaaguacauuuaugcuuuuguaguuucagaaucauucuaucuucuauguuuaauguuagugacuuuacugguuucucuaugaaaauacauucuggaaaguauaucagaaucuauuguuaaauuauauacccacauucauauguuaacuuguggcauguuacuuauccuaucauguucaaaugaaaauuaggaucaaauaaguagggauaaaugcauaacgggcuucucauguaagcaaucugucaugcuuuucuuaaacauaauuuaagaaagaauuacaaauaucauuucaaauuuauuuguuguuuucauuucagaacuuuuuucauguuuacaaugggcucagaacugcuuucuugaugagaaugcaauuaaaugcagugguaaugguaguaggaaaaaagaguaacuuaaauauuguuaaguaugaccaugccguacuucaaccauuucacuagugaaaaaaaaugguaaacaccagaggaaagcuguaccaguuaccaugugguuuccucucuucucccucugggaauggccagcuguucucauaccuacauucuuuuucuugaccuacccaagugguaaaauuauuuuucuacaaggccugguucauggguuccuuucuuucuuaaaacauagugaacagaguuuuaaggaagagugaggaagaacucuugauguucuucuucuuccucgggggaggggguucuaaagauuucaagaaugcagacuuaugggucguuuuuuuucugauucaggaacaaagagugaaauauguacaacuuuuauuucuacaauggcuuagaagcucagcuuuacuuuuuuuuuucucuuuuuaaguuucauuuuauuugugugucuguggugcuguggugggccacacuuauauacacuguguguguagaagcuugagugucuucuuugauugcuuucuaccuuauauagaggcagggugucucauuuuaauccagagcucaccaucugacuaguauagccagauacaguuuauuauuaacuucuuuguuugaggcagggucuuacuauguagcccuggauggccugaaacuaacacaccaccuuaaacguugggauuaaaggcaagugccaccaugccaggccugccaagaaaaguuuacaagaauguuauuacuaauucauagccagaaugaucuagaagccaagauaaauaacacaauggagaauuuacacaaauuuggugaagaaaagcaggggcuuuucuggugaagaaaauaauuuauuaaguuacuggcaccugaauuagagaagguccaggaaaagguggcagcugcucacaggguacaguaccggcugaaaguucaguacccacugguggcaccuauaauaaugaaggaaaauucaagucuaugagcuaccauugguaaaaaauauauacuaagaaaaaauuaauuuaaaagcagaacgauacuaaaaugugucuacuuauagcauuuaaauuacacuuuucagucuguuuuaaaggacaacauaccaaagacacuaguaugacaguuacaaucaaacaacuaugaaacaaaugauaaaaugcaaugagaagggaaacaaaaagaacaaaauuuuuaaguagacagauaagaguacaguuaggggcugaagagacagcucagcaguuaagagcacuagcugcucuuauagagaacccaaguuuuguucccagaaucaacauuguggcucaaaacuccaguucuaggggauuugaugcccuuuucugacuuuguugggcaccaggcaucaagugccaaaaaaagagccaccaacaaauuuuugaaguugcucauaugagauaaauaagacauuucaaagaaaacaagcagauuuagaaauaaacaaaggucaugacugauaacaaaggcauaaaauuauauuauucuauuggcacagaaagaggaugaagauaucagaaugagaggacaucugcaacagcacaauuaaauaguuucuguuuauuggauuucuagaaugcuauuauuuccucuuucauuuucaaucacuuuuaucaacuuccaacuuuauuuauuguuuacgaguacacugucacucucuucagacacaccagaagagggcaucagaccccauuacagauggcuaugagccaacacgugguucuaggaaucgaacucaggaccucuagaaguuaacugcuuagccaucucuccagcccaacuucaacuuuuuauuaacucccaauuuuuaucaaaggaaucuacaauaaggaauauucauucucaacuaaaagaugauaaaauauuccuuuauuggucaauacauuuugcuccuuuuugggauguagaauucuuuaauaucuaccaaucccguagaaauaaccuguccuuuucaacagacuuauauuguuaaacuauuuauaucuaugcaugucuuugugggaguaugagcauucugaaugcaguugccugcagaggccaggagaggucagauccagagguuguuauuaagucuucugcacauggcuucugggaaccaaauuuggguuauuugaaagagcaguguucuuaaaugcugagcccuugguuuuuuuucuuuucuuuccuauuucuuuauuuagagacaaagcccuauucuauagccaagacuggccuguaacucauuguagugcccaggcuuuccuguaacuuguaacuaccuucugucuucaaguguugggguaauagacaugaggcauaagacccagggaaaaaccuguauuuuacuugaccauuauuuauuuuaccugauaauucuacauucuaagaaaacuguucaauauaaccuaaaaaucuagccacauuccaaacuaagagaacauucuuguguuaccuauacuuagauccuaaaacuguugucacuuuaagacugagagacgaguuuauaugccaggcaccuucauaacuugcaagacucagcugaaaacauguaauuauugagaggaaagaaaaguaaucauauuuauuuagucauuguaugaugacucuuaccacagucuuaguuggcuuugggggaguuguuccagguuuuacuccuguugcagugccgacuggggcugaagcgugugugccugggguagaaaccugcccaggugugccuacuggcauaacuggcaugccagcugcuccuaaugguaaacugguuggugguaagcaaguacuuguaguggaagucaugaguuuacuuggugcuacagcagugguagugaugcccggugugacagucgucucuacuacuaaaggugucucuagggagacagaagcaugcugaguuccagaugagcuguguucacuaaagagagaucucagcuuuuccuccagagucuuuauaucaucaaucccaggagcuuuggauuggguaucagcauccauuucaggacagugugugugaggcugguugggaagcagagcugguugaggcugacugugaaugaguguuugcuguacagcaggcacauuaacaacagguuguaccaagggugggauauuagguacuugggguaauaaagguguagaaguagguacuacugguugggggaggccagguguagaaacuacagcugaugagaugaccaaaggaugaaccauaccaggcugagaaacagaaguagacacagcuguuccagaggaggaggaagaggauggcgcacaaaaggacaaacccaauccugcuguacuacugugagaugccuugucuagugagugugcacuaaccaccauuguuucagcuagaguaggagcagaggugcugcuacuaaguggaagggauggcugugaagccaugccugggaauggaguggugguagagacugaugucacuauggcaaccccagcaguauugcuugcuaccuguugcaauaauacaguuggaggcuuagcaucuggggccaccacacuacccauuguaguagcuguaguuguagaaaauguuccaggaggaaaacugccuguacuugaagcaaugcucccagauguggaagccugaacuggcugggaugguguggacacagugacaacugcagguacuguagaacuugaaaccgcacuggaagauguuggugacucagacacagacauuguggugagaccaccugaagcuaccacaccugugcugguagugguaacucccacgaugccuuuuucagugggcagugcagucucagacugcaucacugauguggaaaugucauuaagaggacugcuuguuauagggacugauacugacgguguggaugcugcuacaguuuggacaccagcaaugcuagccaaaaagggagaaaauguuggucccgccaugugauuaaaauuuggaggugcuguauuggguccuucagucaucugaccauguuucaguucagaaaaagccugcuggagacugagggaugaagcagagugagauaaguucauuccaggggccugagauguagaggccacaacuagaaaggaaaacaaaaauaaagaaauuagccuauauauacacauggauuaaaaaagagaguuuuugaagaaccauuauuggauuaucaacaaugcuacacaucaguaagacucccaaggaaacagcaugcaguaaaacaguaaaggagcaguuuacccuaguaaggcagcuuaugaguacauaaucuugaaaaccaucaaacauaagacuaaccugaaaaaaaaauuuaccucuaaauacagaaacacacuacuguauagguuguuuagcacaccugguccuucauggucugcagucuuucucuuauuucucuuuucuauuuuuucuuuuuuggagacaaagugucacucagccacccaggcugaccuccugaucaucccccuucucucugucuccugagcaaugaaaucacgugcaugugucauguccaacuacauucucuauuauaauucauuuccuucuucugugugacuuuauuacuuuuaauuuucuacuuuugauuugaucauuaauuauugcuugaucaagcuuccaccauaucagagaugcuguaagauuuacuaaagcauggcugaaucauucuuaccuggaucugauaugucacuggugaaaacuuuugauucucguaaccuacuuucagguacaggacucacuauaaaccgucuuccagcagaaugaacaacuugcguuaaagaacugguaggaacaccugaacaaaacaaaucauugaaauucauauauauuguuauauaugaauaaacccuugagaguucguuauuagcacauacaacuccuugucaaauaaaaaaagaaaagcuuaccuauuuguuguggcauggaagauacagcaauugguugcuugaacucuccuucuaauuucuacaauaagcaaaaguaaaacucuucucaaaugcaaccuccaugauuaugcaaagcauauugucauuugaugagaacauaaauguucauucucagacacaagggcauuauuuuaucaguggauauucuguuuggcagauuaagcaguacagaacuauuuuaaauaaacagaacuaacuaaaaguauggugaaccuaccugagaaccugggaagccauagucauccuuuccuugcagacucuccaaucccuggucacccucaggcuccacacugacauccucacuuaacauuucaucagccuuuucaauaauuucccgcacuugagccacaaaagacucucucucuauugcuagaauaaagucauuguucaccuauaagaaacgugauaucaaucuuauuaguacuuuuuuaagcuuuaagucauucaauuaccauuuuauuuuuaugacuuuagucuguacaucagcuguacuauguacuugguauuuaaaauacuacuuuccuuuauaagacccugaacauauacacagcuacaucuuagacaaaagccaucucuaaaucauagaaucaugguuggguaugcuaguuuuagaacaugaauuaaaauuuauugucagaaugaaaguggaugacaaaauaaugcaugguugccuagaacauguauuuaagaccaaauacuaugggaaaauguggaauuccaaauggaggcauaccauaauuguugcuaucucuucaggguugucaccaucuaggucaaauuuaaauguaaccaucuuccgauuaugagucucuaauugacauucuacuacucggucuccuuuauuugaaaccuaaaaagaaaaaaguaauucauauucugacuuauuacagacuucgggaagucaucuugaaauuccuugaguguguguguguguguauguguguguuugagacaggguuucucuguguaguugucuugaacucagauaucugccuaccucugccugucaagugcuaggauuaaaggugugugccaccacccuugaccaucccuuaaauuuuaaauuggcuaaagaaauaugugagaagaucuugagcucuuuucaacuuccauuagcaaaagcaucuagucuguuuuucuacuaguuaaaacucuagagcuaggugcaacaacaaaaugaaaugugauacucaauagaagaaauuguguaauuaaauaaaaaguugcuaugaaauuauauauaaagaugaguuaucuuuauuuuaacaaagugagugguuuagauuucaugauuucuaaaauuaaaagugcuaaauucuuuaagcaauacaauggucacaaaucaauauuuacauuuaaaauccucaguuuugggcgagaagucuuuucaugccgagagcgacuucuuacggauuuucuauaaugccguuuuguuguccucccuucaugccucccgcuggaugauggagcauucucauugccaucacucauaccagaagcaacgucugaaugugcacuuugagggggaaaaucguguauaauaagauucaaaggcauauuauucugaaguuucauauuccugccuacuacucaaaagaguguuuuaguuuacuuaccugucugcagagguaaccaauggaacaggcugaguagguugugacuguguuauuggaguuuguucuggaggagcagccugagagacucccugaguacucuguagauugaaaggguaauucaaauuuuggcauuuauacauauauauauuuaaauaugaaauaaccauccaccaauugcuuauguucccuuucuuuuuuguuaccccgcuauaauuccuagaagcaaugaagcuacuaguaauucuuaauauucaacaucuaaaaacagugugcuuacauuuugagaguuuccaaagcuaguugcuaguacagacuguuggugugaacucagccaaccuauuugcuaggcacugugaaacuacaauuugccaugcagccagcaucuuaccagagugugcaauaggacagguagagcaaagugcagagaugaauucagaacuguauccuacuaggacaaaaaugacugcugggagcacagcaagauaagauacucuuaugaacugcuaauggcacaaguuuguggaagaacaauggcuaaugcacuagcuagagaagugaagugcuaauaguguuaaucuucucuaaggcaaacucacuucccaacagaacagccaguggcaacaaggcccccacauuggcauuucauucugcuguaagacaaagucauuuagaaguuaguuuaacagucuccaaauguguuuuaaauaaggggagccuguuuuucuuugcuauuuuaaccccauguucauagauguuuccuauauaaacaugcaguaauuccauuuaccuccagaacugcuugcugggaggauguaguuggggguuguugcguuaaacucacugcugguugggacacuugaaccuggccuccuacacugcccauaggaaccaaaggaguugauuccacauaaggcugcacuacuguaggaaaguaaccuuggguggccaaugcuucugucggcauagaaggaggggcuaggacuguagaauggaugcaaacagaagccacguuggaagagggagcaauauuugaaucuccuggguauugugguggcagucgagaugggaagcccugugacagaaaugaggaaggugaguuagugcagguugagacaucaaauuagcaaaucaguagacaaggagguggagggggggaagcacaaagcaaaggacagugucccacuuucuaauaguuuaaagauuauuuucaaaaugaacugguuaaauaacuuagaaaguggcacucuuucaaugaugcuuuaaacugcuugguuucuccuucuagagacaauugaaguagaacuuaaaucuacagcaaucuuacauggaagaauggaaaaauauguuucagguaucagucauaucaucaaauguaaacccucuuaaucuaaacccugaaguuucuguuaguaccaggcugccugcuuucuuuacuuaucuccauauaaaggaacagccuaguagauuuaacuaaccauguauccaggguuaucuagcuuaccaugacuacugagugaacuuuucuucuaauuugugucuuuaaaaaauguauaaggaaucauuugauaauauuaucccauuagguuuuuuugaaaccgggacuuacuauauagcccuggcuggccuagaacacgcuauauagacuaugcagccuugaacuacagagaucugcuaccugccucuacucuacaauaagcauugggaucaaagcacacaguacuaugcccagucuuccauucuuuuuuuuuuuuuaagacuuucaacuuuuguuauuguuacugacacucaacuaguacaauucucaaguucuuaaugaucuuccauuaaaauuaaacauucuaauacccucugauuuuucuggcuaacacgauaccugguacaaaacaucuccagagggaaguggacccucagcagcuuguccaagguuagcugguauuccuauggacugaacuguuguuggcuguagaagcugugggugaaccugacucugcagcugauucacaggcugcagaagaguuggaagcugauuaggaacuacaggugaucccccugggauugaagaugcuguagcagaugaagccaaggugagcagaggcugguuaaugccagcagccauuguuauaggaacggaugagaaaccugucugcgccguggacacaugaggagucgauaugggaauuugagagacaggauacugugggaguaaagaaguagggauuggcugucccauaggaaggaaaugagcaccagaguggacuggaacaacugaggguuguguugaaacugggaugugagguucaccuuggacaguugcuacugucugggaaacuggaagcugagaagguaaagaaaaacaaaacaagacuuuuuuaaaagcaaagcugccaaaagcaagauuuacauauuaggcaagaagaagaaaaccaaaacccugaauacauuaguauaaauuaauaugccacauaauuaugaaagaauaggaaauaugcuaauaaaaaaagugucuaacaucuccaaaccuuuuauugcagaauaauuugauaguguuuccuuguuggcaauaaaaagaggacuuuuucaaaaaacaaggcuuucucccucucucuuuugauuuugagucucacauagcugaggcuuuccuguagcuugcuugauggucuauacuggacgaaaaauucuagguccuccugcccccaucucccaagugccaagauuccagauuauguccuacaacacccaguuuucuguuuguuuuuuuagcugccauuacugcauauguuucacaugccaaaauccacuguuuuguaaaaauacguguuugcuguaaccuaaucucugacagcuauuauagugauuaaacauaaauuucuuuccaguggaauuagauuucaccaguauuacaucucaguuuugaaaauguaaaacagcucuauaaaaguggcucuaauuaacacaauucacugauucuaggauguuauuacucauuauucuauuacucugacaucuuaauaucugagaaauugggauacauguagaaauuagaaugauguguuaguauuuacuuugugguaaauaaaacaauagugcauucacaguugauacuguuuuaguucuaagaucugauaauaauauucuaugcauacagggugcauaauaaaugagguuggcuauucauaagaacauagcuucuacaggguaccuuccaagcaagugaaaaaaaaaaccaaaauaaucauucaaacaaaccaaacaaaaauucaugaaggauuuuuuuugggggguaggguggguagguauagcagauagcuaagguuuuucuugaacuucugaaaccaucugccugaggaaucucagaugugucaauccuagcucaaauguggguaaucccggaugucaacuuuaauuggacuuaagaauaaaguaggagguuaguaauauaugucccuuguguaugucuccgagaacauuuccagagacaacuugaucauaaggauucugaccucugaugaagucaaaccuugaaugaacuaaaaaguagaggaacugugguggguggggccuaguuauggguaauggguauguggagcuuugaaaaguauauuuuggccuuaaccucuucuauguuccuugguaaauaguuucuuauggcauaacccuucuuccaucccuugcuacaguucuaaaaccaauacagccugccaaucauggauggacugaaaccucugaaaccacacaagaagaaaaaaagauucuuuccuuauaauaauauucuacuuauuuguuaguuaugagaagcuaaucaauacaauaaguuaguaucuguagguagugagggagaaaauacugaaguuuacauggaaauaaaacauaguggcaaaucuggaauaucaaauacagcugacauuuucuagagaaugucacagguucaguuacgaaagcaucuccauuuagcucauuaguuucaauacuuuacaccuauaaaccuaauauuucauauuucauugucuuugcuaucugcauauacugauuuacaauaaauaaaaguauauaauggcaaugauuuuuauuccauucuaacagaucuuucacuaucugaagagucaguaaaaccuguaggaagggacaaaguacacagauaucauuugaagaaucucuucagaaauuugaguuuaccuguguuccagcugacacuugaggcugacucacuggcugugcaguaguaccuucacuggaagaugcugcuuguggaagugaauacuguacugccuguugagaaggaacaguuggcuguauucccugcuguuaagaauaaaauacaauguuugagauucuuuugagagagggauuuuugcuauguugacuaaacuaaacuggucucccuccguccgucccccccgcccccaggacaagguauuauuauguagcuuuggaauucacagagucugccugcccccgugacuguagugauugauggcaagcuccaucacccucagcuccuguuggccuuuaaacauaggccaggagaaugacauuaagacuauaaaacaacaacuaauccaaugaccucuucuggccuccaugggcacugcauauaugagacauacauacaaucguucaggcuuuaaacacuaauacaaauaaaaguaaaaucucaauaaauacaaaaaaguaaaauauauauauauauauauauauacacacacacacacacacacacacacacacacacacacacacacacuuuuuuuuaaaaguuaaauguaaaugcuacuguuucuaccuauucucaaaggcagcugcuauggguuuucucaguuuucccauuuuuauuuucaguugaaauaaaggaaaaccaaaccuauauuauaaacagugauguuacuaguuaacauuuugguaggguuuuuuuuuugggagggggauugggagauacuuaaacauguuucaacuaauagcccugucuuauuugggguuaacuacugaugugaucuaaugccacgaccaaaagcaaguuggggaagaaagcccaucucagcagcccuuuacaaauguuuaaugaaaaauucucuuuacguaaaaaguauuuauguaaagguauaugagcauguucauguauguuuacacuuccacaucauaguccauauuugaaggaagucagggcagggaaccugagucaggcuaaugcagaggccauggaagugcucuacuuauuggcuugcucagcuugcuuucuuauagaacccagcacuacaagccacaauagucugugcccuccuauuaagaaaugccuuacaggcuugccgacagucugacuccucccugaugacucuagcuuuuguuaaguagaaguaaaaguagccagcacaaaaccuuugucgugauauauccaguacaaauguuuggcuguuaccuauauaaugguacgcuauuuauucacaguuauguauauaaucaccauaauaagcaccuuggauuuuuauauaucuggaaauacuuuuguuccuacagaaugauuuuguaucaucaaauuaaaacuaccaaauuuuaaaagcaccaaaauacacuugucuuauucaaccauuccugaugauacuaaggauugaacucaggggccucucuugcccaugugauaacauaagaaacacccaaccucuaacacuuauuuuuuuguauacaugcuugccacagaaccaugugaaaauccuaagacaggccuuucuacaauggggauuccagagauugaacuccauuguuuacuaauggcagcaacugccuuuaccuguuuuaaauuaucucagcagcccuuuacaaauguuuaaugaaauguuuaaugaaaaauucucuuuacauaaaagguaucuauguaaagguauacaagcauauucauguauguagauguaaauauaugugcaugagccaaaaagaauuguuucuuagaagcugucuucuuuucuggaaacagcuucucucacugcucacugcuggucccuaccaggacuguauuuuacaauccugccucagccuucuaagagguuaugauuuacagggugugucuugagguucacagcucauuccaauuuucaaaacaagcaugcacuuaugaauggcgauucaauuaacaacuuucuuuagaaaauaguguaggugggcaugggaacauguaucuacaaucuuauaugagaucuagaacauuagacaauuuccuuacuucuuuuacuaaaagaaauccccaaaccaggagaccaucuaucuauacuuuaagaauuaugaacaaaugcucuauaauuacauaacucauugaguuaaagauuaaauauauuuaaauaagacaucaggcauauaaaaauacuaauuugaaaacuaaaccauaagcucauacuuuucaaauauaaggcacauaagcaccuucauuuuuaccagaauuguauuacaggugcuuugguagucuucugguauaacacuuuaaaagaacguguaugccucugugaguauguucguugaguauauucaugucaugguguacuugcaguggucaguaaacaaccuaugggugucuguccuugacauuucaguuaauuugagccagguuaucuuuuccuauuuaagcuaggcuggcuucuaaagacucacuugccucugauugucauuuuuugauagguacacugggauuacuuguacuacaguguucaacuucuauguguguuccauagauaugauagauaggcaauaaaguuuguuuagcaagcacuuuuauccauugagucaacugcagccuacacuuauaaugucacaguauucuuucuguacauuuuuguucuguuuugugacauuuuacaguccugucaccuugguaucagcuccuaaaguaaucuuuaaacaaauaauacuuauauaguacuuauaaaguacuuauaaaguaucgaauaggaucaaaaccaggucccuaugcuugguggcaugggccuuuuguccacugagccaucuugcuggcucagugcauuuguuuuuacuuguuuuauucuauuuuucgguuguucaaaaaaggagagagagagcuuguuaaguaacaaagguuugcauaauauaguuuuguuuguuuuuuucugagauaggguuauuaccagauagaagucuaggcuggucuucaacccuggaaugcucagauuaccugcauaugcuaucacaucuagcaauucaccaccaacaaauaaauuugaggaaaaaccuuaccuuugggcauaugguauuuccuguccuucuccuguucccauuaagaaucaaggcucacauaaaaauuuugacugucaauucuuuccugaaaauauucuuuaacaaaucuaucuucucauuaaauaaaauuggauguagcuaacucaaaaauguaugugaaacaugcauaugcaaguaugcaugcaagcacgcacacauauaaauggaagaaaauauuaaaacaaaaaagaucuuccuuaaacuaaacucaagguuucuuuuaucugucccauacuuuucuaauguuguuccuuuuauaucgucuaaauugcaauacuuccaccccagccugaaauauucuuucuucuuauaucaaaguaugacuuaacuacuagggcccaacagaaacuauuaaugaacuagcuuauuauauacagagauggguauaaaauuuguuugaaacuaauuuuaaauuguacaaaaaagaaugauuuucuugcaaacaaaagccuguuaauaaaagaacugaugaauuauaaacaaaaccucuuugguucuuuuuaaacucaugucccaaauuacucagcucuuuuggaauauaaaccuuccaagucaaaaguaaaacuuaaaaacaaaacaaaacaaaaaaaaaccccaaaacuuccuacaguucuuuauguuuucuuaaaauguuaugccugcauguauauguguguuuaacauuaauuuugaggaggccauaagagagcacuggaucccauggaauuaguuacagauguuuguuagccaccauguggguccugggaagugaaccuaggucuuccuuuggaagaauaauaguacaugcucuuaucuagggagccaccucuccaauuccuuuaagauuauuuucauucagaccaaaaugacaaaaaugcucauuuuuuuuaaagauaaggauuuuuucaauaggcauggcugugcucuguggaccauguauagaccuucaacccagagauucaccugccccugcuucccaaaugcuaggauuaaaggugauaaaugcucuuacauggacaaguuauaaaguagaaacaaagauuuucuuuguaugguuuaaccuuaugcauaaaauuauuuaggaugggcgauaaauuauaaauauagcaauucuuuucuuucuuuuuuuaaaaaaagauuuauuauauacuuauuauguauagugcucugccugcaugugugccccccaaacaaacaauggcaucauauuucauuauagaugguuaucagucaccaugugguggcugggaauugaauucaggaccuguggaagaacagccagugcuauuacccuuugagccaucucugcaguccauaauucuuccuuuuaacucuuaucuuuuaaauugcucauagguacauaagauguguuaugauacuuucaguuacucuuucaaaaacguagcaagccauuuauaucagaaaucuagcucauaaagauauaaaacagugccucuggcuacugcuaaaacauaguauagcaaugcaacauuuuuaccugcugaggauguuggauagguugugaagauagaaccccagccaaacuacuugauggcuggcccugguucugccccugugccugaagaaagaaagcaaauacaaauuagagaaaguuuauacacauacagauuuuguauaaauacuucagauccugagaagauugcuucaucaaaaugaaccaucagcuugauacuguaguacaaggucgacaucugggaauuuuuggugaguucagaaaaaagaucauagaacauuucugaucacaucucagguaaacacaaacagagagacaaaaacacaauacacugauaguuccauugacgaugccuagaguuuuagcuggcuugaauagucagauucacaauaaaauugucacaggaaaaaugugguaauauaucaguaugaaaaauuauuuuugacaauuaaagaaaacuacauucaaauauguuaauuugguucucucuugcuguuucuuguagugucauaguaacucugaugaaagagguacaaggucuguuaaaaaacaacuccucaacaggcauauaauaguuguucagguaacauagaaauaucuggagucauuaugauuguuaacuaggggaaauggcugcuacuaaaaaaaaaaaaaaaaaaaucucuauaaugaccagacuaaccaacccagaaugucaaccaugugggcucugaaaaacugaacaguguauuccaauuaaaaagucaaauuaaguaagaauaggggguaagaauauauguuaggaaaauuaacucauauauacuauguauauaaacauguuaaggaaaugaaaagacuacauuuauugcuucauuccaauguagccuagauucuuugaaguuuacauggauguacccacuaaaacuuuaauuaucuauuuucuuuaaaaacauuuuucuuuugcaaagcuuagaggauaaugcaagcauaaaacauguccacgcuguuuaaauuucaggguccuuuuguucauuaacacuacucuaaauaacugauaugaacuagucacugcugacuugaguaaauguucuuguguaaauguucaugaguauauaugcuccccugugugauuaaaguuuuaaauguauugggaacagggccugaaagauccacuguuccuaacauuguaacuaguuaccauaaacgcaugaaaaccuaauaaaaucauuauacaauaggcucuaauagucauuaaaauuagacaauaguccuuaauuuuaauuuaauguuuuauuuuuaucuuuaauauagugacuugacugauaucaucucaaaauggcacuuucauuuguuaaacuaaacucccacaauacguuuuaaguucuuauaaugaaaagcuauguguuucuuaauaugacaccaaaaaaaguuuucauuacuucccauuuugcuuuaugguuaguuuuuuaaucuuuaaaaacuuauuuagaaaaaugaauuauacacuaaaucauuuuacuauaaucaagacugacagacaaaugcauuuucauuacuaccacaaaauuccaaagagauuagucauugauucugacaauuaaaaucacaggcaaaccagguauuuucugcuuuauaguucauuuuuuacuacaaguauuuauaaccacaaaagaaauccuacuaggaaaauaaacaacauuccuuauaaauccaugauucagguaaaugagauagagaauuuaaaugcacugguguauaauaggguaguuuaaaagaauugugaaaguuuuccuauaaccuguggauggaguguagauccuccugaagaauaugaagcagauaagaccugcugagaugugguuccuugggggaaacagaagaauaguggggauucuuguaacacugucugaggcaggcgaauaaagggcaaugagacgucagagccaaaaggugcagcuguccccccuguagggggaggugauugaaaaucacugagaucugaagaaguaauuugagaggaaucacuggaauauucugggcuuccuauuggccagauuugucccauagguucuaccacagaaauggucaauucgggggcaugguuauuacgcuguucuucaguaacaggcugcagguggcaauguaauccaacugacugaggagacaguucuuccugauuugaguccacugcaaccugccgauuucgguaaacacguugagguaaaaucccaccuccuucuccugaagaacuugguguuugagcaugaaauucaaauacacaguugcuucuguucucauugcuauuaguuaacacagcuggugcagaaugagguacaaagacagggugaaauuucagauguguagcaucuguacuguuaggcgcagaaauacuagagaggggugaugcuggacuugguccagaaucuaaucuuaaauucugaagguguccuaccaggaaagccuguccagaaggaaauucaaagacagaacuugaggcagggccccccggcacuggcuucuguucagauaucuguuucauaggacuugacaguacuggugaguuguaugaaaugcccucauacuguccugccaccugggccugguaaugcaccccagcuagauauacuguuuccugaggaauaaaauagugagcuucuucugccaguacuaguccaggucuauagucacuguaaaucuggguuggcucaaacacagguuggaccugcaucucacauagcucucuauuuacucuauuggcuguagcacccaacauaacuauggccucugguguccaguuaguugggcugcuaccagguggaagaugauuuuggccaacaguccucagcagggguuggaaguggcgaguuugggcuuccaggaaggaggugcucuuacgucguugggaaauggcuacuuucgguggacaggugggagguggugaaaaagaaacuggacguucaugaauaguugggaaaaauaucugugauucuggguauguugggguccccccacacggaugcgccauggacugaggcuguaucaacaugaauaagacaaguaauucauacauucaauauguaaaauuacaucagacaugcacagcuggauaguucuguguaaccccaugaaguggccacacgaaaauuuuaauaaauaacaaugcuuuuggaauuuauagcaaaaauccauuaaauacauccagggccaauaaaguuaaucuguggcacuuccuugaaugaaaaaaaaaaaaaaaaaccaccccaguugcuuucccacaaacuugcucugucaaagcaaaggcaugaauuaaaauuucccaaguaauuauucuauuuuaccuauaauaaauguguuuauucuuaaaauauuugucaauggaaauagguaaaguuagaauauuaaaggauaauaaauaaccuuauaauuuuuauaauuuaaaauauacuucaauuuaagcuacuguucauaaugcuaugacaucagucuguuagaggcuucaguuauuuuucaucaacuaacaguagaugaucagaagaaauuuauaauaguauaaaucagaagagguuuuugcuauaugguauaagauaagccaaguacaguaguacauacuuauaguaauguuagcacucgagaggcugaggcagggggauuuuagaguacaaggcccaagcaauuauauagugagacuaccuuaaaaaacaaagaagaagauauaugacuuguuguucccuucuguguuuaaaacuacaauuaauaguuucacuauaaaacaaguuacagacgcuaagucauucuucugaucauuguugaacaccaugaguuuucuaacucugacaaaccaagcaaauaggagguaaaccugauuuuauggcacauuuuguuuacugaauuuaagacugagcuuagaauccuagcuugccaaaugcaauauaaauaaauuucuaccauguacuggacuccuaaagucuuuggugagcauauguaaggguccagguucaauccuuaauaacacaaaaacagguguugaggucagaggauaaccucaaguguuggacaucacuguccaacuuguuagagacagguguuuguugcuuauguauacaacagacuacagggcacaugagauucuggagagucuauuaccaucucccaucuggagauuauggguagucacuagugcaccaggcuuuacaugggaucugagaaucuacauuuaggucuccaugcuuaugcagcaaguauuuaaguuauggagccauuucuucaaccugcuaaaguauccuccaccaaaucagaaugcuuauauuuuauuauucaacuuguguccugaagccauaaaacacaguacaguuaaccauuuuccuaaguaaaaaucuggugucauuaguucagaauauucucuuguuuggaaaagcagcaaacaaggccuuauagcaauuaauguaauuugagagguuuuaucuuucauagacacuaauggacacaaggaaaauuauauguuauauaugugucuaaugucuaugccccauuuuauguaaucuaagaggugaacaaaaaagugcuucccagagaggaaauagccuuuugguuuccugacauuucauuuuacacaaaugacuaaauuaaaaucaacuuuuacuccucacuugacuaguuuaaaaaacaaaggacucaguuauauuccuuaagaauaaauugaggagaaaacacaguuggucaauguuugguagacucuacuuuugauuaggcuaaugaguuuaguaaaguacuauacauacuuuuugcuaagauaugaaaaugaaaacucuuaucaauagaagauaagaaaguauaauaaaaacucuacuaauaugugcuaaugacauuauaagcauucucuuucauugccucuuugcuuuuuauucccauuuaacaucuuauuacaaaauguuuccuacaggaauaguuaucuuaaaagcacaacauuugcuaauaguuuagcuuugcgcuuuaagcauauucuccaugcccggauguauucauugguuaaugguuuuucacuuuucaggaaguuuacaguuacauacaguagugacaaagagggaaggcaggcuggagcgucggugcuugcgcugggaggcagagugcauaggcaggacacucuccaaugcuuuagagaguuuuucggcaaaaguuuccucaggggcaguccgaaggagggaaggacaaagaggugcagacagcacugguggugggguggaaggagcacugggagagaugcgggauagagagggaacagcagaaagauggggaacacaaaccgacaugcuacggccacgacgaggcuaaacagaaaacaaacacacaugaaaaacacaguacuuugaaaacaaaauaaccaaauguacagugauaauaggguauaguuaacauaaagaaauguucuaccuuccccaauucuaccaaaaaaaaaaaaaaaaaaaaaaaaaaaggaaaaaaguguaagacauaauucuacaaagcacaccugguauauuguaacuauucucccuguucugcuggguuugugcagguuuucuuauaaacaaucaaaaagaucuugaauauuuugacauaauacuaacugcuaaguuauuaauauuaaguccacuaauuuaaaaagaauuacuaacaauaccacacaaaaacaguuaacuaaaaacuuacuaaaauuaaguaagaauaaauucuauuagaguacgagauuugggagauuaagguuacauuauuugcaagagcucaggccaugugagggaaauaaaugcaucuauuuuagaaggcagcauaaaaaguuguuugcuuacacuacuuuauuauacuugccauguucuguacaaagguuaaaaagucagugaucagaagaaaaaaaauucacaaauggguaucagaaauauuuuauaccguuauaaaggagccaguugggggaaaugccuucuauuuaaaucucuaagaaucauuaccacccucaaaauaaaaaauucaguuuagaccuacaaaauuugaaguagcuuaagacaaagaguuuaacacaguuacggguugucuggagcaaguuuauggccuauuucuuuuucaaaacugacugcaaaaaauacuuucagccaaacuuggagccuguaaguauguaucauaauuuaguucauuuugguuccaauuuuuuaccugccuuucuuauuuuuaaacuuucucuuacaguuuauccauuauuguaagacauaguuaguucuugaaaugagacaauagaauuauaaaauauuuuauuauaaagacuuguaauucuuuauaacuacucuauuagaauacugucaucaaaaaucuagaaaguaugauuuuagagcagcaaauaaauacaacuauguuaauggcuuaagcauuuaauaucuacauaaaugaucaauccuguuugucuuuuagaaacauacauaacccuguggugggggaagucccaagagguugaaaauaacuguuaagcaaagggagauugucaauauucagaaauaaauuacccaagauuauuuaccacauuaagccuaaagaacagacuguuaaaagagguuaauauauauauuaguaguaguuuucuuuguauuaauguguccauuaaucuuggggccuauguccaaagcaggacugaucaaucaauggacuccaaaauaaacaucuuuuauaagcaaaaagcaucuuccuggaaaaaaaagauucauuuaauaaagauaggaauucuucaaaguucagauuaaagccuucugaggagggaggaaaauugguuugcguaaagauuguucuaaacaagugauagaguaaacaauuaucaucuaguuccuucugaaguauacgaucuagcuuuuuuccuccaaagaccucacaaagagagucagcaaaagaaaugagaauauuuuaugauucauuuacuuuaacauucacuauugaaaauggacaaugugcauacacaucauguacacaaacauaaacuauuccaagaaauuacuucuauaagcugacucugaaaauaaacugguaaugaaauaaauaccaaauaaagggaaaaagcaaaugaacauauacugggaaaggaacacgcauagcaacugaugaucaacuaaauacaagcaauaaauuagucagaggucauacaauaaaggauuccuuuacucuauaauauucacaugcaacauucuauaauaguuugaaggucuuaccugguuuuuauacaaaagaaaaaucuuaaaaugucuuuaguaaguaagcuuuuaaaaauauuaaaaaaacaaaaaaccaaaccaauguuccacccacaaaucauuugguauaucuaguuuaagccaccgugaaaaguuuuaauuccuaggagucuuaauauucacaaagcugcuuucuguaggaaguucagcugauuuucacuuuuaauuguguauuuuacccaguuugaucuacuccaguuaugcucuuauaaacugacuuguuuagaaauaccauuagccucagucucugcacugaacugguuucaaauuaccccuacagauaucaaaaucugcagcuggcuaaguacuuuauauagauuauaguauuugcauaucgucucuagauuauauacuuauaguacccaauguaauucagaagccaugucauauugguagggaauaacaagaaaagucuguacauguuugguacuaauaaauuuuuaagcguuucacuauuuaaacacccccccaaguaaaaacaauagauaucgagacugacuagacuguuuauauucucuuagacucacagugcuacuuaaaugacauaaauaauuucaauuuagcagauuaccuauuggcuauuauuuuaguauuaaauuuucuuauucauuuacucaccauacuugaggguggauacaccccauggggcugagauugugcuuggauacuagaaacuguauguccuggugcugugccaguagaaugugccugcucauguugggaaccauaggaaacagucuguuggcugcucacucuggauucugugaauacggaugauccuugaccacuaucaaugguuccaucagcugaaggaaaaaugaaucauaagagggagggaaauggaagaggaagaaauuguucacauuuagagucauuacauuaauauuauugguuauuucuuuauucaaaucugaaauaaauuaaaaaaaaagaauagcuuaaaugaguacuuaaaaaauauuucucugauuaucacugaauguuaucaucugcagagcaagcaaaacuuaagucuuuaauugaauccaacuucuaggucuuacccuguggagaccuauguguacuugauuuucaauuaaugagcacuggucuuaucaauuuuuggucugcuaugcaguuuugcuaaaagagcugaaacagauuaacagcuacaauuauaaaucccaaacuuuguucauucuugauuauucucaauuuuaaggaacuagauagaacagacaacuaaaagcucaaaaugucaagauacuggaaguuuuucaaacuuucuucuauucuaaccacauuuccucaguguuuuacccuucuauuaaucauggguacaagaauggaaacauauaaagaaaauaauagcacauuuguuuacuuccccagauacuuacacaacacagauauacuagguugcugauauugcagcuguugauguugaucugccucagguucuucagguucuaccuguguagaaacugaagcagagguggcaggagcaguggguaugccagugcuagcagcagagagcugcuggauuccugccugggaaacgcuugcuuguuguucauucugcuguuugaaacugcucucuucuuguuuucuuuuuucuugcucuucucgaaccaacugccgcugcucucguuuucucuuaauuaaggacacccuaucuuugauagcuuuagccauggucuugugaucaccuucacagacauaaccagacucaaccuacagaguaaaagaguauauuaggaagaaaaagguaccccaaggaaaauuacuucaaauaguaaaauuacuagucugcauuaaguuuccccacaauugugguaaucagagugggccccacuccaugggaagaccagcagucucaacuguccuagaccccugagaucucuaaaacacugagcguccaaccaggcagcauacaccagcugauaugagguucacugacauauauacagcagaggacugucuggucuagccucaguuaaagaagaugcaccuaaccuugaaacuugaagccuuagggagugggguggucucgaaagguggggguugggguuaaggacauccucuuagagacagagagaggagguaugagaugggggaggagggaagguugaaacaggguaaaggacuaaaggauaaaaaccaagcaaaccaagcaaccaaccauuaaauuaaguauauuuuucacauuuggccuuuuuuuuuuaaacauugaauaauuuuuuuaaauccuaguaaggguacucuaugucuaucuguguaauaauugaccuuuauugucuuuuuauaggcacuguggcauaucuagauuugauuaaggauuuccuuuagaacugugaucuuuuacacauacuuaaaguaaggauacaugguuaguaacuugaucuucaaaacacccuucaaagcaagaaaguuuucauaauacuuauuuuuauuauuuaaaucaugugugugcagaugaaggcccaguauuugauccccugaugcuggaauuuuaggcagacgugagcugcuugauguggguagugaaaacuaaacuaaggaucuuuaaaagagcaguauacaccuguaacugcuaucucucuagccacggaaguaaaaauacuuuauaauccuauaucucucuacaguauuuaucaggauggaucaaaggcuaaccaguauuuagaaacaauuccaaaggaggaacuauuagcauuuauaggacuccagaaugcaucccagucucauaucuaauuuauccacuuguaccuccauguuauuucccucaaauaaaaaaaucaaaccagauuaucaaaacaauaucaaaaugcacaaagaaagaacuuaaggagaaauuauaggaacccccucccccacauccaaagacaaaacacuugggaacaacacaacuucauauuaaugacauacauaucauacaucacuaauuaaaauaguuguuuuguuuuugccuaucaguuucaguaaacauaaaucuacaacaucaucuaagggccaauuuaccauuucuugagcaacaucuucugguacaucccucuccaagucaaaggaaaacucaauagcuucauugucuuuguauuuucccuuuaauuucuuaauaucuucaauacgcagccauaauuuaauagcuaucuuuucuccaucaucuucuucugcuaauucuacccguaccccuguuuccuccuggaaaaaggcaugguucaaaaggucuuugauggaauaucuuucaaagaaagaaaaagaaaauuaaaaaaagucauuaguuugaaaaaacauuuuucuuucuuuuucugagguaguaucucacuauguugcacaggcuggccucagacuacagaauauuagaggcauaagaaugacuuucaaauguguguuuacuauuauuuaguuaaggggaaaaucuacaauagaaauuuucaacauuaauccauaugaauaguaauguuauagaaguguguguguguguguguguguguuuguuucugugagugagugcuggcaauggaauauauuaccuuauaagugcuagacagcuacaucuccagcauauagucauauuacaaucuguuuuuuuaauaacuguccuuagggacaaauuuuagaucaaaugaucuaaucuuauuaguaggauauaauuaugggaaguaauacaaaauaccaaagaagcauagcaaaacaagcaaaacaaaagcucagaagacaaaauuauguauggccuugucugacucuugaacaauaacuaugcaauggaauaccauuuauugacuaauguaaaaugaagauugagaaaagguuaauagucuuucucaaaguucuacaauaaucaauuauauuaucaaaacuagaccauaaauuuauugauuucuaguuugguacuuucuacaacagccaccuuuaucacuacaauaaaguccuucaauuccuuaucaacacuuguggauuuagcaagucagaggcugguugcauaacaaucauucuuuuuuaaacaaaauaccagcaaucaaauaaaacguuccauccauaaaagaaacagaauaacauuguaagacucaaaacaaauaucccuuuguuuacagugaaaaagucuuaaaagagcaaaacagaaacucaaacuaaauauccagagaaaagucuuaaagaucaugauguuaagcucuucuaaauaacaaaguuuugaaacgaacaugagccuacaagggugaagauacagaauucuugaauuugucugauauacccaauggugcccaaauuuuaggagauagguuaugcucaauuuacaauuuauauuuguauuaauuaggauaggaugguguaguuuuucuuuuaaagcugguaugggggugugguaaaggcagauuauuuucaaauaaagaucauggcucuuugccaagccuacaguugacccauuagcuacaccaccuaacagauacuugacacuuuucucagaaaaguucuguuuguacaaaugacuaaaccagaucuccucuuaagccuuaaguaaaaucucuuuuuacucauaggaauuuugauguuuugcuuuuuuaaaucuuggaauaaugacagaaaaaaaauccaggccuguguagcugagcugauuuucaauagccaagauuuuacuuuaccuuucaaacuuuaaugacaaaaagauuaaggaauagguuugcuucauuggaaaauaaacacuauuguagagcuuucuaaauuauccuauaagaacucucuuguaaggugguucuagcuuacuuaaaaaucacuaaaccacuuuuuuacaguuacaguggucaaaucuaaguagcuucaauagaaauaaucugauuuuuaaaaguguccuugcuaugaaugaaaaaaugaaacacaaguauuaaauuuaccucucauuguucaaauaacaccaugucaaagaagcaacuuaccuuucaucuuuguuuugucggauacauccuucaauaauuucuuuuacuucaggaauugcuacuuugucaaaacuggcuggcuucacucccuaaaauccagggggggaaaaaaaagccauagaaauaaugaaguaaugagaggagaaugcuggacuuuuaaauaggcugccuuuuuaauauccuggcccuuuuuccaauguaccuguaagaccugaucaguguagggaccagagguauuaaguggcaaucucaagaaacaacaaauaguauggcaggucuuuuagcagaaaaaaauuaggcugccgauaacaucuuacaguuaaaugguauccaggugcucugaaugguuagaaaaucuuuugugcaaccuugaaaacauauugauuacuucagccuuuauucuggacacugaacccaggaauagguaugaauucacacaguuugguagacauccuauuauauaauacucuuuaaaauacuuaauauuaagaauuaugggcuacuauuaugccagaauaacuaagaagcaacuuuacauaaauaaaacagaaaaaugagaaucaggaacagugauaugucuauaagcccaacacuuuugaaauggaggcgggagggucaggcuugcaagguuauccuuggagccaugucagaauggaguacaucagaaucaaaccucucaguuauuaauaggcauccuacugggauguuuucuaugacaccccaccacuaccaacccagcuagaagacuuguugaaaucccuggaaauguugcauucuuaucuuuaucuuuuuuaucggcagccuaauuuuuuuaauucuuaucuuuaaacacuccccugccucuagccuagaaauuuaagagucuggcuacagaauuuuacuauaaacaaccccuccaccuaaagugucagaaaagagacacuucucagagucucuaccaugcuauuggcuccuuugucaguugguucuuggaauuaauaauguuucuaaugaaacaaaaugaaauagaugcaccagcuuaauuagucagcaaggccaucuuucccccuacuugacccuaguacuucugaccacugucugcccaguaguuuucuucuuuuugcuucagucuagcaucuaccuacaaguccccuaccuggcaauuugacaaauucacuuuuuucuuguucuuuuuuuuuaaagcauuguuacaagugucugaccugcugauuauaauaaaugcagauuuaacaaaaacaaacucuucuuucuaauaaacucacuagugccuaguaaucuguuaguauccuuugaacaaccugccccauccaaaaccagaguucaagggcaccuugggcuaccugugacccugucucaaaacaaaaacaaaccaaaaaaacccccagucauaaaaugaacauuaauaucagacucacauuuaagaagaaaucucaucagcacuacucuaucugaaacuaacaucacaguguaucuuaguuaggguuuuuauugcugaaaugaaacaccaugaggaaaggaaucuggaaaugaaaaagcuuauucggcuaacauuuccauaguauuagggaaggaacucaugacgggaacacaaacggugaggaaccuggaggcaggggcuaaugcgcaguguuuacuggcuugguccucauggcuuggcucggggauggcaccacacaaaauggacugacaaacaccccccccacacacacacacacacauacacacacacaaucacuaaaucaaauccuacaaccuuaccuacaaaaccaucgcauggaggcauuuucucaauugagguuccuuccuuucagaugacuuuguguugugucauguugacauaaaaccauccaguacaguaacaguuuaaaauuuuaauuugauaaaaaauucuuuggcuggauaugauaucacaugccuuuaauucuaacacuauggaggcagaggcaggcugaucucuaugaguucaaggccagccuggucuacauagugaguuccaguauauucagggauguguacagaaacccugucuccaaaaacaaacaaauacuucaaaaauaaaacuuucagcaaagugucaaaacagcacuauuggagagauagguuagaagaaggccuucgcauuuauugccauuucaguaaugauauggauuaagaaccaagugccgggcaugguagcacacuccuuuaaguuugaggacagccugauuaauuaacauagugaguucugggccaccuaagggcuacauaguacaaccugucucaaagcaaacccccaaaccuaauccacucccaaaaggaauccagggagauauagcaacauguauaaguggugauauaaaucuguaaacacauagaugggagggaguuugauacauaaauucuaaccaucucuacagucucuguaacagaaauaaaacuagugauaacugaaucacagagagauacauaaucuuucacaagacuaaauaaaacacaguaguuugaauucuucaaguguagacugaaaauauuaauauuugucuugauccuguucaagaaaccuccuuggaaacuuuuuacaauaagguacauuaaguccuagaggaaauguauuauaagauucaguacaguuucagacacccacugguuauacaucaaaugauuuagugucaaagucguuaaacauggaagugagacacaaauuugauuaauucucauuaauuaccuguugcauucuuucaagcagugacuuacagaauugugcuccuaagaguaacuuuuuacagcaacugacugcgaaauagaguaaauccucaagucauaugaagguaauuugaaaguuuaaaucugagaaagacuacuaacaucacuuuuuuguguuuuccucccuaaauaucuuuguccacauaacuguuugagaauuucauguaugcauaugugccuucaccuagccuauccauucucccacaaauccaugcacacacaaaccccuuugaguccacuuagcauugccaguauacacuugaguguacagucauugucuggauccuauauaauaaccucuuagagacugucccuauucauacuaggauuuugucugguuuauuuagccaggucuuguacaugcugucacaacuguuauaaguacauaugugcaguugcucugcucuauccaaaacaccccaauaaguugugaaauguauuaauauauggguauagugauacaccauuaugagucauuuuaauauuauacccauuagcugaauaauauuaguagguauuucucuagggccuauguccuucuuggacaaacugcaguuacaagcauguguucucucuuaggaagugggccuuagauccaaucaguaaguguuugaaugcuggacauaaugacacagccuuuauucccagaacuugggaggcagaggcagguggaucucagaauuaagaggccacacauuuaaguuacaggacaaucaaagcuccacaauguagguaacccuaccuaggaaaauaaagcaaaacaaaagccaaaagggauugggggggauaugguuaccuccauaacauccugccacuguugcaccaguagccauaucuuggcaggccagucuuuaucuuagcuaacuucacagcugagggaagccuggugaugacucuuuuccacuaguggcugcaccuuccauaacuaaaaaaaaaaaccgagcuaguagggaugaagcuucuagauuguuaugaggcuuugcuuucuccauguucuagguacuaguauguaguaccuucaguaauaugaucuuacuauuuccagaugacaauagccuaugagauccacuaacaaccaacuccaagauaggaaaugcaugccuaccacuggggcuuuuuuuuuuuuuaaaauaccuuauagugucaaggagaacaacuguuuuucccccuuaccucaccucagcuacaggguaacuccuuuuaauuucuuuguauguuuguguagauuuagaaaguuucuacauuaguagguuuccaugcagcauuucugaaagucuuuaguuuaaauugucccuacccauacuccauccuugugagugcuaguauuaaaaaagccacccugguggcacacaccucuuuuagucuaagauaucagguauuggacagaauugcaguaauuccauacuuggcuaacuuaaagagcuuauaaaaacaaacaaacaaaaaaauacuuuuccauguuaagauaugggucuugauuucccugaugacuaaggauguugaacauuuuuuaagugcuucuuguccauuugugauuccucuauugagaaaucuguuuagcucuguacccauuuuuaauugaguuacuuuagguuacuggagucuaauuucuugaguucuuuauauauuuuggauauuagcccucucugucagauguaggguuaguaaaaaauuuuucccaauccauaggcugccauuuugucguauugacaguguccuuugccuuacagaaccuuuucaguuucaugaggucccauuuaucaauuguugaucuuauagccugaaccacagguguucuguuaaggaaauugucucuuuuaccaaggcuacuucccacuuccucuucuaugagauuuaguguauccaguuucauguuuugagguccuuaauccacuuggacuugaguuuugugcagggugauaaacaugaaucuauuugcacucuucuacaugcagacaucaaguuagaccagcgccauuucuuuuuuccauuguaugguuuugucaaaaaucaagugucuguaggugugucuguuuauuucucagucuuugauuugauuccauugaucaaucugucuguuucuguaccaacacuaugcaguuuuuaaucacuauuguuuuauaguauagauccugagauuccaccuuacaccagucaaaauggcuaacaucaaauacucaaaugacagcacaugcuggcgaggaaagggggaaaggggaacacuccuccauugcuggugggacugcaaacuuguauacucuggaaaucaaucuagcaguuucucagaaaauuggaaauagaucuaccugaagacccagcuauacugcuccugaguauauauauacccaaaaagaugcucuaccaugccacaaggacauaugcuccacuauguucacagcagcuuuauuuguaaagucagaaacuggaaauaacccagaugucccucaacugaagaacagauacagaaaauguaguucauuuacacaauggaauacuauucagccauuuaaaacaaggacaucgugaauuuugcaggaaaauggacagaacuaaaaaaacaucauccugacugagauaacccagaaccaaaaagacaugcauucucaccaaucaguggauauuagccauaaagcacagaauacccaugauacaucccacagacccaaagaaguuaaggaaggaagguccaagcuugaaucacacuuaggagggggaacaaaauagucauagggggcgaagaaauggguaggagaguagaaucaggauguauggagagaggagaaagagacccaaaggaccaggagaauaaauggaaaucuguagcugccagguauacaagaaggcuaccaagucuuauauguuaaguuuauguucuugcuccuuuguuaaauguguuuaucaguggccagaauuuucuaguagaggcuuuagagucuuuuaugcauagaaucauaccauaugcaaacaagaauaauuuuguuucauccuuucuuauguguaccauuguuaacaacuucagucacaagucuguaggcacuauauuaauaggaguggagaucauggacacucuugucuuauuacugacuuuagcagacacauucuccauaaauaagaauaauacagcuaaagucaaagaaugcagugauagagcaaaagaguauuuaaaauuuaagacuaaaauaaauagaaacuggguugugucucaguugguacaguacuuccuaacaagcaugaagcccuggguuugaauuccaacaugauauaagccgaaucuggucugguguuccaugauuaauccuggcacccagggaggugccauuaaccaagaggaucagaaauucaagagcauuaaugauuacaaggcaaguucaaggucaaccuagguuauacaagacauuguuucaaaaaacaaaacaaacauaaaauaaagccacaaaugucacagcacacaagcaguuguggacauacacacaguaaguaaaauaguaauuuacaagaaaacaaaacaaaacaaacuuccuugaagaaauuuuauggaugucuugcacuaggguugauaggagaaaauuugagcuuucuguuuuacauuggcuuuuguuuucuacaauaaaguaaaacagcauaaaguaaacuuuaaauggcaagaaacaccuaaaauguuauuuacaagcaauggucugaaacauaauuugguauaacagauugaauacaguuagaccuugaaugugagagcaguuaaaaugcuacagaaaaauaaccacagacagaaaauuuaaugaggaaaagaaagugacuucuauacaguaucuaaagggaauguguuuaaauuacuggugguaacauaucaaacuaaguugguaaauuguacuaccuuuuguauuaauguaggaaggacauaagaaauucuccugauccugcuuuuaucccuggugauuuuaauuuuuuagcuaucuuauuaaccacagcaacucauaaaaacauacacacguucauaucuucaaaucuaguuccuaacaaccucaaauauauuaguuuauacugccauuuaaauuuaugucauguuagaaacagaugauuccaugugaauguaauaaaacauauccaaaagccacuauggacuuaggaaauggccuuuaaaaaaauuauuaugugguccagcaaugguggcauaugccuuuaaucccagcauuuuggaggcagaggcaaguggaucuguguaaguucacgggaagccuggacgauacagaaugaauuccagaacggagaaagcuacacugagaaacccuguuucaaauaacaauaauaauaauguacaagaauguauaguauaaaaguaaaguauauggaauaaauucaaagcuuuccaagccugaaagugacuuacaggaaagcuauuagacauugaguaacaagguuuugagauacucgugggcuuuuuauuuuuaagaaacuaauauauauuugaucacugacauuuuuaaaaaguuggucuagguuauucuaaaacauaauuuuuagcaccagaaagaacacauuaguaauaacaaauguucuuauauuaacuucaucuuauuucuuuuuaacauguauacaucaaauagaggcgaagauuaacuuaaaagucuuauaacccugcaaaagcaaccccucuucuuccuuguuagcuuaaucacacgugguucuguuccaacuaguaaaagcaaauguauuuucugaauaagguuaaaaaauacaaaaccauuacuaagaaaaacuggguuacuguuaaagaaaaaaaacuaaguuuuauucaauaaaggcacacacuuuacucauuccacucguccaaacaagcaacuuagcucuaaaaguacucuugcauuauuguuguaauugaugggcaauggucucaaaagacauacaugcccuucaaacauguaagaguagcuuauuucucuucuuuaaauuauauuaaguauguauugaauaucuauugauacacacuagauacuuucaagguaauauaaaauugugcaguuucucauucugugaccuugucucaaucacuucuguaacacauauaauguauaaaaaaauaaauaauguuugucuccaaaguaucaaauauguagcuuuaggugcuagagacaugacugacugcucuuacagaggacccagguucauuucucagcacccacauaagggcuaacacuugucugugacuccaguuccagggcuucugacaccugacacacacauccauguaagcauaacaccaaugaauuuaaaacacacacacacacacaccuuuaauuuuguuuguuugccaacuaaucugcuggaaacacagaaaugagucauaguauagaauucuuugguucaaucuuugauuuuuuuaaaaauucucaguaauugcuucuuaaaagcuuaaguuucaaaaguuagaguaacauuuaguaucuugauaaaaguaaaaccugucuuaauaauucugaauuuagaaaagcauacuuccucaaacagaauaaauuauagaucauugaauaauuucaguaauuuaagugaaauuuccuauauacaucacuagaaagguuagaagaugcucuauauaaagacuggaaauucuuaccucauuuauacaauccuuuugagaacagcagcagcaaugagaauuuacaauaacaaauacugaacaaaaaucuuucuucauaaaauccaucagaaaaggcaacagacuuauuagacuuuaguaaaaaacuaggaggaaaguaaauagaaauauaaacuaauauaaccuagcccacagcauaaggaagacaaauaccaaaguuggagcauaguucuuguuuaauauccaugcuucccaacucugagauuguucuguucagccaacaaucuauuuagcuuggcucuguggauauaaacccugaaagacagggauuuugcuacuaguaguuucuucugcuucuccuacaauagcaauacauccuugaauaagcagacuuuuuuauuugcucaaagcuccaccuacuguauccaaaagcucugccuccuugacuuugaaaucuaccuuggaggcuuuccuauaucuaaaacuagauaccuaccuacugaaacacuucuuucaugccaaucauacugaaacuaacuuuuauuuaaaagugggguaagagacugaauucagacaacgaagcaaauucaggagaaugaucaaaaggagacaauauauuggcaguuauccaguuaacuuuacuucuacuagcucuuuuuuuuuuuucagaggacccagcacauacacagcagcucacaaccaucuguaacuccuguuuccagagaaaucgauaucuucuucuggccuccaugggcacuagguacaaguagugcauagaaauagaugcagacaaaacacucaugcacauagaaaauagaaauauuuccuguuuucccaacugaaaaugugguaauguuagggcugggaacaucauaguucagugguacagugccuugcuugugugugggaggguaggaguaagagacauuaaacugcuugcacuucugcauagguuuuuuuuuuuuuaaaagaacagugaacugcuauacaaaagcaguaaagguuucuuucuuucuuucuuuuuucuucccuccuacuaaaagccuacacaugugcagauauuuccuggaaagaaaaucucaugagcucaaauaaaagcuacuuugaauucaaauacuguuuagcuuuucuucauaauauuaauauaguagaaaaaguacugcuguggcagcaguauaagcuguauccuuugaaaagguaugagauugaaucccaaauaagacaguaaauaucaagguucaaucauugacagaaucagguaaggguuagaugcuauuuaguaaacauacuucuacucuggggacagcuaaaugacuuaguggguaaaagaacucacaacuaagccuaauaugaguuugauccaucagacucauauguugaaaggagagaacagacuccugaaaguucauuucugacuuccacauaauauuuugcuaugauacaucagugccccccacacaaaauauaugcaauuuaaaaaauacuucuaaagguuagaaauguacuaauccuaacaggcuaucucaaagcagcaguaauuucuggcucagucauuuaucacuacuaagcaagucagguacuacuacuaagaugucagguauuggacagaaauguaguaguucuuucagcuuacacauaugaggaagauuguuuaagacuauaugcuuggcuaacucaaagcagguuuuuaaaaaaugccuuuuccaagcuucuuuaagauauggguguugccuagagguggugguacacgccuuuaaucccagcacucaggaggcagaggcagguagaucuaucucugugaguuugaagccagccuggucuaccgagcaaguuccaggacagccaaggcuauauagagcaaccuugucuaauuaaaaaaaaaaaaagugagaugcaaagcaaucaggacaaaaaccaaacaaaaccccuaaacaaauaaaaguaaauaaaauacaauaaaauaaaaauaacuuuaagauacccauagaauaggagaaaacaaaguaaaacagaaauccuaggaauuuaaaaaaaaucuuaugagcuauagauauaagguuguacauaagauccccaaacuacaccuacacuuuggggccuuauauaaaugucugugguccuuauucagcgcaugcacgcaugcacacaaacacacagaggauuagcugcauauuauacuugcuauuugacccacuuaucuuaaaccuaugccuuugauagugagauagaaggaagagggaucuuuugggguuuuuuuuuguuguuuuuauuuuuucaagacaugguuucucuguguucccuuggccuuccuagaacucagucuuuagaacaggcuggccuugaacucagaauuccgccugccuaugccucccaaagugcugagauuaaagguaccacugcccagucacggaagagaauuaauucagcuacuugggagguuaaaguaguaggaccgaauguucaagcccugcuugaauuacagaauguacucagaacucugugagacuaucucaaaguaaaacguuuauagguugguauggggaggcuggagagauagcucagcaguuaagagcacugacugcuuuucuuaagaucaugaguucaaaucccagcaaccacaugguggcucgcaaccaucuauaacaagaucugacucccucuucugguaccucugaagacagcuacaguguacuuagauacaauaauaaauaaaucuuaagaaaaaaaguaaagguggguacagaaauacaauucagcaguagaacaucugucuaguaugugcuuggccauagguucaaucugcaguggaggaggaaaaguaauacaagcuuugcaugcuauuaaaagcauacgccacagcaucaauauuuauaugaaggauagugcauuugagguuggagcaauaccuuggcuuucaaguauccaaaguaauaagccuuagggaaucaugaggcaagcuaauuuccuuuaauagagccaacucaauuugguagggcauuugaagaggcuuguuuuccaauggaaauauauacuauguucaaauaccuguaaacuaaugguucauaccaacaagaaucuggcuaaauccagcccuuuaacaaccaaguuaaaaauaauggggauuuuuaauuacuuuguuuguguaaugugacuuugucacugauuccauuagccuuugaauugaaaggcuugaacaucuuguauggaaaaacagaauuaaagccauuaggguaaaauuccuuugaguuuuuauauaacagauuacaguuugcuccuucccacagaaacaagugacaccaauuugugauuagguaguguuugaaguugagaaaaauguuguauugucuuuuagcaguuagauaaaaacagguuuuuuuuuuuaagcuaaaaugauuuuuuuuaauaauccuauaaauguugauuguaagugaaaaaaaaauuuuguuugucacaaguuguagcuuaacauuauugucuuucaggggcuaccuguuacuauucuaugauucuaaauuuaaaagacaauuugggguaucauuugggggaauguuaaaaaacaauugaaaauuuuuucauacuucaucaauuaauccugaauaucaaucuuuacuucccaaaguaguagacagaauaaaaacuaacaguauguaaagauacuuuucuuauuuaggcacauuucagcaauacuaaaauuuucuggucucuugaaaauaaaacaugcuaaguacuaaaagaauagagacacuuuauaauugcugcuuuuuacuaguguaucauauaugacuuaagguaccacugaagaagcauaagaaguagguauacagugaacagaagaaauacaucugacugaacuuacaaggguggugaagagaaaaauauuaacuuugaauauuauugagucagaauuugggaaagauguuuauugagggcaaaagaauauaucuuucauaggagcaucauauaaaaaauaguauauuguuuguuugguuggcuucuuuuuugagacaguguuucuucucuauguagcccaggcuagccuccagaaaucugccugccucugcuucccaaaugaugggauuaaagcauuauacucaacugaaaaaguguuauuaauagaaacaaguuuuaagcauucacugaacaauuacucaguuugacugacuuacugagaauauaaguguagauagaggugaaguacaaagcauguaguauauguaacacugaacuugacaugaaauaucugaauucuacuuuuugcucuagcugcucaaauuaaugcauuauuagcacucacuggacuagauauucaguagucaacacugaauuaacauuuaucauaugaaugcucaaauauauaaaaauaaaaugagauauuuauguugagaaauguaauaaauauaauugaagaaaacagaacagcucucuacauuguuacaaauuaauacaaauaauuacauaauuacaaauaaauacauuguuacaaguaaaguuacacuaggcauaauaauguuuuagaaagauauaaaaauuacuaauggcuagugcaguuuauuaaaacuacugcugucuuaagagcucuugaagcaaaguuuagguugguuguuugguugguuguuugaacagaugguuuguaccuucuagucuuccaauagucuaacauuucaagcaaggcaaaaauaagauuuuuauaaagcaauuaccucccuaaaucacuuuguuuccuuugcauuaaauuuguggcccccaaauucuggagagauugaugugcaguuaagaacacuuaaugcuuuuccuaagguuugauucccucucaauguaguagcucacaauagucuagacuggaguuucaagggaucagaagccuuugggccucacuggggaucaggcaagcaugugauguacagacaaacauacaaacaaaacacucaagaauagauagauagauagauagauagauagauagauagauagauagagaauagauagauagauagauagauagagaauagauagauagauagauagauagauagauagauagauagauagauaaagugccaagaagacuaagcuauucaagaugccuuacuuccuugggaaauuaguuuuagaaaaacuuuccugaaaugucugagggauauuuaaaaaaaaauacaauuugcuuuugcucucagaaaacaaagugaaaauaagacuaaaaauuauggggaaauguugccaggcaaaaccccacaguccaaucccgacaacacaguacauuacuuuaacuggcuaccagaaauuucaauuuugagauuuuagaaucuguacagcagcaaaagaauggaugaggguuuagauauuaccccauucuaucgucuuuucuauacuuauauguuacucuuacuuguauguagauuucuauuuacugugauuuaacuucauuuuguaagauaacaacuuuucaagagucacuuuaaauuucauuucuucucuggaauauaauucuuauaaacuggcauaaagcccaacuuuuaacuacaauuaggauuacuuuuaauuuuuuuuauuuuuaaaaacauuuauaaaugcccguaccaugucauacgcaaugaacauguaaauagaaacaaguauuugauaagucgaacucuaagacaaugacuuuuuuaaaaaaacuacuaacauuauccaucacguuagcuaugaucugauuauuuauauauccacuuaaaaauuugcugucaaaauacaacauccaauggaauaguauucagagauacaaccuuugguauaugguuaggucaugaauguacaaacuguaacuuaauaaaaagaaccuuucaccagguaaggacaaugugaaaaggcauuuugcaugaagaaugggucuccaguagauauugaaacugaaggcaccuuuauuuugaacuuuccaguuuccagagcugaaaaauaaacuauauaaaauaaauaaacuugcuguuuauaaucccacucaguuuaugguauuucuauuauagcugcucaaaaaauuagaacacuguucuuuauccuucuccaggaguaagaaaagcuguugaauauuauacaauggaauauuauuuaacuauaaaaaguaaugaaguacugacacgugucagcauguaaaugaacauuggaaauauuaugcuaggugaguaaaacuaaaauauugauguuaaaugcaccaaaagaggcaaaucaaauuugguuugguggguagagaagagagauauaguaaauaggggauucuuuugaagaauggugaaaagucuuggaaucaguagugaugcaucgggaaugcaacagaaaccaccaaacucuauauuuuagcuucuucguguauucguauuugcucacuuaaaaaaaaaucuauucaacaauugaaaacaggcugagcgcuauaauaacaaagaaagaaucugaauacuagucacagaaaagucuuauuuuauuuaaaagaauuuuauucuuuuuuuaaaaaaauugguuauuucauuuauauacauuucaaauguugucucccuuccuggucucuccucugcaaaccccccauuccauucuccugcccgugccucuaagagggugcuccucuacccacccacccacucccaccucaccgcucuagaauccuccuaugcuggggcaucaagccuccacaggaccaagggucuccucucuuaacugaccugaaguuuauaacuagugaccucuuuucuucucccuucauuuccugugagccaauucuuuuaaaacuauccaacugaauuaagacuguaaagacaaaguuaacaccuggauuagaauaaaagccaaguauguuaggucuucucuugaucaagaauaaaauuuguagaaguguacuucucuaaaauggucauuuauuuuaacuguuagguauaagaacucaaauuuaaauuuaauaagacaaaacaaaaagcaaaaacuucuugaauccaucuaauguaguuuuucccuaugacuccauacuucuacauuuucaguuauuuccccacuagcugauuacuauaaggaucauuucccauuuaucuuucucccuauauggcucauaauccuccugccucagcacucugaaugcuaguggauaccacuaaaacagaacuucaauagccaaccuuucaacuguuuuuaguuugauuugaucggauuuuaguucccuguucugcuuuuccaacuuugguuuuaguucuucaaaucuacauccagaaaaaucuuuauaaaaucuaggccugcuuaugugacaccuaccuguuuuauagaagcuacaacaauucuguucuuuuccuaucugcaaacucagcaggcaugcaaaacuguaguucucucauaguuaauacuuagggccuccuagaaucuuuaaugaucacucuccuaaccuguucaacucagugagguacuaacugcuccaugugcuuugcuuagcuauuuaacacuagaauagcuggcccaguugugguggcacacaucauuaaugagggcagggagauacaagcaguaagagcucaaggcuaggacagccauggcuacacacacacacacaaaaccaacuaacgcaaccaaccaaauaaacccacuagaauauuguuuuauacucugugauacccaacuucuuugucauuguccuuccuccacuuaagcuuuuuagaaacaagaacuacaguuaauaacauucaacaucaugaauuuagaaaagucuggaauacagaaggaacucaaaauauuuguugguaggugagaugauucagcuuguggacaaaccuggugacccagcuauugucccuggggcucauacuguaaaaggaagacuccucugaccucaacacauuugcuauagcaugcauguacaccuacucaaugaaaauaaauguaaugaaacaaaaggcauguuguaguucuaauauauauacuguauaaugugacugugguaaauuuauaccaacugucagcuugacagaaccuagaaauaccuuggagaaaaauauaugaagaugucugucaagaauuauauugauuagauuaacugaggagggagaccaaccuucaguauuagauuaacugaggauaagaccaaucuuaaauaugguaguaacauucauuucccuagguaacauucauuccuaggcugggaucuugggcugaauaaaaaaagaagaaagcuaccuggguagcagcauucaucugucucugccuucugauguggauguuacauaaauaaauaaauaacugcuucaagcuugugcugccauuaacuuccuugccaagauggacaguacucaaaugugagauaaaaauaaacccuucauugauuccuuaaauuacuuuugucagucuuuuuuuggucaaaguaacaaaacaguaacuaauauaaaaaauggacuaauuaauauguuugauggaggaaauuucaagcaaugucaguuacugcucacuggcucacuggucuuauccaagucuacagguuuuguuuguuuguuugguugguugauuuuuaaaguaaaauaaggaaaagaaagggcauaaggaaaaaaauguaaaguuuggucaaaaagaaaaaaaaguaaugaacaaguuuuagaguuugaaaaggagacuaagcaauggccaagcaccuauaauuguuaaagaaauuagcaccgccuggcgugguggcgcacaccuuuaaucccagcacuugggaggcagaggcaggcagauuucugaguucgaggccagccuggucuacagagugaguuccagaauagcuggggcuacacaaagaaacccugucuugggggggaggggggguuaucauaguuucacugcuauaauaccaaucuucuuaaugcuuccaaaagucuacaacugaacucucauauucccauccuaaaagcuuuggcuuucuguuguauugcccuuuuacauaaguggauguuauccagccugacuuuauaagcuaugacucaaugucaucaacaauuagguaaggacuuacacuggucacucgacgguagaucugcgcagcauuuuggcauucugaguauggauauucagauguagccaucucaagcaugcacaucccaaaagcauaaacaucaacggauucaucauauuucuccucauacaucucaggagccauaaacucugggguaccuuaaauuaaaagaaugauucacacucaauauggccaauagcuguaggucuuccuuaccagaggguucaagaaacaaagagguugaccuaucagaggaaaaaaaaauagaagggaauaaaaaagaaagggggaaaagaagacaaaacgcuucuuagucuguuccaucgaauauccuauagaagauuuucuacuguaaggccuuuaaaaacacacugaacauagucaaguaagugauuauuuauaguguuguguauaaauuauuaacauggaacacuuuggcuaaaaaaaaaacaaucauauuucauaauaaaaacaaauagaagggaagaguaauaaaauacaaauaccuagcagggaacaaaauggauacauggauacugugggauaauaaugaaaaagaucaaauauuugucugcccucuacuuuauggcagauguauggauuuuccuuuuuugugggguagugggggcuagaaaagagggggugagacaggguuucucuguguagccuugguuuccuagaacucacucuguagaccaggcugaccucaaacucggaaacccaccugccucugccuccugaguacugggauaaaaguauuuggugggauaguuguuagaggaguauucacaacuagucucuugccauugaugguacuuuuuaaagccuuguagaaaaaacccucuguauucaauguuuuuaaagauaacaaaaaggccuuuucuucauauacuuacccucccaccuagaguacacaaauaagccuaguacagauauaggugauaaagugagggguauccugcaggugaaaaacaaauauacauacaaauauagaacucaaauacagacugauuuguaagcauaauauguacauguauauguauauguaugguacuacaagauuagauuuuacaaugauuucagaaucuuuaacuucaguuccaagaauaaguaugcacaguaugauuuaauacaggggguuauguuugauuuuaagauuucacagacaauuaaaugcucccuaugaagaaaacaaaauggcaauuuagcuucaaauauauuuuuccuauuaauauauuaugugaauacauauaaacagcacuacgcaauauuccaaugagaacauuguuuuuguuuuggucuuuaaagaaauacaagugacuggcaugccaugauguucuuaucaguacuuaggauucugguccaacuauuuauuaacaaaugggcuuuugauguuauacccuauuggaaagcagauagaaugugaacugcaaauuuuuaagucucagagaacuaaaccuuaucaaacagccauuauuuuuucccagcugugacucuaauauacaaucaaaaagucugaaaggucacucauauucuuuguacuacuuaaugaugaguuaauuuugcucuacugacagccaugucuggaaacggucuggugacaacaauuaggaauaaauauacaagaguaugcuacuaguguacugugguagaacucaggauugcuaggaaauaauucuacaauaugucuacacaacugucuagagacugacauccagagaacuacggcugggaaaccuaauugauacaaaguucauuucaaaaggugggaauuaaguaagguuuaugagacuagccuuucacugcaccuucccauauauucuaauuuucaaaucaaauuuuuauagcagguauucuugaacauauacccaauggacauuucugaaguugaacuacaaauacauuccauuuauuuuuugaaaaaagcaacauguuguuccuacuguauaaauaaaauauaaaauauuauuagcaggaugucucaguaagaauagcaagauacuguaucaauguucaccuuacuucucuccauguaacuuuauaaaaacaauaaucuucaaaaugauuuuagaagcuuacuauuuuaaaaaaucccucauuucauauuuagauagacuugaucacuagguucaugcuaugaauuccuaaagguuuauuucaugucagaaaauauaugauagggucaaguuucuaaagaaaagcuaugucaaagggccaaacuggcuccaaaagcacacuggaaacauaccuaucacacucuuggcaaaagaagcccgcuuuagaguugccagaccaaggucuccgaucuugacugagccaguaggaccagugauaaagauguugucacauuuaagaucccggugaauaauugguggaguucguguguggagaaacugaagcccuuuaaggauuugccgacaccagcuucuuaaaacuuugauuuucaucacuuuaaaccuuuuuaaguaccuggaaaaggcaaaguaaaccaaacagguuaucaaugauaugagguucugcuuugaagaauuucauuaaauucugacauaccaaagauaggaauaucaaauuuggaauacugaaccucaguauaaguuuaagggucugagauaaguucaaaaugaaauucuaucaaaagacaagaaaaauaacuuuaaaaaaaacuuuacauauauauaaauauauauauauauauacacacauauauaagacaagaaaaugaacuuuauaaaaacacaucuaucuauaucuauaucuacauuuuuuuauauacauauggugugggaaaguacaugcaccuguccauguauggaagucagaaauccucuggagaugaaauuacaggugcuugcugguugccuggcuucuuaccugggugaugggaucuaucuucaugacucugcaguaagugaucuuaaccaucucucuggcuaguaguuuguuuucaaagaaucuaacuauguagcccaggcuagcuucaaacuugcaauuguucugccucuguaaacuuuuuuuauuauuuguuuguugagaaagggacucauguaacccaugcuaccaugcuugaugacaaacuccaugacucacaugguauaaaaagauaauggacucccuuaaguguucuuugaccuccauaugcaugcuaugacauguguaugugcacacacaccuaaguaaauguaauaauuuuuuaaaaggucuuaugugguaaauggaacaauuuugggguacaguauaauaaauagcaguucuaugucugcagugcaguacugauaaguaaagauaggggauggggagaaagaugcuucaguuguuaagaacacuuguggcuuuucagaagcccuacauucauuuccaagcauucaugccaggcggcucauaacuaccuuuaacuccagcuccagggaauccaacacccuguucuggcuucucugggcaccugcauauggcacuugugugugcacacacacauuuaaaagagauagagcugggcgugguggcgcacgccuuuaaucccagcacucgggagguagaggcaggcagauuucugaguuccaggccagccuggucuacaaagugaguuccagggcagccagagcuauacagagaaacccugucucgaagaucucaaaaaaaaaaaaaaaaaaaaaaaaaaaaaaaaaaagaagaggaggugaccugcugcacaagacuaaugacuuuaguuugauuucuggaauucauagugaaagaaaagaaaugaauucuggauuuagucuuucuaccucuauacuugugccauggcacaugucuggacuagcacauacacauuauucucauucauauucuauuuauucucauaguugcucuccuuuccacccgucucuccuccuccccuauacccaugauaaagugcacuuuaaaaaggcaaugagacuagcuuaacaagagggaaaccacacccucacgccuuguauaagaaaucugcggggguccaucccauaaucagccaccaaaugcagacacuauuaaauaugacagcaagauuuugcugaaaggacccugauauagcugucucuugugaggcuaugccagugccuggcaaacacagaagugaaugcucacagucagcuauuggauggaacacagugcccccaauggaagagauagagaaagugcccuaggagcugaaggggcugcaacccuauagguugaacaacaauaugaacuaaccaguacccccagagcucgugucucuagcugcauauguagcagaagauggccuacucggccaucaaugggaagagaggccccuuggucuugcaaacuuuauaugccccaguacaggggaacgccagggccaagaagugggagugaguggguaggagagcgggggggggggggggggugguauaggggacuuuugggguagcauuugaaauguaaaugaagaaaauauauaauaaagaauuuuuuaaaaaaaucuagacaacuaacuaccuagggcuaauggcguuauagaccuggaagaagaaucuacaacuuccacuucacuauaccaacauaaucccuaacuacauuuuaaauauuuguucuuauaaccacacauaagugugguucuuacccuaaaaugaggaaaguucucuuaguagcagauggagaccauuacagcacaacugcucaaaaugcagaguuguagagcccagauauaacugauacaucuacaacucugcuuagacaucaccuaaacaaagacaacaucaauagacaugcuauaaucgaagggacaaaaucuuaacccuugaaaaagaccuauaagcaacuaaggacuguuuagaguggaaaauuagucuuucccuggaaaaagcauaccaauagguuaucaacuacaaaauaguuagcccugaaaacauauacuacaaguaacauuauauagacugaauagguauuuauauacuuaugaauuuguauauauacacacauucauaacaauugauaagcuggagaaggggaaugaaucugaaagagagccuaggagagcagguaccaugggaaggcuaagaggaaagaaagagggaagagagaugauauaaucauauuauaaccucaaaaaauaaaauauuuaagaagggaagggagaaauuccagaaaguagucacagaaaaagaguccacaguucuauauauuuuuugccccaagucuccagguaacuggugaaauagguacauauacaacagaauccacaaggcgauuaacaugaaaagaacagcucaggggcuggagagauggcucagugguuaagagcacugacuguucuuccagagguccugagcucaguucccagcagccacaugguggcucacaaccaucuguaaugggauucccaugccugcuucuggggugucugaagagaguaguaguauacucacauacauaaaauaaauaaaucuuuuuuaaagaaagaaaagaacugcacaaauuucucugacaauaccuaccacuguagagaagauacugggaauaggaauugcacccugaugugcauuuuaucuguacauguccaggguuaaggaagggaaaucaucuauuuucauauuauuuuuaagguacaugcaauuagucaauaggaaagaaaaaucuguauuuggggaaaauucuguauuuguauaaaauguacauuuaccaaauauaagaaucauaguauaaaaacaaguguuagcuaggaaauguguuuuaaaugaauuugcacaauauuagugcucaguuagugaagagguaaggauauaaauaaaaucuuuacaguaaucuuuuuuuuuuuaagaaauccuacaccagaucugaaucaaaaaucuaagaguaaaacuaaaauaaaauucuacauuuggauguagcaauuaaauaaggcaaguaggugcuuugacuacauguaugccugugcaccgagugugugccuaguguccacgcuggccaaaaguagaagacagagccucuaagacuagaguuaaagacagacaguugugagccugcugggaccugaaccaggguucuaugcaagagaaccugguguucuuaacucuugaacaaucaaucucuccagccccauaauuacuuuaauccucaaaaccugauuuggggagagguugggugaauauauaaucaagacacgcuguucucuaagaguugauaaaaauagcauuaaaaacaaaaccaaacaaacaaacaaaaaugaucaguaccagggguaccauagaccccuaacauuacagccuauugcuauuguugguuacccucuagaaauugauggcaagccccuacugcuaaggauaccacauagcugaaauggagaaaaaucaagcuggagaauucaucccuacugacaaacuuucacagugcuggaagguauugugaacacuacagcaaucaacagucccacccaacuuagaacccaugugagcuacaguaagaacuggcagagcaagaaaugcaauugauacaauauugacaaaauguuaugggaguaagaaacuacuaguuuaugacugaauuuaagacagaacccaugccugauacuacuaugcuuaguaguaggggaaacagccauagcacuagagugacuccuggugguuucucacaucucucacaucucucaaaccucaggagaagcuucuuuuuuugcagcaggugaauccugagacuuaacaauuaguaaacauguauggagaauuagagcuuccagauugcucaguccuaaaggacaucuacgucacaccuccucucuguguggcucagggaucauugccaaagagggggugaaagauuauaagagccagagguaguggaagacugcuguuaaaccauguuuucuauaaguuaaagaacucuauaccugguacuauaaaccugaucaaaaacucauggcugggagguuuuaggaucuaaaggagugguucucaaccuuccuaaugcugugguccuuuaguacauuuccaucauguuguggugacugcaaccacaaaauuauuucauugccauuucuucauaacuuuaacuuugcuacugugaauuguaauguaaauaucugauauuugacuccugcagggguugucccacagguugagaaccacucacugauaagaacuuaguacuguuggcaagcaaaacugacagcaaacugccuucuaaauguuuaaauuuauacacauagacaaaugcuuuucuuagccuuaauuagagaagguucucuuuguaaugaauguaaaugcagagccucauagcugcucaaguuggugaaaguaagugauagcugaauguucaacuuugaauaaaaccuuuuaacaaccuuucuuagggaauuuguggaauugggacagaaaacuauaagauccaaagauagugguaagaacuaugggauggcccggcagugguggcacacggguuuaauccuagcacucaagagacagaggcaaguagauaucugaguuugaggucagccuagucuauagaguaaguuccaagacagcuagggcuacacagagaaaccugauucaaagaaagaaagaaaaaaaaaaaaaaaacacaaaaaacaaacaaacacccaacaacaaaauguaacuacagaaugcuauuuuccaggaaugacuccaccaucucaucaucucacagaagcuugcaucugccuguauaagauugggccuaucccuugguccugugaaggcucuuugccccaguauaggagaaugccaggaccaggaauaagaguggguggguuggggagcagggggaggaggaaggggauaggggauuuucagaggggaaacuagaaaaggggauaacacuugaaauguaaauaaagaaaauaucuacuaaaaaaaaaagacuggguccuacauacaccaccaaccccauuccacccuacugaacuacuaguuaccaauuaugggggaggagaugucacuuucuucaauuuuguacccauuaguaaguccaucaggcuccaauacacaauuccaaacacauguucacaagggguuaaacucaaccagucauaaaacaaaacaaaaaagcaugaauguggggaaaagacuugugaagagaagggggaguggcaggaauugggaagauauuggaggaaugaaacaauaaucagaauauacaauauuuauauauaaaauugucaaagaaugauuuuuuuaagacagucuuacuaagugucccuggcuacacuggaaucuacuagauagaacagacugaccucgugaccugucucugccuccuaaguacugagauauaaaggaguguaacaggaccaggauauuuuaaugaguugcucuuaggcaaaucuuguucaacuaugccugucauuuucaggauagagucucauuucuuucuuaagucuucuacuauuuauucucaauugcccuucauaaaacuguuugcauauucacuuucaccuuuccauaaauauuuaauauauauuacuuuaagaauuacccauaguacaccguagcugucgucagacaccagaagagggcgucagaucucauuauggaugguugugagccaccaugugguugcugggauuugaacucaggacccauggaagagcagucgggugcucuuaaccccugagcugucucuccagcccuggagggcaucauccugagugagguaauccaaucacaaaggaacucucacaauauguacucacugauaaguggauauuagcccagaaacuuaggauacccaagauauaagauauaauuugcuaaaaacauuaaacucaagagaacgaagaccaaaguguggacacuuugccccuucuuagaauaggaaacaaaacacccauggaaggaguuacagagacaaaaucuggaagugugacgaaaggauggaccaucuagugauugccauacccagagauccaucccaugaucagcuuccaaacgcugacaccauuguauacacuagcaagauuuugcugaaaggacccugcugucucuugugagacuaugccagggccuagcaaacauagaaguggaugcucacagucagcuauugaauggaccacagggcccccaauggagaaacuagagaaagcacccaaggaacuaaagggaacugcaacccuauagguggaacaacaauaugaacuaagcaguaccccggagcucuugucucuagcugcauauguaucaaaagauggccuagucggccaucacugcaaagagaggcccauuggacuugcaaacuuuauaugccccaguacaggggaaugccagggccaaaaagggggaguggguggguaggggaguggggggguggguaugggggacuuuugguauagcauuggaaauguaaaugagcuaaauaccuaauaaaaaaugggggaaaaaaaaagaaaagaauuacccauaguaucuuuagcugcuccaguauucauuucugguugugucuucauaguuuuuuaguggguacauuauuuaacuaugaaaucaucugucuaguuacuuuucuguugccauaacaaaauaccaucaccaaggcaacauauuaagauauauuuaauugggcuuacaguuucagagaguuaggggccaugaugguggagcaaagacauggcaccagacacaucugagagcuuacauccuaauccacaaguauuagacagaaagacuagaagucuagcucaaggccugccaccucucccaacaagacuauaccucgaauccuucccaaauaguuccaucuacugaaccaaguagucaaguacaugggccugugagagucauccucauucaaacuaccuuugaaaacuuaucuguacauagugugaccaucaaugaacuaugaaaauguccauggaaauuucauuuggguucacuuauggcauaucuuuuggccugaguuuccugcacuagcuaggcagcagaauuuacaguagagaauauauauuauuaauuuauuauuguacaugagauaaugauagacaugaguacaaaguacaggcauugauagcaacuuggagaggagaauggggcaaagaggagaggaguauuuuucagagacuuuucuuucauccaaagggccaaagcuuuuuguaguuuuuacugauuggagugccaccuuuauuuagcuuuuuauggacaauuacauuuuuuaacauggguuauauucuaaucuuucucucuaccagcugucacuuugugaauacaaaacuaguauccauuuucacguguaccauauuuauauaauggugauuugucgucccuuauuauuuuauuggggauuacccuuuccuacugauucuuagauauauacuaaaacaacuuauguuaaauuccccauugcauuucacagguggcgagcagccaguucacaugcaacccuuugcuuguaccaaaaauguuucucuauaguuuuguuuuguuugaacaggucucauuuaguuggccuuuaacuuacuauguagcugggccuggccuugaacuccugauucugccuacaucuuccaagugcuaggauuacaugugaacuucaaacuagacuuucaauaucguuuucauuugcuuguuuuaagauagugucucguguagccuggacuggccucaaacuuccuaaauaccuguaaaugaacuugcuugaacuuuuugcaaccucugaagaacugagauuucagcuauaccaacacacccaguuuaugugguauggcugaaugaacccaggauuuuguauuuugugcauacuaguuaagaaccaauugauucugaguuacacucuaauauaguuguuguuucuucuauuucuucuuccuuuccucuuccuucucuucuucuuccugguguguaguaucuguaaucaacucuagcacucuggaggcagaagcacauguacugcuuaauucuaggcccaucugggguuccauagcaaguuccagaucagccaaggcuacauaauaagaguaugucuccuauggcucuggcaucauaaugcucagcucuuacuuuacuuuuuaacauuuuucauuacuuuuacauuuauuuguuucuuuguuuagguuuucugaagacagggcuucucuguaauacuggcuccuagcauccauaauaaaacagcccacuacagccuguaacuucagcucuaaggaaucuaucacccucuuccccacuacaaagacucccauauggcauacacucacagauauacacauuuauacaugaauuaaaaaaauaaaucgugaaaacuuccuaguagauucauuaauuuuauguauguuuuugccuguguaucuguguguguaccacaugcaaacuugguggccacagaagucaaaagguguuugaucccuagaacuggaauuauacauguuuguaaacuaccacagccaugcugagaaucagauauggguccucugcaaaagcaacaagugcucuuaaccaaugagugcucuagcucaauagucaugacuuuaaaaaacaaacaaacaacaaacaaauaaauaagcaaggaagauacaagucaaaccauuguaacgugacagacugcugacaagcaacuagguaucuguaucauugaaaagacuuucaagguguagauagacauacaacuaucacacaacuuucuuuaaaccacucaaguauuuaucaaguuucagacacugugcuacaaaguaaaguaguagaagaagcagguauaugaauaaggagcuugaaugaauaucaucauacccaucaucaucuucauccucuccaagagagauggagaugacucucagugguuaagagugcuugcagaggaucugaguucagcuuucagcauccaugucuagugcuuccucuguuaaucucauuuuaaccacuagagggcaaccuugacauugauuucuacuuccuaaacugcucaauuuuaaaaauaucaaucaauaugacuuaaaauuaacuagguuuauucagcaacaaacucaucccaauagcuaccaauaaauaauaaccuuauuauuuuauauacaagaagauuuuguggguaguaaaaacacauugguugaaaggauuauuucugucauaguagacuaaacaacaaaaguaaauauaaaacaagagauuucuagaaaauauugauugacuuacgucuuaaguguuccagaugucauuaguucagucacuaaaacaaugcauuuuuucccuuuuacuguggauucccaggaaucauagaaucgaacaauguugggauguugaagacccuuuaacauuucagccucuucuuugaaucucugccuuucagauuuuguuaacuuucgauccuaaaaggcaaaaaacaaaacaaugugauuuaaaaugauaaaacacaagucacauagcuauauuaggaugcuaaauaagcuggucaagauggcacauggugacaaucucagaagucagguagccccaaugaggcagcaagacuaaguucaaaacuugucuaagcugggcgugguggcgcacgccuuuaaucccagcacuugggaggcagagacagagauuauauuuuagacauuagagauuauauuuagauuucugaguucgaggccagccuggucuacaaagugaguuccaggacagccaagacuauacagagaaacccugucucgaaaaaccaaaggggggggaaaaaaaacuugucuaaauaaaauacgccgggcauggugaugcgcaccuuuaaucccagcacuucugaggcagaggcaggcagauuucuggguucgaggccagucuggucuacaaaguaaguuccaggacagccagggcuauacagagaaaaccugucuugaaaaaccuaaauaaauaaaucaauagaaaugugcuaauuauacguuaaugauaaauagcauuaaaaugaaacagaaacacuaauaaaagucauuugcgugccuuaagaguuggagaacacagccggauggugguggcacacgacuuuaaucccagcacuugggaggcagaggcaggcagauuucugaguuugaggccagccuggucuacaaagugaguuccaggacagccagggauacacagagaaacccugucucgaaaaaccaaaaaaaaaaaaaaaaaagaguuggagaacagaguacuguaucuuuaaggaaaauggauuauaaagugaugcuugaaauuauuuaucauuaguaucaaugucaaaaauauaaucucauuccauaaaauacaguuaacuugucacuuccaaaauaagucaauaauuguuagaaacaggcgauuaaugucacagaauaguuauaggcaaagacuuaauaaucagagcuauauagaaaaaaacauaucuuagguaaaaaacaaaaacaguuaaaugauauauaucuuuguauuaauuagaacuuucuaugaauaugcuguauaaucuaacaaaauuguuaucauaaucaagcaaucuaguaaguaugcuuucaccagguguuaaguucuuggugccuuuacaggagcuaauuuacuuccuaucugagaugaagaauccaauuuggcuuuauaguuuguuaaaguccauacacgcaaugucuugauuguucuguuuauuaaaauggaaacuaucuuuagucacucucaguauagauaucucaauguaguauugccagcaaaacuaaaagugauuuaauauuacaauguuuuagcaaaaagaagugauuuuaauauuauacaccuaauuuaaacuaauuuaaaauccuuuggguaacuagaauggacccucguuucuacuccuuaaccuuaaaugaacacuaucauaaauuuagguauaagaaucauugguuuuuauacuuugccaaaaaaaagaaagagaaaaaaagaacauaucacaguuuauauauuaccuacuaaggaaucuuuaggcacuuagucauuuguugcuucuccaauacccgaaauaagguuauacuguuaaauuuuuuuggcuuguauauauaacuauuuacagaacacuggggcuuuuguuuagauaugaucucucuacauaacccuggcuguucuggaacuaauuauguaguccaaucugacauuuaacucagagauguaccugcuucuacauccugagugcuaggauuacaggcaugugccaccaagcccagcuuagacacuuucucauaggauucacaaaauucuucauuuauaaacuuacaggacuagacagauggcucauuaguuaagaguaguuguuggucuugcagagaccccaaguucaguuaccagcaccaauauaauagcauacaagcauccauaauuccagaaccagggauacuaaugcacauucuuccaaccuccucuagcaccaggcauguacacucucauuuacauacauaaaauaaaucuaaauauuuuaaagauuuacagacuugcacaaauauuauuuucauuagcuuugaauuaagacuugccauuucuuaauuaugaauguaaacaucuaacaguauucuguauuaccuacaauuuuuaaucacuguuggacuuaaucaaauaacaaauaauuauagauaucccaaaaugccacugauuaaucacuacuuggaaauuaccauagcuauuagaucuugcacuacaucauagaaucuauuagugauauauacaaugccacuucuaaaaaaaaugauacuuugauaacuaauacaaugccacuucuaaaaaaaagauacuuugauaacuaaagcaacuucuuuucugcucuucugugcuuuugcuauggucuaagugauucacauuaaaauuuuagccucaaagauauuaggagguagacucuuuagguagugacuuuauaagggggcggggacuucagggaagaaauuaaucucuucauccuguuccaccaugugaggaugcaacaagaacaugauacaaguucucugaggcacaguaaguacugaccagacauggcaaguugaccgagaacuucccaguuaccuaaacuaugaaaucuuuucuauuauuuauaaauuaaugucaucuaaguacauuauaguagccuaugcagucuagauauuuacuuaugucugaagguuaccacugcuacacaugcucaagagcacaugugguaguuaucuacaacacaucaacuuugucaauuuggugaguguaaaaccaaucagugccauuaaucugcuucaaaaaaccuuuuacuuuucugagagggucuuauauugcuuggggugugugugugugugugugugugugugugugucuguguguguguguguguguguauccccagauaauuuugaaauugcagcccuaucucagucucagaugugcaucaucaaugccuacucuaauuguguuuuuuaaauaaaaauuucaagcauuuguuucaggaaaauauucauauucucuccccgccccccuugaaauaaauuucucucaaccuucacuccuucucuuuaagacuuuauguguagaaaugcauacauguaugcuugggggacuuaucuuuacuguuucucauuuucuacugcuuucugauaucacaaucuguacuaauuuucuuguugcuacaacacauucuuguuuauuaccuuuuaaaaacuaucauuauuaauuaaaccauagggcuuaagaaaggcaaugugccagagugucugcuccagauagaaggaugaggugagcauaaauaaaaaugcaaguaaguuugaaauauagauugggguggguaggugauuacccauaaauaacauaaaacuggccaagcuaggcauagugguauaaucuuagcacucaggauugagauuuuuuuuaaggucagaagaggcuguuuuucucccaaaacacaaaacaaaaaaaacccacuuccaaacuaaagcagaacagcacaacaacaaaaacucuacagggauaagaauucagauucaaaaguauuuauggagaaguucgagacagggaaagucuagucauuauuccuuccaagggucauauuaaugaaaaaaacuuuguaggccuugcuuccaauggagauuauauagcguguggaagugagaacaacucccucuaccuguauuauaaaggacuuucuaaaacuuugcuaacuuuuaaguuugauaccguuaagaguguauuagacaaagaucggaaagaagaugacacaaaugaauuugucagugcuguguguuggcgggcacuaucagacggggaguccaaugugcugauugcugcuaacagccaggguacaauuaaggugcuagaauugguauaaagaguuuccugaagucaaacuguguuugauccucccaaaagccaucugcagcugaugaugaucaaaaacaaggcuaagggcugagagaugacucagcagauaaagguauuuguccauaaaccacauguccuaaguucaauucaaucccuagaagcuacaugguaaaaggagggaacuccugaaagaugaaagauguccucuggccuaaacacacccaugcaagcacccaugcaagcacauauacuaaaaaacaaagcuaaacugggcaugauuauacuuaguacuugugagauugaguuuggaggaggauuagccuguacuacguaguaugaccuacccuaacucacaaaaaaacaaacaaacaaacaaaaacuaagagaaaaugaccuggggaagugauguggggggaaauauggucauacuaaagaauuuauuaagaagagaguuuuucuagccaucacuuccaaggaacccaauuccuagaggagagauuugucuuuccucauacagagacaauccuauacauuugaaugagucacaauaaucaguuuaauacaacaguccacuucauaagcaagcaaguuuucccacauucucuuuggacuucuuccucgucaaaaucuugcuuauucucuaaacuauuacuauaagacuggcaaaaaacauuauuucacugggcuggugacauggcuuaguuaaguaaaagcacuaguuacuacauaauuaauaacauguuacagauucccaggacccaaaugauagauggauaaaacuggcuuggacaaguuuuccacucaccucuaacacauauauccaacaacaaugaaaguaauaauuuuuuaaaguaauguuuaagaaaaaaaaaaaaacaaagcucucuuucacaucuuuuuguauuuuauuucaacucuccaaccaaaggcuguguucuaggguucauuagucaugaugacacaauuuguguaugaacuuuccagaaaucagucaaaggcacaggucuaaguaacugaagacuagaugacugaagaagaugauaguacuaaucauuuaauauuugauuucagggcauuuucacuucauauuauaucaauuuuucauuguaccaccacaacaucaguacauuauuuucaaucucuuuaacucuuaaaagauacugaggagguuacguuaggaguacggaguucaaggccaaucugaucaaauagugcgaccuuaucuaaaauaaaaacaaaaacauaaaaagcuaacagagaagaaaaaagcaaagagagauggaaguguggcuauguuacuuagacuaacuagucuugaacucaagggauucucuugucucagccacccaaguagcaggacuacaggugcaacugcaccugauuuaaaauauacuuuauuacuagacaugagggcucaugcuuuguaauacuagcacuuggaaggaugagaaagaaauaugaguuugaaacgugccugaauuauauacauacaaguuucaagguagcaugaacuacacacacacacacacacacacacacacacacacacaacuuuagaaucucaguuuacugucacuuuuacguagaauaucagggaucuaaguugccaaagguuuugacugcugccauuaguuuuguaaaugauuuaugacacuggauaaugaaguuacuuaaagcugcaauuuguugaaauucccauauauccuauguuucuguugacaagcuucuaauuuacuuaaguuuguugacucagagauaguaaucaguccuagcuaugacucuuaugcaaugagcuuaucugcaucuuaccuguaugcccugcaugucucugguuauaauucuaaaaguguacuuucuucagcuucugauuuuaucauucauucucauucuguaacuuguuucucuaugcccuuaccacauaggcaauggaagucuugugggaaagugcagggguuacuucucuuaccuugcuuuuuccuauaaagagccuccaacucaccucccacuucccaaagacuccucauuauuuucccuaauuccuaaucacuggcucuauucugaugcuucugucucuucucugaacugcuucuugaggccuuuaaaaaguacacacugcuagccuugagucaccagaaggaagggcagaagaaccuuccuagccgaguauuuuucugcaacaaauacuauagaaacuuuaaaaggcaaauaaggucuugaaggcuaacaaauaagcacauacgggucugagaaucauuaauaauagagauaggauaaaagaagcuaaaggaccacagaaaagaacuaaaggcugaauugcuaacugcugcugugaacucugugccacucugggaaugcccaccaauaaaaaaauauuaggaaggcaccaguuagguccuagccagagcuauaaugaagccaagcaccugcaaaucauauauguaagugaaaaggacacuggaauacaaaacaucccuuugaaggaaaaggaccaacgauucccugcccucucugaaaacaaaugggauucuagaaagaaaaugucuccagcucugaaacaagugcaaauacaggaaaaaucuugaaaacuaagagauuguagauccuuacccagaaauccagccucuugccagcagagaagaauuucagaacaauuaacaacugccuauggcccuugucacuugcuuuccagcuuuaagccuggaaguuucuagaaucucaccagaagccccauuuacagggaaggaauauauauuaaacucuuugugcaccccugguagguucugcuuuuacuuuauaagauuauauagauuauaauugggcccaaggcauuuccagagccauccuauauauaaucugacuucucaaaggaaaacaaacaccacuaaaguuuucuagcaacuuucugagauguuaauuuucaagcuagcaaacugguacacagggcuaaugcugagacaauuaauugugacucuuucuugagaaguauagaucucuauuuggauaugucuuauuuccugugacucucucuuagagaaacccauacccaugcucuuaguggaacaucuuuuuuuuuuuuuuucucucagacacucaugauucguuuucauuaaaauaucuuuaaggccaacaagaugggugaguuuuuaagacacuugccauauaagccagagcucauuccuagaacacacauaaaaguaaaaccaacaccacaaaguuuguucacugaccucuacaugcaugcaguggcauacgugcuuaugugcguguaugugcacacucacacacacuauuuuaaagaaauaacaauaaacucuuccauucugcuuauaucguucagcuaagcuuagaauucuuuucugcaucaaagcuaagagucccaguugaaccugagucaagauccuuuaaaggcuuaggggaacucugcugaggacaacaucauggagcaguguccucaacacugauuaauuucagaggaaacugaggcuauccaauguuccagugccucaggacaauugaacaaacuaaaggcccucucuuuccccuacaucaccauaucaagcaauucugaaagggacuggaaaaacaaaaucaaacaaauugaacuugugaacugacacuuaaccuuaaauauaucuuuaagaaaagaccacauaagaccagcagugguaguaccugccuguaacccuagaacuaugagauaggauuacgaauuggagaguaaccuaggcuacuaaugggacccugucucaaaaggaggguggagaaaagaggggaggggaagagucuggagggaagaagaaaaggggaaaaaccagcaaacuaggauugaagagaaacgccucaguagguaagaaugauuacuauucuccuuuagaugucccaaguuugguuccuggcacucaaauaggaaaaauugcuuguuaacuaaaauccaucagcuacuuuauugacugacaguucaguguacucaaccucaguucauuauucuaaagaaauuauuucauuuagaaaguccacaaggccucaacacuacaaaagaacuacaaguaacuaaggaauaccuaaaaguaggagaaauguuugucaggaaagaacacaccaacugguuauuuaauaacaaauggucaucccuaaaaacacacauacaaguaacacuauauagacuggauagguuauauuuaggaguguguguguguguguacauacauauaugcauuuaaaugaaaaaaaggcuaugaauuugaaagagcaagaagaagguguauaagagggauuggagggaguagugggaaagguaaauaauuuaacuauauuauaauuccaaaauuaauucuuaaaaagaaaaaaaaaucucauuaaaaacaguaaguaaaaaaggugggagcagcagauaacucaguggauaaaaauguuugcuaugcaaaccugguaaccugacucacacaauggaagaacugacuguccucuacaugugugucaugggacaugaaucccccagcacacaggucucccucuccccacuacaaagaaaauaaauucaauguacaaaguguuuuaaaauucagcuuuuauauucucuagcuagaaauuucucuguuuuuguuuguuuuuauaacaauuucauccuuuuagagaccucuuauuagccccagaugaaaaguuccagaccaauucacaauugaagcagugaaaaugucuucuauuaauuaaaacugaauguuuacaaauccaucucaaaaaauaauauuuaauccucaagucauccuaauuucuaugguauuauauauuugguaacaucugaagucuucuaaauuaagacuccacaugauaauuuuauauaucaaaauauggcugacaugccuggaauccuuugauuaaaaaaauuuaggucaauacucgaguccucccuccuuaucacugugcaccacaccaacuuaccaaaaaccugagcauacauuccauuuuuaaagaauaaguaccacuaacuuagguacuuauguuaggaauugugauaaaaauuaauuucagagguaauacaacagcagugugaaacuacugaaguacaaauuccaauuacuacauacagaaaauuuuagugaauccaucaggaauuuaaaacaaaucauaauuauauaagucuggaauauucucugaugaaguagcuuguauaauagcauaugauagaaauauuuguuuggguauuuuauucuuucuguuuuauguauguuugugucugaguguaugugcauauauauguauauaguauucauggagguaagaaaaggucgccaaaucucauagaauuacagauauuugaguugccaugugggugcuagaaacccaacccaguuucuuuaagagcacaaaguguucuuaaccacuaagacaucucucucuacagccccuggucccuaucuuauuauucuugauaucagaagaggcuuagggaguagguaaacaaccauuaagaggcaaaaugauucuuacaacuuaaaaaaaaaugcauauaaagauacaauauaaaaaucacuccugggcugaugagauuagcucaaugguuaagagcacugacugcucuuccaaagguccugaguucaaaucccagcaaccacaugguggcucacaaccauccguaacaaaaaucugaugcccucuccugaagugucugaagacagcuacaguguacacacauuaaauaaauaaguaaauaaauuaaaagaaaaaucacuccugggggaaggguaugggggacuuuugggauagcaugggaaauguaaaugaggaaaauaccuaauuuaaaaaaaaaaaaaaaaaaaaaaacaggaaaaaaaauacauuaaaaaaaaucacuccugacuuuguggccaaaccuagauuaaaaugcuggugcagauuuccuuauaaucuuccaaugcacuaucucuaaaauaaaacugggucuauuccauaggaaaaaaguuuacaauaguugaauuuuuuuucaauagguaaaauauaugauaaucacaggaacaagguacaaugucauuuauaucucauagaaucaucuaagaauuauuugaaaucauaccagagucuuuaauuuuuuuuaaauucucaauuaaaaauauauaaauauauucugguuuuguucuucugucagacccuucuuucuauagcuuauccuuauuuauacucauuuuacugcaacuggaagaaaacucuacuuuaaaagauaucacuuucucaaaacagauguauacuauacucauuuauauguucuauucacuaagcacccuccuccacuuaaaucucccaauuuggaccacagauuuauaagcaccuacacuguauuuaaaacuuggcuuacacaaagcuuuuaauuaauaaaaugugacagaaauauaaaauaguugaaugacaaaaaaaaacccacuauuucuauuuuaaaaacuacacacuauuuuuuuacuaaaugaccuacacuauccagaguaaaacaauacccuagaugucauaaauuuaaaaguggugguggugguguauguuuaacugaaauagcugagaucaaugugaaagcaacuaacugaaagggcuguaccuuuaguuaucucauguagggccuagcacuacuacuguagcuuucuaaagaaagcaguuaagcugagaaagggaccaaggagaaaguuaagucagaugcagaucaaauggaaauuuucuuaaucaucaaauaccaaaauuuuuucuuagggaguggggagucaucaaaggagaagccaauagaacaaaacucauugaagaacuagcacuaaaccugaaagucauacaaaaaaagugucagcacaagagaggaauauguuggugguugugguagauauugcaaagcuaaugagauucucaaugaauuugaugacccugauauccaaaacuucuuucuuuuauuugguuuguuuuuuuuuuugggggggggggagaagauaucaaaucuggggcauaaacacaauuuguuagguuucagaggcaugaugaagcucugacuuaaggaaacaggccagauaagauaggacucagagcccuuggguaguauauaccagugaucccagcauuaaguaggaugagcugaggaaagaguucaaggcacuccaaaaaaagucaggcauagaaccaaaaauaaagauauauucacaaacaaaaaaaggcugcuacaaguaggcagaaaacgauuuuuuaacaaaauagcucaaaaacaauaaucaggcaacaacaaaaaccaccaccaccaccaccaccuucccagaaaaauaaaacaaaaaauaaguagaucuccaauucaaauucuucucaaagaaaaaacacauauuuacaagagucuauuuaccaaaccuggacggauggcaagaaaauaguuaaaacaaacaaacuguaaugaaaagaggauuaaguugaguuuccaaaagagaacgaaauaccuccuuucucuaugcacagguagagaucuaagaacaacauucugaguuguuccucacaagcuguauguaccuaucaccaccaccaccaucauuauuuugagacaagaucucucauuagucuggaaagagucaaauaaauaauugguauggcuggcuucuagugagucccaccaccuacuugucuuccccaccccaucacuggcauuacaagcaugcacaccucaccuggcuuuuacuuuaaaaacaaaacaaaaaaaacuaaacuaaacaaaaacauggguucugaggaucauacucaggccauaaaguacuuuacagccugagcuaucucccuagccugggaacagaauguaaagaaggaaaagugaaauuacagaacccuacagaaaauuagauuuuaaaaguacuuucauauguaaauacacucaaaaguuuaucauauaugcaucucuuucucuuaucagcaagacagcagauacauuaauauuguaagaauuacauuuaauaaauaucuauaaauauuaaauauauuuaacaaaauauuuuuuauaauguuaaagaaggguucaggaacaaaucugcaaagggggagacaaaaacaacaaaagaccaugugugcagcaaacuacuguguaguucagguuuaggagggcacaaaagccugcaaaaaucccaaagaaauuggauaugguaugaaagacauuaaaaaugagggagaaaaaaaaugagguaauuugaaccaaauaaaucagaaagucuugugucauuuuagcauaccaggcauuuuugcuuuuucuguauucuggagucccuuucugcagaaugauauauuaaaaacugcuucauacucauuagucucuugaauuuguuauuaaacagugaggcucuuacuucccagagugcugggaauugaacuugguggguccuuucaagaucuggccucuauauguaggcaugcaugcacgcacgcacaugcaagcagcacaaauacaauacaaugugauugagagaaaaaugaaaaauauaaaagagaaaucaaagccaggaauagugauauacaucuguaaaaccagcacuuagaagguugacucaagggccagugagauggcuaaggcacuauagaagcuugccaccaaagcugacaaccugaguucaauccagggaacacauggugaaaacagaaaacugacucucccaaguuuuccucucaucucuauacaagcacugugguauccauaagcucacacacaugcaugggagaaaauagagagugugagggaaugggggaaaaggggaaagagugagagagggaggggagagaagaaauaaaucccggagucaggaguauuaagaauucaauacuauacaaaagugaguucaaaaccagucuaggccacaggagacccuguuccaaaaauuaggggggggggggagguuaacuaauaaauaaaaggagguacaaaguccaaagugauucucagaaauuuguucucguaaaucaggcacucaggaauuugauagacugguacaagagaaagagucaaaacagggugguugaguaaaaugaagaaauggggucaacaagaugucuuggcagauguuuuguuguuugccaggucugcauggcaaauuccaggcuagucaggauauacaagaaacaugucucaaaaaacaaaaauaccuauaucccuaaagucuuuuuaaagauaaaggauacugaaacaauucaaugugagaagaagaaaaaaaagaccuuuaaaccuuuggguuacccccuuuuuuuuuaaauuuagggguggggguacacaggagauaguuaagacaggguacuacacuaccaaaaaauugaaaacacaacccaaaaagcaaccaaaaaaaagguugcuaaaaccaucucugaaaaaagauuuguaugaucuauauugaaaacuuuuuuuguuucguuuucuuuucuuuuucgagacaggguuucucuguauagcccuggcuguccuggaacucacuuuuguagaccaggcuggccucgaacucagaaauucaccugccucugugccaccaccgcccggcauuaugcauguuuuaaagaggcuaagcauauuuaucuuuucaaacaucauuuuaagauccuuacagcuuuuuugagaugaauauacauuauuguuaucucuagucacccaguguaaauugaauagcaucucagaacuucuuacacccaugcaacugguacuuagugucauugaaaacuucuucuaguuuuugauuauuuuauaccaugaaauggcugcaaaguaauaccuuauugugauuuugguuuguaauugucucauaauuaauaacaucagauaucuucuaaugaccauuguagaucuuuucagucccauugcccauauuuuaauuuggacuaccugugguuuuauuauaguuauaaaaguguucaagccaggcagugguggcgcacgccuuuagucccagcacaugggaggcugaaacaaguggauuucugaguucgaggccagccuggucuacaaagugaguuccaggacagacggggcuauacagagaaacccugucucggaaaaacaaacaaacauacaugcauaauguauuaaaacauuaaguacucuaauauauauauacacacacacacacauauauaauuuuucuauuccuaguuaguugaagaaacaaagucuaaagcugagaaaauuaggagaaccaacaaguccccucuuauaauuuuauagacuuuccaucucauccaacuuuaguaugaaauacuaaaaauagcuagaauuuugguaacuugauuacucuaaaaccacaggggggaaaauuuauauuaacuuuauuaaucaacucagaguuacugugagacccuaugaaguuuuauugucuacauuuagagaacuguuuuucugugcucuauuacuacuuauuuuauuucuuagguauguaaggaugaaguaucuugucuuuuuaaacuaacagcagccacccugguuaagcaguucauauguaguccauuuaagaugggagaugaggaaaaacggcaauaaggguauccaauuccaaauugucuuuuuuguauguguacauggauguggugguauaugagggucugugugaacaugcauguggaaauacaauagguaucacuuucauuuucccagaaaaucucuuacaaaaucuagaauucacaaauucaguuagacugccuggucaaugagcccucaggauuuuguuuccauuuccugagcacuaauaagauaacacugcugaaccaggcuucuacaugagugcaggcuaucaacaaacucagguccucaugauuguaugguaagcauuuaccaggcagaucuaggcuauacuuccaaauuguauuuuaguguucauuauaccugauaagaauuccauaagcuucagaaaacaaagugagccucagaaagguucacaugguuuuucaaaauauaguaugaguagacaugugcaugaacauaugaagaaacagaaucaagagugcugggauuaaaggcgugggcuaccacacccggcuuuauuuuuauucuuuuucuucauuuuuuuuucauauauguguguguguguguguuuguguguguguguguguguauguauguauauauguauguguguguguguguguguguguguguguguguauauauauauauauauauauauauauaaaaaugguucuugguuuuguguuuuaauggaauuuaugugugcaaacaugugucuuugaauguguuugugcuuuuccuuggguucuuuuucuccugguuauuugcuucauccuauucugauuuauuagguuuuguuuuaucuuuuuaaaaugccuguuuguauucuaaugagaaaaagaaaggguguggacucaugcagcgaauuuucucuuuaagaaaacuuuuugugggcuggaaaaaugccuggaaaaacagcacugucugcucuucaagagguccuguguucaauucucagcaaccacauaauggcucacaaccaucuguaaugcgauucaauguccuauucuggugucuaaagagaucuacaguguaaauaaauaaauaaaucuuuaaaaaaaaaagaaaagaaagauuucauuaauaugcucucuccuauuugaggugguggggauggggaagcuuggcuggauuaguaauaauuuuuagguacuacaaaaacaaguaagaaaguuccuuuucauagggaauuaauagggaaaauaaguaaguauaaauucaccucaccuaagguacucuuguauagauccuggguaauuaagacugcuaagugaauggugcauguuuuaaauacauaauaacaaaucacuguuguauuaaaauauauuuuuaaaaaagacaaaaaugcuaaaggcagcaaacagaugagaagaaaacuaucaggaaaugacuuagcaaucgcauuaauuaauguuuaaauacuuuaagggauacauccuguaagcuagaaguuuauuuucuuucuucaauauuuuuuuacuaaguaaaucauuuauaauaaauaucugaagaaauaaagcagcuucccauuuuaagggaggcagguuacacacaaucuuuuuuuuuaauuuaaauaaaaauaaaaucuuuuagccaggcaugauggugaaugccuuuaaucccagcucuaggagauaaauggcucugugugauuccaagcaagcuagggcuuuauagugaguacuuuucucaaacaaacaggcuagagaguugguacuacuguuaaaaagcagauucuuccagaaggccuggguucaauucccaggacccacaugguaucucacaauuauccaaaacuuuaguucuggggaccucuucugaccucugcaggcaucuagcaugccugcauaaacacacacacacacacaccccaaaauuaaacuuaauaguaugcucaaauaaaaauuuccuagagaaauucauaacaaagagagccaaaagauuaaaagaaaaaaauaacucaccuaggagaaaaaaaaaaaaaauagcugucccaaaacagaaaucaaggacaagaaauaaauugaagaaaauucucagaauugauggccauuguuuacagacacuaagagccaugaaaaaaaaaaaauaagacuuacaccacagcacauuacaguaguguauuucaaaauacaagaaaaaaagaaacuuugaaaacuuucaguaaugggagauagcaaagaaauagcaaaguguccuaccagcauccaacaauaauacaaaaacuaaaauaaagcauuccuuuaaaaucuacaagaaccauuuccaaucuaaauauaauauccaaacuaccaauuacagagauagaagaaugaaaagcuauuggcuucaaaccguaucuuccaaauaaugcacugauuaggguuuuuugucaacuugauacaaguugaagucaucuggaaagagagaaucucaauugagaaaauagcuguaggcaagucuuuugagacauuuucuugaugaaggagcccagcacacugugagugaugccaaaucuggccaggaguuccuagggguauauaagaaagcaaauguagcuggcaguggaagcauacacguuuaaucccugcacuuguaaggcagaggcagaaaauguggucuacagagugaauuccaggacaagagggccuacacccaaaacccugccuugaaaaacaagggaggggaaggggaagggaaaggggaaggaaaagaagcaaacaaacaaauaaaauacuuguacaaaggaggaaaucaaaaaagacuaagaaaugggagucuggaaccaggcuguaauagcaugcagagauagaagaaauacccaaauuaagacccuaaccuagacaacaacuuagaaaaucaccagcacaaauugaagauuagaaagucucuaaaacagauuaacuccaaaauggaaaaacaucuacacauuuuaauacagugacaggugauuagaguuuuagaaaauauuaauaaacagcuuaacuaugaugauuucaugaauauauguguguauguauguauguaaauuugccacuauacacuuuacugaauuaucaugucuuauauuuuuuuaaauaaaaaaggauuaucauauuugggcaguggcggcccaugccuuuagucccagcacuucggagacagagauaagaauucauugcuagccuggucuuucagaaacucaaguccaaaaaguugcugauaaauuuuagugucacuaucuuguuauagcuaaagaguacucugccuauuaauaaagauuaaauucaaaguaaaaguaaaaaccuaacagauugggacuggagagauagcucaucuuugggaacauguucuacucuugaaagguauccacuuccaggacccacaucaauguuucauaaccaccuguuacucaaguucuacaugauuugaugcccucuucugucugucaauacugcauauguaugcacaacccucuuccuaucuaaccauacacacuaauuaaaacuaaaaucuuuaaaauaaaaauagauaacuaucuaagauauagcaaaguuagaaaaaccuugccuagcauccacccccuaauuuggagcuccaguacuauauaagccagugcaugcagaaguggggaguugggggguggaauucgcugcauaucaagaauucaaggccauucucugcaaggccagagcugcaugagauccucccugucuuaaagaaaaaacaagaauaaagaacuuuacaaggacccaacuuuagcuguuacauaaaaccauaaucaucugucccuaagaaugaaauagaugguuuguuacaauuaaauaugacaaaaacuaaaauucauauagccaauaauuuuuauuuuguagaaaauacuuauaguuuaaauaauuauuauuuaaaaaacaauaugcagcuucaggcuaaggcaaaggaccaaaaguauaguagcuacuccaaagacuaaggccaaagaauuacaaauucaagucuagcuggaaacuaaugagacccugucucaaacuaaaacaaaaaaggaacugauauaccucaaugauaaaguauuugccuagcauguguaagguacuggguuuaauauucaguacaaaacaaaacaaacaaacaaaaaacaauuuuuacccuaaauguuuuucugaauaaucuauaaauagugccaucuuuguuaugaaagguuagacuuuuauaugugcgcuuaucgucaaaguguuacuuagaauacuugaauacuucucagucauaaaaguuuuuuaacuuuuauagcucaacuauagcaagccauaauauacaccuaaauauccggaaaaaagucacagaacuaagacugaaucaagaauuagaaguguauuuaagacaaagcccuaaaguugguuggaucuuuacuaacaaugcaucauucuucuauaguuuacauaugagccaaaucuccuaaaauaaguuaaauuaggcuguaaaaaacuacauuagcauuuaggucugagugaggucagaaugagucucuuauuuuggguucuaauaucuaaaacacauugcacccuaguacaugugaccacuuucccaagaacuaguauaccagauuaaugaccaugccagccaucccauuaaaagcuuuuucuagcuaguuacuugguacuuagcuuuuuuauggcacuuuucuuuucacauuaugcucaguagugcaugcagcacacuucauuuaggaaugcaacacacuuguuuagaaaugcauagccaugguuguaauauaacugaaaaucuccuuucuuauauuaccuaaauuuagaagcaaaguacuacaaaauggaguugaaucguuuugcauuuuuguuaucuguauuaucuuacuauaaauuaagcuuucauuaaaaaaguaacaucuuagaauauacaaaagaccuuauucccaucaccuaauaaauuuuugcuaauaacuaaaucaauaaaaacacacaaaagagcuggagagauggcucagaguuugagaaaacugacuguucuuccagagguccugaguucaaaucccagcaaccacaugguggcucacaaccaucuguagugagaucugaugcccucuuccagugugucugaaaacagcuacaguguacucauauauaauaaauaaauaaaucuuuaaaaaaaacacacacacaaaaauuaaaaguuaaaauuggauuugcuaguagaucauugugacacacaccuauaagccccacagccaggaagccaggccaaccuggccguucaaaaacaaccuugauuacacagugaaauucugucucaaaaaaucaaauuauaaacaagagccaagaaagccugguucuccccaaccagugcugccucauuuuguaccucccaggacaugaugagcaacaagauuuuacuucuguacuguuugauggguuuuuuuuuuuguacggaagaaucugcuuagcaacuucugaacgaauucuuccucugcauccacacaugaguaucaggugaaaugagugccaguugaacagaugcuuuucucagugagccuggcuguacugaucuacuuucagaagacaugacagaaugguuuauuugggugcucuuguugcccacuuuagcauaaguguagcucugugaaccaaauuguaugcuugaccuucagcauuucucuagaacacuagaaguuacuucauugcccaccagcgaauaaagugaugagauuuuaaaaaaaaaaaucaaauuaauacacaaaauugaguuagaaaaagauucucucuauauaaagaacaaaaacaaguauugcaaacauagugcaguucauaaguacuguacaaucaaagauguacuacuacuaucccccucuuuuccaguacucaugauaaacuuaugguacugcaugaaaagaaaccacccuccaaaguguucaauuaguucuauagacauuauccguucacuuuuaagcaguucuaucaaugacuaucaacaaaaaucacaaacagaauauucagcaauggcacugaauauuguaauggcucuuauaaugcgucaaacugguaaaguauggauaauuugcaaaaaaaaaaaaaaaaaaguacaagcaagagaaaagggucgcuaacuugaguaucuaaguccuuuaucucuaaaacaagauaaaacauccuaguuuucuuucaagcuugucauaugcagucaaagagacuuuaaauguuaguauugugugugcaugcaugauguguauuugaacacauguaccaugguuuucaugauggggccagaagauaacuguaauggcaggucucuccuaccaccuuugcauggguuccagugacagcagucagguugccaggcugugcaguaagugucacugagccauuugcuuaccuaagacauuuuuaaguacacuacuuuucaucuuaaguucaauuuacagaaaugcuguuuguguuuauauuaaacucacacuaacauaccuaagaauucuaaaugagaacagaaaauccucuuauaucaaaauuaaaggcuaccaaagguucacucacacauuuuucugaaauauaauuaagcugagguuguggcacaagacaauaauuaacccuagcauuugggagguaaaggaagggggaauaggaauucaaggcuaaccucugcuaugagacaccaccucaaaauuaagcaaaaaaaaaucuucucaaaaaaaaaaaaaaaaaaguauugauuccugggcagcaggucagugauagaacacuugccuaauaugcacaaggcccuguguucaauuuccagcaaaacacacacacacacacacacacacacacacacacacacaaucacacaccuauuuucuaguuguggucuugguaaauuauuuaauuucacacacaccaaacguauugagucauaucaccugaauuacuuuuagccauaguuagcucuaucucaagauucaugauucaugauuauucuaaaguaaaacaaggacuuaacugauaaaaauguaacuuuucaaaaauaaaaagcuaaaaacccacaaaugcugacauaaaccgggaacugacccucauaaaugcuaagcaagcacucuacccuugagcuauaaaaguaaaacuagaaguaauacuacauuccauucuggaaugagaauaacacaggcacauaauucucaauaaaccacagacuagcaguaauuaaaggcccaggaggucauuuaguccaaucuuuuaucuuugaaguuccugaauaccuacccuguaugaccaggucuuuguaaacacuagucaacaauuaugacucagaguuuucuaguuuaauuucacauuccuauucacagauccucauuuuuuuuuuaaccagccucuucugauuccuuguaaaaucauucauaugugauauagcucuccaaaauacugcucaguuacaaaugccauacaaacuaagagcacacugaaaccuaauuucagcuucacaaauuuaaaauauaacaacaaauugaauacugaaaaaccacuucaaucuuuaguccauaaacaaauugaacuauuaguuuuaauguauacuaacaagguaauucuaaaguuaagaggauucucaaccucuuaacuuuauacuggaaagaauggaaagaaagguaaaaaaaauaagaaaauaaaaauauaaaagaucugggcucaauucccaguccuauuauuugcuaguuguagucuugauaaauuauuuaauuucaguuucuuuaucucuaaaaugacauugacuccaaauaaacaaauacgauucuuuuuuaaaaagcuauauuuccgucauaaccugaauaagacucuauuugugauagaaaauaacauaauaaucuagguuagauaggaaaugagauaaauuguguauauccauaaggaacuaugcuguauguaacuguucaaaauguuuacaguaacucuugggccagugaaagaacaauaucaaccaugccuggcaaccagaguucaaucucacaugguuuaaggagagaaccaccaauuccugccaguugucagauguuacagacuuccaaacacaugcucuggcaugugcccaauauguauauguauagauaagaaagugaaaaaccacacuaaaccuucuccaccucuaagcuuagucaauacacaaaacuaaacuuccucaaauauuuuucccucuaacuuucuuuugagaaagggacucacuagaaaucacuuuuagaucaggcuggccuugaacucagagcaguccuucuaucucugccucuagagugcugggauuacaugugcuuguuuaucaaucauacccagcaguuuguuuuguugaggcaggggucuccuuauguagcccuagcuggccuggaacuuaauauguaaaccagacuggcaucaaacugacaaagauccauuugccuuuuuccugaaugcugagauuaaagguguguaccaccaggccagauccaacaauacagugucaauguuauuuuuuaaguauuuaaauacuuggcuuuuacaaaauuuucugagaagggcaggagagaugguuugguguuuaaacaaacaccuggcuauuuuuccagccaacccaaguugucacauggcagcucacaaccauuuuuuaaaaaacuccaguccugggggauccacugcccucuucagaggaucaauacccucucuucugaccuccaagggcaccaagcauauacaugaugcagacauauaugcaagugauaugcccauacacauuaagaaagaaaaaaaauuaucugagaagcagcgaggauucuugcaucucugaacaaauguuaacaaguagaaaacaaaaauaaauuuggcaguuuaaucaagaaugacuuaaaacuuuguucaaaaugauaauauaguaacugauaaacuucuuaaagucuuaacuaaauauuuccauuuguagaccaaacaucccaagaucucuaagaauuuagaaauaauacacacuuggauaagaacucaacuguaaauuuuagcuucaugaccaaaauuuuaguuauaaaggcugauaccuaccaaaugcuaggauugaagccaugcaccaccacaccaccagggcaagcacucuacaaauuauauauccagcccagggaaauuauuuuucuaauaaaucaagaaaaauaaaagggcugggcagugguggugcgcaccuuuaaucccagcacuccggaggcagaggcaggcagauuucugaguucaagaucuggacugagcucugggguccccaaugaaggaguugaagaagggacugaaggagcugaggggguuuguagccccauggagggagcaacagugucaacaggccagacuccuccaaggucccagggacugcaccaccaaccaaagaguacaaccaagagcaacucauggucccggccacauaugugggagaagauggcuuuguuggauaccaguuaggcucuugggccugaggguguacgaugccccaguguaggaaaaugccauugugggaggaugggagugagaguggggggugaggagcacccucagaggcaaggggagagggaugguauaggggguucccagaaagggagaccuggaaagggaaaaacauuugaaauguaaauaaagaaaauauccaaucaaaaaacuaaccaaacaaacaaaaaacaaaaaacaaauggauauaagaagaguaggcucacagccugacugacaaaguaacaguugcuuuaaacaagaaaaaaauacauccagcuucauucucuucuucucaucuugcagggguccugauccuaccuguucccagccaauacccuaccauaaggaacccucccaagagcccuccuuuuccugggaugacguccauagaacuugaaccuggaaugaggcuucgaaugagaggccacauaccaaaaauauccauuacuccaauggugagaccucccaguaaccccaugauagugcccaaucagacugggaugacuuagcuagcuagacaggcaaaaacaguuuuguuucuauuucauuggagauugcagugcugcaccugaccugaaugcucucuaaugccuagaagcaagagagacucaaguagcugggcgugguggcgcaggccuuuaaucccagcacucgggaggcagaggcaggaggauuucugaguucgagaccagccuggucuacaguuccaggccagccagggcuacacagaggaaacccugucucgaaaaaccaaaaagaaaaaaaaaaaagaaagacucaaguaaugcaaacccaaaugcuaagucaugaaauuuacucauaccuauuuuccuuuaaaacacuaaaacuaguucuaacaaaauuaacaauuccacugccuaguacagagaauaucagaaguguugguaaggauauugaagauacugaagccaggcauuaagcacucauaauucuagcaccaaggagggcaaagcaagaaauuaugaguucaaggucagcuugggcuacauaaagagcuacuguuuuaaaagcaaaacaaauauuuaaugacaaaaucuuucuacuuugaaggcaaaacuuuaguuacaugaaguuacugaaaguaaaggaauauccuguuuccacaaaauaaucucacaaugacugucagaaauauuucucuuuaaacacuuaagccugacagaguauuuucaacaauaaccaauaucuauaauaucuaaaaauuuauaagcacauuaaauuaguaaaauaaaccuucuaucaucuaaauguaaacauugccuaaaaggcuauuuaaauggagauuuguuucaggaagaaguauaacaugugugaccuuaaaaauaauugcuaaauggaauaagauuuagaauuccaguagauucaaacugauuucuuccacaaaguacuuucuaguagaaagaacaagaacuaagauauaagaucucauuauguaccccggcuagccuggaauucagagaucuaccugucucugccucccuagugcugggauuauaggcagugccagcaaacccugagcaugucaguggucuuaaacaagcgguuaaaccugaauuuguuuccucaaauauaaaagucaaaaaacuauacuaucugcccuguagugcagcugugaaguuacaaauaauuuauacagugguguuaggcaagcaaguaacugucaguaauuuuuaauuaccuuuccucaguaauuauaaagaauucaccuugcaagcacucuuaaauauaaagccuaaaguacuacauguguguagaguauuuaaacuuuuguuuaaaaauaaaaaacaaaauacuaaaacaauaauucaaaacuuucuguauaacagaauuuacuuaaaaucuugcuauuuuaaaugagcuggucagauggcucagugguaaaaguaccugacaacccaaaguuccaccucuggaacccuuaaugaaagaaaagaacuauccuaaaagcugcccucugaaggacacagaugcacugaagcacauaugcuccuauacauuugugaaagucaagggacaacuuucaggauuccauuuucuccuuccacuaucugagucccuggaaucaaacucaggucaacagacuugguggcaagcagcguuacuugcugagccaucuuacaaacugucaauuauuuauuuuuauuauuuuaaguauauauauauguauauauauauacuuauauauauauauauauauaugucuuuguguggaauguucauaaauaaccucaaaaggacaaaauaaaaaugacacuguauggggcuggagagauggcucagagguuaagagcaccgacugcucuuccagagguccugaguucaauucccagcaaccacaugguggcucacaaccaucuguaaugggaucugaugcccucuucugaugugucugaagauagcaacaguauauucauauacauauaaauaaaauaaaucuuuuuuaaaaaaaaagacacuguauaaucauaccuaauauuuauggaccaaguuugagcuacuuuguuugaggcagagucucacucuagcccaggcuagacucuuuuuuuuguuguuguuuuuuguuuguuuuuuucguuuuuucgagacaggguuucucuacauagcccugguuguccuggaacucacucuguagaccaggcuggccucgaacucagaaaucugccugccucugccucccaagugcugggauuaaaggcgcaggcuggacucuuaacucacagcaaucuuccugccucagccucccaagugcuggaaauuacagguauuagcuaccacaccuggcuaaagcagguuuucuuuauacuggcuguacaaauacaauaauuaacauagaauuuggccaaggcaaggagaaucacguagcagagaaaugaauacuggcaaccuaggcuuuguuuuuguuuuugagacaggguuuugaccaggcaggccuugaacucagaggucugucuaccuuccucuauaucuagaauuaaaggcguuugaaaccacuguccugcuggcaaccuaguuuuaauuuuguucacuugacaauuuggccucuucaaaccaaaacuaagaucauacuaagcuucaccucuuccuuuccuucuuccuuuuuuuguguauuuugguuuuucaagacaggguuuuucugggaaccaaagcuguccuggaacucacucugcagaccagacucaaacucagagagauaugccugccucugcugggauuaaaggugugugcugccaccaucuaguaccucaucuauuucuauaagaccagauauuucccauguuuaaaaaauagcaauuaaggaggcuggugaggugacucagcggguaagaggacugacugcgcuuucaaagguccugaggucaaauccuagcaaccacaugguagcugacaaaccacccagccgaccggagggagcagagguacuaaauucaauucccaacaaccagaugaagguucacaacuaucuguacagcuacaguguguacucauauacauaaauaaauaaaucuuuuaaaaauagcaauuaaaauucaaguuacugaaaauauauuaauauaaaaaauaauaaagcugaauaugguggcauacaccuuuaaccccaacacagagacugguagaucccugugaguuccagcccagccuguucuauaaagggaguuccaggacaacuaggguuaucacagagaugcugucucaaaaaaacaaaaacaaaaaaacugacauaccaaaaaucuacuaagcaguagugauuauuauuucaaguauuuucagaaauuauuucauuucuucugccaucaguauuaucuaaaacauugguucucaaucuuuccaacacaagccuuuaauguaguuccuuaugauaaccaaccauaaaauuauuuucauugcuacuucauaauuguaauuuugcuacuguuaugaauuauaauauaaauaugauauugagaaccacugaucuaaaagaaaaaaauuaaagcuaccagaaaucucaaauaacacgauuuaaauucugaauacagaagcccaguuguggaaguaccaaaguaugaauuaggguaaauuucacaugaccaggaucuugcacuugaauuuuuuuaagcucuuuuuuuauuuauuuuuuauuuuuuuaauuuuuuaaauauuuauuuacuuacuauauguaaguacacuguagcugucuucagacacuccagaagagagcaucagauuuuguuacagaugguugugagccaccaugugguugcugggauuugaacucaggaccuuuggaagagcagucugcgcucuuaaccgcugagccaucucaccugcccgcacuugaauuuuuaaugugaacaaaugaaaucagucaccagguuaacauuauagccucacuugucuuuuauauaauauaaucucuuuccaaguucauagacuaggaauaacuauguuaaucugggucagaauaaaaggaaaauacagaaaaaugacaaauuuaaauucuugagacugugaaaaagaaccauuuuaagaagucaacuaauuacaauucucuagaacaguuauuuccuacaacauuaaguauguauuuuagggauuguuuuguuuagaacaguguaucuguaauucuguagccaggcuaauccuaaacuuguauuagaccuuacuauuucagccuccuaaaaaauauauugcuugcauucaaauccaggcucugcuaaaugauugcagcuaggauuacagguuugcaccaccaugccaaguuaacauacaucuuaaauccaaucuuaccuagcaaaaaucauauuguuucuaauuguuucugaguuugagcagccuaagcuauacagugaguucuaggucagccucaggcacaaaguaagcccuuaucucaaaauuaaaaaccaaaacaaucaaaugauucaguucaaugaguuaaagcuagcaaaaagaauaaauugccaggcagugguggcccauugccuuuuaaucucagcacuugggaggcagaggcaggcggacuucugaguucgaggccagccuggucuacagagugaguuccaggacagccaaggcuacacagagaaacccugucucaaaaaaaaaaaaaaaaacaaaaauaauuauuauuauagauauauuauaguacauaaacaauaaauauauuuaggccagagcgagccuucauucccagcaaccacaugauggcucacaacuaucauacauaaaucuuuaaaaaaaaacaaaaaaaaacaaaaaccacccaaaaagucauguaguuaggaacucaaaccauaacuuuaagauauaggcauuaaauggacuggaguguaaacaaaaauuacaacuuuuacuucucuuuuuagguaaagcugaaaaaacacaucaucaguauauagagcuucaaggaaauucacuauuuagagacaacuuaugagaaaaaugucagaaauaaguaaauuaccaggucuacguuuguuuuuguaaagcaaacuacaugcuuuccuaauaagcacgcucccacaaacugucccagccuccaaaguguaaacucuacaaaacucccuagaaacauguuuccaccagcacagcugacugaauuaaagugcuuuuuugccuaauagauccugauaaaagaauuaagaguuuuaagacuucuguuauuacuuaagacugguaucgagccgggcgguaguggcacacuccuuuaaucccagcacuugggaggcagaggcaggcagauuucugaguucgaggcuagccuggucuacaaagugaguuccaggacagccagagcuacacagagaaacccugucuggaaaaaaaaaaaaaaaaaagacuguaaagacugugguaucaaaauauuaccuauuuauuauugaaaacaauuugguagauagcuacacauacugugacucuaaaaauaaccuaacaauaggaaguuuaauuuguacaccccacgcauucauccuccaaagucuagauccccauaugaagugauaaaaauuaaauuugucauuuauuagagaacuuuagaaauccugacagccacuucuacacagaauuaguauaacuucauuugaaauuaguauuacuaauuagcuaucuacugagacuacaaauguaguuugggguuuuguuuuuguuuuuguuuuauuugaucaguuguuuuuagguuucucuguguagucuuggauuuucuggaaacucacuauguagaccaggcuggcuucaaauucaaaagaucagccugugacugccucccaagugcuggaacuaaaggcauguaccacgacagccuggccuuucuaaaaaacaaaaauuuaaauucuucuugauucuucagaguguuaacauguauacacaaauauauccaccaccauuucuccccuccaaguccuuuuauaugcccccaacacauacuccucaacucuuugacucuuuaaaaauagccuacuaaauccaauuuguuguugcauggauuugugacugcccaugagaaaccuaccaguugggaacaacaugauaaaagauaaugauucucccucucagagaagcuacaacugccaaagacuccuuaagaugggauaggcccugaagagcauaucuaugccagaaauuuggcuggcaaguuuuauuuuaguaaccacaguuguuuccuuuaccuuuucuggacugaacccagaacuuuguagcuauuaaacaaauauucuaacacugcacuaaaguacucuaccauugaacuguauccccagcucucuucucuuucugacucuaguuuugaguuaaggucucauuuuguuguucaggcugaccuaaaauuuacucuguagccuagacaggccuugaaccugugaucuuacuguuucagccucauugaauaacuaaaauuauaggccucugcuaccaggucuaauuuguaauugccuucaauaccuuccaaauugcuauaucauaacuauuuuaauguuuguaauuucuuaaccaaagcuaaauuacuuaaugcccuaugauuucagguccuuauuuaacaaacaaguaggugggagagauagccugauuuuauccaauuuugcaucuauuuauguagguacacaugugccacagcaagagugcaggggucagaaaacaacuuucacaaguuggcucucuccuuccacaaugugggugcuauauugaacaucaggcuuaguggcagggguccuuaccuaaugagcuauuauuucccaaaacccuucuaguuuuaauacacuaaaaauuuuaaagcuaagcaugguaguacaugcuuaaaaucacacugcuagggagauaaugucaaagggguacuuuuuuuccuuuucuuuucaaagcuuuacuuauccuuagguuugaccuuuaauuugaacccaaauauuuugaucuaaaacaaaaugauaugggcuggaaugauauggcucagcaguuaagaacacugacagcucuuuccagaaguccugaguucaauucccaacaaccacaugguggcucacaaccaucuguaaugggaucugaugcccucuucuggugugucugaagacagaaacagugcacucauacacauaaaauaaauaagucuuuaaaaauaaauaaauaaaaauaaaaaguaaaagcacacauuuauaaaaagccacaugguggcucacaaccaucuguaaugaaaucugacacccucuucuggagugucugaagacagcaacaguguacuuauauauaauaaauaaauaaaucuuaaauaaauagauaauuaaauaaaacaaauguaauugaagaauugaauuccuggaucaguaauagauccuugguacaaaaauuccuauaaaucaguuucaucuaaauuauugaguaugacugcccaguaggaggagaggcauauuuugacaaguuuaccaaacaaacaaacaaacaaacaaugaagguaaguuugucuggcaugguccuguaauaccaauacuccaaaagcuacagcagaagaaucauggauucaaggccagcuuggaguacacaaugagucuucacaauauaggguaagggaaaaaaaaagccaucucaaaaaacaaaauaaaccuacuaaaaguaauuuuguuuguuuuuuuguuuuuugagacaggguuucucuguauagcccuggcuguccuggaacucacucuguagaccaggcuggccuagaacucagaaauccaccugccucugcuucccaagugcugggauuaaaggcgugugccaccacacccggcuaaaaguaauuuuuaaaaaauaccugucacggccaggcagugguggcacacgccuuuaauuccagcacuugggaggcagaggcaggcggauuucugaguucgaggccagccuggucuacagagugaguuccaggacagccaggcuauacagagaaacccuguuuugaaaaaaaccaaaauauuaaauaaauaaauaaauaaauaaauaaauauuugucacauuuccaacucuuaucaguuauaaaauuaacaagggguaauuuuuuuuuugguuauuuuacuucauuaaugugcuuagaaguuccauuuuaaguguugaacucaaggaauuauguucaagaacuugccaguuucauguuugcuuccacaugcugaguuaacguucuuucacauuuuuaaaauaaaaacaaaacgaacacucauuuccaauggugaaaauaaauuucaagcauauagagaaguggaagagaaagcuuaaucgacuaucuuuaagugaacaaucauaugcugauaauuguugaagcuggguaauugcucaccuucacuagauauuuagaagcaaacuccauuuuuuuuuuuuucugagacaggguuucucuguauaauccuggcuguccuagaacucacuuuguagaccaggcuggccuccaacucagaaauccgccugccucugccucccgagugucgggauuaaaggcaugcaccaccacauagaagcaaauuccaaacauuauuccuuucacauuucaaaugaccuugggacauuuggaaaccaagcuguuuauuaauucuuggguaaaucaaguucugagauuauuucaguuacuuuccaauccuauuucaguuugguccauuuucuugacaagaaaucaguaguggcacuuucaucuaugauguagcugaaauucugcuuccaccacaaauacaugcucauuucuggaugugaacaagugcuaacaaaccaauauuuauauagaugcuuuauaauaacauuuauuuaucgcuauaauauauauuauauuauauuauauuauauuauauuauuuauauaaauauaaauuuauauaauaaauauaauaacauuuauuuauugcuauaauucaagcaauuaguaguccaaacuaaucuagcauauaccugcacuuuauuuauaaccugaaaauuucccugagauuaaaaaaaaaaaggaaggaaggaagaaagcacuguaaucccucggacucuugggaaguuucauuuaaaaaucuuuuauaucccuggcauaguggcauuaacuuauaauucuaauacucuggaggcugaggcagagggaucaacaaauucaggacagucugggcuauacuuugggacacucacaaaaagucuuuuauaagauauuacaacaaugaugguauuaucacaacuuucaaagcacuuauacaauuuugcauggacuuuuacuauucacuauggacugaauaggaugaagacagacuaaugaacagugucagaucacagcuagccauaaggcuuaagcaccuguaggugguuauauugguagguauauacuguaccuuccuacucugaaagcacuuaaagggaaagagaguugggaaucagggacugggugguuguuuugaugguggugcaagacuuuaaucccagcacuugggaggcagaggcaggugaauuucugaguucgaggccagccuggucuacagaaugaguuccaggacagccagggcuauacaaaauccugucucgaaaaaaccaaaacaaaacaaaacaaaaaagacagugucucacuacccaggccagacuggccuugaacuugaggcucuccugccucgaccaauagaguaaguaguugggauuuccaggcaugccuuuauuagcuacuaugcuaugauauucugcuaucaagaaaguuguuccuuaaaaguacagggucuugucuaacaaucagauuuuagagauggaaacacacaaggcaguucauuauugcagaggcuuagaagagaaugaaguguacaggaaaaaaagguuugauauuuacuuaaagcaaaagaaaaaaaaaaaauucccaaaggcugaggauauauuuagcucagugggaaagcacuuguccaggccccacuucuucgauccccaacacgaagggaaacccuuuuccaauaauuccaugucuccugccugacauuaaacacacaaguuuguacuuaaaugacucuuuuuaccccuggcugauaacaauccuucuugacaccaauaguuccuaucuuuuccaaacaccuaacuaacuacaagcuccacaaucucccaauuucaaccucuuuggacacuagucuucccgcccucucagagucagagaauuacaaguaaagagugaacucgacaaacuggcuuaacagagccaaauuugggauccaaacgaccgaauaagaaaaaaggggguggggcauuaccugcaauucacaccaggcgacuuccacagugguuucgguguccagaccuuuguagacugucuuaaaggagccucugccgauuucgaugucaaauuugagaaagcgaccgucauuggacauucccacugccuuggucuccagcucuucgauaucauccuguugcuggcuccuauccuccugcgccucuuuggcgcuggcgccaccacugccacuuccacuucuggacggcgguggcuccucuuugcuccccacgaggcugggcugggacaccgggcggucuuugcugguacugcuggggacggucgugguggccgagccuacaacggcuuguuccccaggggaggcagcagccgaggguugcugagacaccugggaagcaacgguggcggucaaaguuuccucucugugagguucggguggagcacucuggggcaccacugcagguacacuagguugcgggauagagagagggaggcccggcagcuccaacgcgguggcauuggagucgcagaugacgcuucggcggaagaaucggugcuccguggggguggugguggcggccgccccacgacuguccuuguccauagugugccggcggcgccgauauuccuccguccugccaacucccgagucggcgaccguagcccccaguuucucgcccacggaagaaucggagcuugagccauucuuggggacgggcgccggaggcguaaggaagcccggagugccgcuuugcuucucggcggcaccgucagacauggucgguccgauggagugaagaaugcgggcucggauuuaugaaugaaaagggaaaagggugacccggagaagccaccaagaagugcugggcagcgcuccuacggcgggcuccgaaccaccggacgacucccacucagcacugacaaggcgccccgagggcgacgcgggacacugaguccggcugcugcggcggcugcugcugcuggcaccgaagcugcugcggcucacggggcgggcucgucggcgggcuaggagggagcggagccacggggguuagcgccgcacaguccgcauccauccugcagcgagcggaggccgguagggcuggggcagcagaagcgccgcagucaugaggagcagggcgcggaauuggcuccugggcgagaggaugcgacccaagugaagacggcuaagcucccuccgcugccgcugccgccgucgccgcccgcccgccgagcacggcgggauaggcccugagggcggaggcacagcgcgcgagggacgagccccgacgccgggcgguggcagcccggggcacaggagugggaggggccgcgcaggggaaggagggccgcggcccggguucccggucgcucgcucgcucgcucgcucgcucggccgccgccucaggcagcacgcgccccggagaggggaccagucucagagggcgcccaucacuagaugcugagggccgaagccucgaagccucgaagccugaggagcggccccccccguccccgaggccuccccgcccgccccgggccuggcgaaccucuuccccucucuggccggcgccgggggcagaggagggagggaacuguggggaggggagggccgcucaccgcggggcccgggcuccgcuacuucucuggccaggaggagaggagaccgaaagaacugggaggagggggagagggagagaaaaagagcagucaccccacuaggcgccuucugucagcgaagaagggaguacggaauagccgagcagaaggagcgcguccgcccgggaaaacucuccgcuuuaaauggcgccgaugucug

SEQ ID NO: 3336 - RNA, 114706 nt, Mus musculus
cagacaucggcgccauuuaaagcggagaguuuucccgggcggacgcgcuccuucugcucggcuauuccguacucccuucuucgcugacagaaggcgccuaguggggugacugcucuuuuucucucccucucccccuccucccaguucuuucggucuccucuccuccuggccagagaaguagcggagcccgggccccgcggugagcggcccuccccuccccacaguucccucccuccucugcccccggcgccggccagagaggggaagagguucgccaggcccggggcgggcggggaggccucggggacggggggggccgcuccucaggcuucgaggcuucgaggcuucggcccucagcaucuagugaugggcgcccucugagacugguccccucuccggggcgcgugcugccugaggcggcggccgagcgagcgagcgagcgagcgagcgaccgggaacccgggccgcggcccuccuuccccugcgcggccccucccacuccugugccccgggcugccaccgcccggcgucggggcucgucccucgcgcgcugugccuccgcccucagggccuaucccgccgugcucggcgggcgggcggcgacggcggcagcggcagcggagggagcuuagccgucuucacuugggucgcauccucucgcccaggagccaauuccgcgcccugcuccucaugacugcggcgcuucugcugccccagcccuaccggccuccgcucgcugcaggauggaugcggacugugcggcgcuaacccccguggcuccgcucccuccuagcccgccgacgagcccgccccgugagccgcagcagcuucggugccagcagcagcagccgccgcagcagccggacucagugucccgcgucgcccucggggcgccuugucagugcugagugggagucguccggugguucggagcccgccguaggagcgcugcccagcacuucuugguggcuucuccgggucacccuuuucccuuuucauucauaaauccgagcccgcauucuucacuccaucggaccgaccaugucugacggugccgccgagaagcaaagcggcacuccgggcuuccuuacgccuccggcgcccguccccaagaauggcucaagcuccgauucuuccgugggcgagaaacugggggcuacggucgccgacucgggaguuggcaggacggaggaauaucggcgccgccggcacacuauggacaaggacagucguggggcggccgccaccaccacccccacggagcaccgauucuuccgccgaagcgucaucugcgacuccaaugccaccgcguuggagcugccgggccucccucucucuaucccgcaaccuaguguaccugcaguggugccccagagugcuccacccgaaccucacagagaggaaacuuugaccgccaccguugcuucccaggugucucagcaacccucggcugcugccuccccuggggaacaagccguuguaggcucggccaccacgaccguccccagcaguaccagcaaagaccgcccggugucccagcccagccucguggggagcaaagaggagccaccgccguccagaaguggaaguggcagugguggcgccagcgccaaagaggcgcaggaggauaggagccagcaacaggaugauaucgaagagcuggagaccaaggcagugggaauguccaaugacggucgcuuucucaaauuugacaucgaaaucggcagaggcuccuuuaagacagucuacaaaggucuggacaccgaaaccacuguggaagucgccuggugugaauugcagguaaugccccacccccuuuuuucuuauucggucguuuggaucccaaauuuggcucuguuaagccaguuugucgaguucacucuuuacuuguaauucucugacucugagagggcgggaagacuaguguccaaagagguugaaauugggagauuguggagcuuguaguuaguuagguguuuggaaaagauaggaacuauuggugucaagaaggauuguuaucagccagggguaaaaagagucauuuaaguacaaacuuguguguuuaaugucaggcaggagacauggaauuauuggaaaaggguuucccuucguguuggggaucgaagaaguggggccuggacaagugcuuucccacugagcuaaauauauccucagccuuugggaauuuuuuuuuuuucuuuugcuuuaaguaaauaucaaaccuuuuuuuccuguacacuucauucucuucuaagccucugcaauaaugaacugccuuguguguuuccaucucuaaaaucugauuguuagacaagacccuguacuuuuaaggaacaacuuucuugauagcagaauaucauagcauaguagcuaauaaaggcaugccuggaaaucccaacuacuuacucuauuggucgaggcaggagagccucaaguucaaggccagucuggccuggguagugagacacugucuuuuuuguuuuguuuuguuuugguuuuuucgagacaggauuuuguauagcccuggcuguccuggaacucauucuguagaccaggcuggccucgaacucagaaauucaccugccucugccucccaagugcugggauuaaagucuugcaccaccaucaaaacaaccacccagucccugauucccaacucucuuucccuuuaagugcuuucagaguaggaagguacaguauauaccuaccaauauaaccaccuacaggugcuuaagccuuauggcuagcugugaucugacacuguucauuagucugucuucauccuauucaguccauagugaauaguaaaaguccaugcaaaauuguauaagugcuuugaaaguugugauaauaccaucauuguuguaauaucuuauaaaagacuuuuugugagugucccaaaguauagcccagacuguccugaauuuguugaucccucugccucagccuccagaguauuagaauuauaaguuaaugccacuaugccagggauauaaaagauuuuuaaaugaaacuucccaagaguccgagggauuacagugcuuucuuccuuccuuccuuuuuuuuuuuaaucucagggaaauuuucagguuauaaauaaagugcagguauaugcuagauuaguuuggacuacuaauugcuugaauuauagcaauaaauaaauguuauuauauuuauuauauaaauuuauauuuauauaaauaauauaauauaauauaauauaauauaauauauauuauagcgauaaauaaauguuauuauaaagcaucuauauaaauauugguuuguuagcacuuguucacauccagaaaugagcauguauuugugguggaagcagaauuucagcuacaucauagaugaaagugccacuacugauuucuugucaagaaaauggaccaaacugaaauaggauuggaaaguaacugaaauaaucucagaacuugauuuacccaagaauuaauaaacagcuugguuuccaaaugucccaaggucauuugaaaugugaaaggaauaauguuuggaauuugcuucuaugugguggugcaugccuuuaaucccgacacucgggaggcagaggcaggcggauuucugaguuggaggccagccuggucuacaaagugaguucuaggacagccaggauuauacagagaaacccugucucagaaaaaaaaaaaaauggaguuugcuucuaaauaucuagugaaggugagcaauuacccagcuucaacaauuaucagcauaugauuguucacuuaaagauagucgauuaagcuuucucuuccacuucucuauaugcuugaaauuuauuuucaccauuggaaaugaguguucguuuuguuuuuauuuuaaaaaugugaaagaacguuaacucagcauguggaagcaaacaugaaacuggcaaguucuugaacauaauuccuugaguucaacacuuaaaauggaacuucuaagcacauuaaugaaguaaaauaaccaaaaaaaaaauuaccccuuguuaauuuuauaacugauaagaguuggaaaugugacaaauauuuauuuauuuauuuauuuauuuauuuaauauuuugguuuuuuucaaaacaggguuucucuguauagccuggcuguccuggaacucacucuguagaccaggcuggccucgaacucagaaauccgccugccucugccucccaagugcuggaauuaaaggcgugugccaccacugccuggccgugacagguauuuuuuaaaaauuacuuuuagccgggugugguggcacacgccuuuaaucccagcacuugggaagcagaggcagguggauuucugaguucuaggccagccuggucuacagagugaguuccaggacagccagggcuauacagagaaacccugucucaaaaaacaaaaaaacaaacaaaauuacuuuuaguagguuuauuuuguuuuuugagauggcuuuuuuuuucccuuacccuauauugugaagacucauuguguacuccaagcuggccuugaauccaugauucuucugcuguagcuuuuggaguauugguauuacaggaccaugccagacaaacuuaccuucauuguuuguuuguuuguuuguuugguaaacuugucaaaauaugccucuccuccuacugggcagucauacucaauaauuuagaugaaacugauuuauaggaauuuuuguaccaaggaucuauuacugauccaggaauucaauucuucaauuacauuuguuuuauuuaauuaucuauuuauuuaagauuuauuuauuuauuauauauaaguacacuguugcugucuucagacacuccagaagagggugucagauuucauuacagaugguugugagccaccauguggcuuuuuauaaaugugugcuuuuacuuuuuauuuuuauuuauuuauuuuuaaagacuuauuuauuuuauguguaugagugcacuguuucugucuucagacacaccagaagagggcaucagaucccauuacagaugguugugagccaccaugugguuguugggaauugaacucaggacuucuggaaagagcugucaguguucuuaacugcugagccauaucauuccagcccauaucauuuuguuuuagaucaaaauauuuggguucaaauuaaaggucaaaccuaaggauaaguaaagcuuugaaaagaaaaggaaaaaaaguaccccuuugacauuaucucccuagcagugugauuuuaagcauguacuaccaugcuuagcuuuaaaauuuuuaguguauuaaaacuagaaggguuuugggaaauaauagcucauuagguaaggaccccugccacuaagccugauguucaauauagcacccacauuguggaaggagagagccaacuugugaaaguuguuuucugaccccugcacucuugcuguggcacauguguaccuacauaaauagaugcaaaauuggauaaaaucaggcuaucucucccaccuacuuguuuguuaaauaaggaccugaaaucauagggcauuaaguaauuuagcuuugguuaagaaauuacaaacauuaaaauaguuaugauauagcaauuuggaagguauugaaggcaauuacaaauuagaccugguagcagaggccuauaauuuuaguuauucaaugaggcugaaacaguaagaucacagguucaaggccugucuaggcuacagaguaaauuuuaggucagccugaacaacaaaaugagaccuuaacucaaaacuagagucagaaagagaagagagcuggggauacaguucaaugguagaguacuuuagugcaguguuagaauauuuguuuaauagcuacaaaguucuggguucaguccagaaaagguaaaggaaacaacugugguuacuaaaauaaaacuugccagccaaauuucuggcauagauaugcucuucagggccuaucccaucuuaaggagucuuuggcaguuguagcuucucugagagggagaaucauuaucuuuuaucauguuguucccaacugguagguuucucaugggcagucacaaauccaugcaacaacaaauuggauuuaguaggcuauuuuuaaagagucaaagaguugaggaguauguguugggggcauauaaaaggacuuggaggggagaaauggugguggauauauuuguguauacauguuaacacucugaagaaucaagaagaauuuaaauuuuuguuuuuuagaaaggccaggcugucgugguacaugccuuuaguuccagcacuugggaggcagucacaggcugaucuuuugaauuugaagccagccuggucuacauagugaguuuccagaaaauccaagacuacacagagaaaccuaaaaacaacugaucaaauaaaacaaaaacaaaaacaaaaccccaaacuacauuuguagucucaguagauagcuaauuaguaauacuaauuucaaaugaaguuauacuaauucuguguagaaguggcugucaggauuucuaaaguucucuaauaaaugacaaauuuaauuuuuaucacuucauauggggaucuagacuuuggaggaugaaugcgugggguguacaaauuaaacuuccuauuguuagguuauuuuuagagucacaguauguguagcuaucuaccaaauuguuuucaauaauaaauagguaauauuuugauaccacagucuuuacagucuuuuuuuuuuuuuuuuuuccagacaggguuucucuguguagcucuggcuguccuggaacucacuuuguagaccaggcuagccucgaacucagaaaucugccugccucugccucccaagugcugggauuaaaggagugugccacuaccgcccggcucgauaccagucuuaaguaauaacagaagucuuaaaacucuuaauucuuuuaucaggaucuauuaggcaaaaaagcacuuuaauucagucagcugugcugguggaaacauguuucuagggaguuuuguagaguuuacacuuuggaggcugggacaguuugugggagcgugcuuauuaggaaagcauguaguuugcuuuacaaaaacaaacguagaccugguaauuuacuuauuucugacauuuuucucauaaguugucucuaaauagugaauuuccuugaagcucuauauacugaugauguguuuuuucagcuuuaccuaaaaagagaaguaaaaguuguaauuuuuguuuacacuccaguccauuuaaugccuauaucuuaaaguuaugguuugaguuccuaacuacaugacuuuuugggugguuuuuguuuuuuuuuguuuuuuuuuaaagauuuauguaugauaguugugagccaucaugugguugcugggaaugaaggcucgcucuggccuaaauauauuuauuguuuauguacuauaauauaucuauaauaauaauuauuuuuguuuuuuuuuuuuuuuuugagacaggguuucucuguguagccuuggcuguccuggaacucacucuguagaccaggcuggccucgaacucagaaguccgccugccucugccucccaagugcugagauuaaaaggcaaugggccaccacugccuggcaauuuauucuuuuugcuagcuuuaacucauugaacugaaucauuugauuguuuugguuuuuaauuuugagauaagggcuuacuuugugccugaggcugaccuagaacucacuguauagcuuaggcugcucaaacucagaaacaauuagaaacaauaugauuuuugcuagguaagauuggauuuaagauguauguuaacuuggcaugguggugcaaaccuguaauccuagcugcaaucauuuagcagagccuggauuugaaugcaagcaauauauuuuuuaggaggcugaaauaguaaggucuaauacaaguuuaggauuagccuggcuacagaauuacagauacacuguucuaaacaaaacaaucccuaaaauacauacuuaauguuguaggaaauaacuguucuagagaauuguaauuaguugacuucuuaaaaugguucuuuuucacagucucaagaauuuaaauuugucauuuuucuguauuuuccuuuuauucugacccagauuaacauaguuauuccuagucuaugaacuuggaaagagauuauauuauauaaaagacaagugaggcuauaauguuaaccuggugacugauuucauuuguucacauuaaaaauucaagugcgggcaggugagauggcucagcgguuaagagcgcagacugcucuuccaaagguccugaguucaaaucccagcaaccacaugguggcucacaaccaucuguaacaaaaucugaugcucucuucuggagugucugaagacagcuacaguguacuuacauauaguaaguaaauaaauauuuaaaaaauuaaaaaaauaaaaaauaaauaaaaaaagagcuuaaaaaaauucaagugcaagauccuggucaugugaaauuuacccuaauucauacuuugguacuuccacaacugggcuucuguauucagaauuuaaaucguguuauuugagauuucugguagcuuuaauuuuuuucuuuuagaucagugguucucaauaucauauuuauauuauaauucauaacaguagcaaaauuacaauuaugaaguagcaaugaaaauaauuuuaugguugguuaucauaaggaacuacauuaaaggcuuguguuggaaagauugagaaccaauguuuuagauaauacugauggcagaagaaaugaaauaauuucugaaaauacuugaaauaauaaucacuacugcuuaguagauuuuugguaugucaguuuuuuuguuuuuguuuuuuugagacagcaucucugugauaacccuaguuguccuggaacucccuuuauagaacaggcugggcuggaacucacagggaucuaccagucucuguguugggguuaaagguguaugccaccauauucagcuuuauuauuuuuuauauuaauauauuuucaguaacuugaauuuuaauugcuauuuuuaaaagauuuauuuauuuauguauaugaguacacacuguagcuguacagauaguugugaaccuucaucugguuguugggaauugaauuuaguaccucugcucccuccggucggcugggugguuugucagcuaccaugugguugcuaggauuugaccucaggaccuuugaaagcgcagucaguccucuuacccgcugagucaccucaccagccuccuuaauugcuauuuuuuaaacaugggaaauaucuggucuuauagaaauagaugagguacuagaugguggcagcacacaccuuuaaucccagcagaggcaggcauaucucucugaguuugagucuggucugcagagugaguuccaggacagcuuugguucccagaaaaacccugucuugaaaaaccaaaauacacaaaaaaaggaagaaggaaaggaagaggugaagcuuaguaugaucuuaguuuugguuugaagaggccaaauugucaagugaacaaaauuaaaacuagguugccagcaggacagugguuucaaacgccuuuaauucuagauauagaggaagguagacagaccucugaguucaaggccugccuggucaaaacccugucucaaaaacaaaaacaaagccuagguugccaguauucauuucucugcuacgugauucuccuugccuuggccaaauucuauguuaauuauuguauuuguacagccaguauaaagaaaaccugcuuuagccaggugugguagcuaauaccuguaauuuccagcacuugggaggcugaggcaggaagauugcugugaguuaagaguccagccugcgccuuuaaucccagcacuugggaggcagaggcaggcagauuucugaguucgaggccagccuggucuacagagugaguuccaggacaaccagggcuauguagagaaacccugucucgaaaaaacgaaaaaaacaaacaaaaaacaacaacaaaaaaaagagucuagccugggcuagagugagacucugccucaaacaaaguagcucaaacuugguccauaaauauuagguaugauuauacagugucuuuuuuuuuaaaaaagauuuauuuuauuuauauguauaugaauauacuguugcuaucuucagacacaucagaagagggcaucagaucccauuacagaugguugugagccaccaugugguugcugggaauugaacucaggaccucuggaagagcagucggugcucuuaaccucugagccaucucuccagccccauacagugucauuuuuauuuuguccuuuugagguuauuuaugaacauuccacacaaagacauauauauauauauauauauaaguauauauauauacauauauauauacuuaaaauaauaaaaauaaauaauugacaguuuguaagauggcucagcaaguaacgcugcuugccaccaagucuguugaccugaguuugauuccagggacucagauaguggaaggagaaaauggaauccugaaaguugucccuugacuuucacaaauguauaggagcauaugugcuucagugcaucuguguccuucagagggcagcuuuuaggauaguucuuuucuuucauuaaggguuccagagguggaacuuuggguugucagguacuuuuaccacugagccaucugaccagcucauuuaaaauagcaagauuuuaaguaaauucuguuauacagaaaguuuugaauuauuguuuuaguauuuuguuuuuuauuuuuaaacaaaaguuuaaauacucuacacacauguaguacuuuaggcuuuauauuuaagagugcuugcaaggugaauucuuuauaauuacugaggaaagguaauuaaaaauuacugacaguuacuugcuugccuaacaccacuguauaaauuauuuguaacuucacagcugcacuacagggcagauaguauaguuuuuugacuuuuauauuugaggaaacaaauucagguuuaaccgcuuguuuaagaccacugacaugcucaggguuugcuggcacugccuauaaucccagcacuagggaggcagagacagguagaucucugaauuccaggcuagccgggguacauaaugagaucuuauaucuuaguucuuguucuuucuacuagaaaguacuuuguggaagaaaucaguuugaaucuacuggaauucuaaaucuuauuccauuuagcaauuauuuuuaaggucacacauguuauacuucuuccugaaacaaaucuccauuuaaauagccuuuuaggcaauguuuacauuuagaugauagaagguuuauuuuacuaauuuaaugugcuuauaaauuuuuagauauuauagauauugguuauuguugaaaauacucugucaggcuuaaguguuuaaagagaaauauuucugacagucauugugagauuauuuuguggaaacaggauauuccuuuacuuucaguaacuucauguaacuaaaguuuugccuucaaaguagaaagauuuugucauuaaauauuuguuuugcuuuuaaaacaguagcucuuuauguagcccaagcugaccuugaacucauaauuucuugcuuugcccuccuuggugcuagaauuaugagugcuuaaugccuggcuucaguaucuucaauauccuuaccaacacuucugauauucucuguacuaggcaguggaauuguuaauuuuguuagaacuaguuuuaguguuuuaaaggaaaauagguaugaguaaauuucaugacuuagcauuuggguuugcauuacuugagucuuucuuuuuuuuuuuucuuuuugguuuuucgagacaggguuuccucuguguagcccuggcuggccuggaacuguagaccaggcuggucucgaacucagaaauccuccugccucugccucccgagugcugggauuaaaggccugcgccaccacgcccagcuacuugagucucucuugcuucuaggcauuagagagcauucaggucaggugcagcacugcaaucuccaaugaaauagaaacaaaacuguuuuugccugucuagcuagcuaagucaucccagucugauugggcacuaucaugggguuacugggaggucucaccauuggaguaauggauauuuuugguauguggccucucauucgaagccucauuccagguucaaguucuauggacgucaucccaggaaaaggagggcucuugggaggguuccuuaugguaggguauuggcugggaacagguaggaucaggaccccugcaagaugagaagaagagaaugaagcuggauguauuuuuuucuuguuuaaagcaacuguuacuuugucagucaggcugugagccuacucuucuuauauccauuuguuuuuuguuuuuuguuuguuugguuaguuuuuugauuggauauuuucuuuauuuacauuucaaauguuuuucccuuuccaggucucccuuucugggaacccccuauaccaucccucuccccuugccucugagggugcuccucaccccccacucucacucccauccucccacaauggcauuuuccuacacuggggcaucguacacccucaggcccaagagccuaacugguauccaacaaagccaucuucucccacauauguggccgggaccaugaguugcucuugguuguacucuuugguugguggugcagucccugggaccuuggaggagucuggccuguugacacuguugcucccuccauggggcuacaaacccccucagcuccuucagucccuucuucaacuccuucauuggggaccccagagcucaguccagaucuugaacucagaaaucugccugccucugccuccggagugcugggauuaaaggugcgcaccaccacugcccagcccuuuuauuuuucuugauuuauuagaaaaauaauuucccugggcuggauauauaauuuguagagugcuugcccugguggugugguggugcauggcuucaauccuagcauuugguagguaucagccuuuauaacuaaaauuuuggucaugaagcuaaaauuuacaguugaguucuuauccaaguguguauuauuucuaaauucuuagagaucuugggauguuuggucuacaaauggaaauauuuaguuaagacuuuaagaaguuuaucaguuacuauauuaucauuuugaacaaaguuuuaagucauucuugauuaaacugccaaauuuauuuuuguuuucuacuuguuaacauuuguucagagaugcaagaauccucgcugcuucucagauaauuuuuuuucuuucuuaauguguaugggcauaucacuugcauauaugucugcaucauguauaugcuuggugcccuuggaggucagaagagaggguauugauccucugaagagggcaguggaucccccaggacuggaguuuuuuaaaaaaugguugugagcugccaugugacaacuuggguuggcuggaaaaauagccagguguuuguuuaaacaccaaaccaucucuccugcccuucucagaaaauuuuguaaaagccaaguauuuaaauacuuaaaaaauaacauugacacuguauuguuggaucuggccuggugguacacaccuuuaaucucagcauucaggaaaaaggcaaauggaucuuugucaguuugaugccagucugguuuacauauuaaguuccaggccagcuagggcuacauaaggagaccccugccucaacaaaacaaacugcuggguaugauugauaaacaagcacauguaaucccagcacucuagaggcagagauagaaggacugcucugaguucaaggccagccugaucuaaaagugauuucuagugagucccuuucucaaaagaaaguuagagggaaaaauauuugaggaaguuuaguuuuguguauugacuaagcuuagagguggagaagguuuagugugguuuuucacuuucuuaucuauacauauacauauugggcacaugccagagcauguguuuggaagucuguaacaucugacaacuggcaggaauuggugguucucuccuuaaaccaugugagauugaacucugguugccaggcaugguugauauuguucuuucacuggcccaagaguuacuguaaacauuuugaacaguuacauacagcauaguuccuuauggauauacacaauuuaucucauuuccuaucuaaccuagauuauuauguuauuuucuaucacaaauagagucuuauucagguuaugacggaaauauagcuuuuuaaaaaagaaucguauuuguuuauuuggagucaaugucauuuuagagauaaagaaacugaaauuaaauaauuuaucaagacuacaacuagcaaauaauaggacugggaauugagcccagaucuuuuauauuuuuauuuucuuauuuuuuuuaccuuucuuuccauucuuuccaguauaaaguuaagagguugagaauccucuuaacuuuagaauuaccuuguuaguauacauuaaaacuaauaguucaauuuguuuauggacuaaagauugaagugguuuuucaguauucaauuuguuguuauauuuuaaauuugugaagcugaaauuagguuucagugugcucuuaguuuguauggcauuuguaacugagcaguauuuuggagagcuauaucacauaugaaugauuuuacaaggaaucagaagaggcugguuaaaaaaaaaaugaggaucugugaauaggaaugugaaauuaaacuagaaaacucugagucauaauuguugacuaguguuuacaaagaccuggucauacaggguagguauucaggaacuucaaagauaaaagauuggacuaaaugaccuccugggccuuuaauuacugcuagucugugguuuauugagaauuaugugccuguguuauucucauuccagaauggaauguaguauuacuucuaguuuuacuuuuauagcucaaggguagagugcuugcuuagcauuuaugagggucaguucccgguuuaugucagcauuuguggguuuuuagcuuuuuauuuuugaaaaguuacauuuuuaucaguuaaguccuuguuuuacuuuagaauaaucaugaaucaugaaucuugagauagagcuaacuauggcuaaaaguaauucaggugauaugacucaauacguuuggugugugugaaauuaaauaauuuaccaagaccacaacuagaaaauaggugugugauuguguguguguguguguguguguguguguguguguguguuuugcuggaaauugaacacagggccuugugcauauuaggcaaguguucuaucacugaccugcugcccaggaaucaauacuuuuuuuuuuuuuuuuuugagaagauuuuuuuuugcuuaauuuugagguggugucucauagcagagguuagccuugaauuccuauucccccuuccuuuaccucccaaaugcuaggguuaauuauugucuugugccacaaccucagcuuaauuauauuucagaaaaaugugugagugaaccuuugguagccuuuaauuuugauauaagaggauuuucuguucucauuuagaauucuuagguauguuagugugaguuuaauauaaacacaaacagcauuucuguaaauugaacuuaagaugaaaaguaguguacuuaaaaaugucuuagguaagcaaauggcucagugacacuuacugcacagccuggcaaccugacugcugucacuggaacccaugcaaaggugguaggagagaccugccauuacaguuaucuucuggccccaucaugaaaaccaugguacauguguucaaauacacaucaugcaugcacacacaauacuaacauuuaaagucucuuugacugcauaugacaagcuugaaagaaaacuaggauguuuuaucuuguuuuagagauaaaggacuuagauacucaaguuagcgacccuuuucucuugcuuguacuuuuuuuuuuuuuuuuuugcaaauuauccauacuuuaccaguuugacgcauuauaagagccauuacaauauucagugccauugcugaauauucuguuugugauuuuuguugauagucauugauagaacugcuuaaaagugaacggauaaugucuauagaacuaauugaacacuuuggagggugguuucuuuucaugcaguaccauaaguuuaucaugaguacuggaaaagagggggauaguaguaguacaucuuugauuguacaguacuuaugaacugcacuauguuugcaauacuuguuuuuguucuuuauauagagagaaucuuuuucuaacucaauuuuguguauuaauuugauuuuuuuuuuuaaaaucucaucacuuuauucgcuggugggcaaugaaguaacuucuaguguucuagagaaaugcugaaggucaagcauacaauuugguucacagagcuacacuuaugcuaaagugggcaacaagagcacccaaauaaaccauucugucaugucuucugaaaguagaucaguacagccaggcucacugagaaaagcaucuguucaacuggcacucauuucaccugauacucauguguggaugcagaggaagaauucguucagaaguugcuaagcagauucuuccguacaaaaaaaaaaacccaucaaacaguacagaaguaaaaucuuguugcucaucauguccugggagguacaaaaugaggcagcacugguuggggagaaccaggcuuucuuggcucuuguuuauaauuugauuuuuugagacagaauuucacuguguaaucaagguuguuuuugaacggccagguuggccuggcuuccuggcuguggggcuuauaggugugugucacaaugaucuacuagcaaauccaauuuuaacuuuuaauuuuuguguguguguuuuuuuuaaagauuuauuuauuuauuauauaugaguacacuguagcuguuuucagacacacuggaagagggcaucagaucucacuacagaugguugugagccaccaugugguugcugggauuugaacucaggaccucuggaagaacagucaguuuucucaaacucugagccaucucuccagcucuuuuguguguuuuuauugauuuaguuauuagcaaaaauuuauuaggugaugggaauaaggucuuuuguauauucuaagauguuacuuuuuuaaugaaagcuuaauuuauaguaagauaauacagauaacaaaaaugcaaaacgauucaacuccauuuuguaguacuuugcuucuaaauuuagguaauauaagaaaggagauuuucaguuauauuacaaccauggcuaugcauuucuaaacaaguguguugcauuccuaaaugaagugugcugcaugcacuacugagcauaaugugaaaagaaaagugccauaaaaaagcuaaguaccaaguaacuagcuagaaaaagcuuuuaaugggauggcuggcauggucauuaaucugguauacuaguucuugggaaaguggucacauguacuagggugcaauguguuuuagauauuagaacccaaaauaagagacucauucugaccucacucagaccuaaaugcuaauguaguuuuuuacagccuaauuuaacuuauuuuaggagauuuggcucauauguaaacuauagaagaaugaugcauuguuaguaaagauccaaccaacuuuagggcuuugucuuaaauacacuucuaauucuugauucagucuuaguucugugacuuuuuuccggauauuuagguguauauuauggcuugcuauaguugagcuauaaaaguuaaaaaacuuuuaugacugagaaguauucaaguauucuaaguaacacuuugacgauaagcgcacauauaaaagucuaaccuuucauaacaaagauggcacuauuuauagauuauucagaaaaacauuuaggguaaaaauuguuuuuuguuuguuuguuuuguuuuguacugaauauuaaacccaguaccuuacacaugcuaggcaaauacuuuaucauugagguauaucaguuccuuuuuuguuuuaguuugagacagggucucauuaguuuccagcuagacuugaauuuguaauucuuuggccuuagucuuuggaguagcuacuauacuuuugguccuuugccuuagccugaagcugcauauuguuuuuuaaauaauaauuauuuaaacuauaaguauuuucuacaaaauaaaaauuauuggcuauaugaauuuuaguuuuugucauauuuaauuguaacaaaccaucuauuucauucuuagggacagaugauuaugguuuuauguaacagcuaaaguuggguccuuguaaaguucuuuauucuuguuuuuucuuuaagacagggaggaucucaugcagcucuggccuugcagagaauggccuugaauucuugauaugcagcgaauuccaccccccaacuccccacuucugcaugcacuggcuuauauaguacuggagcuccaaauuaggggguggaugcuaggcaagguuuuucuaacuuugcuauaucuuagauaguuaucuauuuuuauuuuaaagauuuuaguuuuaauuaguguguaugguuagauaggaagaggguugugcauacauaugcaguauugacagacagaagagggcaucaaaucauguagaacuugaguaacaggugguuaugaaacauugauguggguccuggaaguggauaccuuucaagaguagaacauguucccaaagaugagcuaucucuccagucccaaucuguuagguuuuuacuuuuacuuugaauuuaaucuuuauuaauaggcagaguacucuuuagcuauaacaagauagugacacuaaaauuuaucagcaacuuuuuggacuugaguuucugaaagaccaggcuagcaaugaauucuuaucucugucuccgaagugcugggacuaaaggcaugggccgccacugcccaaauaugauaauccuuuuuuauuuaaaaaaauauaagacaugauaauucaguaaaguguauaguggcaaauuuacauacauacauacacacauauauucaugaaaucaucauaguuaagcuguuuauuaauauuuucuaaaacucuaaucaccugucacuguauuaaaauguguagauguuuuuccauuuuggaguuaaucuguuuuagagacuuucuaaucuucaauuugugcuggugauuuucuaaguuguugucuagguuagggucuuaauuuggguauuucuucuaucucugcaugcuauuacagccugguuccagacucccauuucuuagucuuuuuugauuuccuccuuuguacaaguauuuuauuuguuuguuugcuucuuuuccuuccccuuucccuuccccuuccccucccuuguuuuucaaggcaggguuuuggguguaggcccucuuguccuggaauucacucuguagaccacauuuucugccucugccuuacaagugcagggauuaaacguguaugcuuccacugccagcuacauuugcuuucuuauauaccccuaggaacuccuggccagauuuggcaucacucacagugugcugggcuccuucaucaagaaaaugucucaaaagacuugccuacagcuauuuucucaauugagauucucucuuuccagaugacuucaacuuguaucaaguugacaaaaaacccuaaucagugcauuauuuggaagauacgguuugaagccaauagcuuuucauucuucuaucucuguaauugguaguuuggauauuauauuuagauuggaaaugguucuuguagauuuuaaaggaaugcuuuauuuuaguuuuuguauuauuguuggaugcugguaggacacuuugcuauuucuuugcuaucucccauuacugaaaguuuucaaaguuucuuuuuuucuuguauuuugaaauacacuacuguaaugugcugugguguaagucuuauuuuuuuuuuuucauggcucuuagugucuguaaacaauggccaucaauucugagaauuuucuucaauuuauuucuuguccuugauuucuguuuugggacagcuauuuuuuuuuuuuuucuccuaggugaguuauuuuuuucuuuuaaucuuuuggcucucuuuguuaugaauuucucuaggaaauuuuuauuugagcauacuauuaaguuuaauuuugggguguguguguguguguguuuaugcaggcaugcuagaugccugcagaggucagaagagguccccagaacuaaaguuuuggauaauugugagauaccauguggguccugggaauugaacccaggccuucuggaagaaucugcuuuuuaacaguaguaccaacucucuagccuguuuguuugagaaaaguacucacuauaaagcccuagcuugcuuggaaucacacagagccauuuaucuccuagagcugggauuaaaggcauucaccaucaugccuggcuaaaagauuuuauuuuuauuuaaauuaaaaaaaaagauuguguguaaccugccucccuuaaaaugggaagcugcuuuauuucuucagauauuuauuauaaaugauuuacuuaguaaaaaaauauugaagaaagaaaauaaacuucuagcuuacaggauguaucccuuaaaguauuuaaacauuaauuaaugcgauugcuaagucauuuccugauaguuuucuucucaucuguuugcugccuuuagcauuuuugucuuuuuuaaaaauauauuuuaauacaacagugauuuguuauuauguauuuaaaacaugcaccauucacuuagcagucuuaauuacccaggaucuauacaagaguaccuuaggugaggugaauuuauacuuacuuauuuucccuauuaauucccuaugaaaaggaacuuucuuacuuguuuuuguaguaccuaaaaauuauuacuaauccagccaagcuuccccauccccaccaccucaaauaggagagagcauauuaaugaaaucuuucuuuucuuuuuuuuuuaaagauuuauuuauuuauuuacacuguagaucucuuuagacaccagaauaggacauugaaucgcauuacagaugguugugagccauuaugugguugcugagaauugaacacaggaccucuugaagagcagacagugcuguuuuuccaggcauuuuuccagcccacaaaaaguuuucuuaaagagaaaauucgcugcaugaguccacacccuuucuuuuucucauuagaauacaaacaggcauuuuaaaaagauaaaacaaaaccuaauaaaucagaauaggaugaagcaaauaaccaggagaaaaagaacccaaggaaaagcacaaacacauucaaagacacauguuugcacacauaaauuccauuaaaacacaaaaccaagaaccauuuuuauauauauauauauauauauauauauacacacacacacacacacacacacacacacacauacauauauacauacauacacacacacacacacacaaacacacacacacacacauauaugaaaaaaaaaugaagaaaaagaauaaaaauaaagccgggugugguagcccacgccuuuaaucccagcacucuugauucuguuucuucauauguucaugcacaugucuacucauacuauauuuugaaaaaccaugugaaccuuucugaggcucacuuuguuuucugaagcuuauggaauucuuaucagguauaaugaacacuaaaauacaauuuggaaguauagccuagaucugccugguaaaugcuuaccauacaaucaugaggaccugaguuuguugauagccugcacucauguagaagccugguucagcaguguuaucuuauuagugcucaggaaauggaaacaaaauccugagggcucauugaccaggcagucuaacugaauuugugaauucuagauuuuguaagagauuuucugggaaaaugaaagugauaccuauuguauuuccacaugcauguucacacagacccucauauaccaccacauccauguacacauacaaaaaagacaauuuggaauuggauacccuuauugccguuuuuccucaucucccaucuuaaauggacuacauaugaacugcuuaaccaggguggcugcuguuaguuuaaaaagacaagauacuucauccuuacauaccuaagaaauaaaauaaguaguaauagagcacagaaaaacaguucucuaaauguagacaauaaaacuucauagggucucacaguaacucugaguugauuaauaaaguuaauauaaauuuuccccccugugguuuuagaguaaucaaguuaccaaaauucuagcuauuuuuaguauuucauacuaaaguuggaugagauggaaagucuauaaaauuauaagaggggacuuguugguucuccuaauuuucucagcuuuagacuuuguuucuucaacuaacuaggaauagaaaaauuauauauguguguguguguguauauauauauuagaguacuuaauguuuuaauacauuaugcauguauguuuguuuguuuuuccgagacaggguuucucuguauagccccgucuguccuggaacucacuuuguagaccaggcuggccucgaacucagaaauccacuuguuucagccucccaugugcugggacuaaaggcgugcgccaccacugccuggcuugaacacuuuuauaacuauaauaaaaccacagguaguccaaauuaaaauaugggcaaugggacugaaaagaucuacaauggucauuagaagauaucugauguuauuaauuaugagacaauuacaaaccaaaaucacaauaagguauuacuuugcagccauuucaugguauaaaauaaucaaaaacuagaagaaguuuucaaugacacuaaguaccaguugcauggguguaagaaguucugagaugcuauucaauuuacacugggugacuagagauaacaauaauguauauucaucucaaaaaagcuguaaggaucuuaaaaugauguuugaaaagauaaauaugcuuagccucuuuaaaacaugcauaaugccgggcggugguggcacagaggcaggugaauuucugaguucgaggccagccuggucuacaaaagugaguuccaggacagccagggcuauacagagaaacccugucucgaaaaagaaaagaaaacgaaacaaaaaaaguuuucaauauagaucauacaaaucuuuuuucagagaugguuuuagcaaccuuuuuuuugguugcuuuuuggguuguguuuucaauuuuuugguaguguaguacccugucuuaacuaucuccuguguacccccaccccuaaauuuaaaaaaaaaggggguaacccaaagguuuaaaggucuuuuuuuucuucuucucacauugaauuguuucaguauccuuuaucuuuaaaaagacuuuagggauauagguauuuuuguuuuuugagacauguuucuuguauauccugacuagccuggaauuugccaugcagaccuggcaaacaacaaaacaucugccaagacaucuuguugaccccauuucuucauuuuacucaaccacccuguuuugacucuuucucuuguaccagucuaucaaauuccugagugccugauuuacgagaacaaauuucugagaaucacuuuggacuuuguaccuccuuuuauuuauuaguuaaccuccccccccccccuaauuuuuggaacagggucuccuguggccuagacugguuuugaacucacuuuuguauaguauugaauucuuaauacuccugacuccgggauuuauuucuucucuccccucccucucucacucuuuccccuuuucccccauucccucacacucucuauuuucucccaugcaugugugugagcuuauggauaccacagugcuuguauagagaugagaggaaaacuugggagagucaguuuucuguuuucaccauguguucccuggauugaacucagguugucagcuuugguggcaagcuucuauagugccuuagccaucucacuggcccuugagucaaccuucuaagugcugguuuuacagauguauaucacuauuccuggcuuugauuucucuuuuauauuuuucauuuuucucucaaucacauuguauuguauuugugcugcuugcaugugcgugcgugcaugcaugccuacauauagaggccagaucuugaaaggacccaccaaguucaauucccagcacucugggaaguaagagccucacuguuuaauaacaaauucaagagacuaaugaguaugaagcaguuuuuaauauaucauucugcagaaagggacuccagaauacagaaaaagcaaaaaugccugguaugcuaaaaugacacaagacuuucugauuuauuugguucaaauuaccucauuuuuuuucucccucauuuuuaaugucuuucauaccauauccaauuucuuugggauuuuugcaggcuuuugugcccuccuaaaccugaacuacacaguaguuugcugcacacauggucuuuuguuguuuuugucucccccuuugcagauuuguuccugaacccuucuuuaacauuauaaaaaauauuuuguuaaauauauuuaauauuuauagauauuuauuaaauguaauucuuacaauauuaauguaucugcugucuugcugauaagagaaagagaugcauauaugauaaacuuuugaguguauuuacauaugaaaguacuuuuaaaaucuaauuuucuguaggguucuguaauuucacuuuuccuucuuuacauucuguucccaggcuagggagauagcucaggcuguaaaguacuuuauggccugaguaugauccucagaacccauguuuuuguuuaguuuaguuuuuuuuguuuuguuuuuaaaguaaaagccaggugaggugugcaugcuuguaaugccagugaugggguggggaagacaaguagguggugggacucacuagaagccagccauaccaauuauuuauuugacucuuuccagacuaaugagagaucuugucucaaaauaaugaugguggugguggugauagguacauacagcuugugaggaacaacucagaauguuguucuuagaucucuaccugugcauagagaaaggagguauuucguucucuuuuggaaacucaacuuaauccucuuuucauuacaguuuguuuguuuuaacuauuuucuugccauccguccagguuugguaaauagacucuuguaaauauguguuuuuucuuugagaagaauuugaauuggagaucuacuuauuuuuuguuuuauuuuucugggaagguggugguggugguggugguuuuuguuguugccugauuauuguuuuugagcuauuuuguuaaaaaaucguuuucugccuacuuguagcagccuuuuuuuguuugugaauauaucuuuauuuuugguucuaugccugacuuuuuuuggagugccuugaacucuuuccucagcucauccuacuuaaugcugggaucacugguauauacuacccaagggcucugaguccuaucuuaucuggccuguuuccuuaagucagagcuucaucaugccucugaaaccuaacaaauuguguuuaugccccagauuugauaucuucucccccccccccaaaaaaaaaaacaaaccaaauaaaagaaagaaguuuuggauaucagggucaucaaauucauugagaaucucauuagcuuugcaauaucuaccacaaccaccaacauauuccucucuugugcugacacuuuuuuuguaugacuuucagguuuagugcuaguucuucaaugaguuuuguucuauuggcuucuccuuugaugacuccccacucccuaagaaaaaauuuugguauuugaugauuaagaaaauuuccauuugaucugcaucugacuuaacuuucuccuuggucccuuucucagcuuaacugcuuucuuuagaaagcuacaguaguagugcuaggcccuacaugagauaacuaaagguacagcccuuucaguuaguugcuuucacauugaucucagcuauuucaguuaaacauacaccaccaccaccacuuuuaaauuuaugacaucuaggguauuguuuuacucuggauaguguaggucauuuaguaaaaaaauaguguguaguuuuuaaaauagaaauaguggguuuuuuuuugucauucaacuauuuuauauuucugucacauuuuauuaauuaaaagcuuuguguaagccaaguuuuaaauacaguguaggugcuuauaaaucugugguccaaauugggagauuuaaguggaggagggugcuuagugaauagaacauauaaaugaguauaguauacaucuguuuugagaaagugauaucuuuuaaaguagaguuuucuuccaguugcaguaaaaugaguauaaauaaggauaagcuauagaaagaagggucugacagaagaacaaaaccagaauauauuuauauauuuuuaauugagaauuuaaaaaaaauuaaagacucugguaugauuucaaauaauucuuagaugauucuaugagauauaaaugacauuguaccuuguuccugugauuaucauauauuuuaccuauugaaaaaaaauucaacuauuguaaacuuuuuuccuauggaauagacccaguuuuauuuuagagauagugcauuggaagauuauaaggaaaucugcaccagcauuuuaaucuagguuuggccacaaagucaggagugauuuuuuuuaauguauuuuuuuuccuguuuuuuuuuuuuuuuuuuuuuuuaaauuagguauuuuccucauuuacauuucccaugcuaucccaaaagucccccauacccuucccccaggagugauuuuucuuuuaauuuauuuacuuauuuauuuaauguguguacacuguagcugucuucagacacuucaggagagggcaucagauuuuuguuacggaugguugugagccaccaugugguugcugggauuugaacucaggaccuuuggaagagcagucagugcucuuaaccauugagcuaaucucaucagcccaggagugauuuuuauauuguaucuuuauaugcauuuuuuuuuaaguuguaagaaucauuuugccucuuaaugguuguuuaccuacucccuaagccucuucugauaucaagaauaauaagauagggaccaggggcuguagagagagaugucuuagugguuaagaacacuuugugcucuuaaagaaacuggguuggguuucuagcacccacauggcaacucaaauaucuguaauucuaugagauuuggcgaccuuuucuuaccuccaugaauacuauauacauauauaugcacauacacucagacacaaacauacauaaaacagaaagaauaaaauacccaaacaaauauuucuaucauaugcuauuauacaagcuacuucaucagagaauauuccagacuuauauaauuaugauuuguuuuaaauuccugauggauucacuaaaauuuucuguauguaguaauuggaauuuguacuucaguaguuucacacugcuguuguauuaccucugaaauuaauuuuuaucacaauuccuaacauaaguaccuaaguuagugguacuuauucuuuaaaaauggaauguaugcucagguuuuugguaaguugguguggugcacagugauaaggagggaggacucgaguauugaccuaaauuuuuuuaaucaaaggauuccaggcaugucagccauauuuugauauauaaaauuaucauguggagucuuaauuuagaagacuucagauguuaccaaauauauaauaccauagaaauuaggaugacuugaggauuaaauauuauuuuuugagauggauuuguaaacauucaguuuuaauuaauagaagacauuuucacugcuucaauugugaauuggucuggaacuuuucaucuggggcuaauaagaggucucuaaaaggaugaaauuguuauaaaaacaaacaaaaacagagaaauuucuagcuagagaauauaaaagcugaauuuuaaaacacuuuguacauugaauuuauuuucuuuguaguggggagagggagaccugugugcugggggauucaugucccaugacacacauguagaggacagucaguucuuccauugugugagucagguuaccagguuugcauagcaaacauuuuuauccacugaguuaucugcugcucccaccuuuuuuacuuacuguuuuuaaugagauuuuuuuuucuuuuuaagaauuaauuuuggaauuauaauauaguuaaauuauuuaccuuucccacuacucccuccaaucccucuuauacaccuucuucuugcucuuucaaauucauagccuuuuuuucauuuaaaugcauauauguauguacacacacacacacacuccuaaauauaaccuauccagucuauauaguguuacuuguauguguguuuuuagggaugaccauuuguuauuaaauaaccaguugguguguucuuuccugacaaacauuucuccuacuuuuagguauuccuuaguuacuuguaguucuuuuguaguguugaggccuuguggacuuucuaaaugaaauaauuucuuuagaauaaugaacugagguugaguacacugaacugucagucaauaaaguagcugauggauuuuaguuaacaagcaauuuuuccuauuugagugccaggaaccaaacuugggacaucuaaaggagaauaguaaucauucuuaccuacugaggcguuucucuucaauccuaguuugcugguuuuuccccuuuucuucuucccuccagacucuuccccuccccucuuuucuccacccuccuuuugagacagggucccauuaguagccuagguuacucuccaauucguaauccuaucucauaguucuaggguuacaggcagguacuaccacugcuggucuuauguggucuuuucuuaaagauauauuuaagguuaagugucaguucacaaguucaauuuguuugauuuuguuuuuccagucccuuucagaauugcuugauauggugauguaggggaaagagagggccuuuaguuuguucaauuguccugaggcacuggaacauuggauagccucaguuuccucugaaauuaaucaguguugaggacacugcuccaugauguuguccucagcagaguuccccuaagccuuuaaaggaucuugacucagguucaacugggacucuuagcuuugaugcagaaaagaauucuaagcuuagcugaacgauauaagcagaauggaagaguuuauuguuauuucuuuaaaauagugugugugagugugcacauacacgcacauaagcacguaugccacugcaugcauguagaggucagugaacaaacuuugugguguugguuuuacuuuuauguguguucuaggaaugagcucuggcuuauauggcaagugucuuaaaaacucacccaucuuguuggccuuaaagauauuuuaaugaaaacgaaucaugagugucugagagaaaaaaaaaaaaaaagauguuccacuaagagcauggguauggguuucucuaagagagagucacaggaaauaagacauauccaaauagagaucuauacuucucaagaaagagucacaauuaauugucucagcauuagcccuguguaccaguuugcuagcuugaaaauuaacaucucagaaaguugcuagaaaacuuuagugguguuuguuuuccuuugagaagucagauuauauauaggauggcucuggaaaugccuugggcccaauuauaaucuauauaaucuuauaaaguaaaagcagaaccuaccaggggugcacaaagaguuuaauauauauuccuucccuguaaauggggcuucuggugagauucuagaaacuuccaggcuuaaagcuggaaagcaagugacaagggccauaggcaguuguuaauuguucugaaauucuucucugcuggcaagaggcuggauuucuggguaaggaucuacaaucucuuaguuuucaagauuuuuccuguauuugcacuuguuucagagcuggagacauuuucuuucuagaaucccauuuguuuucagagagggcagggaaucguugguccuuuuccuucaaagggauguuuuguauuccaguguccuuuucacuuacauauaugauuugcaggugcuuggcuucauuauagcucuggcuaggaccuaacuggugccuuccuaauauuuuuuuauuggugggcauucccagaguggcacagaguucacagcagcaguuagcaauucagccuuuaguucuuuucugugguccuuuagcuucuuuuauccuaucucuauuauuaaugauucucagacccguaugugcuuauuuguuagccuucaagaccuuauuugccuuuuaaaguuucuauaguauuuguugcagaaaaauacucggcuaggaagguucuucugcccuuccuucuggugacucaaggcuagcaguguguacuuuuuaaaggccucaagaagcaguucagagaagagacagaagcaucagaauagagccagugauuaggaauuagggaaaauaaugaggagucuuugggaagugggaggugaguuggaggcucuuuauaggaaaaagcaagguaagagaaguaaccccugcacuuucccacaagacuuccauugccuaugugguaagggcauagagaaacaaguuacagaaugagaaugaaugauaaaaucagaagcugaagaaaguacacuuuuagaauuauaaccagagacaugcagggcauacagguaagaugcagauaagcucauugcauaagagucauagcuaggacugauuacuaucucugagucaacaaacuuaaguaaauuagaagcuugucaacagaaacauaggauauaugggaauuucaacaaauugcagcuuuaaguaacuucauuauccagugucauaaaucauuuacaaaacuaauggcagcagucaaaaccuuuggcaacuuagaucccugauauucuacguaaaagugacaguaaacugagauucuaaaguuguguguguguguguguguguguguguguguguguguaguucaugcuaccuugaaacuuguauguauauaauucaggcacguuucaaacucauauuucuuucucauccuuccaagugcuaguauuacaaagcaugagcccucaugucuaguaauaaaguauauuuuaaaucaggugcaguugcaccuguaguccugcuacuuggguggcugagacaagagaaucccuugaguucaagacuaguuagucuaaguaacauagccacacuuccaucucucuuugcuuuuuucuucucuguuagcuuuuuauguuuuuguuuuuauuuuagauaaggucgcacuauuugaucagauuggccuugaacuccguacuccuaacguaaccuccucaguaucuuuuaagaguuaaagagauugaaaauaauguacugauguuguggugguacaaugaaaaauugauauaauaugaagugaaaaugcccugaaaucaaauauuaaaugauuaguacuaucaucuucuucagucaucuagucuucaguuacuuagaccugugccuuugacugauuucuggaaaguucauacacaaauugugucaucaugacuaaugaacccuagaacacagccuuugguuggagaguugaaauaaaauacaaaaagaugugaaagagagcuuuguuuuuuuuuuuuucuuaaacauuacuuuaaaaaauuauuacuuucauuguuguuggauauauguguuagaggugaguggaaaacuuguccaagccaguuuuauccaucuaucauuuggguccugggaaucuguaacauguuauuaauuauguaguaacuagugcuuuuacuuaacuaagccaugucaccagcccagugaaauaauguuuuuugccagucuuauaguaauaguuuagagaauaagcaagauuuugacgaggaagaaguccaaagagaaugugggaaaacuugcuugcuuaugaaguggacuguuguauuaaacugauuauugugacucauucaaauguauaggauugucucuguaugaggaaagacaaaucucuccucuaggaauuggguuccuuggaagugauggcuagaaaaacucucuucuuaauaaauucuuuaguaugaccauauuuccccccacaucacuuccccaggucauuuucucuuaguuuuuguuuguuuguuuguuuuuuugugaguuaggguaggucauacuacguaguacaggcuaauccuccuccaaacucaaucucacaaguacuaaguauaaucaugcccaguuuagcuuuguuuuuuaguauaugugcuugcaugggugcuugcauggguguguuuaggccagaggacaucuuucaucuuucaggaguucccuccuuuuaccauguagcuucuagggauugaauugaacuuaggacaugugguuuauggacaaauaccuuuaucugcugagucaucucucagcccuuagccuuguuuuugaucaucaucagcugcagauggcuuuugggaggaucaaacacaguuugacuucaggaaacucuuuauaccaauucuagcaccuuaauuguacccuggcuguuagcagcaaucagcacauuggacuccccgucugauagugcccgccaacacacagcacugacaaauucauuugugucaucuucuuuccgaucuuugucuaauacacucuuaacgguaucaaacuuaaaaguuagcaaaguuuuagaaaguccuuuauaauacagguagagggaguuguucucacuuccacacgcuauauaaucuccauuggaagcaaggccuacaaaguuuuuuucauuaauaugacccuuggaaggaauaaugacuagacuuucccugucucgaacuucuccauaaauacuuuugaaucugaauucuuaucccuguagaguuuuuguuguugugcuguucugcuuuaguuuggaaguggguuuuuuuuguuuuguguuuugggagaaaaacagccucuucugaccuuaaaaaaaaucucaauccugagugcuaagauuauaccacuaugccuagcuuggccaguuuuauguuauuuauggguaaucaccuacccaccccaaucuauauuucaaacuuacuugcauuuuuauuuaugcucaccucauccuucuaucuggagcagacacucuggcacauugccuuucuuaagcccuaugguuuaauuaauaaugauaguuuuuaaaagguaauaaacaagaauguguuguagcaacaagaaaauuaguacagauugugauaucagaaagcaguagaaaaugagaaacaguaaagauaagucccccaagcauacauguaugcauuucuacacauaaagucuuaaagagaaggagugaagguugagagaaauuuauuucaaggggggcggggagagaauaugaauauuuuccugaaacaaaugcuugaaauuuuuauuuaaaaaacacaauuagaguaggcauugaugaugcacaucugagacugagauagggcugcaauuucaaaauuaucuggggauacacacacacacacacacacagacacacacacacacacacacacacacacacaccccaagcaauauaagacccucucagaaaaguaaaagguuuuuugaagcagauuaauggcacugauugguuuuacacucaccaaauugacaaaguugauguguuguagauaacuaccacaugugcucuugagcauguguagcagugguaaccuucagacauaaguaaauaucuagacugcauaggcuacuauaauguacuuagaugacauuaauuuauaaauaauagaaaagauuucauaguuuagguaacugggaaguucucggucaacuugccaugucuggucaguacuuacugugccucagagaacuuguaucauguucuuguugcauccucacaugguggaacaggaugaagagauuaauuucuucccugaaguccccgcccccuuauaaagucacuaccuaaagagucuaccuccuaauaucuuugaggcuaaaauuuuaaugugaaucacuuagaccauagcaaaagcacagaagagcagaaaagaaguugcuuuaguuaucaaaguaucuuuuuuuuagaaguggcauuguauuaguuaucaaaguaucauuuuuuuuagaaguggcauuguauauaucacuaauagauucuaugauguagugcaagaucuaauagcuaugguaauuuccaaguagugauuaaucaguggcauuuugggauaucuauaauuauuuguuauuugauuaaguccaacagugauuaaaaauuguagguaauacagaauacuguuagauguuuacauucauaauuaagaaauggcaagucuuaauucaaagcuaaugaaaauaauauuugugcaagucuguaaaucuuuaaaauauuuagauuuauuuuauguauguaaaugagaguguacaugccuggugcuagaggagguuggaagaaugugcauuaguaucccugguucuggaauuauggaugcuuguaugcuauuauauuggugcugguaacugaacuuggggucucugcaagaccaacaacuacucuuaacuaaugagccaucugucuaguccuguaaguuuauaaaugaagaauuuugugaauccuaugagaaagugucuaagcugggcuugguggcacaugccuguaauccuagcacucaggauguagaagcagguacaucucugaguuaaaugucagauuggacuacauaauuaguuccagaacagccaggguuauguagagagaucauaucuaaacaaaagccccaguguucuguaaauaguuauauauacaagccaaaaaaauuuaacaguauaaccuuauuucggguauuggagaagcaacaaaugacuaagugccuaaagauuccuuaguagguaauauauaaacugugauauguucuuuuuuucucuuucuuuuuuuuggcaaaguauaaaaaccaaugauucuuauaccuaaauuuaugauaguguucauuuaagguuaaggaguagaaacgaggguccauucuaguuacccaaaggauuuuaaauuaguuuaaauuagguguauaauauuaaaaucacuucuuuuugcuaaaacauuguaauauuaaaucacuuuuaguuuugcuggcaauacuacauugagauaucuauacugagagugacuaaagauaguuuccauuuuaauaaacagaacaaucaagacauugcguguauggacuuuaacaaacuauaaagccaaauuggauucuucaucucagauaggaaguaaauuagcuccuguaaaggcaccaagaacuuaacaccuggugaaagcauacuuacuagauugcuugauuaugauaacaauuuuguuagauuauacagcauauucauagaaaguucuaauuaauacaaagauauauaucauuuaacuguuuuuguuuuuuaccuaagauauguuuuuuucuauauagcucugauuauuaagucuuugccuauaacuauucugugacauuaaucgccuguuucuaacaauuauugacuuauuuuggaagugacaaguuaacuguauuuuauggaaugagauuauauuuuugacauugauacuaaugauaaauaauuucaagcaucacuuuauaauccauuuuccuuaaagauacaguacucuguucuccaacucuuuuuuuuuuuuuuuuuugguuuuucgagacaggguuucucuguguaucccuggcuguccuggaacucacuuuguagaccaggcuggccucaaacucagaaaucugccugccucugccucccaagugcugggauuaaagucgugugccaccaccauccggcuguguucuccaacucuuaaggcacgcaaaugacuuuuauuaguguuucuguuucauuuuaaugcuauuuaucauuaacguauaauuagcacauuucuauugauuuauuuauuuagguuuuucaagacagguuuucucuguauagcccuggcuguccuggaacuuacuuuguagaccagacuggccucgaacccagaaaucugccugccucugccucagaagugcugggauuaaaggugcgcaucaccaugcccggcguauuuuauuuagacaaguuuuuuuuccccccccuuugguuuuucgagacaggguuucucuguauagucuuggcuguccuggaacucacuuuguagaccaggcuggccucgaacucagaaaucuaaauauaaucucuaaugucuaaaauauaaucucugucucugccucccaagugcugggauuaaaggcgugcgccaccacgcccagcuuagacaaguuuugaacuuagucuugcugccucauuggggcuaccugacuucugagauugucaccaugugccaucuugaccagcuuauuuagcauccuaauauagcuaugugacuuguguuuuaucauuuuaaaucacauuguuuuguuuuuugccuuuuaggaucgaaaguuaacaaaaucugaaaggcagagauucaaagaagaggcugaaauguuaaagggucuucaacaucccaacauuguucgauucuaugauuccugggaauccacaguaaaagggaaaaaaugcauuguuuuagugacugaacuaaugacaucuggaacacuuaagacguaagucaaucaauauuuucuagaaaucucuuguuuuauauuuacuuuuguuguuuagucuacuaugacagaaauaauccuuucaaccaauguguuuuuacuacccacaaaaucuucuuguauauaaaauaauaagguuauuauuuauugguagcuauugggaugaguuuguugcugaauaaaccuaguuaauuuuaagucauauugauugauauuuuuaaaauugagcaguuuaggaaguagaaaucaaugucaagguugcccucuagugguuaaaaugagauuaacagaggaagcacuagacauggaugcugaaagcugaacucagauccucugcaagcacucuuaaccacugagagucaucuccaucucucuuggagaggaugaagaugaugauggguaugaugauauucauucaagcuccuuauucauauaccugcuucuucuacuacuuuacuuuguagcacagugucugaaacuugauaaauacuugagugguuuaaagaaaguugugugauaguuguaugucuaucuacaccuugaaagucuuuucaaugauacagauaccuaguugcuugucagcagucugucacguuacaaugguuugacuuguaucuuccuugcuuauuuauuuguuuguuguuuguuuguuuuuuaaagucaugacuauugagcuagagcacucauugguuaagagcacuuguugcuuuugcagaggacccauaucugauucucagcauggcugugguaguuuacaaacauguauaauuccaguucuagggaucaaacaccuuuugacuucuguggccaccaaguuugcaugugguacacacacagauacacaggcaaaaacauacauaaaauuaaugaaucuacuaggaaguuuucacgauuuauuuuuuuaauucauguauaaauguguauaucugugaguguaugccauaugggagucuuuguaguggggaagagggugauagauuccuuagagcugaaguuacaggcuguagugggcuguuuuauuauggaugcuaggagccaguauuacagagaagcccugucuucagaaaaccuaaacaaagaaacaaauaaauguaaaaguaaugaaaaauguuaaaaaguaaaguaagagcugagcauuaugaugccagagccauaggagacauacucuuauuauguagccuuggcugaucuggaacuugcuauggaaccccagaugggccuagaauuaagcaguacaugugcuucugccuccagagugcuagaguugauuacagauacuacacaccaggaagaagaagagaaggaagaggaaaggaagaagaaauagaagaaacaacaacuauauuagaguguaacucagaaucaauugguucuuaacuaguaugcacaaaauacaaaauccuggguucauucagccauaccacauaaacuggguguguugguauagcugaaaucucaguucuucagagguugcaaaaaguucaagcaaguucauuuacagguauuuaggaaguuugaggccaguccaggcuacacgagacacuaucuuaaaacaagcaaaugaaaacgauauugaaagucuaguuugaaguucacauguaauccuagcacuuggaagauguaggcagaaucaggaguucaaggccaggcccagcuacauaguaaguuaaaggccaacuaaaugagaccuguucaaacaaaacaaaacuauagagaaacauuuuugguacaagcaaaggguugcaugugaacuggcugcucgccaccugugaaaugcaauggggaauuuaacauaaguuguuuuaguauauaucuaagaaucaguaggaaaggguaauccccaauaaaauaauaagggacgacaaaucaccauuauauaaauaugguacacgugaaaauggauacuaguuuuguauucacaaagugacagcugguagagagaaagauuagaauauaacccauguuaaaaaauguaauuguccauaaaaagcuaaauaaagguggcacuccaaucaguaaaaacuacaaaaagcuuuggcccuuuggaugaaagaaaagucucugaaaaauacuccucuccucuuugccccauucuccucuccaaguugcuaucaaugccuguacuuuguacucaugucuaucauuaucucauguacaauaauaaauuaauaauauauauucucuacuguaaauucugcugccuagcuagugcaggaaacucaggccaaaagauaugccauaagugaacccaaaugaaauuuccauggacauuuucauaguucauugauggucacacuauguacagauaaguuuucaaagguaguuugaaugaggaugacucucacaggcccauguacuugacuacuugguucaguagauggaacuauuugggaaggauucgagguauagucuuguugggagagguggcaggccuugagcuagacuucuagucuuucugucuaauacuuguggauuaggauguaagcucucagaugugucuggugccaugucuuugcuccaccaucauggccccuaacucucugaaacuguaagcccaauuaaauauaucuuaauauguugccuuggugaugguauuuuguuauggcaacagaaaaguaacuagacagaugauuucauaguuaaauaauguacccacuaaaaaacuaugaagacacaaccagaaaugaauacuggagcagcuaaagauacuauggguaauucuuuucuuuuuuuuucccccauuuuuuauuagguauuuagcucauuuacauuuccaaugcuauaccaaaagucccccauacccacccccccacuccccuacccacccacucccccuuuuuggcccuggcauuccccuguacuggggcauauaaaguuugcaaguccaaugggccucucuuugcagugauggccgacuaggccaucuuuugauacauaugcagcuagagacaagagcuccgggguacugcuuaguucauauuguuguuccaccuauaggguugcaguucccuuuaguuccuugggugcuuucucuaguuucuccauugggggcccugugguccauucaauagcugacugugagcauccacuucuauguuugcuaggcccuggcauagucucacaagagacagcaggguccuuucagcaaaaucuugcuaguguauacaauggugucagcguuuggaagcugaucaugggauggaucucuggguauggcaaucacuagaugguccauccuuucgucacacuuccagauuuugucucuguaacuccuuccauggguguuuuguuuccuauucuaagaaggggcaaaguguccacacuuuggucuucguucucuugaguuuaauguuuuuagcaaauuauaucuuauaucuuggguauccuaaguuucugggcuaauauccacuuaucagugaguacauauugugagaguuccuuugugauuggauuaccucacucaggaugaugcccuccagggcuggagagacagcucagggguuaagagcacccgacugcucuuccauggguccugaguucaaaucccagcaaccacaugguggcucacaaccauccauaaugagaucugacgcccucuucuggugucugacgacagcuacgguguacuauggguaauucuuaaaguaauauauauuaaauauuuauggaaaggugaaagugaauaugcaaacaguuuuaugaagggcaauugagaauaaauaguagaagacuuaagaaagaaaugagacucuauccugaaaaugacaggcauaguugaacaagauuugccuaagagcaacucauuaaaauauccugguccuguuacacuccuuuauaucucaguacuuaggaggcagagacaggucacgaggucagucuguucuaucuaguagauuccaguguagccagggacacuuaguaagacugucuuaaaaaaaucauucuuugacaauuuuauauauaaauauuguauauucugauuauuguuucauuccuccaauaucuucccaauuccugccacucccccuucucuucacaagucuuuuccccacauucaugcuuuuuuguuuuguuuuaugacugguugaguuuaaccccuugugaacauguguuuggaauuguguauuggagccugauggacuuacuaauggguacaaaauugaagaaagugacaucuccucccccauaauugguaacuaguaguucaguaggguggaaugggguuggugguguauguaggacccagucuuuuuuuuuuaguagauauuuucuuuauuuacauuucaaguguuauccccuuuucuaguuuccccucugaaaauccccuauccccuuccuccucccccugcuccccaacccacccacucuuauuccugguccuggcauucuccuauacuggggcaaagagccuucacaggaccaagggauaggcccaaucuuauacaggcagaugcaagcuucugugagaugaugagaugguggagucauuccuggaaaauagcauucuguaguuacauuuuguuguuggguguuuguuuguuuuuuguguuuuuuuuuuuuuuuucuuucuuucuuugaaucagguuucucuguguagcccuagcugucuuggaacuuacucuauagacuaggcugaccucaaacucagauaucuacuugccucugucucuugagugcuaggauuaaacccgugugccaccacugccgggccaucccauaguucuuaccacuaucuuuggaucuuauaguuuucugucccaauuccacaaauucccuaagaaagguuguuaaaagguuuuauucaaaguugaacauucagcuaucacuuacuuucaccaacuugagcagcuaugaggcucugcauuuacauucauuacaaagagaaccuucucuaauuaaggcuaagaaaagcauuugucuauguguauaaauuuaaacauuuagaaggcaguuugcugucaguuuugcuugccaacaguacuaaguucuuaucagugagugguucucaaccugugggacaaccccugcaggagucaaauaucagauauuuacauuacaauucacaguagcaaaguuaaaguuaugaagaaauggcaaugaaauaauuuugugguugcagucaccacaacaugauggaaauguacuaaaggaccacagcauuaggaagguugagaaccacuccuuuagauccuaaaaccucccagccaugaguuuuugaucagguuuauaguaccagguauagaguucuuuaacuuauagaaaacaugguuuaacagcagucuuccacuaccucuggcucuuauaaucuuucacccccucuuuggcaaugaucccugagccacacagagaggaggugugacguagauguccuuuaggacugagcaaucuggaagcucuaauucuccauacauguuuacuaauuguuaagucucaggauucaccugcugcaaaaaaagaagcuucuccugagguuugagagaugugagagaugugagaaaccaccaggagucacucuagugcuauggcuguuuccccuacuacuaagcauaguaguaucaggcauggguucugucuuaaauucagucauaaacuaguaguuucuuacucccauaacauuuugucaauauuguaucaauugcauuucuugcucugccaguucuuacuguagcucacauggguucuaaguugggugggacuguugauugcuguaguguucacaauaccuuccagcacugugaaaguuugucaguagggaugaauucuccagcuugauuuuucuccauuucagcuaugugguauccuuagcaguaggggcuugccaucaauuucuagaggguaaccaacaauagcaauaggcuguaauguuaggggucuaugguaccccugguacugaucauuuuuguuuguuuguuugguuuuguuuuuaaugcuauuuuuaucaacucuuagagaacagcgugucuugauuauauauucacccaaccucuccccaaaucagguuuugaggauuaaaguaauuauggggcuggagagauugauuguucaagaguuaagaacaccagguucucuugcauagaacccugguucaggucccagcaggcucacaacugucugucuuuaacucuagucuuagaggcucugucuucuacuuuuggccagcguggacacuaggcacacacucggugcacaggcauacauguagucaaagcaccuacuugccuuauuuaauugcuacauccaaauguagaauuuuauuuuaguuuuacucuuagauuuuugauucagaucugguguaggauuucuuaaaaaaaaaaagauuacuguaaagauuuuauuuauauccuuaccucuucacuaacugagcacuaauauugugcaaauucauuuaaaacacauuuccuagcuaacacuuguuuuuauacuaugauucuuauauuugguaaauguacauuuuauacaaauacagaauuuuccccaaauacagauuuuucuuuccuauugacuaauugcauguaccuuaaaaauaauaugaaaauagaugauuucccuuccuuaacccuggacauguacagauaaaaugcacaucagggugcaauuccuauucccaguaucuucucuacagugguagguauugucagagaaauuugugcaguucuuuucuuucuuuaaaaaagauuuauuuauuuuauguaugugaguauacuacuacucucuucagacaccccagaagcaggcaugggaaucccauuacagaugguugugagccaccauguggcugcugggaacugagcucaggaccucuggaagaacagucagugcucuuaaccacugagccaucucuccagccccugagcuguucuuuucauguuaaucgccuuguggauucuguuguauauguaccuauuucaccaguuaccuggagacuuggggcaaaaaauauauagaacuguggacucuuuuucugugacuacuuucuggaauuucucccuucccuucuuaaauauuuuauuuuuugagguuauaauaugauuauaucaucucucuucccucuuucuuuccucuuagccuucccaugguaccugcucuccuaggcucucuuucagauucauuccccuucuccagcuuaucaauuguuaugaauguguguauauauacaaauucauaaguauauaaauaccuauucagucuauauaauguuacuuguaguauauguuuucagggcuaacuauuuuguaguugauaaccuauugguaugcuuuuuccagggaaagacuaauuuuccacucuaaacaguccuuaguugcuuauaggucuuuuucaaggguuaagauuuugucccuucgauuauagcaugucuauugauguugucuuuguuuaggugaugucuaagcagaguuguagauguaucaguuauaucugggcucuacaacucugcauuuugagcaguugugcuguaauggucuccaucugcuacuaagagaacuuuccucauuuuaggguaagaaccacacuuaugugugguuauaagaacaaauauuuaaaauguaguuagggauuauguugguauagugaaguggaaguuguagauucuucuuccaggucuauaacgccauuagcccuagguaguuaguugucuagauuuuuuuaaaaaauucuuuauuauauauuuucuucauuuacauuucaaaugcuaccccaaaaguccccuauaccacccccccccccccccccgcucuccuacccacucacucccacuucuuggcccuggcguuccccuguacuggggcauauaaaguuugcaagaccaaggggccucucuucccauugauggccgaguaggccaucuucugcuacauaugcagcuagagacacgagcucuggggguacugguuaguucauauuguuguucaaccuauaggguugcagccccuucagcuccuagggcacuuucucuaucucuuccauugggggcacuguguuccauccaauagcugacugugagcauucacuucuguguuugccaggcacuggcauagccucacaagagacagcuauaucaggguccuuucagcaaaaucuugcugucauauuuaauagugucugcauuugguggcugauuaugggauggacccccgcagauuucuuauacaaggcgugagggugugguuucccucuuguuaagcuagucucauugccuuuuuaaagugcacuuuaucauggguauaggggaggaggagagacggguggaaaggagagcaacuaugagaauaaauagaauaugaaugagaauaauguguaugugcuaguccagacaugugccauggcacaaguauagagguagaaagacuaaauccagaauucauuucuuuucuuucacuaugaauuccagaaaucaaacuaaagucauuagucuugugcagcaggucaccuccucuucuuuuuuuuuuuuuuuuuuuuuuuuuuuuuuuuuuugagaucuucgagacaggguuucucuguauagcucuggcugcccuggaacucacuuuguagaccaggcuggccuggaacucagaaaucugccugccucuaccucccgagugcugggauuaaaggcgugcgccaccacgcccagcucuaucucuuuuaaaugugugugugcacacacaagugccauaugcaggugcccagagaagccagaacaggguguuggauucccuggagcuggaguuaaagguaguuaugagccgccuggcaugaaugcuuggaaaugaauguagggcuucugaaaagccacaaguguucuuaacaacugaagcaucuuucuccccauccccuaucuuuacuuaucaguacugcacugcagacauagaacugcuauuuauuauacuguaccccaaaauuguuccauuuaccacauaagaccuuuuaaaaaauuauuacauuuacuuaggugugugugcacauacacaugucauagcaugcauauggaggucaaagaacacuuaagggaguccauuaucuuuuuauaccaugugagucauggaguuugucaucaagcaugguagcauggguuacaugagucccuuucucaacaaacaaauaauaaaaaaaguuuacagaggcagaacaauugcaaguuugaagcuagccugggcuacauaguuagauucuuugaaaacaaacuacuagccagagagaugguuaagaucacuuacugcagagucaugaagauagaucccaucacccagguaagaagccaggcaaccagcaagcaccuguaauuucaucuccagaggauuucugacuuccauacauggacaggugcauguacuuucccacaccauauguauauaaaaaaauguagauauagauauagauagauguguuuuuauaaaguucauuuucuugucuuauauauguguguauauauauauauauauuuauauauauguaaaguuuuuuuuaaaguuauuuuucuugucuuuugauagaauuucauuuugaacuuaucucagacccuuaaacuuauacugagguucaguauuccaaauuugauauuccuaucuuugguaugucagaauuuaaugaaauucuucaaagcagaaccucauaucauugauaaccuguuugguuuacuuugccuuuuccagguacuuaaaaagguuuaaagugaugaaaaucaaaguuuuaagaagcuggugucggcaaauccuuaaagggcuucaguuucuccacacacgaacuccaccaauuauucaccgggaucuuaaaugugacaacaucuuuaucacugguccuacuggcucagucaagaucggagaccuuggucuggcaacucuaaagcgggcuucuuuugccaagagugugauagguauguuuccagugugcuuuuggagccaguuuggcccuuugacauagcuuuucuuuagaaacuugacccuaucauauauuuucugacaugaaauaaaccuuuaggaauucauagcaugaaccuagugaucaagucuaucuaaauaugaaaugagggauuuuuuaaaauaguaagcuucuaaaaucauuuugaagauuauuguuuuuauaaaguuacauggagagaaguaaggugaacauugauacaguaucuugcuauucuuacugagacauccugcuaauaauauuuuauauuuuauuuauacaguaggaacaacauguugcuuuuuucaaaaaauaaauggaauguauuuguaguucaacuucagaaauguccauuggguauauguucaagaauaccugcuauaaaaauuugauuugaaaauuagaauauaugggaaggugcagugaaaggcuagucucauaaaccuuacuuaauucccaccuuuugaaaugaacuuuguaucaauuagguuucccagccguaguucucuggaugucagucucuagacaguuguguagacauauuguagaauuauuuccuagcaauccugaguucuaccacaguacacuaguagcauacucuuguauauuuauuccuaauuguugucaccagaccguuuccagacauggcugucaguagagcaaaauuaacucaucauuaaguaguacaaagaauaugagugaccuuucagacuuuuugauuguauauuagagucacagcugggaaaaaauaauggcuguuugauaagguuuaguucucugagacuuaaaaauuugcaguucacauucuaucugcuuuccaauaggguauaacaucaaaagcccauuuguuaauaaauaguuggaccagaauccuaaguacugauaagaacaucauggcaugccagucacuuguauuucuuuaaagaccaaaacaaaaacaauguucucauuggaauauugcguagugcuguuuauauguauucacauaauauauuaauaggaaaaauauauuugaagcuaaauugccauuuuguuuucuucauagggagcauuuaauugucugugaaaucuuaaaaucaaacauaacccccuguauuaaaucauacugugcauacuuauucuuggaacugaaguuaaagauucugaaaucauuguaaaaucuaaucuuguaguaccauacauauacauauacauguacauauuaugcuuacaaaucagucuguauuugaguucuauauuuguauguauauuuguuuuucaccugcaggauaccccucacuuuaucaccuauaucuguacuaggcuuauuuguguacucuaggugggaggguaaguauaugaagaaaaggccuuuuuguuaucuuuaaaaacauugaauacagaggguuuuuucuacaaggcuuuaaaaaguaccaucaauggcaagagacuaguugugaauacuccucuaacaacuaucccaccaaauacuuuuaucccaguacucaggaggcagaggcagguggguuuccgaguuugaggucagccuggucuacagagugaguucuaggaaaccaaggcuacacagagaaacccugucucacccccucuuuucuagcccccacuaccccacaaaaaaggaaaauccauacaucugccauaaaguagagggcagacaaauauuugaucuuuuucauuauuaucccacaguauccauguauccauuuuguucccugcuagguauuuguauuuuauuacucuucccuucuauuuguuuuuauuaugaaauaugauuguuuuuuuuuuagccaaaguguuccauguuaauaauuuauacacaacacuauaaauaaucacuuacuugacuauguucaguguguuuuuaaaggccuuacaguagaaaaucuucuauaggauauucgauggaacagacuaagaagcguuuugucuucuuuucccccuuucuuuuuuauucccuucuauuuuuuuuuccucugauaggucaaccucuuuguuucuugaacccucugguaaggaagaccuacagcuauuggccauauugagugugaaucauucuuuuaauuuaagguaccccagaguuuauggcuccugagauguaugaggagaaauaugaugaauccguugauguuuaugcuuuugggaugugcaugcuugagauggcuacaucugaauauccauacucagaaugccaaaaugcugcgcagaucuaccgucgagugaccaguguaaguccuuaccuaauuguugaugacauugagucauagcuuauaaagucaggcuggauaacauccacuuauguaaaagggcaauacaacagaaagccaaagcuuuuaggaugggaauaugagaguucaguuguagacuuuuggaagcauuaagaagauugguauuauagcagugaaacuaugauaacccccccucccccccaagacaggguuucuuuguguagccccagcuauucuggaacucacucuguagaccaggcuggccucgaacucagaaaucugccugccucugccucccaagugcugggauuaaaggugugcgccaccacgccaggcggugcuaauuucuuuaacaauuauaggugcuuggccauugcuuagucuccuuuucaaacucuaaaacuuguucauuacuuuuuuuucuuuuugaccaaacuuuacauuuuuuuccuuaugcccuuucuuuuccuuauuuuacuuuaaaaaucaaccaaccaaacaaacaaacaaaaccuguagacuuggauaagaccagugagccagugagcaguaacugacauugcuugaaauuuccuccaucaaacauauuaauuaguccauuuuuuauauuaguuacuguuuuguuacuuugaccaaaaaaagacugacaaaaguaauuuaaggaaucaaugaaggguuuauuuuuaucucacauuugaguacuguccaucuuggcaaggaaguuaauggcagcacaagcuugaagcaguuauuuauuuauuuauguaacauccacaucagaaggcagagacagaugaaugcugcuacccagguagcuuucuucuuuuuuuauucagcccaagaucccagccuaggaaugaauguuaccuagggaaaugaauguuacuaccauauuuaagauuggucuuauccucaguuaaucuaauacugaagguuggucucccuccucaguuaaucuaaucaauauaauucuugacagacaucuucauauauuuuucuccaagguauuucuagguucugucaagcugacaguugguauaaauuuaccacagucacauuauacaguauauauauuagaacuacaacaugccuuuuguuucauuacauuuauuuucauugaguagguguacaugcaugcuauagcaaauguguugaggucagaggagucuuccuuuuacaguaugagccccagggacaauagcugggucaccagguuuguccacaagcugaaucaucucaccuaccaacaaauauuuugaguuccuucuguauuccagacuuuucuaaauucaugauguugaauguuauuaacuguaguucuuguuucuaaaaagcuuaaguggaggaaggacaaugacaaagaaguuggguaucacagaguauaaaacaauauucuaguggguuuauuugguugguugcguuaguugguuuuguguguguguguguagccauggcuguccuagccuugagcucuuacugcuuguaucucccugcccucauuaaugaugugugccaccacaacugggccagcuauucuaguguuaaauagcuaagcaaagcacauggagcaguuaguaccucacugaguugaacagguuaggagagugaucauuaaagauucuaggaggcccuaaguauuaacuaugagagaacuacaguuuugcaugccugcugaguuugcagauaggaaaagaacagaauuguuguagcuucuauaaaacagguaggugucacauaagcaggccuagauuuuauaaagauuuuucuggauguagauuugaagaacuaaaaccaaaguuggaaaagcagaacagggaacuaaaauccgaucaaaucaaacuaaaaacaguugaaagguuggcuauugaaguucuguuuuagugguauccacuagcauucagagugcugaggcaggaggauuaugagccauauagggagaaagauaaaugggaaaugauccuuauaguaaucagcuaguggggaaauaacugaaaauguagaaguauggagucauagggaaaaacuacauuagauggauucaagaaguuuuugcuuuuuguuuugucuuauuaaauuuaaauuugaguucuuauaccuaacaguuaaaauaaaugaccauuuuagagaaguacacuucuacaaauuuuauucuugaucaagagaagaccuaacauacuuggcuuuuauucuaauccagguguuaacuuugucuuuacagucuuaauucaguuggauaguuuuaaaagaauuggcucacaggaaaugaagggagaagaaaagaggucacuaguuauaaacuucaggucaguuaagagaggagacccuugguccuguggaggcuugaugccccagcauaggaggauucuagagcggugaggugggaguggguggguggguagaggagcacccucuuagaggcacgggcaggagaauggaaugggggguuugcagaggagagaccaggaagggagacaacauuugaaauguauauaaaugaaauaaccaauuuuuuuaaaaaaagaauaaaauucuuuuaaauaaaauaagacuuuucugugacuaguauucagauucuuucuuuguuauuauagcgcucagccuguuuucaauuguugaauagauuuuuuuuuaagugagcaaauacgaauacacgaagaagcuaaaauauagaguuuggugguuucuguugcauucccgaugcaucacuacugauuccaagacuuuucaccauucuucaaaagaauccccuauuuacuauaucucucuucucuacccaccaaaccaaauuugauuugccucuuuuggugcauuuaacaucaauauuuuaguuuuacucaccuagcauaauauuuccaauguucauuuacaugcugacacgugucaguacuucauuacuuuuuauaguuaaauaauauuccauuguauaauauucaacagcuuuucuuacuccuggagaaggauaaagaacaguguucuaauuuuuugagcagcuauaauagaaauaccauaaacugagugggauuauaaacagcaaguuuauuuauuuuauauaguuuauuuuucagcucuggaaacuggaaaguucaaaauaaaggugccuucaguuucaauaucuacuggagacccauucuucaugcaaaaugccuuuucacauuguccuuaccuggugaaagguucuuuuuauuaaguuacaguuuguacauucaugaccuaaccauauaccaaagguuguaucucugaauacuauuccauuggauguuguauuuugacagcaaauuuuuaaguggauauauaaauaaucagaucauagcuaacgugauggauaauguuaguaguuuuuuuaaaaaagucauugucuuagaguucgacuuaucaaauacuuguuucuauuuacauguucauugcguaugacaugguacgggcauuuauaaauguuuuuaaaaauaaaaaaaauuaaaaguaauccuaauuguaguuaaaaguugggcuuuaugccaguuuauaagaauuauauuccagagaagaaaugaaauuuaaagugacucuugaaaaguuguuaucuuacaaaaugaaguuaaaucacaguaaauagaaaucuacauacaaguaagaguaacauauaaguauagaaaagacgauagaaugggguaauaucuaaacccucauccauucuuuugcugcuguacagauucuaaaaucucaaaauugaaauuucugguagccaguuaaaguaauguacuguguugucgggauuggacugugggguuuugccuggcaacauuuccccauaauuuuuagucuuauuuucacuuuguuuucugagagcaaaagcaaauuguauuuuuuuuuaaauaucccucagacauuucaggaaaguuuuucuaaaacuaauuucccaaggaaguaaggcaucuugaauagcuuagucuucuuggcacuuuaucuaucuaucuaucuaucuaucuaucuaucuaucuaucuaucuauucucuaucuaucuaucuaucuaucuauucucuaucuaucuaucuaucuaucuaucuaucuaucuaucuaucuauucuugaguguuuuguuuguauguuugucuguacaucacaugcuugccugauccccagugaggcccaaaggcuucugaucccuugaaacuccagucuagacuauugugagcuacuacauugagagggaaucaaaccuuaggaaaagcauuaaguguucuuaacugcacaucaaucucuccagaauuugggggccacaaauuuaaugcaaaggaaacaaagugauuuagggagguaauugcuuuauaaaaaucuuauuuuugccuugcuugaaauguuagacuauuggaagacuagaagguacaaaccaucuguucaaacaaccaaccaaacaaccaaccuaaacuuugcuucaagagcucuuaagacagcaguaguuuuaauaaacugcacuagccauuaguaauuuuuauaucuuucuaaaacauuauuaugccuaguguaacuuuacuuguaacaauguauuuauuuguaauuauguaauuauuuguauuaauuuguaacaauguagagagcuguucuguuuucuucaauuauauuuauuacauuucucaacauaaauaucucauuuuauuuuuauauauuugagcauucauaugauaaauguuaauucaguguugacuacugaauaucuaguccagugagugcuaauaaugcauuaauuugagcagcuagagcaaaaaguagaauucagauauuucaugucaaguucaguguuacauauacuacaugcuuuguacuucaccucuaucuacacuuauauucucaguaagucagucaaacugaguaauuguucagugaaugcuuaaaacuuguuucuauuaauaacacuuuuucaguugaguauaaugcuuuaaucccaucauuugggaagcagaggcaggcagauuucuggaggcuagccugggcuacauagagaagaaacacugucucaaaaaagaagccaaccaaacaaacaauauacuauuuuuuauaugaugcuccuaugaaagauauauucuuuugcccucaauaaacaucuuucccaaauucugacucaauaauauucaaaguuaauauuuuucucuucaccacccuuguaaguucagucagauguauuucuucuguucacuguauaccuacuucuuaugcuucuucagugguaccuuaagucauauaugauacacuaguaaaaagcagcaauuauaaagugucucuauucuuuuaguacuuagcauguuuuauuuucaagagaccagaaaauuuuaguauugcugaaaugugccuaaauaagaaaaguaucuuuacauacuguuaguuuuuauucugucuacuacuuugggaaguaaagauugauauucaggauuaauugaugaaguaugaaaaaauuuucaauuguuuuuuaacauucccccaaaugauaccccaaauugucuuuuaaauuuagaaucauagaauaguaacagguagccccugaaagacaauaauguuaagcuacaacuugugacaaacaaaauuuuuuuuucacuuacaaucaacauuuauaggauuauuaaaaaaaaucauuuuagcuuaaaaaaaaaaaccuguuuuuaucuaacugcuaaaagacaauacaacauuuuucucaacuucaaacacuaccuaaucacaaauuggugucacuuguuucugugggaaggagcaaacuguaaucuguuauauaaaaacucaaaggaauuuuacccuaauggcuuuaauucuguuuuuccauacaagauguucaagccuuucaauucaaaggcuaauggaaucagugacaaagucacauuacacaaacaaaguaauuaaaaauccccauuauuuuuaacuugguuguuaaagggcuggauuuagccagauucuuguugguaugaaccauuaguuuacagguauuugaacauaguauauauuuccauuggaaaacaagccucuucaaaugcccuaccaaauugaguuggcucuauuaaaggaaauuagcuugccucaugauucccuaaggcuuauuacuuuggauacuugaaagccaagguauugcuccaaccucaaaugcacuauccuucauauaaauauugaugcuguggcguaugcuuuuaauagcaugcaaagcuuguauuacuuuuccuccuccacugcagauugaaccuauggccaagcacauacuagacagauguucuacugcugaauuguauuucuguacccaccuuuacuuuuuuucuuaagauuuauuuauuauuguaucuaaguacacuguagcugucuucagagguaccagaagagggagucagaucuuguuauagaugguugcgagccaccaugugguugcugggauuugaacucaugaucuuaagaaaagcagucagugcucuuaacugcugagcuaucucuccagccuccccauaccaaccuauaaacguuuuacuuugagauagucucacagaguucugaguacauucuguaauucaagcagggcuugaacauucgguccuacuacuuuaaccucccaaguagcugaauuaauucucuuccgugacugggcagugguaccuuuaaucucagcacuuugggaggcauaggcaggcggaauucugaguucaaggccagccuguucuaaagacugaguucuaggaaggccaagggaacacagagaaaccaugucuugaaaaaauaaaaacaacaaaaaaaaaccccaaaagaucccucuuccuucuaucucacuaucaaaggcauagguuuaagauaagugggucaaauagcaaguauaauaugcagcuaauccucuguguguuugugugcaugcgugcaugcgcugaauaaggaccacagacauuuauauaaggccccaaaguguagguguaguuuggggaucuuauguacaaccuuauaucuauagcucauaagauuuuuuuuaaauuccuaggauuucuguuuuacuuuguuuucuccuauucuauggguaucuuaaaguuauuuuuauuuuauuguauuuuauuuacuuuuauuuguuuagggguuuuguuugguuuuuguccugauugcuuugcaucucacuuuuuuuuuuuuuaauuagacaagguugcucuauauagccuuggcuguccuggaacuugcucgguagaccaggcuggcuucaaacucacagagauagaucuaccugccucugccuccugagugcugggauuaaaggcguguaccaccaccucuaggcaacacccauaucuuaaagaagcuuggaaaaggcauuuuuuaaaaaccugcuuugaguuagccaagcauauagucuuaaacaaucuuccucauauguguaagcugaaagaacuacuacauuucuguccaauaccugacaucuuaguaguaguaccugacuugcuuaguagugauaaaugacugagccagaaauuacugcugcuuugagauagccuguuaggauuaguacauuucuaaccuuuagaaguauuuuuuaaauugcauauauuuuguguggggggcacugauguaucauagcaaaauauuauguggaagucagaaaugaacuuucaggagucuguucucuccuuucaacauaugagucugauggaucaaacucauauuaggcuuaguugugaguucuuuuacccacuaagucauuuagcuguccccagaguagaaguauguuuacuaaauagcaucuaacccuuaccugauucugucaaugauugaaccuugauauuuacugucuuauuugggauucaaucucauaccuuuucaaaggauacagcuuauacugcugccacagcaguacuuuuucuacuauauuaauauuaugaagaaaagcuaaacaguauuugaauucaaaguagcuuuuauuugagcucaugagauuuucuuuccaggaaauaucugcacauguguaggcuuuuaguaggagggaagaaaaaagaaagaaagaaagaaaccuuuacugcuuuuguauagcaguucacuguucuuuuaaaaaaaaaaaaaccuaugcagaagugcaagcaguuuaaugucucuuacuccuacccucccacacacaagcaaggcacuguaccacugaacuaugauguucccagcccuaacauuaccacauuuucaguugggaaaacaggaaauauuucuauuuucuaugugcaugaguguuuugucugcaucuauuucuaugcacuacuuguaccuagugcccauggaggccagaagaagauaucgauuucucuggaaacaggaguuacagaugguugugagcugcuguguaugugcuggguccucugaaaaaaaaaaaagagcuaguagaaguaaaguuaacuggauaacugccaauauauugucuccuuuugaucauucuccugaauuugcuucguugucugaauucagucucuuaccccacuuuuaaauaaaaguuaguuucaguaugauuggcaugaaagaaguguuucaguagguagguaucuaguuuuagauauaggaaagccuccaagguagauuucaaagucaaggaggcagagcuuuuggauacaguagguggagcuuugagcaaauaaaaaagucugcuuauucaaggauguauugcuauuguaggagaagcagaagaaacuacuaguagcaaaaucccugucuuucaggguuuauauccacagagccaagcuaaauagauuguuggcugaacagaacaaucucagaguugggaagcauggauauuaaacaagaacuaugcuccaacuuugguauuugucuuccuuaugcugugggcuagguuauauuaguuuauauuucuauuuacuuuccuccuaguuuuuuacuaaagucuaauaagucuguugccuuuucugauggauuuuaugaagaaagauuuuuguucaguauuuguuauuguaaauucucauugcugcugcuguucucaaaaggauuguauaaaugagguaagaauuuccagucuuuauauagagcaucuucuaaccuuucuagugauguauauaggaaauuucacuuaaauuacugaaauuauucaaugaucuauaauuuauucuguuugaggaaguaugcuuuucuaaauucagaauuauuaagacagguuuuacuuuuaucaagauacuaaauguuacucuaacuuuugaaacuuaagcuuuuaagaagcaauuacugagaauuuuuaaaaaaaucaaagauugaaccaaagaauucuauacuaugacucauuucuguguuuccagcagauuaguuggcaaacaaacaaaauuaaagguguguguguguguguguuuuaaauucauugguguuaugcuuacauggaugugugugucaggugucagaagcccuggaacuggagucacagacaaguguuagcccuuaugugggugcugagaaaugaaccuggguccucuguaagagcagucagucaugucucuagcaccuaaagcuacauauuugauacuuuggagacaaacauuauuuauuuuuuuauacauuauauguguuacagaagugauugagacaaggucacagaaugagaaacugcacaauuuuauauuaccuugaaaguaucuaguguguaucaauagauauucaauacauacuuaauauaauuuaaagaagagaaauaagcuacucuuacauguuugaagggcauguaugucuuuugagaccauugcccaucaauuacaacaauaaugcaagaguacuuuuagagcuaaguugcuuguuuggacgaguggaaugaguaaagugugugccuuuauugaauaaaacuuaguuuuuuuucuuuaacaguaacccaguuuuucuuaguaaugguuuuguauuuuuuaaccuuauucagaaaauacauuugcuuuuacuaguuggaacagaaccacgugugauuaagcuaacaaggaagaagagggguugcuuuugcaggguuauaagacuuuuaaguuaaucuucgccucuauuugauguauacauguuaaaaagaaauaagaugaaguuaauauaagaacauuuguuauuacuaauguguucuuucuggugcuaaaaauuauguuuuagaauaaccuagaccaacuuuuuaaaaaugucagugaucaaauauauauuaguuucuuaaaaauaaaaagcccacgaguaucucaaaaccuuguuacucaaugucuaauagcuuuccuguaagucacuuucaggcuuggaaagcuuugaauuuauuccauauacuuuacuuuuauacuauacauucuuguacauuauuauuauuguuauuugaaacaggguuucucaguguagcuuucuccguucuggaauucauucuguaucguccaggcuucccgugaacuuacacagauccacuugccucugccuccaaaaugcugggauuaaaggcauaugccaccauugcuggaccacauaauaauuuuuuuaaaggccauuuccuaaguccauaguggcuuuuggauauguuuuauuacauucacauggaaucaucuguuucuaacaugacauaaauuuaaauggcaguauaaacuaauauauuugagguuguuaggaacuagauuugaagauaugaacguguguauguuuuuaugaguugcugugguuaauaagauagcuaaaaaauuaaaaucaccagggauaaaagcaggaucaggagaauuucuuauguccuuccuacauuaauacaaaagguaguacaauuuaccaacuuaguuugauauguuaccaccaguaauuuaaacacauucccuuuagauacuguauagaagucacuuucuuuuccucauuaaauuuucugucugugguuauuuuucuguagcauuuuaacugcucucacauucaaggucuaacuguauucaaucuguuauaccaaauuauguuucagaccauugcuuguaaauaacauuuuagguguuucuugccauuuaaaguuuacuuuaugcuguuuuacuuuauuguagaaaacaaaagccaauguaaaacagaaagcucaaauuuucuccuaucaacccuagugcaagacauccauaaaauuucuucaaggaaguuuguuuuguuuuguuuucuuguaaauuacuauuuuacuuacuguguguauguccacaacugcuugugugcugugacauuuguggcuuuauuuuauguuuguuuuguuuuuugaaacaaugucuuguauaaccuagguugaccuugaacuugccuuguaaucauuaaugcucuugaauuucugauccucuugguuaauggcaccucccugggugccaggauuaaucauggaacaccagaccagauucggcuuauaucauguuggaauucaaacccagggcuucaugcuuguuaggaaguacuguaccaacugagacacaacccaguuucuauuuauuuuagucuuaaauuuuaaauacucuuuugcucuaucacugcauucuuugacuuuagcuguauuauucuuauuuauggagaaugugucugcuaaagucaguaauaagacaagaguguccaugaucuccacuccuauuaauauagugccuacagacuugugacugaaguuguuaacaaugguacacauaagaaaggaugaaacaaaauuauucuuguuugcauaugguaugauucuaugcauaaaagacucuaaagccucuacuagaaaauucuggccacugauaaacacauuuaacaaaggagcaagaacauaaacuuaacauauaagacuugguagccuucuuguauaccuggcagcuacagauuuccauuuauucuccugguccuuugggucucuuucuccucucuccauacauccugauucuacucuccuacccauuucuucgcccccuaugacuauuuuguucccccuccuaagugugauucaagcuuggaccuuccuuccuuaacuucuuugggucugugggauguaucauggguauucugugcuuuauggcuaauauccacugauuggugagaaugcaugucuuuuugguucuggguuaucucagucaggaugauguuuuuuuaguucuguccauuuuccugcaaaauucacgauguccuuguuuuaaauggcugaauaguauuccauuguguaaaugaacuacauuuucuguaucuguucuucaguugagggacaucuggguuauuuccaguuucugacuuuacaaauaaagcugcugugaacauaguggagcauauguccuuguggcaugguagagcaucuuuuuggguauauauauacucaggagcaguauagcugggucuucagguagaucuauuuccaauuuucugagaaacugcuagauugauuuccagaguauacaaguuugcagucccaccagcaauggaggaguguuccccuuucccccuuuccucgccagcaugugcugucauuugaguauuugauguuagccauuuugacugguguaagguggaaucucaggaucuauacuauaaaacaauagugauuaaaaacugcauaguguugguacagaaacagacagauugaucaauggaaucaaaucaaagacugagaaauaaacagacacaccuacagacacuugauuuuugacaaaaccauacaauggaaaaaagaaauggcgcuggucuaacuugaugucugcauguagaagagugcaaauagauucauguuuaucacccugcacaaaacucaaguccaaguggauuaaggaccucaaaacaugaaacuggauacacuaaaucucauagaagaggaagugggaaguagccuugguaaaagagacaauuuccuuaacagaacaccugugguucaggcuauaagaucaacaauugauaaaugggaccucaugaaacugaaaagguucuguaaggcaaaggacacugucaauacgacaaaauggcagccuauggauugggaaaaauuuuuuacuaacccuacaucugacagagagggcuaauauccaaaauauauaaagaacucaagaaauuagacuccaguaaccuaaaguaacucaauuaaaaauggguacagagcuaaacagauuucucaauagaggaaucacaaauggacaagaagcacuuaaaaaauguucaacauccuuagucaucagggaaaucaagacccauaucuuaacauggaaaaguauuuuuuuguuuguuuguuuuuauaagcucuuuaaguuagccaaguauggaauuacugcaauucuguccaauaccugauaucuuagacuaaaagaggugugugccaccaggguggcuuuuuuaauacuagcacucacaaggauggaguauggguagggacaauuuaaacuaaagacuuucagaaaugcugcauggaaaccuacuaauguagaaacuuucuaaaucuacacaaacauacaaagaaauuaaaaggaguuacccuguagcugaggugagguaagggggaaaaacaguuguucuccuugacacuauaagguauuuuaaaaaaaaaaaaagccccagugguaggcaugcauuuccuaucuuggaguugguuguuaguggaucucauaggcuauugucaucuggaaauaguaagaucauauuacugaagguacuacauacuaguaccuagaacauggagaaagcaaagccucauaacaaucuagaagcuucaucccuacuagcucgguuuuuuuuuuuaguuauggaaggugcagccacuaguggaaaagagucaucaccaggcuucccucagcugugaaguuagcuaagauaaagacuggccugccaagauauggcuacuggugcaacaguggcaggauguuauggagguaaccauaucccccccaaucccuuuuggcuuuuguuuugcuuuauuuuccuagguaggguuaccuacauuguggagcuuugauuguccuguaacuuaaauguguggccucuuaauucugagauccaccugccucugccucccaaguucugggaauaaaggcugugucauuauguccagcauucaaacacuuacugauuggaucuaaggcccacuuccuaagagagaacacaugcuuguaacugcaguuuguccaagaaggacauaggcccuagagaaauaccuacuaauauuauucagcuaauggguauaauauuaaaaugacucauaaugguguaucacuauacccauauauuaauacauuucacaacuuauugggguguuuuggauagagcagagcaacugcacauauguacuuauaacaguugugacagcauguacaagaccuggcuaaauaaaccagacaaaauccuaguaugaauagggacagucucuaagagguuauuauauaggauccagacaaugacuguacacucaaguguauacuggcaaugcuaaguggacucaaagggguuugugugugcauggauuugugggagaauggauaggcuaggugaaggcacauaugcauacaugaaauucucaaacaguuauguggacaaagauauuuagggaggaaaacacaaaaaagugauguuaguagucuuucucagauuuaaacuuucaaauuaccuucauaugacuugaggauuuacucuauuucgcagucaguugcuguaaaaaguuacucuuaggagcacaauucuguaagucacugcuugaaagaaugcaacagguaauuaaugagaauuaaucaaauuugugucucacuuccauguuuaacgacuuugacacuaaaucauuugauguauaaccagugggugucugaaacuguacugaaucuuauaauacauuuccucuaggacuuaauguaccuuauuguaaaaaguuuccaaggagguuucuugaacaggaucaagacaaauauuaauauuuucagucuacacuugaagaauucaaacuacuguguuuuauuuagucuugugaaagauuauguaucucucugugauucaguuaucacuaguuuuauuucuguuacagagacuguagagaugguuagaauuuauguaucaaacucccucccaucuauguguuuacagauuuauaucaccacuuauacauguugcuauaucucccuggauuccuuuugggaguggauuagguuuggggguuugcuuugagacagguuguacuauguagcccuuagguggcccagaacucacuauguuaauuaaucaggcuguccucaaacuuaaaggagugugcuaccaugcccggcacuugguucuuaauccauaucauuacugaaauggcaauaaaugcgaaggccuucuucuaaccuaucucuccaauagugcuguuuugacacuuugcugaaaguuuuauuuuugaaguauuuguuuguuuuuggagacaggguuucuguacacaucccugaauauacuggaacucacuauguagaccaggcuggccuugaacucauagagaucagccugccucugccuccauaguguuagaauuaaaggcaugugauaucauauccagccaaagaauuuuuuaucaaauuaaaauuuuaaacuguuacuguacuggaugguuuuaugucaacaugacacaacacaaagucaucugaaaggaaggaaccucaauugagaaaaugccuccaugcgaugguuuuguagguaagguuguaggauuugauuuagugauuguguguguguaugugugugugugugugugggggggguguuugucaguccauuuuguguggugccauccccgagccaagccaugaggaccaagccaguaaacacugcgcauuagccccugccuccagguuccucaccguuuguguucccgucaugaguuccuucccuaauacuauggaaauguuagccgaauaagcuuuuucauuuccagauuccuuuccucaugguguuucauuucagcaauaaaaacccuaacuaagauacacugugauguuaguuucagauagaguagugcugaugagauuucuucuuaaaugugagucugauauuaauguucauuuuaugacuggggguuuuuuugguuuguuuuuguuuugagacagggucacagguagcccaaggugcccuugaacucugguuuuggauggggcagguuguucaaaggauacuaacagauuacuaggcacuagugaguuuauuagaaagaagaguuuguuuuuguuaaaucugcauuuauuauaaucagcaggucagacacuuguaacaaugcuuuaaaaaaaaagaacaagaaaaaagugaauuugucaaauugccagguaggggacuuguagguagaugcuagacugaagcaaaaagaagaaaacuacugggcagacaguggucagaaguacuagggucaaguagggggaaagauggccuugcugacuaauuaagcuggugcaucuauuucauuuuguuucauuagaaacauuauuaauuccaagaaccaacugacaaaggagccaauagcaugguagagacucugagaagugucucuuuucugacacuuuagguggagggguuguuuauaguaaaauucuguagccagacucuuaaauuucuaggcuagaggcaggggaguguuuaaagauaagaauuaaaaaaauuaggcugccgauaaaaaagauaaagauaagaaugcaacauuuccagggauuucaacaagucuucuagcuggguugguagugguggggugucauagaaaacaucccaguaggaugccuauuaauaacugagagguuugauucugauguacuccauucugacauggcuccaaggauaaccuugcaagccugacccucccgccuccauuucaaaaguguugggcuuauagacauaucacuguuccugauucucauuuuucuguuuuauuuauguaaaguugcuucuuaguuauucuggcauaauaguagcccauaauucuuaauauuaaguauuuuaaagaguauuauauaauaggaugucuaccaaacugugugaauucauaccuauuccuggguucaguguccagaauaaaggcugaaguaaucaauauguuuucaagguugcacaaaagauuuucuaaccauucagagcaccuggauaccauuuaacuguaagauguuaucggcagccuaauuuuuuucugcuaaaagaccugccauacuauuuguuguuucuugagauugccacuuaauaccucuggucccuacacugaucaggucuuacagguacauuggaaaaagggccaggauauuaaaaaggcagccuauuuaaaaguccagcauucuccucucauuacuucauuauuucuauggcuuuuuuuucccccccuggauuuuagggagugaagccagccaguuuugacaaaguagcaauuccugaaguaaaagaaauuauugaaggauguauccgacaaaacaaagaugaaagguaaguugcuucuuugacaugguguuauuugaacaaugagagguaaauuuaauacuuguguuucauuuuuucauucauagcaaggacacuuuuaaaaaucagauuauuucuauugaagcuacuuagauuugaccacuguaacuguaaaaaagugguuuagugauuuuuaaguaagcuagaaccaccuuacaagagaguucuuauaggauaauuuagaaagcucuacaauaguguuuauuuuccaaugaagcaaaccuauuccuuaaucuuuuugucauuaaaguuugaaagguaaaguaaaaucuuggcuauugaaaaucagcucagcuacacaggccuggauuuuuuuucugucauuauuccaagauuuaaaaaagcaaaacaucaaaauuccuaugaguaaaaagagauuuuacuuaaggcuuaagaggagaucugguuuagucauuuguacaaacagaacuuuucugagaaaagugucaaguaucuguuaggugguguagcuaaugggucaacuguaggcuuggcaaagagccaugaucuuuauuugaaaauaaucugccuuuaccacacccccauaccagcuuuaaaagaaaaacuacaccauccuauccuaauuaauacaaauauaaauuguaaauugagcauaaccuaucuccuaaaauuugggcaccauuggguauaucagacaaauucaagaauucuguaucuucacccuuguaggcucauguucguuucaaaacuuuguuauuuagaagagcuuaacaucaugaucuuuaagacuuuucucuggauauuuaguuugaguuucuguuuugcucuuuuaagacuuuuucacuguaaacaaagggauauuuguuuugagucuuacaauguuauucuguuucuuuuauggauggaacguuuuauuugauugcugguauuuuguuuaaaaaagaaugauuguuaugcaaccagccucugacuugcuaaauccacaaguguugauaaggaauugaaggacuuuauuguagugauaaagguggcuguuguagaaaguaccaaacuagaaaucaauaaauuuauggucuaguuuugauaauauaauugauuauuguagaacuuugagaaagacuauuaaccuuuucucaaucuucauuuuacauuagucaauaaaugguauuccauugcauaguuauuguucaagagucagacaaggccauacauaauuuugucuucugagcuuuuguuuugcuuguuuugcuaugcuucuuugguauuuuguauuacuucccauaauuauauccuacuaauaagauuagaucauuugaucuaaaauuugucccuaaggacaguuauuaaaaaaacagauuguaauaugacuauaugcuggagauguagcugucuagcacuuauaagguaauauauuccauugccagcacucacucacagaaacaaacacacacacacacacacacacacuucuauaacauuacuauucauauggauuaauguugaaaauuucuauuguagauuuuccccuuaacuaaauaauaguaaacacacauuugaaagucauucuuaugccucuaauauucuguagucugaggccagccugugcaacauagugagauacuaccucagaaaaagaaagaaaaauguuuuuucaaacuaaugacuuuuuuuaauuuucuuuuucuuucuuugaaagauauuccaucaaagaccuuuugaaccaugccuuuuuccaggaggaaacagggguacggguagaauuagcagaagaagaugauggagaaaagauagcuauuaaauuauggcugcguauugaagauauuaagaaauuaaagggaaaauacaaagacaaugaagcuauugaguuuuccuuugacuuggagagggauguaccagaagauguugcucaagaaaugguaaauuggcccuuagaugauguuguagauuuauguuuacugaaacugauaggcaaaaacaaaacaacuauuuuaauuagugauguaugauauguaugucauuaauaugaaguuguguuguucccaaguguuuugucuuuggaugugggggaggggguuccuauaauuucuccuuaaguucuuucuuugugcauuuugauauuguuuugauaaucugguuugauuuuuuuauuugagggaaauaacauggagguacaaguggauaaauuagauaugagacugggaugcauucuggaguccuauaaaugcuaauaguuccuccuuuggaauuguuucuaaauacugguuagccuuugauccauccugauaaauacuguagagagauauaggauuauaaaguauuuuuacuuccguggcuagagagauagcaguuacagguguauacugcucuuuuaaagauccuuaguuuaguuuucacuacccacaucaagcagcucacgucugccuaaaauuccagcaucaggggaucaaauacugggccuucaucugcacacacaugauuuaaauaauaaaaauaaguauuaugaaaacuuucuugcuuugaaggguguuuugaagaucaaguuacuaaccauguauccuuacuuuaaguauguguaaaagaucacaguucuaaaggaaauccuuaaucaaaucuagauaugccacagugccuauaaaaagacaauaaaggucaauuauuacacagauagacauagaguacccuuacuaggauuuaaaaaaauuauucaauguuuaaaaaaaaaaggccaaaugugaaaaauauacuuaauuuaaugguugguugcuugguuugcuugguuuuuauccuuuaguccuuuacccuguuucaaccuucccuccucccccaucucauaccuccucucucugucucuaagaggauguccuuaaccccaacccccaccuuucgagaccaccccacucccuaaggcuucaaguuucaagguuaggugcaucuucuuuaacugaggcuagaccagacaguccucugcuguauauaugucagugaaccucauaucagcugguguaugcugccugguuggacgcucaguguuuuagagaucucaggggucuaggacaguugagacugcuggucuucccauggaguggggcccacucugauuaccacaauuguggggaaacuuaaugcagacuaguaauuuuacuauuugaaguaauuuuccuugggguaccuuuuucuuccuaauauacucuuuuacucuguagguugagucugguuaugucugugaaggugaucacaagaccauggcuaaagcuaucaaagauaggguguccuuaauuaagagaaaacgagagcagcggcaguugguucgagaagagcaagaaaaaagaaaacaagaagagagcaguuucaaacagcagaaugaacaacaagcaagcguuucccaggcaggaauccagcagcucucugcugcuagcacuggcauacccacugcuccugccaccucugcuucaguuucuacacagguagaaccugaagaaccugaggcagaucaacaucaacagcugcaauaucagcaaccuaguauaucuguguuguguaaguaucuggggaaguaaacaaaugugcuauuauuuucuuuauauguuuccauucuuguacccaugauuaauagaaggguaaaacacugaggaaaugugguuagaauagaagaaaguuugaaaaacuuccaguaucuugacauuuugagcuuuuaguugucuguucuaucuaguuccuuaaaauugagaauaaucaagaaugaacaaaguuugggauuuauaauuguagcuguuaaucuguuucagcucuuuuagcaaaacugcauagcagaccaaaaauugauaagaccagugcucauuaauugaaaaucaaguacacauaggucuccacaggguaagaccuagaaguuggauucaauuaaagacuuaaguuuugcuugcucugcagaugauaacauucagugauaaucagagaaauauuuuuuaaguacucauuuaagcuauucuuuuuuuuuaauuuauuucagauuugaauaaagaaauaaccaauaauauuaauguaaugacucuaaaugugaacaauuucuuccucuuccauuucccucccucuuaugauucauuuuuccuucagcugauggaaccauugauaguggucaaggaucauccguauucacagaauccagagugagcagccaacagacuguuuccuaugguucccaacaugagcaggcacauucuacuggcacagcaccaggacauacaguuucuaguauccaagcacaaucucagccccaugggguguauccacccucaaguauggugaguaaaugaauaagaaaauuuaauacuaaaauaauagccaauagguaaucugcuaaauugaaauuauuuaugucauuuaaguagcacugugagucuaagagaauauaaacagucuagucagucucgauaucuauuguuuuuacuuggggggguguuuaaauagugaaacgcuuaaaaauuuauuaguaccaaacauguacagacuuuucuuguuauucccuaccaauaugacauggcuucugaauuacauuggguacuauaaguauauaaucuagagacgauaugcaaauacuauaaucuauauaaaguacuuagccagcugcagauuuugauaucuguagggguaauuugaaaccaguucagugcagagacugaggcuaaugguauuucuaaacaagucaguuuauaagagcauaacuggaguagaucaaacuggguaaaauacacaauuaaaagugaaaaucagcugaacuuccuacagaaagcagcuuugugaauauuaagacuccuaggaauuaaaacuuuucacgguggcuuaaacuagauauaccaaaugauuuguggguggaacauugguuugguuuuuuguuuuuuuaauauuuuuaaaagcuuacuuacuaaagacauuuuaagauuuuucuuuuguauaaaaaccagguaagaccuucaaacuauuauagaauguugcaugugaauauuauagaguaaaggaauccuuuauuguaugaccucugacuaauuuauugcuuguauuuaguugaucaucaguugcuaugcguguuccuuucccaguauauguucauuugcuuuuucccuuuauuugguauuuauuucauuaccaguuuauuuucagagucagcuuauagaaguaauuucuuggaauaguuuauguuuguguacaugauguguaugcacauuguccauuuucaauagugaauguuaaaguaaaugaaucauaaaauauucucauuucuuuugcugacucucuuugugaggucuuuggaggaaaaaagcuagaucguauacuucagaaggaacuagaugauaauuguuuacucuaucacuuguuuagaacaaucuuuacgcaaaccaauuuuccucccuccucagaaggcuuuaaucugaacuuugaagaauuccuaucuuuauuaaaugaaucuuuuuuuuccaggaagaugcuuuuugcuuauaaaagauguuuauuuuggaguccauugauugaucaguccugcuuuggacauaggccccaagauuaauggacacauuaauacaaagaaaacuacuacuaauauauauauuaaccucuuuuaacagucuguucuuuaggcuuaaugugguaaauaaucuuggguaauuuauuucugaauauugacaaucucccuuugcuuaacaguuauuuucaaccucuugggacuucccccaccacaggguuauguauguuucuaaaagacaaacaggauugaucauuuauguagauauuaaaugcuuaagccauuaacauaguuguauuuauuugcugcucuaaaaucauacuuucuagauuuuugaugacaguauucuaauagaguaguuauaaagaauuacaagucuuuauaauaaaauauuuuauaauucuauugucucauuucaagaacuaacuaugucuuacaauaauggauaaacuguaagagaaaguuuaaaaauaagaaaggcagguaaaaaauuggaaccaaaaugaacuaaauuaugauacauacuuacaggcuccaaguuuggcugaaaguauuuuuugcagucaguuuugaaaaagaaauaggccauaaacuugcuccagacaacccguaacuguguuaaacucuuugucuuaagcuacuucaaauuuuguaggucuaaacugaauuuuuuauuuugagggugguaaugauucuuagagauuuaaauagaaggcauuucccccaacuggcuccuuuauaacgguauaaaauauuucugauacccauuugugaauuuuuuuucuucugaucacugacuuuuuaaccuuuguacagaacauggcaaguauaauaaaguaguguaagcaaacaacuuuuuaugcugccuucuaaaauagaugcauuuauuucccucacauggccugagcucuugcaaauaauguaaccuuaaucucccaaaucucguacucuaauagaauuuauucuuacuuaauuuuaguaaguuuuuaguuaacuguuuuugugugguauuguuaguaauucuuuuuaaauuaguggacuuaauauuaauaacuuagcaguuaguauuaugucaaaauauucaagaucuuuuugauuguuuauaagaaaaccugcacaaacccagcagaacagggagaauaguuacaauauaccaggugugcuuuguagaauuaugucuuacacuuuuuuccuuuuuuuuuuuuuuuuuuuuuuuuuuugguagaauuggggaagguagaacauuucuuuauguuaacuauacccuauuaucacuguacauuugguuauuuuguuuucaaaguacuguguuuuucauguguguuuguuuucuguuuagccucgucguggccguagcaugucgguuuguguuccccaucuuucugcuguucccucucuaucccgcaucucucccagugcuccuuccaccccaccaccagugcugucugcaccucuuuguccuucccuccuucggacugccccugaggaaacuuuugccgaaaaacucucuaaagcauuggagaguguccugccuaugcacucugccucccagcgcaagcaccgacgcuccagccugccuucccucuuugucacuacuguauguaacuguaaacuuccugaaaagugaaaaaccauuaaccaaugaauacauccgggcauggagaauaugcuuaaagcgcaaagcuaaacuauuagcaaauguugugcuuuuaagauaacuauuccuguaggaaacauuuuguaauaagauguuaaaugggaauaaaaagcaaagaggcaaugaaagagaaugcuuauaaugucauuagcacauauuaguagaguuuuuauuauacuuucuuaucuucuauugauaagaguuuucauuuucauaucuuagcaaaaaguauguauaguacuuuacuaaacucauuagccuaaucaaaaguagagucuaccaaacauugaccaacuguguuuucuccucaauuuauucuuaaggaauauaacugaguccuuuguuuuuuaaacuagucaagugaggaguaaaaguugauuuuaauuuagucauuuguguaaaaugaaaugucaggaaaccaaaaggcuauuuccucucugggaagcacuuuuuuguucaccucuuagauuacauaaaauggggcauagacauuagacacauauauaacauauaauuuuccuuguguccauuagugucuaugaaagauaaaaccucucaaauuacauuaauugcuauaaggccuuguuugcugcuuuuccaaacaagagaauauucugaacuaaugacaccagauuuuuacuuaggaaaaugguuaacuguacuguguuuuauggcuucaggacacaaguugaauaauaaaauauaagcauucugauuugguggaggauacuuuagcagguugaagaaauggcuccauaacuuaaauacuugcugcauaagcauggagaccuaaauguagauucucagaucccauguaaagccuggugcacuagugacuacccauaaucuccagaugggagaugguaauagacucuccagaaucucaugugcccuguagucuguuguauacauaagcaacaaacaccugucucuaacaaguuggacagugauguccaacacuugagguuauccucugaccucaacaccuguuuuuguguuauuaaggauugaaccuggacccuuacauaugcucaccaaagacuuuaggaguccaguacaugguagaaauuuauuuauauugcauuuggcaagcuaggauucuaagcucagucuuaaauucaguaaacaaaaugugccauaaaaucagguuuaccuccuauuugcuugguuugucagaguuagaaaacucaugguguucaacaaugaucagaagaaugacuuagcgucuguaacuuguuuuauagugaaacuauuaauuguaguuuuaaacacagaagggaacaacaagucauauaucuucuucuuuguuuuuuaagguagucucacuauauaauugcuugggccuuguacucuaaaaucccccugccucagccucucgagugcuaacauuacuauaaguauguacuacuguacuuggcuuaucuuauaccauauagcaaaaaccucuucugauuuauacuauuauaaauuucuucugaucaucuacuguuaguugaugaaaaauaacugaagccucuaacagacugaugucauagcauuaugaacaguagcuuaaauugaaguauauuuuaaauuauaaaaauuauaagguuauuuauuauccuuuaauauucuaacuuuaccuauuuccauugacaaauauuuuaagaauaaacacauuuauuauagguaaaauagaauaauuacuugggaaauuuuaauucaugccuuugcuuugacagagcaaguuugugggaaagcaacuggggugguuuuuuuuuuuuuuuuucauucaaggaagugccacagauuaacuuuauuggcccuggauguauuuaauggauuuuugcuauaaauuccaaaagcauuguuauuuauuaaaauuuucguguggccacuucaugggguuacacagaacuauccagcugugcaugucugauguaauuuuacauauugaauguaugaauuacuugucuuauucauguugauacagccucaguccauggcgcauccguguggggggaccccaacauacccagaaucacagauauuuuucccaacuauucaugaacguccaguuucuuuuucaccaccucccaccuguccaccgaaaguagccauuucccaacgacguaagagcaccuccuuccuggaagcccaaacucgccacuuccaaccccugcugaggacuguuggccaaaaucaucuuccaccugguagcagcccaacuaacuggacaccagaggccauaguuauguugggugcuacagccaauagaguaaauagagagcuaugugagaugcagguccaaccuguguuugagccaacccagauuuacagugacuauagaccuggacuaguacuggcagaagaagcucacuauuuuauuccucaggaaacaguauaucuagcuggggugcauuaccaggcccagguggcaggacaguaugagggcauuucauacaacucaccaguacugucaaguccuaugaaacagauaucugaacagaagccagugccggggggcccugccucaaguucugucuuugaauuuccuucuggacaggcuuuccugguaggacaccuucagaauuuaagauuagauucuggaccaaguccagcaucaccccucucuaguauuucugcgccuaacaguacagaugcuacacaucugaaauuucacccugucuuuguaccucauucugcaccagcuguguuaacuaauagcaaugagaacagaagcaacuguguauuugaauuucaugcucaaacaccaaguucuucaggagaaggaggugggauuuuaccucaacguguuuaccgaaaucggcagguugcaguggacucaaaucaggaagaacugucuccucagucaguuggauuacauugccaccugcagccuguuacugaagaacagcguaauaaccaugcccccgaauugaccauuucugugguagaaccuaugggacaaaucuggccaauaggaagcccagaauauuccagugauuccucucaaauuacuucuucagaucucagugauuuucaaucaccucccccuacaggggggacagcugcaccuuuuggcucugacgucucauugcccuuuauucgccugccucagacaguguuacaagaauccccacuauucuucuguuucccccaaggaaccacaucucagcaggucuuaucugcuucauauucuucaggaggaucuacacuccauccacagguuauaggaaaacuuucacaauucuuuuaaacuacccuauuauacaccagugcauuuaaauucucuaucucauuuaccugaaucauggauuuauaaggaauguuguuuauuuuccuaguaggauuucuuuugugguuauaaauacuuguaguaaaaaaugaacuauaaagcagaaaauaccugguuugccugugauuuuaauugucagaaucaaugacuaaucucuuuggaauuuugugguaguaaugaaaaugcauuugucugucagucuugauuauaguaaaaugauuuaguguauaauucauuuuucuaaauaaguuuuuaaagauuaaaaaacuaaccauaaagcaaaaugggaaguaaugaaaacuuuuuuuggugucauauuaagaaacacauagcuuuucauuauaagaacuuaaaacguauugugggaguuuaguuuaacaaaugaaagugccauuuugagaugauaucagucaagucacuauauuaaagauaaaaauaaaacauuaaauuaaaauuaaggacuauugucuaauuuuaaugacuauuagagccuauuguauaaugauuuuauuagguuuucaugcguuuaugguaacuaguuacaauguuaggaacaguggaucuuucaggcccuguucccaauacauuuaaaacuuuaaucacacaggggagcauauauacucaugaacauuuacacaagaacauuuacucaagucagcagugacuaguucauaucaguuauuuagaguaguguuaaugaacaaaaggacccugaaauuuaaacagcguggacauguuuuaugcuugcauuauccucuaagcuuugcaaaagaaaaauguuuuuaaagaaaauagauaauuaaaguuuuaguggguacauccauguaaacuucaaagaaucuaggcuacauuggaaugaagcaauaaauguagucuuuucauuuccuuaacauguuuauauacauaguauauaugaguuaauuuuccuaacauauauucuuacccccuauucuuacuuaauuugacuuuuuaauuggaauacacuguucaguuuuucagagcccacaugguugacauucuggguugguuagucuggucauuauagagauuuuuuuuuuuuuuuuuuuaguagcagccauuuccccuaguuaacaaucauaaugacuccagauauuucuauguuaccugaacaacuauuauaugccuguugaggaguuguuuuuuaacagaccuuguaccucuuucaucagaguuacuaugacacuacaagaaacagcaagagagaaccaaauuaacauauuugaauguaguuuucuuuaauugucaaaaauaauuuuucauacugauauauuaccacauuuuuccugugacaauuuuauugugaaucugacuauucaagccagcuaaaacucuaggcaucgucaauggaacuaucaguguauuguguuuuugucucucuguuuguguuuaccugagaugugaucagaaauguucuaugaucuuuuuucugaacucaccaaaaauucccagaugucgaccuuguacuacaguaucaagcugaugguucauuuugaugaagcaaucuucucaggaucugaaguauuuauacaaaaucuguauguguauaaacuuucucuaauuuguauuugcuuucuuucuucaggcacaggggcagaaccagggccagccaucaaguaguuuggcugggguucuaucuucacaaccuauccaacauccucagcagguaaaaauguugcauugcuauacuauguuuuagcaguagccagaggcacuguuuuauaucuuuaugagcuagauuucugauauaaauggcuugcuacguuuuugaaagaguaacugaaaguaucauaacacaucuuauguaccuaugagcaauuuaaaagauaagaguuaaaaggaagaauuauggacugcagagauggcucaaaggguaauagcacuggcuguucuuccacagguccugaauucaauucccagccaccacauggugacugauaaccaucuauaaugaaauaugaugccauuguuuguuuggggggcacacaugcaggcagagcacuauacauaauaaguauauaauaaaucuuuuuuuaaaaaaagaaagaaaagaauugcuauauuuauaauuuaucgcccauccuaaauaauuuuaugcauaagguuaaaccauacaaagaaaaucuuuguuucuacuuuauaacuuguccauguaagagcauuuaucaccuuuaauccuagcauuugggaagcaggggcaggugaaucucuggguugaaggucuauacaugguccacagagcacagccaugccuauugaaaaaauccuuaucuuuaaaaaaaaugagcauuuuugucauuuuggucugaaugaaaauaaucuuaaaggaauuggagagguggcucccuagauaagagcauguacuauuauucuuccaaaggaagaccuagguucacuucccaggacccacaugguggcuaacaaacaucuguaacuaauuccaugggauccagugcucucuuauggccuccucaaaauuaauguuaaacacacauauacaugcaggcauaacauuuuaagaaaacauaaagaacuguaggaaguuuugggguuuuuuuuuguuuuguuuuguuuuuaaguuuuacuuuugacuuggaagguuuauauuccaaaagagcugaguaauuugggacaugaguuuaaaaagaaccaaagagguuuuguuuauaauucaucaguucuuuuauuaacaggcuuuuguuugcaagaaaaucauucuuuuuuguacaauuuaaaauuaguuucaaacaaauuuuauacccaucucuguauauaauaagcuaguucauuaauaguuucuguugggcccuaguaguuaagucauacuuugauauaagaagaaagaauauuucaggcugggguggaaguauugcaauuuagacgauauaaaaggaacaacauuagaaaaguaugggacagauaaaagaaaccuugaguuuaguuuaaggaagaucuuuuuuguuuuaauauuuucuuccauuuauaugugugcgugcuugcaugcauacuugcauaugcauguuucacauacauuuuugaguuagcuacauccaauuuuauuuaaugagaagauagauuuguuaaagaauauuuucaggaaagaauugacagucaaaauuuuuaugugagccuugauucuuaaugggaacaggagaaggacaggaaauaccauaugcccaaagguaagguuuuuccucaaauuuauuuguugguggugaauugcuagaugugauagcauaugcagguaaucugagcauuccaggguugaagaccagccuagacuucuaucugguaauaacccuaucucagaaaaaaacaaacaaaacuauauuaugcaaaccuuuguuacuuaacaagcucucucucuccuuuuuugaacaaccgaaaaauagaauaaaacaaguaaaaacaaaugcacugagccagcaagauggcucaguggacaaaaggcccaugccaccaagcauagggaccugguuuugauccuauucgauacuuuauaaguacuuuauaaguacuauauaaguauuauuuguuuaaagauuacuuuaggagcugauaccaaggugacaggacuguaaaaugucacaaaacagaacaaaaauguacagaaagaauacugugacauuauaaguguaggcugcaguugacucaauggauaaaagugcuugcuaaacaaacuuuauugccuaucuaucauaucuauggaacacacauagaaguugaacacuguaguacaaguaaucccaguguaccuaucaaaaaaugacaaucagaggcaagugagucuuuagaagccagccuagcuuaaauaggaaaagauaaccuggcucaaauuaacugaaaugucaaggacagacacccauagguuguuuacugaccacugcaaguacaccaugacaugaauauacucaacgaacauacucacagaggcauacacguucuuuuaaaguguuauaccagaagacuaccaaagcaccuguaauacaauucugguaaaaaugaaggugcuuaugugccuuauauuugaaaaguaugagcuuaugguuuaguuuucaaauuaguauuuuuauaugccugaugucuuauuuaaauauauuuaaucuuuaacucaaugaguuauguaauuauagagcauuuguucauaauucuuaaaguauagauagauggucuccugguuuggggauuucuuuuaguaaaagaaguaaggaaauugucuaauguucuagaucucauauaagauuguagauacauguucccaugcccaccuacacuauuuucuaaagaaaguuguuaauugaaucgccauucauaagugcaugcuuguuuugaaaauuggaaugagcugugaaccucaagacacacccuguaaaucauaaccucuuagaaggcugaggcaggauuguaaaauacaguccugguagggaccagcagugagcagugagagaagcuguuuccagaaaagaagacagcuucuaagaaacaauucuuuuuggcucaugcacauauauuuacaucuacauacaugaauaugcuuguauaccuuuacauagauaccuuuuauguaaagagaauuuuucauuaaacauuucauuaaacauuuguaaagggcugcugagauaauuuaaaacagguaaaggcaguugcugccauuaguaaacaauggaguucaaucucuggaauccccauuguagaaaggccugucuuaggauuuucacaugguucuguggcaagcauguauacaaaaaaauaaguguuagagguuggguguuucuuauguuaucacaugggcaagagaggccccugaguucaauccuuaguaucaucaggaaugguugaauaagacaaguguauuuuggugcuuuuaaaauuugguaguuuuaauuugaugauacaaaaucauucuguaggaacaaaaguauuuccagauauauaaaaauccaaggugcuuauuauggugauuauauacauaacugugaauaaauagcguaccauuauauagguaacagccaaacauuuguacuggauauaucacgacaaagguuuugugcuggcuacuuuuacuucuacuuaacaaaagcuagagucaucagggaggagucagacugucggcaagccuguaaggcauuucuuaauaggagggcacagacuauuguggcuuguagugcuggguucuauaagaaagcaagcugagcaagccaauaaguagagcacuuccauggccucugcauuagccugacucagguucccugcccugacuuccuucaaauauggacuaugauguggaaguguaaacauacaugaacaugcucauauaccuuuacauaaauacuuuuuacguaaagagaauuuuucauuaaacauuuguaaagggcugcugagaugggcuuucuuccccaacuugcuuuuggucguggcauuagaucacaucaguaguuaaccccaaauaagacagggcuauuaguugaaacauguuuaaguaucucccaaucccccucccaaaaaaaaaacccuaccaaaauguuaacuaguaacaucacuguuuauaauauagguuugguuuuccuuuauuucaacugaaaauaaaaaugggaaaacugagaaaacccauagcagcugccuuugagaauagguagaaacaguagcauuuacauuuaacuuuuaaaaaaaaguguguguguguguguguguguguguguguguguguguguguguguauauauauauauauauauauauuuuacuuuuuuguauuuauugagauuuuacuuuuauuuguauuaguguuuaaagccugaacgauuguauguaugucucauauaugcagugcccauggaggccagaagaggucauuggauuaguuguuguuuuauagucuuaaugucauucuccuggccuauguuuaaaggccaacaggagcugagggugauggagcuugccaucaaucacuacagucacgggggcaggcagacucugugaauuccaaagcuacauaauaauaccuuguccugggggcgggggggacggacggagggagaccaguuuaguuuagucaacauagcaaaaaucccucucucaaaagaaucucaaacauuguauuuuauucuuaacagcagggaauacagccaacuguuccuucucaacaggcaguacaguauucacuuccacaagcagcaucuuccagugaagguacuacugcacagccagugagucagccucaagugucagcuggaacacagguaaacucaaauuucugaagagauucuucaaaugauaucuguguacuuugucccuuccuacagguuuuacugacucuucagauagugaaagaucuguuagaauggaauaaaaaucauugccauuauauacuuuuauuuauuguaaaucaguauaugcagauagcaaagacaaugaaauaugaaauauuagguuuauagguguaaaguauugaaacuaaugagcuaaauggagaugcuuucguaacugaaccugugacauucucuagaaaaugucagcuguauuugauauuccagauuugccacuauguuuuauuuccauguaaacuucaguauuuucucccucacuaccuacagauacuaacuuauuguauugauuagcuucucauaacuaacaaauaaguagaauauuauuauaaggaaagaaucuuuuuuucuucuugugugguuucagagguuucaguccauccaugauuggcaggcuguauugguuuuagaacuguagcaagggauggaagaaggguuaugccauaagaaacuauuuaccaaggaacauagaagagguuaaggccaaaauauacuuuucaaagcuccacauacccauuacccauaacuaggccccacccaccacaguuccucuacuuuuuaguucauucaagguuugacuucaucagaggucagaauccuuaugaucaaguugucucuggaaauguucucggagacauacacaagggacauauauuacuaaccuccuacuuuauucuuaaguccaauuaaaguugacauccgggauuacccacauuugagcuaggauugacacaucugagauuccucaggcagaugguuucagaaguucaagaaaaaccuuagcuaucugcuauaccuacccacccuaccccccaaaaaaaauccuucaugaauuuuuguuugguuuguuugaaugauuauuuugguuuuuuuuuucacuugcuuggaagguacccuguagaagcuauguucuuaugaauagccaaccucauuuauuaugcacccuguaugcauagaauauuauuaucagaucuuagaacuaaaacaguaucaacugugaaugcacuauuguuuuauuuaccacaaaguaaauacuaacacaucauucuaauuucuacauguaucccaauuucucagauauuaagaugucagaguaauagaauaaugaguaauaacauccuagaaucagugaauuguguuaauuagagccacuuuuauagagcuguuuuacauuuucaaaacugagauguaauacuggugaaaucuaauuccacuggaaagaaauuuauguuuaaucacuauaauagcugucagagauuagguuacagcaaacacguauuuuuacaaaacaguggauuuuggcaugugaaacauaugcaguaauggcagcuaaaaaaacaaacagaaaacuggguguuguaggacauaaucuggaaucuuggcacuugggagaugggggcaggaggaccuagaauuuuucguccaguauagaccaucaagcaagcuacaggaaagccucagcuaugugagacucaaaaucaaaagagagagggagaaagccuuguuuuuugaaaaaguccucuuuuuauugccaacaaggaaacacuaucaaauuauucugcaauaaaagguuuggagauguuagacacuuuuuuuauuagcauauuuccuauucuuucauaauuauguggcauauuaauuuauacuaauguauucaggguuuugguuuucuucuucuugccuaauauguaaaucuugcuuuuggcagcuuugcuuuuaaaaaagucuuguuuuguuuuucuuuaccuucucagcuuccaguuucccagacaguagcaacuguccaaggugaaccucacaucccaguuucaacacaacccucaguuguuccaguccacucuggugcucauuuccuuccuaugggacagccaaucccuacuucuuuacucccacaguauccugucucucaaauucccauaucgacuccucauguguccacggcgcagacagguuucucauccguuccuauaacaauggcugcuggcauuaaccagccucugcucaccuuggcuucaucugcuacagcaucuucaaucccagggggaucaccuguaguuccuaaucagcuuccaacucuucugcagccugugaaucagcugcagagucagguucacccacagcuucuacagccaacaacaguucaguccauaggaauaccagcuaaccuuggacaagcugcugaggguccacuucccucuggagauguuuuguaccagguaucguguuagccagaaaaaucagaggguauuagaauguuuaauuuuaauggaagaucauuaagaacuugagaauuguacuaguugagugucaguaacaauaacaaaaguugaaagucuuaaaaaaaaaaaaagaauggaagacugggcauaguacugugugcuuugaucccaaugcuuauuguagaguagaggcagguagcagaucucuguaguucaaggcugcauagucuauauagcguguucuaggccagccagggcuauauaguaagucccgguuucaaaaaaaccuaaugggauaauauuaucaaaugauuccuuauacauuuuuuaaagacacaaauuagaagaaaaguucacucaguagucaugguaagcuagauaacccuggauacaugguuaguuaaaucuacuaggcuguuccuuuauauggagauaaguaaagaaagcaggcagccugguacuaacagaaacuucaggguuuagauuaagaggguuuacauuugaugauaugacugauaccugaaacauauuuuuccauucuuccauguaagauugcuguagauuuaaguucuacuucaauugucucuagaaggagaaaccaagcaguuuaaagcaucauugaaagagugccacuuucuaaguuauuuaaccaguucauuuugaaaauaaucuuuaaacuauuagaaagugggacacuguccuuugcuuugugcuucccccccuccaccuccuugucuacugauuugcuaauuugaugucucaaccugcacuaacucaccuuccucauuucugucacagggcuucccaucucgacugccaccacaauacccaggagauucaaauauugcucccucuuccaacguggcuucuguuugcauccauucuacaguccuagccccuccuucuaugccgacagaagcauuggccacccaagguuacuuuccuacaguagugcagccuuauguggaaucaacuccuuugguuccuaugggcaguguaggaggccagguucaagugucccaaccagcagugaguuuaacgcaacaacccccaacuacauccucccagcaagcaguucuggagguaaauggaauuacugcauguuuauauaggaaacaucuaugaacaugggguuaaaauagcaaagaaaaacaggcuccccuuauuuaaaacacauuuggagacuguuaaacuaacuucuaaaugacuuugucuuacagcagaaugaaaugccaaugugggggccuuguugccacuggcuguucuguugggaagugaguuugccuuagagaagauuaacacuauuagcacuucacuucucuagcuagugcauuagccauuguucuuccacaaacuugugccauuagcaguucauaagaguaucuuaucuugcugugcucccagcagucauuuuuguccuaguaggauacaguucugaauucaucucugcacuuugcucuaccuguccuauugcacacucugguaagaugcuggcugcauggcaaauuguaguuucacagugccuagcaaauagguuggcugaguucacaccaacagucuguacuagcaacuagcuuuggaaacucucaaaauguaagcacacuguuuuuagauguugaauauuaagaauuacuaguagcuucauugcuucuaggaauuauagcgggguaacaaaaaagaaagggaacauaagcaauugguggaugguuauuucauauuuaaauauauauauguauaaaugccaaaauuugaauuacccuuucaaucuacagaguacucagggagucucucaggcugcuccuccagaacaaacuccaauaacacagucacaaccuacucagccuguuccauugguuaccucugcagacagguaaguaaacuaaaacacucuuuugaguaguaggcaggaauaugaaacuucagaauaauaugccuuugaaucuuauuauacacgauuuucccccucaaagugcacauucagacguugcuucugguaugagugauggcaaugagaaugcuccaucauccagcgggaggcaugaagggaggacaacaaaacggcauuauagaaaauccguaagaagucgcucucggcaugaaaagacuucucgcccaaaacugaggauuuuaaauguaaauauugauuugugaccauuguauugcuuaaagaauuuagcacuuuuaauuuuagaaaucaugaaaucuaaaccacucacuuuguuaaaauaaagauaacucaucuuuauauauaauuucauagcaacuuuuuauuuaauuacacaauuucuucuauugaguaucacauuucauuuuguuguugcaccuagcucuagaguuuuaacuaguagaaaaacagacuagaugcuuuugcuaauggaaguugaaaagagcucaagaucuucucacauauuucuuuagccaauuuaaaauuuaagggauggucaagggugguggcacacaccuuuaauccuagcacuugacaggcagagguaggcagauaucugaguucaagacaacuacacagagaaacccugucucaaacacacacauacacacacacacacacucaaggaauuucaagaugacuucccgaagucuguaauaagucagaauaugaauuacuuuuuucuuuuuagguuucaaauaaaggagaccgaguaguagaaugucaauuagagacucauaaucggaagaugguuacauuuaaauuugaccuagauggugacaacccugaagagauagcaacaauuaugguaugccuccauuuggaauuccacauuuucccauaguauuuggucuuaaauacauguucuaggcaaccaugcauuauuuugucauccacuuucauucugacaauaaauuuuaauucauguucuaaaacuagcauacccaaccaugauucuaugauuuagagauggcuuuugucuaagauguagcuguguauauguucagggucuuauaaaggaaaguaguauuuuaaauaccaaguacauaguacagcugauguacagacuaaagucauaaaaauaaaaugguaauugaaugacuuaaagcuuaaaaaaguacuaauaagauugauaucacguuucuuauaggugaacaaugacuuuauucuagcaauagagagagagucuuuuguggcucaagugcgggaaauuauugaaaaggcugaugaaauguuaagugaggaugucaguguggagccugagggugaccagggauuggagagucugcaaggaaaggaugacuauggcuucccagguucucagguagguucaccauacuuuuaguuaguucuguuuauuuaaaauaguucuguacugcuuaaucugccaaacagaauauccacugauaaaauaaugcccuugugucugagaaugaacauuuauguucucaucaaaugacaauaugcuuugcauaaucauggagguugcauuugagaagaguuuuacuuuugcuuauuguagaaauuagaaggagaguucaagcaaccaauugcuguaucuuccaugccacaacaaauagguaagcuuuucuuuuuuuauuugacaaggaguuguaugugcuaauaacgaacucucaaggguuuauucauauauaacaauauauaugaauuucaaugauuuguuuuguucagguguuccuaccaguucuuuaacgcaaguuguucauucugcuggaagacgguuuauagugaguccuguaccugaaaguagguuacgagaaucaaaaguuuucaccagugacauaucagauccagguaagaaugauucagccaugcuuuaguaaaucuuacagcaucucugauaugguggaagcuugaucaagcaauaauuaaugaucaaaucaaaaguagaaaauuaaaaguaauaaagucacacagaagaaggaaaugaauuauaauagagaauguaguuggacaugacacaugcacgugauuucauugcucaggagacagagagaagggggaugaucaggaggucagccuggguggcugagugacacuuugucuccaaaaaagaaaaaauagaaaagagaaauaagagaaagacugcagaccaugaaggaccaggugugcuaaacaaccuauacaguaguguguuucuguauuuagagguaaauuuuuuuuucagguuagucuuauguuugaugguuuucaagauuauguacucauaagcugccuuacuaggguaaacugcuccuuuacuguuuuacugcaugcuguuuccuugggagucuuacugauguguagcauuguugauaauccaauaaugguucuucaaaaacucucuuuuuuaauccauguguauauauaggcuaauuucuuuauuuuuguuuuccuuucuaguuguggccucuacaucucaggccccuggaaugaacuuaucucacucugcuucaucccucagucuccagcaggcuuuuucugaacugaaacauggucagaugacugaaggacccaauacagcaccuccaaauuuuaaucacauggcgggaccaacauuuucucccuuuuuggcuagcauugcugguguccaaacuguagcagcauccacaccgucaguaucagucccuauaacaagcaguccucuuaaugacauuuccacaucagugaugcagucugagacugcacugcccacugaaaaaggcaucgugggaguuaccacuaccagcacaggugugguagcuucagguggucucaccacaaugucugugucugagucaccaacaucuuccagugcgguuucaaguucuacaguaccugcaguugucacuguguccacaccaucccagccaguucaggcuuccacaucugggagcauugcuucaaguacaggcaguuuuccuccuggaacauuuucuacaacuacagcuacuacaauggguagugugguggccccagaugcuaagccuccaacuguauuauugcaacagguagcaagcaauacugcugggguugccauagugacaucagucucuaccaccacuccauucccaggcauggcuucacagccaucccuuccacuuaguagcagcaccucugcuccuacucuagcugaaacaauggugguuagugcacacucacuagacaaggcaucucacaguaguacagcaggauuggguuuguccuuuugugcgccauccucuuccuccuccucuggaacagcugugucuacuucuguuucucagccugguaugguucauccuuuggucaucucaucagcuguaguuucuacaccuggccucccccaaccaguaguaccuacuucuacaccuuuauuaccccaaguaccuaauaucccacccuugguacaaccuguuguuaaugugccugcuguacagcaaacacucauucacagucagccucaaccagcucugcuucccaaccagccucacacacacuguccugaaauggaugcugauacccaauccaaagcuccugggauugaugauauaaagacucuggaggaaaagcugagaucucucuuuagugaacacagcucaucuggaacucagcaugcuucugucucccuagagacaccuuuaguaguagagacgacugucacaccgggcaucacuaccacugcuguagcaccaaguaaacucaugacuuccacuacaaguacuugcuuaccaccaaccaguuuaccauuaggagcagcuggcaugccaguuaugccaguaggcacaccugggcagguuucuaccccaggcacacacgcuucagccccagucggcacugcaacaggaguaaaaccuggaacaacucccccaaagccaacuaagacugugguaagagucaucauacaaugacuaaauaaauaugauuacuuuucuuuccucucaauaauuacauguuuucagcugagucuugcaaguuaugaaggugccuggcauauaaacucgucucucagucuuaaagugacaacaguuuuaggaucuaaguauagguaacacaagaauguucucuuaguuuggaauguggcuagauuuuuagguuauauugaacaguuuucuuagaauguagaauuaucagguaaaauaaauaauggucaaguaaaauacagguuuuucccugggucuuaugccucaugucuauuaccccaacacuugaagacagaagguaguuacaaguuacaggaaagccugggcacuacaaugaguuacaggccagucuuggcuauagaauagggcuuugucucuaaauaaagaaauaggaaagaaaagaaaaaaaaccaagggcucagcauuuaagaacacugcucuuucaaauaacccaaauuugguucccagaagccaugugcagaagacuuaauaacaaccucuggaucugaccucuccuggccucugcaggcaacugcauucagaaugcucauacucccacaaagacaugcauagauauaaauaguuuaacaauauaagucuguugaaaaggacagguuauuucuacgggauugguagauauuaaagaauucuacaucccaaaaaggagcaaaauguauugaccaauaaaggaauauuuuaucaucuuuuaguugagaaugaauauuccuuauuguagauuccuuugauaaaaauugggaguuaauaaaaaguugaaguugggcuggagagauggcuaagcaguuaacuucuagagguccugaguucgauuccuagaaccacguguuggcucauagccaucuguaauggggucugaugcccucuucuggugugucugaagagagugacaguguacucguaaacaauaaauaaaguuggaaguugauaaaagugauugaaaaugaaagaggaaauaauagcauucuagaaauccaauaaacagaaacuauuuaauugugcuguugcagauguccucucauucugauaucuucauccucuuucugugccaauagaauaauauaauuuuaugccuuuguuaucagucaugaccuuuguuuauuucuaaaucugcuuguuuucuuugaaaugucuuauuuaucucauaugagcaacuucaaaaauuuguugguggcucuuuuuuuggcacuugaugccuggugcccaacaaagucagaaaagggcaucaaauccccuagaacuggaguuuugagccacaauguugauucugggaacaaaacuuggguucucuauaagagcagcuagugcucuuaacugcugagcugucucuucagccccuaacuguacucuuaucugucuacuuaaaaauuuuguucuuuuuguuucccuucucauugcauuuuaucauuuguuucauaguuguuugauuguaacugucauacuagugucuuugguauguuguccuuuaaaacagacugaaaaguguaauuuaaaugcuauaaguagacacauuuuaguaucguucugcuuuuaaauuaauuuuuucuuaguauauauuuuuuaccaaugguagcucauagacuugaauuuuccuucauuauuauaggugccaccaguggguacugaacuuucagccgguacuguacccugugagcagcugccaccuuuuccuggaccuucucuaauucaggugccaguaacuuaauaaauuauuuucuucaccagaaaagccccugcuuuucuucaccaaauuuguguaaauucuccauuguguuauuuaucuuggcuucuagaucauucuggcuaugaauuaguaauaacauucuuguaaacuuuucuuggcaggccuggcaugguggcacuugccuuuaaucccaacguuuaaggugguguguuaguuucaggccauccagggcuacauaguaagacccugccucaaacaaagaaguuaauaauaaacuguaucuggcuauacuagucagauggugagcucuggauuaaaaugagacacccugccucuauauaagguagaaagcaaucaaagaagacacucaagcuucuacacacacaguguauauaaguguggcccaccacagcaccacagacacacaaauaaaaugaaacuuaaaaagagaaaaaaaaaaguaaagcugagcuucuaagccauuguagaaauaaaaguuguacauauuucacucuuuguuccugaaucagaaaaaaaacgacccauaagucugcauucuugaaaucuuuagaacccccucccccgaggaagaagaagaacaucaagaguucuuccucacucuuccuuaaaacucuguucacuauguuuuaagaaagaaaggaacccaugaaccaggccuuguagaaaaauaauuuuaccacuuggguaggucaagaaaaagaauguagguaugagaacagcuggccauucccagagggagaagagaggaaaccacaugguaacugguacagcuuuccucugguguuuaccauuuuuuuucacuagugaaaugguugaaguacggcauggucauacuuaacaauauuuaaguuacucuuuuuuccuacuaccauuaccacugcauuuaauugcauucucaucaagaaagcaguucugagcccauuguaaacaugaaaaaaguucugaaaugaaaacaacaaauaaauuugaaaugauauuuguaauucuuucuuaaauuauguuuaagaaaagcaugacagauugcuuacaugagaagcccguuaugcauuuaucccuacuuauuugauccuaauuuucauuugaacaugauaggauaaguaacaugccacaaguuaacauaugaauguggguauauaauuuaacaauagauucugauauacuuuccagaauguauuuucauagagaaaccaguaaagucacuaacauuaaacauagaagauagaaugauucugaaacuacaaaagcauaaauguacuuggauuguccuaaggauugauagacugacaacuugauagauaauauuacuucauuauacugguuuuauauucaguauuagaacaaaugugauuuagagcauaaaaugauguaaucuguauaauuagcuauauauagugacacugaaggugcuaaacaacuuacaguacuguuuuugcuuagucccagcaaccacuagaagaucuugaugcucaguugagaagaacacuuaguccagagacuauuacaguggcaccugcaguugguguaaguuuuuaaauggcgaucaaaaacaaacaaaaagccucuuaagauugucuucuagcauaaacuaucaucuaggugauuauuaccuuaauucagaguccuugucagcaaaaugacacagauuuaaaagaguaacuauggaaaaagauaucagagaugcuuguuguuuuauuuauuuuccucucagcaaauuauauuguagcucaagcuuacgauuuugugcuuuggaaaagguuaauccucuaugacaauauuuuuauuagaacuacgguccagucagcuaguggacgccuaucucugugaguucaaggucagccuggucuacagauaaaguuucagggcagccaaggcuaaacagagaaaccugcuuuaaaaaaaaaaaaauucccuaauaaguaucuaagcuaaacuauuuaaauaucuugugagaggcacugaaaagauggcuuaacaaguaaguacaugugcugcucuuggaaaagaccagaguucaguuccuggcaccccaacucuagcagcucacaacugcuuguaauucaaccuucagggaaucaaaugcauuuuucuagccucuucuggcaccuguauacauauacaugaauaaaaauaauuuuaaauuuuuuugugcugaaaacuaacagaauaguaaagaaguuuuguuuuguuuuccuaaaagcugccuuucuuuaucaaaacuuuagguuguaaaagaaaaaaggagagggaaaaaaccccacuacauuuuuuguccauuuuacauagaugaaagguagcaaaaguugucagaaugaugaaaacugaagagucuguggucucuguguauguguuuugcagccuuugucuacgaugucuucaacaacaguuacagaagcagggacucggcuucaaaaggauggugagaugccuccuucuuccuuuugcuuuacugaacccagaucuaccuguaaaugauaauacaguuuacuacuuaaaggacacauuguugcacuuuugacuuauauauaaggauguuucaugacugaagaacauugcuaaguaauuucuaaaguaggaaauauuaguggacuaaugagucuugaaugauuauauuggggugaagaguuacauguaauaagcauuguguuauuuuauaaaauuagauccauuguuauuauuaaaaaacaauuuacaagcccaggugugguggugugucgcagcagaggcaggauaauucugaguggaagaccagacugagcaauauaacuaaagcaagcuuagcuacauagcuguacacugucucaagcggggaaaaggcuaggaguagucaguuuacagauaacuauuaaugauuuguagcacugacuauauagaaauauaguuuaucuggaagagccuguacauaacauuuguuuauugauaaaauuuaagguaaauuuaucaguuuagacauuauaauuuuuauuuucaaagcaauuaccuucugaauuggcucucauuaaaaacaguagaaaugaguacaacaguacagaaagucuagaaaugaacaaaguauagauuuccgauguauuuuagauguauugaauauauacaauaaaagcugauauuuaucucagggcugggaauaaaaucuacaggcacaaauccuuggggucaaucuacaucacuuaggguuuggggugacaaggcgugccaaauaagaaaacacuaggucuaaucccagaacucagaaagcuaagguaggaggauugccaugaguugcaagccagugugggaugcagugucagaccuugucucagaaacaaaacagggaagagaagcauguaaagucugagaaaggugguuuuuuaagccaguaaaguuuguuggagacagggucucuacauagcccugacuugccuggaacucacuuuguuaacaaggcuggccuaaaagcucauagagauccuccuaccucugucuccacugauucgaucacaggugucaagauaggaaauuuugauaaaugguuugaucaacuauguagucaucuguauaaugccaagaugaacagaguuuagaccaagguaaaauuacaaauaaacgucauaaaauaucacugauaaaaguauauguaugucuggcagugguggcacacaccuuuaaucccagcacuugggaggggagaagcaggcagauuucugaguucaaagccagccuggucuacaaagugaguuccaggacagccagggcuacacagagaaacccugucuugaaaaaccaaaaaaaaaaaaaaaaaagguaugaaaauaccauaagccuauucuauauauauuuuguuguuguuguuguuuuuuugagacaggguuucucuguguagcccuggcugaccuagcacucacuuuguagaccaggcuggccucaaacucagaaaucugccucugccucccaagugcugggauuaaaggcgugcacaaccaccgacuggcaccuauucuauauaauuaaggcaaacugaaaauaaugaaaccuccugaacuaauuaagcauaauauuuaaucuucuccucccucuccacucuccuacccccaacuaucuagagcagagucuaggaccauuuggguauuuuuuguuugguuuaguuaguuuguuuauuuguuuguuuuuuauaaagggucccauauagccuaggguagccuguaacuuacuauguaguuaaggauuaccuugaacuccugaaugugcuuccacauucugagugagcauuagugaugugugcuaucauaucauuccugacugaaacuuuuuuuguaaaggccagauacuaagauuauuaaaagggcuuuucaagucauacagucucuauucagucuucuguuauacucagacuuacagcaaguaagugaaugagcauggcugugugcaaaauaaauguauuucuaaaaaugguuaaaagcaaaauuugggggcuggcgagauggcucagcaguuaagagcacugacugcucuuccaaagguccugaguucauaucccagcaaccacauggugacucacaaccacccauaaugagaucugacacccucaucuggugcaucugaagacagcuacaguguacuaaugaauaauaauaaauaaaucuuuuaaaaaauuauuaaaaaauaaagcaauuacuaaucacaguuuuuacuaauacaaugaaacggguuaguaauaaguuuggugcacaacccagaggaggcaauaguagucuuuuagacuaaguuuuuuaaaaaaaaaaaaaaaucagaaaauacuuuauuguuuuucuggagagggguuauugagacaggguuucucuguauaucccugccugucuuauacuugguuuauagaccaggcugaccuugaacucaagucugccuacuucuuauaagugcugggauuaaagguaugcacuaugaaaauacauaauaacaaaaauauaaaacuuuauaagcaguuggauuuuucagacucaaggaaaaagucuguggcaauugguuuaguaacaucuaucaaaguugcaguauguagaccuauaaaagacuauuucucagacaacuuuaaaaauaugaagaaaggugaugguuaggcaggcagaagcuucuccuugcaaagccugucaaccugaguuugauuuugagacucacaagguuagaagaagaaaaccaacugccacaaguugacauccugaccuccacacauauucuauagaauacaaguaugcacacauacacacauacaaaauacauaaauguaauuuucuuuguguguauguguauuuaaagacaaaaacugauguugccuagugauaugacucaaggguugaugccacacaagccugacagccugcuuucuaaugccagaaucuacccuguguagagaacuaaguccugaaaguuguccucugccaugugcuguuguacaugcaagugcauacucacacgcacacaucauaaagaaaucauagccugccugccugccuucuugauauucuuauguuuugcaaauuguaucuuggguauucuaaguuucugggcuaauauccacuuaucagugaguucauaucaaaugacuucuuuugugauuggguuaccucacucaggaugauauuauccuccagauacauccauuugcccaagaauuucacaaauucauuguuuuuaauagcugaguaguaguucauuguguaaauguaccacauuuucuauauccauuccucuguugaggggcaucuggauucuuuccagcuucuggcuauuauaaagaaggcugcuaugaacauaguggagcaugugugcuuauuaccaguuggaacaucuucuggauacaugcccaggagagguauugcuagaucuucccguaguacuauguccaauuuucugaggaaccgccauguagcagaagauggcuuagcuggccaucauugugaagagaggcuccuuggucuuucaaacuuuauaugccccaguaaggggaacgcccgggccaagaagugggagugggugaguagggaagcagggccugggggaguguauauggaacuuuugggauagcauuuuaaauguaaauaaagaaaauaucuuuuaaaaagauguaauucaaaauguuuaaagcuucaaaggggcuggagugacugcucaguaacaugggaacuugcuacucuugcagaggaucugaguuaaguuuccaaaauccaucuuagguuauucacaacuuucaguaagucccgauucaguuggccugccgccaucucugggacuuacaaucacucacacucaugugaacaaacauguaaagaaaaauuaaaaaaaaaaaaaaagaaaccauagcaauaaaaacaaauguuguguaucugauugcgcacuuguaguuucauacauacuuggaagacugacacagaaagaucacguuuguuagcacacaaaggguagcaaaggaaucuucaaugucacauuacugaugaaauugcaaaaagagauguuaauuggcuuugucuuccuauuuucuuguuuucucucaaggcacagaaggucaugucacagcaacuaguucaggagcugguguuguuaagauggggcgauuucagguaagaugaccauuuucuuugccucuuuuggagacaggguauauaauaaaaaaaaaaaagauuggccaaaccugguggcaugggcuugauacuugauacuuuguuaagaaccugagcaggagggccaucaguucagggcauucuugggacuacugaguaaguucaaguccagacuuacuaagauucuuuucucaaaauuaaaaguaaaaagaaggcuaggacacuuaagaagcauauucaagaccuucaauucaauccccaccaaaaagaaauauauauauaugggacauaauacaucaaucuaaugaugcauuuuauuuuauauaccauuuuauagcucuauuguuuauuccucauaaaccauuacuacuaauuaaagaaaaugcaaacucauauuuucuuccaccuaccccuuaacaacuggcuauagcuucacaaauuaacuuuucuagauccccuuuuccaguagccauuugguuuaccuagacauucuuuuguuucuuguuguaauuuuccaacacacuaaggaaaguaauagcaaacaucuaaaaauaccuuccauauuuaggauguuuuucuuaggauucagccuucaagugaagucagcaucaagugguacuacauuuuauuuaccuacuuggugagaauuuuugaaccuuaguacauacaaaaccauuuacaaaaccacuuuaauuauuuugggauaguccuuggaguuggauauguuguuuguucguuuguuuguuuuguuuuuaauucacaaaccaaaguucuaagaguuugggacaugcugaguuuauaugaugaacaagccauggcauggaugaucuugcuauuauugauucuaacauuugaaguuuguuggauauuaucuauucauacaaaaccaucauuaaaauuugacugagacgugaauuugugugaugucacgugagagguaaaaaugaaucauuuaguuagcagccacugagaauaugcaucucaguacugaugcaguguucucuauaauagguguccacuuuacuucacacugaucaaagagacuaagagaagaaauuccacaaauucacuggaaaauaaguugauccuccuccuuuauucccugccccuccugaccucucuccccucuuuaagcuaagcucuacagcucgggcuauauguauaugagggugguuuugaauuucuuucugauccucuugacaccaccuccagaguaugcugggauuacagacaugugcuaccuucccugguuuacuuaguccuggagguuucucccaugggccucauuuauacgaggcaagcauuuggccagcugagcuguaucaccagcagauuuuucuuuucuaacugucccugcuaaaaauggaagaucugcuucucuacccaccccacucacuuuuguuuguuugacuuuggguuuuuuguuuuuauuguuuguucauuucguuuuugaaaaaagguuucacuguguagccuuagcuggcuuggaacuugcuauauagcccagguuggacuugaacuuaaggagaucuuccugccucuaccucuggagugcuaggauuaaagccuagccagggacaucauuuuuuaauuauacuucauucucuuuuucccaucagguuucaguuacaauggaugaugcccagaaagaacguaaaaauaggucagaagauacaaagucgguucauuuugaaucuagcacaucagagucaucaguucuuucaaguaguaguccagagaguacccugguaaagccagagccuaauggaauuaguauuucuggcaucuccuuagaugucccagacagcacccacaaagcaccuaccccagaagcaaagucagaugcaggacagccuaccaaggugggacguuuucaggugacaacuacagccaacaaagugggucguuucucuguuucaagaacugaggacaaggucacagagcucaaaaaagagggaccagugaccucuccuccuuucagagauucagaacaaacuguuauuccugcugugauaccaaagaaggagaagccugagcuggcagaaccuucccauuugaaugggccaucuucagaccuggaggcugccuuucuaaguagggguacagaggauggcucagguaguccacacucucccccucaccuguguucaaagagccuucccguccagaaucuaagucaaagccuuaguaauucauucaacuccucauacaugaguagugacaaugaguccgacauugaagaugaagacuuaagguuagaacuacgacgacuacgagaaaaguaagucauuuuuucauguaaaauaguguuaguaucuuaccugguauuaauagcuuuucaaugcagaugcuaauuuuacaccccauuugagcagaaagugauauacaaaagcuaaaauuaccugauacauuauucauggguaguccuguacucaccagcacccauggcauuucuacuuuugggaucucuuuaacaccucuauauuauuauuuuuuauuauggcaccuuuaaagaaaguuguuuauguguauguuuauguuuauguguuuugccugcauauauguauaugcaugauaugcaugccuaggguaggacaaaagucaguauaguucucuggaccuagagucacagaugguuguugacugugauguggguacugcaaacugaacccagguccucugcaagagagaaacugcucuuaacugcugaaccaucucuccagcuauguuaauaacuaacaacucuugguuguuuguuagucuauaacaugaaucuaauaauagcacuacaauauauaauuguggucaguuuuccaacuaucacuuggaucacauuagcauuuuugccuacccuuccuaugacuucaagucauuuuuuucuguaguaugcuaucaucaaggcuaggagcuugcuagaaugugucuuguguaauagagaccagcaaaaaugaauuguaaaaguagaaucucacauuuagcacuugacugcagauuuaagaauaugcuuuaacucuuacuucaacaaagaugguuaucuuuuuaucugugucugauuauuuuuuauagacaucuuaaagagauucaggaccugcagagucgccagaagcaugaaauugaaucuuuguauacuaaacugggcaagguucccccugcugucauuauucccccagcugcuccucugucggggagaagaaggagacccacuaaaagcaaaggcagcaagucuagucgcagcagcucauugggcaauaaaagcccacagcuuucagguacaacacccugggccuucaugucagucaucucaugucuguaucucaccauguauguaacuacuaaacauugguuaacuucuauuacauugcaaagguguuuagcuuucuaguauucuuucuuugaguuuucuaucucucguauauuuugaaccucuguugacacuauagaaguaggcuuuugguuuguuuguuuuauuuccuuauuuuuacuuauguaauugguguuacuguuuaucuuacuaacaaucuuuguuuaugauuauucuucagaauaaacauucagcucugucaauucauacaaugcaacauuugaucagacccuugggcauuuagaagaaaaaaauuauucucugucuaguuaacuaaagauacuuucuuuuuuuuuuuuaaauguauguauguauuuuuauuccaugugcauugcuauauagccugcauaugugucuguguaaggugucagaucuccuggaacuggaguugcagaugguugugaguagccaugugggugcugggaguugaacccagguccuuuggaagagcagccagugcuccuaaccacagagccauuucuccagccucaggauucuuucuuuuuuaaaugucugugaauugaccauaauuuuaucaacuuaauuuagcugucagagacuugggugugccuaagugguaauaucguaaaugaaacuuugcaucucauguaccugucuuagaauaaagaacuggauggugacucuaaacaaagauacaaaaucauaacuuuucauaauagacuaugccuauuucaaugggauagaaaguuuuguccuuguuguguaguguaugacagcuaauugguuucagaguuaagagaggguggaaaguggauugauuuucacauuuguucuccaggucuaguugaaguauggaaagcauuuguaaguuucuuaccugcucuauuaucuaaaaaauuuuuauaguuauucaaacauuuucuuguguauuugaccaguuuauucaacuuuauaucuguauaggagaguggcuaauucagacucagacucuggauaugacauaauuuuuagugcauuucuuuuuuuuuuuuuuuuaagauuuauuuauuauauccaaguacacuguagcugucuucagaugcaguagaagagggcuucagaucuuauuaccgaugguugugagccaucaugugguugcugggauuugaacucaggaccuucagaagaacauucagugcucuuaccugcugagucaucucuccagccccuuuuuauauaucuuauaucauguguauuuauuagaaaauguaagcagagacuaacagccuguuuguauagucaccaucuuucuaauaggaagaaaccagugauuauggaaguagaaauggaagcucuguaucuaucuuagucuaauuuacuguacauucugcucagauuagugagcucuacauguuaucuaaagcuaucauucuugaggagcaauucauaauaacucuauguuaauaaauuuaucuuuucugaccuucauaucaauaaaguuuuuguccauuugucauuuucuggguuuauuuuauuuaccacucaguacaaauaggaaacagaaacaauaaguguauuuggaaaggcuuauguguuguuuguuuauuuuuuuauuuccuuuuguuuuauuacuuauuuauugaagauauggccucauguaucccaaacuagcuucauacucacugugcaguuaaggaggauuaccuugaaugccuaaucauucuuccuccccuuuccaagugcugggauuacagacaugcugaccaccauacccugguguauauggugcuagagaugaaauccaaugcuucacgaaugcuuauugaauuaaaauauagcuucagccccuucuacaugauuuuccaugcuucucugucuuucaacaggcaaccugucuggucagaguggaacuucagucuuacacccccaacagacccuccaucccgcaggaaacacccccgagacugggcacaaccagcuguuacagccucuuaagccaucucccuccagugacaaccucuauucagccuuuaccagugauggugccauuucaguaccaagccuuucugcuccaggucaagguaagaauucaaacugaccaccaauuuccagaaacauuaaaauagaaauauugccauacuugguacaaaaggaagaugaauagcuuacugccaucagcugaguagaaagagucugaguuguuaagcaaugacuagccauugaacuuagcagaaaaacugaguagggauuagaaccacugaccugcuugcuuccagccaucugauaggauagcuucuuguuuguuguuuagacagcaccucauuuuauagccuagacuguacugaucuguaacucaacguggaacccggcuaaccuggguccuuccagaaguccucuugcuucagacucccacaagcaugaauuuacaugaauuacagguguaagucaucaaacccagcucugaaauaacuuauuuugaaagaauaaccauuauaccugcagccuauauguauagcugauuuaagacuuagaccuuaaccuuucacccuaagccaagacuuguggacaaaauucuaaggaguugcuggcaguuuuuaaaaacuaaugugguuuuuuuuuuuuuuuuuuuuuuuuuuuccaaugugcuuuuuaaacuuccaagcaugauagcagcauucugaaaugacuagcucuaacaucuuuuuuuuuuuuuaauacauagugaacauugauuuagaaaauaagaaaauuucagagagugggacagggucugagagcggaauaucuuaagaucaaauucuugauccguacucuacuuaccaaaauacuguuuuguuuaguauuauucaaaacuuacugcauggagcuuuuaguaacuaaaauugagaacugaaaggagagacuauguauaucaguaguuaagagcacuagcugcuuuugcagaggaucuggguuuaauucccagcacucacgugcaggcucccagccaucccaggggaucugaugcucucuucugaccucugauggcagugcauguauauggugcacagacuuucaggccaaacacucauacacauaaaauacauuuuaaagauugaaaggaaagccagguauuguagcacaugauuucgaggcugaggccaggcugggcuauaguagugaaaccuguuucaaaaaaaaacaaacaacaacaaccaaaaaacagaggaguuauuaauagagaaaaauugaaaugaauuggguguuuagguagaaaggaguugggggacagacuacagaaaaguaagugccuuuugcauaaaaucuaaacauuccauuuucccuucaccuaguuaauguguuugcuuaauaagaauugacacaaaguugcaagcauuauuccaaucguaaaaaagcgucauuucugccaauggagugaggucuggcgucucugucucauacagcagauggacuucccugcggaucuugcucuucuacaugccauccagugugucaccacuccagccucaagcucuaacaucuuguaguuguguugucucuucuccucucuguucuuuccuuuucccuucucacaggcugugcgaaguuuaacugugcaucugagcaggugacauucaaaccugguggcaggaggacccgauuucugaguacgcccugcuuggcucuuuguguguaacuccuuuacuccuuccuuguccuuguuuuucugcugcuuuggaucugauuugucacgcaguccauuuucauuugucuuuauauuucaucuacucaguggcuuggcugauuguuacccucagaaguuuggguccccauuguuaggcugcaauacauagccauauucugugacauuaguggugguauguacccaugaaucccauguuagggaaggaaaagcaaagauugcaaguuugaggccagcaugaacuacauagcaagucucuuucucaaaauuaaaauuaaaaagaaagacaguaagcauguuccuaaccaauucuuacuaaagauaaaaauaugccuucucaauuaagccugaauauuugcaaguugaauagauacuagaaaucccuuuccaucauuaccaacuccgugacacuaaguaguucaaagaacauuuaauauaguuaccuugacaaagcauuuauucuuuugaagaccaaagcugaaguccauagcugaagaucugcaaaugaaauuuguuauuuuaauauuaauagaacucccccacuuucuguuuaaaaacaaggugcaggaagcuagaagaauaccucaaaaaguacuuacuauguagagagccugagugugaucccuagaaacuaaguuaaaggcuuagcauauuggcuuguacuugugauccuaguagcagcaaaguuggagaaagcaucccaggucucacaagcaaaucaguuuggccauguuaacaagcacugggccaaugagagacccuuccucagaagaaaacuggguguugucaugaaaacccacaccugagccuuuucuccaaccuccacauguaccaauacacaagagagcacacaccaaagagaaagguacagugcugcuggaaagaaggcuggagaguuaggagcacuggcugcucuuccaguggacucagguucaauuuccaacacccauguggcagcucacagcuuucuacaaugccaguucaacauccuccucuggccuuagaacaccacacacaugagguacacagacauacacacaggcaaaacacccauauguguaaaauaaaaauaaauucuaauuuaaucacuaauaauaaggugacacaagagcaaaugcccuaucuugucuucuccagguaaggaauaaauagucagugcccacuuccuagggcuacugugcaauuuaaaugugauauuguuuauaaaaacaucugcuacuuaguagguggccaguaguguauauugaaagaaaaaaauauaaaagaaaaaccucaaguaagaaaaagaacuugauuagaguuugaauaauuggugaaggccucaaacuucuggagugguuauuagugcuuuuaaaugcaugugcuaaagccaucaguguuucuaaguauggcucagggaggcuuuggccucuucauggugggaagaauuugcucucugcucuguucuugugccuuuguguauuagauuuaaccucuguuucgcucacugacauauuugucauccuucuuccccuguucuuuuuuuccugaguuaguuauggauugcuucugccuauagccuucucuuaccacauucccacacaugucagugguccagggcugggcucuucaacaaaguggcuggagggcauuguccauuuucguaguuuccaagcauguauaauuuggguaugcauuuauuaauagcuucuuuuuuuuuuuaauuaggguagcuuugacuacauauguuauuagcacauuugaauaagcauucaauuuauguguccagcuagaaagauuaauaauaauaguaaugauaauagauuauugauaauagaguauuauuaauaggguauuaauaaaugugacaugccaggccuguaauacacagccugauaaguuugagaagaaaaaagacaaagcaaggcuuccuucuauaauaucuguuaugcaccauuugaauuaauuuuguauuucacagcauacucuuaauuauaggcaguauuaucuguuugaaaaugaaaggccuuauaccuauggaaggugcaucaugguaugucguguaaaacugcuggacaaauccuaggaggcagaauuuuuaaaauacauagaaaacagauacuugaaagcgugagggacccuuacuaguuuuggauacauuauccuauguucucaaaauaguuuggaagcacggcuuggcuuaaugcuuuaucuauauuuaaagguugcuuguuuuccacauacuuuuaaguuguuucuggaagggauggggcacauugggggaagcgagagucuguguguguaguguaggaguguguguguguguguguguguguguguguguguguguguguguguguaccuaggauguggaaauauaacaaccaguuuaaauuaacuuaaagcuuuaacaauggaacugauuuaaaugcuuuauaacaacccagcaggagaaacaggaaguaggacgagaucaauggaagcacugcuuggguauuugaaauucaagcagugagaccaguuccuuccuucucuagagccuuagugccacauuauaguuuagaaauagauuagguguaaaaguucagcaucugucauccaggcuuuagaguccaccugauaauuauguuaauacucaagccaguuugacuaaucuauagacuugaauuuacauuuagggcuaccaggucccacccagcuauguccccuccugcuuucucuugcugggcuucugugugcuguuuggagagucuguaaagauuuuacacugauauuucuuuaacacacugcucucucuuuaugcuucagggaagauggugaaaaaagucuguccuugcaaccagcucuguaguaauuaucuuuucuuucuguuacuuuugguccugauugcaaagccaugaguucuuugaacucugaagccucauuaacucccuguuuccuaauuuccauccauuccugcacccuuuucugauaugcuuaauugccauauuuaauuacuacuacuuccaguuugagaaaccacuucauaguuagugcucuccugugagcccagcuggguuagucguggauccacugugauggagggagccuaggaucuguacagagggucucugaggcagggagcaugcucccaccacuguuggucacacuggaaacccagcgaugaucuagguguacagacagccauguucucaucucauucauagcgcaguaguaguuguugcucagcuaguagggaaaggagugcugcuuguugguugguagagcuuggcuuuuuagccuagggguuucucauuaaaauaaagcgcaaaugcuaagaauuuaguacucaacagguuauaagaauauagagaguuaacaagaaaauucuaugggugggauuccuuggcaguaaauauggcuuauaugauggcugauggacauguauuaauaauggcugauggacaugucuuaaucugacagcguagggauaggagaaacuuagaagaugaauuuaaggaaauaaaaucuaucauauuuuauaaagcuuucagggaacugaaaacauuuuaaaguaaccacaccgcagaaagccuguuaauccuacuuuauagucagaaacuacaauaaaaagcuaacuguagggugacgcucacauguacgguaaagcucauuuuuagaauacaguauugaggaauauagacuaaaaugaaugguguuuaguuuuaaaggcccucacaacaucaagagcaugagacuagagaagugucaccucuggcaugagcucucugacaagcagugcucacccugccuuggcuucucaucuggcaucgacagcucugcucacuuguggauauuuuuauuguuucgaucaucuggccugucaucuagcaggaugcuaguccucgugcaugccacaugccugcuuucuggguuuccucacuguuguaacugcccaucucacagccugugcuuccuucccacugcaccuuugucccacacuugcuauucaaggaaggcuguuuccugugcuuuuauacuuucccacuugguuuccuauacuguaggugaauuacucuaccuuuacacuguauaguaacaauccucugcaguuuuagcaggcaccaugugacugcaacaauucaugucuugccacagcaaccaaagaagcaugugagcauccuuauucugcaccuuuacccaaguuagcuuuccucuagcacagacaugcuuuuagcuagagacauucccuuugugguaaaauagauacacccuuugguaccaacaguggauugcaguaggguugcuucaggugugcugcugugcucuggugugcugcuuuggcauuuaaaagcaggaaaacgcaugcauuuagucccagaguuccuugaguaugguaggaccuucuggcucacaacauuaguaaccuuuauuuacuguguaguaaauguaaagucuacuaauuaagugggggauaaaaaccaaaaauaagaccaugacucuucuuucccucuucccuaaaacuugccucuacgaauaaccuucagugugcccuccagcugaaccgaaaucaggcaggacacagacuccuccuuucuuuuucaucaaaccauagaaauagaaauccuucaucauaaccucuaugccuucucuccccucugcaccccugccucagcugcauuuuccuguugcuucaacccaggagugcuucuucuguugggaagaauggggagaagggaugagaauccuugaccaguuaaaacccaaguccucaagaagucauaacuucauggagcugagaauuucaggcauuucugcugcugccaaaacucaguucuuuauucaugggacauagagaggaguugaagccucgacuccuuccaaauuuauauuuucaaauuuauguuuaugguuucaggugaaaacuuuuaaacaaagcauguagcaucuccuuauuucuauuuguuugaagagcaucuaaagaacgaaugccacagcauacaugcugucuggaaaccccaucuuuuccacagaagcccugaucucugccuuuguacuauauaacuugcccagugcacaguacuucuuuggcccugcucucuucaaaguuccauagcagccagccccguggaccauaucacucccucaucaguauguugcugggaauagaauacuggcagacagucccaguguuagaaaaugcccuucccuucaugccugccaucacuccauguuguuuagccuuaucuacaagcuguggaagagaaaccauuuucacuaccuguugugcaaaagcaaauggauaaguaauacuucaaaaucuuccucuccugcauggcuucccaaauauucuccccauuccguggcuugccaaucauuacccuaugacauuuuccccuuuccccaaaguuauaucccagaacccuacuuuaaugcuaauauuguguuacuuauaauucuagggaccagcagcacaaauaccguuggaggaacagugaguagccaggcugcccaggcucagccuccugcuaugacuuccaguaggaagggcacauucacagaugaccugcacaaguuaguagacaacugggcccgagaugccaugaaucuuucaggcaggagaggcagcaaaggacacaugaauuaugaggugagucuucccuuuuccuaaccugccagacuauacacagacaugucauggacagccaaggcugguaugccauccuuaccacuaccaucuucaguagccuguggauucuauuauugagaaaacaaggcagcaaucauuuugguacccuuuuucuucaacauccugcacuaccugcaugugcacauaaaacacaucucagauccuacuuuucacuccuccuuguuaaggguaaagccaauaaauaugggcggcuucguuauauuuugauaaugcuaagauuagaacaucucagcucuacaacagcauuauaguaucacccauuuuucaucaaauucucauugcuacuuucuuguuuuuagggcccuggaauggcaaggaaguucucugcuccugggcagcuguguguucccaugaccucaaaccuggguggcucuacccccaucucugcagcaucugcuaccucucuaggucacuucaccaaauccaugugucccccacagcaguaugguuuuccaccugccccauuuggcacucaguggaguggaacaggugguccagcaccgcagccacuuggccaguuccaaccuguaggaacagcauccuugcaaaauuucaacaucagcaauuugcagaaguccaucagcaaccccccagguuccaaucuacggaccaccuagucagcagcaaggauguuaacugaguagauuugggggcaggaaauggaaugcuggggggguggggggguggggaaguagccuauauacuaacuacuagugcugcauuuaacugguuauuucuugccagaagggaauguuuuuaauaccauuuugagcccucagaauggagaaccacccuccuucuccguuuguuggaguuaaaaaagaaggaaugaacagcuuucugguggaggggcugcuugagacugcuuuucuguuuuuguaccccucaguaaggccuagaacuagaagagaaccuuguuaccagaaagccccaagagcucaauguaagccaaacccgaucuguaucuguaagugggcagagcucuuuaauuuugacaugugucccaaauuccuuauucccucaacaaugcacaccuuaagacaaagguucucucccacucugaucccuacccccacuuuuucccccccuuuuacaaccuagugaaaaauaccaggggacugggguugcaacccuuucuuacauaggucauuaaugcuuuaagcaaaagauauuagcagcuuugacugcagcauuagcaauuagggaaaacaauaacguucccugcggacauguaacuuugccaucaguuuugauguggaaacacugugauauauaaauguuguuggacaacauuaguuuuaagagaaaaauuugaaagguuuaaaagguucacacacacacaaaagcuagcucuguccuuuacuuauuaagacacuuuaacuuuuuccuuuguauuuccauuguauuagauaaauaaaugugaauguaaaauuguauaaauuacuguacuugaauacuucuguucucccaguauugcuugcuggauauuuuagugccuuggacuucuauugcuucugcuguuagcaucaacuuaccagaccccaggucaccaaaggguauguggaaagaaaucuuagguccacaugaccccagcaguggauaugccaaagggaaaaugaaaguguuuuugguuuugguuugguuuauuauuuuguuuuguuuuguuuuguuuucucagucguuucaauuuugccuagagcagguguaaggugagcacagugaaguuggcaucagugguugaaaacaaaguucuguuucagaaagaaugaggaggguugugagcugugugugaaagauaaggacugaagauguggggacaagcuuguuugaagugaugcuuggccagugaacaaacgagaucuagaagagauuaaacaaaaagaggggagugggcuagauuuuaaguugggaaggaugacagugccaagucacagauggaaaauguugcucuaaggaaaccugcucgguugcccccaccucuuguugcacaaguaccaccacacuuucucugcuuuaaguacuguauugugggaauucaacccacuucuaacuuucuaagcauuguaggaaaaagugcuuauuuccuuuccuagcuguccaaaugguugcacagucagaaucuauugugcugccuguacuucuauauuagagcuaauacucucacauuuucauacccauauccccaaauaacagcaaccaaccaguauuaucugauuuucuggcaauagggaccuaauuggcuguuugggaucugaauauucuggaaaaguggaaaaaguagaacucauuucuugggugcuuccuccuucaccuugaguugggaacugacacauuuccaacuuuaugacacaucccaggaguugccacacuagcaaggcuucuuccuguaagagucuuguucuuuuuaaguuggucgaggcccaaagauacaagugagagcugaaaguuucaggagagggaaguguaaugagcagggcuuuuguuucaggucgugcuaccaaaguguugacucauuuauuccuuuugggagcgguaagagguacugugggagugaagcagguuacaggaugacugagugcuucauaccagcaguagagggagccaaaugcagcaugugguguuugguuuagucauucugagugaggucuguucccccuucacagagguuuacuuacuguugguuucccccuccuguggaugaaauaacugaagccuagagaaacgagcuagugcuacugaacuguuuaaauuauuuuuguguuaauaguacacuuugaguaucuuuccacauuuaaaaagaacuuuccgaauuauaaauguuuuccuuacguuauuuaacaauguacacuguuuaaaacugaauucaaaccuugggguuucucagcagccguuaccuguacauuugcacuaacuccgggggcugcgcuucuguaagauugcgcuuugugcuucaguuuguuaccuuuguagacuuauuuaaugaaaccauucaaauaaaccaaacuugcuuuuguugaac

SEQ ID NO: 3337 - RNA, 92646 nt, Mus musculus
cauggggagcccccgcgccgcguugcugaugcugcuccugcgcccgaucaagcugcugaggaggcgcuuccggcugcugcugcugcucgccguaguaucggugggacucuggacucuguaucuggagcugguggcgucggcccaggccggcgggaacccccugaaccacaguaaguagcgccggggggcgaggagguggcggaggugggcgggcgcuccgggcggggacccgccucuccgagcugauuccaggugccggcgccgccccgcgcuuuccuggggaccugggcuugucgaggccacugugggucgcugauccuggccugcccacucaggacagaguggagccgggacgcucucaggacauccggagcgcugguggaggauuggggcgccuuccaccgugcgggagccacagccucgcgggacagagcuguuugcgagcgcgggcucuggggcugcggcgcacucggccacacgcugcgaucagagccuccccaacuuugcccucggcuugcuggagugguuggcucgcuguuuccccuccagccgagcuuucggggguuccuuuucaaaaagcaccuccgagagagacgccuggccuucccgccuugcgugcgccucuuuuuccaagagucccaccuccugaaugcgugguucucugcugguccagacugccuccuccaguguuuucacacucuccgcaauacccacagaucuaacaaacuccccagaccccgcccaaggcgacccugccaugaguaaauuccuacuuguauuuuuauuucaucaaagcacucaaguuucugcuuaggaaaaggggaggaaauggccuauccccucuucaauggauaugauuauuacccacagugacuuucaguauacuuuugauaggcuuaauaaaauuaaaagucaucuaguagccagaaaggaguggagaaguuucgagaagggucaggugcucuucuccagccuugagggggggggguguggggggaaguucuacuucaucuucucacugggucucacuuuccugcuuuaagaaacucaaagacuacccuccugguagauuuuuuuggccaacaguuuuucucuuagcuggaugugaugguuuaucuuuuguggcucagaagaagaaaugaguguccuagucaguaacuaagcaggaucgguuuggagauguacucuuauagcccuaccucucuauggcuguggacacaauucuggcugugaacuagaagaugcuguuacaagggaucaagcuauggcuguagcuagagaucaagaggcaagaggaauccugccuacauggucuccagggucccucucaguugggcuguggagauuguauggccucugacacuugaacauuuccaacgugagagagccccuacuugggggaagaccgaggacgguugcacucagccacaagcauguagucuuacaaagaagucuuccuugccuugaccccacucuuccuccucagguuuuguugcagguagcugaauuuucuuggaguguguaacggugggagguguggauucaucuuccuuggaaggccuuugccagccugguuagugggauagucuacauaaaauagacagggaagcagucgcuuugugauccugaagucaguggcugccuuugcuccuuuucgccuguccucugccgcaggugucacgagucucuucugagaccagguccagguggccagaauaauaauaaguugcacucuggcucugggucucuggauccugccgccuucuucauaccagacuuguggccuuuuuaaguuuuuauuuaaaaaauuauuucuuuuuccaaaccgacccuucuccaaaaauguguucucagugucuuauuccaaaauugacuuaguguuccuugugguuucuuucuuucuuuuugagacagccacucauucuguaucccaggcugcagcaacuugcaggcugggcuugacuucaaaaucuuccuuccucagucucucgagugcaggaggauuauggggaaugccacacauagccugucuuccuugugauaucugucugucugucugucucugguuuuucuuguuuaaaaagguuuauuuauuauuauuauuauauauaaguacacuguaggugucuucagacacaccagaagagggugucagaucucaauacagaugguugugagccaccaugugguugcugggacuugaacucaggaccuucggaagaacagucagugcucuuacccacugaacuaucucuccagccccucucucugguuuuucaagacaggguguacuuugccuguccugggacucacccuauagaccaggcuggccuugaacuaagaaauccaccugccuuugccucucaagugcugggauuaacagugggcgccaucaugcccaguuuugcuugugauuucuaacaagagccuaaagaucacugaggaucaguuuccucuucuuagauuccuaggauccugagguccauccacugggaaauguguccugauccugccuugauuuccuuauggggugggauuuagaguguggcuguauuuguucccauuauuuuucuuuucuuuucuuuggcuuuuuuuucaggacaagguuuuucuguuuauuucuggcuauccuggaacucuaagccaagcuggcaaugagcucagagaucugccugcuucugccucccuaccugacucuguucuuuuuugucauuaagaagugcagguguuuugcauaaaaauucccuuuugugcugagucagagcuaguccucaggggaaggggaugggauuaggaauggagaaguaggaaggggauugugguguuuccuaguccacacccugcauacuagcugcgccagagucggaaagcuauuaacccccccccccccaaaggauuguacucuggucuugaccacagccaccagaaccccagcuuggccuguuucccaaugagccaccgugccacuuucuugcaaucucugccaacucaguccaccacccgccuuccugucaucuguggggcuggcuuccaucgcccagaaccugucauuugcuuguucccaugugaggguauaucgguuucgcacugcaaaaguguauagagaauggcagucacaaacucuaggguggcaaaguaaugacaggggaguacacuuccugcuccaucuucacaaaauaaccuaguaguuuaagauauggauggugugcaauuuggacuccauaugcagaaaaagauacaaccacaauugggagcccuguaaaggaaaacaacuauaaucauuaacaaauagaaaagggucccuuggcugaaagaguuacagccauucacucuguugucuguuuaacacauugcucaagcaaagcacugugcuaggucauuuuauuaaucaauucauuuauuacuuuuccagacaggguuucuccaugucgcccuggaacuagcucuguagaccaggcuggccuugaauucacuaaaaucaccuaccuuuaucuuuugaauguugggguuaaaagugugugccaccacuaccuggcugugcuaggucauuuagauaugaugaccaagauguggugucuuaauuaggauuaccauuguuaugaugaaauaucaugaccauaaguaaauuggggaggaaggguuuuuauuuggcuuauacuucuacguuaaucacuaauuaagaaaaugcccuaccggcuugccuacagccuaaucuuauagaggcauuuucucaguugaggcuuccucucugaugacuacagccugugucgucauugacagaacacuagccagugguguguguguguguguguguguguguguauuuuuuuuuuuuucuauaucuuucugucuaggaguagaacaaggugguuauguggaaacaaccaaaauacaaaacauuaaguuuaucuuuuucuuuuucuuuugcuuuuuuuuuuuuuuuuuuuaagauuuagcacacucgcuuuugucuucagacacaccagaagaacagauccaauuacagacaguugugagccaccaugugauuguugggaauugaacucaggaccucuggaagagcagucagugcucuuaaccagugaacuauuucuccugcccaacauuaaguuuuucaaaaguaggaaguagauguugcugugauaguucuggaaaugggacacagcuuucgaguaauuucauagaaguggagacauuuggagagauggugagcaguugguaagauucugaugacuugaagcuggagagauggcucagugguuaagggccuuuguugcucuugcagaggaccuagguuugguuccuagcaucaauauggauuuucauuccaguacauaggaucuagcacccucuuuuggccucuaccaacacggcacgcccaugguguacuuaucuugaugcagacaacauacacauaguuaaaaaaaaaugaugaacggaggcuggggauguagcucaguugguagugugcuugccuagcguacacgaagcuccguguuugaucuuuaggaccauauaaagcgggauauggcgcaugccugucaucauagcuauucauccaguggagauggagggaggaggaucagaaguucaagggcaauguuauauacuaacccucuuuaagaccagcuacaugugcuacaugagacccugccuuaaaacacacaaauugaaauggggaaaaaggaggcucugauggagggcagaaaaaaaggcuacacucaagcagcaaagaccaggagucgggggaaaguuaguacuugggaauacagagcagcugagugugguaagacagaggguauguaguuaaaguaaaugaaggaggaggcucaacugugaagacuguugggccacuugcagaaggucccagcccuucugcaagacuuugaaugacaacuggaaaagaaaacagugucuaguaccggaaagcagaaaaacagguauuaguuuuagggugggauagcauuguuguguugaacaggcaagggccaucacgaaucuguucaauaaaacuuugaggaugggaguggcugggacccggucuuauggaacagagcuuccccauaugaauccuuaagcugcuggaugguaaaggcugcucugggugggucaucauaguaguagugguggugcucagaggacccuuggugaugguugcauucagacaugauuucaguauucuaguaacugcuguguacuggaugaauagcagccuagggagcugacuguuaaggguucucuguucaggugggcuuuaacaaguuguauuuagacuggaguguggugguacaugccuuuaauaccagcacucuggaggcaggggcagucggacagguggaucucugaguuucaggccagccuggucuacagagcaaauuucaggauagccaaggcuacauggagaaacccugucuugaaaacaaacaaaacaaaaaccaaccaaccaaccaacaaacaaacaaaaaccaaguuauauccauuuauucauauugaaucagguaagguuugccagaaggcagagguuguacuaaaaugguuucuaggguccuuuauauaauggacuuacaguuggagucaaguuggagacaagagguaacaucugguacaaagccagcacaaagagaugguguccauaguacauacuggucauguuucuauccaaguacaggauuuacuugcuaaacaccaaagugcucucacgccuaggaagcugauugucuuuuguugccucuuugaccugcuccacauuucuagcuggcccuugggaugggcuugaguacgcuaaggggagggacacccacugacgucuggcagaccuuaucaccacagccauuguacuugauacagacuuccuguagcauagguaaccggggauggagcuguaacccgagaagcggguggcagggagacacaacuggggcagauguguggacaaaggagggauaguauggcuuggagaggcaucucagcagaggagaauucaacauggugcggcuccugcugucugacacacuguucuuucccacuggaaaagaaagagcacuggcucuuuuucuugugcccugcuugccucucuguacuuugacauuuguuauguuaccuagcugcuauggccuccuucaaauuaguacucagaucugggcacauauuagguacuugcuuaaacaccuuugguaagcaguucuuggagagauggcucaguggugaagagcacugacugcucuucaggaggacccggauucaguucccagcaaccacauggagguucacacugacuguaacuccaguuccaggagacugacaccuuuauacagacauacaugcaggcaaaacaccagugcacauaagaaaguaauaaauuauuuuuaaaauacaucugguaaccacugggcaguuccagcuuucaaagcaccugguaguuucuauuagcagacaauuauuuaucagugaccaacucaagaauaaaauccaggaauuuuuguucuguguaccaucauuuacauaaucuccaaugccuucaaagauaagaaucuccaaugccuucgaauauggaugucagagauaagaaaucaacuaugccauugauaugaaugucaaagaauuaagcagucaggagcuggagagauaguucaguauauaacccuuguugggcagcucguaaugucuguaacuccagggggucagagccucugaggacacuagaacucacccuguacauacacauagacauaaacgcacauaauuaaaauccuaaaaagaauugugcuguuucugaauguugguguuuggcagggagaaacugugcccuuacucgugucugccuuccaccuggccucugccgugccuguucugauggagccaguggauaucuuggcaagacaucucucuguuccccacccagggauccuuaaucuaagugugguggcacuagagcugcuggauagauacuccguccuuguaguugcucggggcacgauucuccuacuuuccagcacaaggucucccgaacuaaccgccucugugcugguucauuggaggcuggaaggugcacugcaguaauuuuccaggccacagaaucuggccuggcccucuagugcugcgcuuuauggagcagagcagagcagccgccauggaguuugcuuuggaagggggccuggaggcuguucuuggaguugcugcacagucuagugucuacccucuuccaccagucucaaaccucucccccuuaagaaacuucccacuagcgcuuuuucuuguauccuaccacgaugagauccaaaccgggccaaccauacauuuaagccgaaagucuuccuuugaccuuuugaucuaccuaauugauagacuuauagauucgcuaauacaaaagaguacugcugggacagaugagcuuggaugacguccuuaaaggguguucgacugaaugaauagauugugaaguccgagcaaggcgugacggggcuuuaacuaaugauacucauagguucugcuuuuuuuccccuccucuuugacgugugggguuucgagugucccaggcuagccuccaauuccugauguagccagcgaugaccuuaagcuucugaugcuuuugccuuuacuuccugagggaaucugauaccugggauuacagacaugcccugcuacacccgguucuuucaugugguguggaggguaagccagggcuuucuguguguuagaugagcacucugccgacagcuaccucucuggcacagguuccucaaagguuggaagcauucauuggauaaacaaaaaugauuauguuaauuaauuauuuuggccaugcugggguuugagcuaagacuuuguaucauuauaccuaaauuccuagcuuuuuuuuuuuuuuuuuuuuuuuuuuuaaagaugucuucccggcaagcuuggucuacagagcaaguuucaggacagccaaaacuacacagagagacccugucuugauaaaacaaagcaaaaauauucugccugccugccuaccuaucuaucuaucuauccucucucucuuucucucuuucucucuuucucucucucucucucccucucucucucucucucucucucucucuaucuaucuaucuaucugagacaguuucacuuuguagcuuuguaguuccagaucaggaacucucucuaugucgaccaggcuggccuugaacucacagagauccacuugccucugccuccuaaguccuggguuaaaggcauguacucgagccacuauguccagauuuuuuucuuauuauuuuaucuauguguguuuacguguacgcucauggaugccauacucuccuggagcuggaguuacauacaggugguuguaagcugucugaugggcuuuagaaauccaaccuggauccuuugccagagcuguauacauacuacugagccauucuccagcuuguaguuuuucuuuaaaaccuuuugauguaauauauaggcagacagacagguaggugcgcgcacacgcgcgcacacacacacacacaaggagggggugcucuguaaguguauaguuugauaaacagugugucuggguagccaaccaugaugaagaaacacuaauucuauaagaccccuugggcuucuuuuugaaucacugacaccagcauggauaaauuaaucuauacuggucuaaauuaagacuauuuucuauauaucacaaauggaaucauacaguauguaauuuguuguauaagcuuuacacacacacacacauuacuuuaaauuacuuuaaagaguacuaauauuacuggugugugccaccacaguugacuuuaaaauacucuuaauaacucuaaaaauaaugaguauuccuuguccccaugacagcuuauagcuggaguacauaauugauguaacaucgucaucagaggcuaaggaaggcuggggaccccacugcugugagacacagcccuguggauuccccaccagggcugcuauggguuuagaaucgggggcuuuuugcuuuuauuguguaugaacccccccaaaauacuucuugauacuagaauagguguguuuaucuugagcaguuuucauuuguuuuuaauggucaaguuaguggccuugguuucucccuuuguguggguaucagaaaaccuuagaauuucuuucuucccauggagaaaugcauaagggauuuguagucugccuucccucccuuccuccuucccuccuccccucucccuuccuucuuuucuagcuuccuacccuucauaguguuagggauggagcccagaaccucccguuuguuaagcgaguguucuacuccugagcugugcucccagcugcagaucuguauuucucuauuauuuuuaugccuauacuaauuucucuuuugugucuuccagcuacuccugggcuauaucaucuuaacagccugugguucuuacaagccacuuaacuuaaucaaggcauaaaagaaaucaauaaaaguacuacaguauacauagaagcauuuuaaaaauugccucugguccgcuacucuugacugagagauuauugcagagaaacugcaauagguaaaugacguacaguaggcuggucagcauauagagaagauucuggauuuaaaaacacaagcaucuagaaaauuauuuccauuuaaaaaaaaaaggccaauuggaaaauugaaugccauccaaaaauaaauucucaccuuucugucccaaaagaccauuaaaaauguaggauuuacugguagacacuggggccugagccacuguuguugcaaaguaauauaaacaaggaaaauucaguaaggcuuggguacuucccaacacugcuggucacacaauucagccagaaaacuagaaaacucauuugucacgugggcacugaaugacaagagagaccugagagcgcagagagaucaugggugugaugucugcugcccagccuguggcugacaucccuagagucacagacaucagaggucccuccccuuuaugaacagcugaggaaacagaugaggggagagacuuuuuuccauuuuguuuucugagauagucucuccacacagcuuacacuggcuuccauucucugaguguugccgauguagguuuguaucauuacaucauuauauccagcuuauaccccuagcccccuuuaaagcucucacucuguaacguaggcuggccuugaacucauagagacugugccgcgaugcuuggcuuccacuucuuuuaaaccgucuuuuuaugucuccuagcaggagggcaugcuguguucuacuuuacagcaggcaaaugaugcuuuguaaaauaaggcccauagaagaggcugggaugggaaaggggggaagaaaaaaaauaccugcuguggcgcugcacaucccugcucaugggaggcugaggccaguggaucucugagaguucaaggugagccuggucuacauaggaaguaccaggccagccagagcuacacagugagaucuugugucauaaaaggaagugcaguauuaagagauaacaguucagagcacugccauucuuccagaggaccuguguucaauucccagcacacacaugaccgcucaugaccaucuguaacuccaguugcagggcuucugaaccuucacacagacaugcaugcaggaaagacaccagugcucauaaaauaaagauaaagaaggaaggaaggaaacagagagggaaagggggaggguagguauagagaaaggacuuccaagagauuuucuauauaagcacccgggaaauugaauaauguguuuuucaguucucaauuuguaaaucuugaaugguaacugagaugacucauucuaaaacuuaaacuuaagggaaaaugucuguggaacauuuccuuuuuuuuuuuuuguagaaagcugaauggaauaaagccuugauaguuccuggaaaauguggaauuugaaggcaaggcaggguuuuagucccaguucuguuacucaccaacuuaaggccucacuuaagguaacuccuuucccaggcucaucugggucagaggucacacagcuugguguagguagagcuuuucuucuuaacagugagguuaaugagucugucacauacaggugacuaaguagaccucaagaaguuaagugcucagcaaauguugggcuccacuucuuccuccuuggaguuuucagguuggaccaaauggagaaugcucaggcaggcaaggguauucccugacuggcccgugggcagugcuucuucaaguuagccuaugccaaaccugugcaaggcuccaagcacucgccagggcaucccugcccagcaucuacugccggaggcaccaucucuuccuucaugaugucggcccugaggaaggaguccuuccauuuuugacauacaggcauauuugugucauguugggagguaguccugcauugggagacuugcagacauggcgagcuguuugguuguaguaggacaggaaggagcacugguugggaaaccacagccugcuauuacacugcaugcucuggacuacaugcugaggacggaaagcacugaagggcaggagcuuguacaauaaucuuaaguuuuaccuuagcugcgcuugccuuaaccaucacucaggcagagguggguggaucuuuaugaguucaaggucaaccugauccaccuaaaaugagauacggguuggccaaggcuacagagugagagucuguuugaaauaaacaguaaaagaaaaaaaauuuaaaucuuagcuuuaacuuguuauggguacuagauuagauagagugaauuuauuuuuaaugauuagaaacgaaggaaaauuaacaauuagaagaaacuguauuaauuacuuuucuaguugcugugacaaaaagaaaccugucaaaaguaacucaaguaauucaguggcugaccuugguugucaacgugacacaccugggagagggacccucaguucaugaauuguuucuguuggcucccagcagccaugucugugggaauugucuugcuugcugguugaaguaggaggcgguagguaucauccugguuaggugagccugggcuguguaaaagggacauaggaagcgagcuggguacgcgaugcuccuccauggucucgaucuacuuccggccuccggguuccugccauggcuucccugcuuuuggcccuagugguuuuuguuuguuuguuuguuuguuuguuuguuuugucguucuuuucuuucucucucucucucucucucucucuuuuuuucgagacaggguuucucuguauaucacuggcuguccuggaacucacucuguagaccaggcuggccuugaacucagagaucugccugccucugucucucaagugcugggauuaaaggcaugugccaccacuaaccggcuuggcccuaguguuuaucacagcaacaggaaaguaacuaggcuaggcaggaaggguuuauuuuggcuaauagcuugggguccaguccaccaugcuggagaagccaugguggcaaggcaguggggaagucuuuggguucccacucaagaaccucagagaaaugaacgcuggcacuccauugcuuucucuguucguuuugggaccagcacgugagauggguccauuugggucuuuucuccucagucaaacuccaggaaacacuuucauaccauucacagguauaaucgagucaagcuguccauggagaguaaccauuaaaaugagguaauaaauuuaaacuaaagccauauaaaaaguugaaggcuuuagcuucauccucuuugggaguaggucuggaauucuuccacaucacaaagggacagccgucggguuuucuuuuuauuuuuaauuuaaaaaaaauuuuaaaauauucugguuauagucuugaagacucagcugccuaaacccuuagugguggaguuuucccagggccucuggccaaggucaucucuaacauggucucgacacaagcaguugccaaaggucucucucugagauccuauccuuccccuucuccuuuccagcuugucugccaaccagaguucacagagauguguggcccgcucacacccuccucaugcagcccccucauccagugacguggucacugcuggguccacgauuggcagagggaguggggaccccaggacucccuccagaacaagagacaaagcccagcguugcaucucagucuuugugggagaagggaguugggaaugggaggacagccccaguggaugacuuucagcaguagcaaugacaguuguaagacggaggaagaugagggaggaggaccagggcaaggacccaagcggggcaccuuuucucuccuuuuucauucuagugacuuuuuucuugucuauaagcuuuucagccuauaauuaauuguaugcuuuugacaauuguaaacaggcuuauaaucugauauuguugguugccccuuguaucaacuugcuguaucugauugccacaccuuuuuuuuuuuuuuuuuuuuuuuuuacauuaugaaggacuaaguuguguccauuaaaaaaaaagaagcuaguaauauugcaauauuguaauauugcgugcaugugguauuguaagcacucucggguauuuuuccaaagaaguuggcuuaaacuccuuuuuaagauauuuuuguuuguuuguuuuucaagaucaacucacauagcuagggauucuuuguauagccuugacccguucuggaacuuucucuguagaccaggcuggccucaaauucucagcuucacccaccucugccuucugagugcuaggauuaaaggcgugcgcuguagcagcauaaacucuuauuagguaggaguuugagauaugaaaguuucuuuuuuuuaaaaaaauuacuaauuuguauuucaauucuucagauauuuauugaacuuauguacauucuaggaacuaugacuguacugauaaagcuguuggaaguuuauaggguggcuugugacagauauucagaucugguuaugacagcacauguauauaaucccugugcucaggaaacagguuguugcaagucugaggccaguuuggcacaugugguaugagccucucuuuccuucccucccucccucucccccucucuuucucccuccuucucucccuuccucccuccccaagauaucaguauguaacccugccuguccuggaacucaucauguagcuuaggcuggccuugaacucacagacaucugccugccucugccuccacuaugccugacuacaaccuugucuuaaaagaaauagcccaguguauggcaugggccuuucauuguagcacucaguaggcagaucuuugugaguuccaggucagcuagggugauguagucagaccuugucuugaaugaaugaaugaaugaccuacucaaccccaaaccacuucagugguugacuccaaggguagaaacagagugucuggcuugacagggagggggacaccagcugagucgucucaagaaaagaugugauggaguuugauguuguaaagguuauggguuucagacaugacucucuggcuccauucuguccugaccguuuuaauuaagagaugcugugucagugccauaucucaaaaguguucuugugagaaggaagagcuucauuuuucucauagugcugggauuugugacguaccaggcagugcccuuggcacugagggcacaguaugggucaugaaauuuaagaguguuuuuuuuuucccccuuuguagacccuggguuucuggugggggaagggcaggaaauaauuguacccgcaaacagggaaggauuuuagauggugauacauucugggaggaagaauguggcagccgcccaaagugacuucguggagguaagaggcuucccaagaggugacauuuugaaaacaggugucuuagcgguacaggaugugauuaagcacccgaugaaugucaggauuguaaggccuuuagugauccagaaagagggagcccgguagagacgauaaaacgaaguugcugcuggcucaguguccuuucuguccuuucugcccuuccugccguccuggaaguucucccuuuuaccuccuggcaggaagggccagcugcugccgcuaagcugucuacucaggguuauucuggaccuggagagagacccguaguaguauaaaccuggaucccaaaacaaggaugggguuggguccguccuugccuacugaaagccuggcuggaauuaaccucugcuccccagucccucgcagcagguuuuuuuuuuuauuccuccauuagagcacuuaucaaggucugcuugcaucagaguuauuucugucuggauuugucuucccccaagagacugugaauuucuagagugauggacguaggccuugccccccacauagcucucugguacagagauuuuuaacacuuuggggauuguguauaccuguaagaauccuguggugaaacuaucgguccuuuccccugaaguuuguucaccccucagauaguuccuguaauauuuuggggacuuacucgguccccugaccucuaucccggaauccuuaagcaguaauuccuuaaguguuuuccccagugcucugauaagcuuucagggcugauugaugagcccugacaauuaaccaucccaccccccuugguugcagaggauggcuaucaggugguaacgaggaaguccgaaagagccccucuguaaaagggagcauguaaacuggaugccccguccaguggcagugaugcucauagagugguggcuauccucaagcuuugggcuagccuucucucacaucuuugccauggcucaugcugcauuccgcuugauuuucaaauucugccuacccuuugaucuccucucucuugagccuucuuuauuucagaaucagucgaccucauccuccuuggaacuuuguugcaguuaaguugugugacgcuugucaucugggucugucccgacacucagcuaccugagaugcucuguuagggcaguucauagcgcuguucuguaaguauuugccaaguccccgaagaggcagccugucaccuuagauguaaguucaugguuccucugagguugccaccacaccacccacaccaccugcuauuauugaguaaagguccaccgccucccagagagauguguagcucaagcgggucuuuaaacucacuauguaguugaggauaaucuuaacuuucugauccuccugccucugccgucccaggugcugggauuucaaucaugugcauggagccgggcaugcugggcaaaucucuaccagcuaagcuacaucugcagucugguagugaguucuugaauccccucugugucucauuggauugguuucaaggcacugucucuaaaacauauggcuaccuguccucccgccccaaauguuagauagagauugaaguuuuugagaugacugauggcagaccauggcagacauucacaggagaaauccucugggucugugcaaucugagacucgugcucaacacaguucaccaagugauggcuacagauucaucugaguuacucguuuuguuuguuuguuuguuuuguuuuucaagacagaguuucucuguauagcccuggcuguccugaaacucacuuuuuagaccaggcuggacucaaacucagaaauccgccugccucugccuuccgagugcuggguuuaaaggcgugcaccaccacacccggccugaguuacucuguuugcccaaaaucaugacuuuaccaaugaggaacuaaggccuacaaaacuuuaauuaacuugugcagauggcagaacugggcuccaaacuccugagaaccauuuugccugcucauuuauuccccuuuuaucugcuaaugcuuucuucuucuucuucuucuucuucuucuucuucuucuucuucuucuucuucuucuucuucuucuucuucuucuucuucuuucuucuccuccuccuccuccuccuccuccuccuccuucuccuccuccuccuucugucagugguucucaaacugccgguugcaaccacuuuggugacugaacaacucuuucacaggggucacaaagaacaucagaaaacacagauauuuacauuauaauucauaacagaagcaaaauuacaguuaugaaguagcaaugaaaauaauuuugugguuagggucaccacgaugugaggaacuguauuaaaaggucccaacauuaggaagguugagaacaacugccuuaggugauauuuuauuuuguuuucucagcgcuguguauagaacccaguguaucaugcaugcuagacagguacucuagcauugagcaacacccuuaucccguguuuaucucuucuuaccaguggggcagcugacgucauugucauugcuacuuaauuguggguggaucacguuccagugcaacaacugcucuuagugguagucuguggcuuugcugagauuucucuuuugacaccugcuuugauauuagugguagcgagcagccucaaagauguucuuauugauguugaauucucacguugcaaggggcaggucaagacuugacauucuucauccaacagauuccuguguguugggcucccguccugagaacagagcccauucagugcugggcuccuccucucaaagcuuuuuuuuuuuaaccauauuuuauguguaugccugcuguguguguguguguguguguguguguguguguguguguguguguguaugcaugugucacagcacacauguagagaucagaggacaacuuaugggaguugguuaucuccaccauguggguccugaggauugaguuuaggucauuggucuugguggcagauguccuugccugcugagccaggccauuggcuccuaaacuggggccuuuaauagcggcuuuuaccucaugucauugcaguggauucuggagucuuguuucaagcagcaacuaagacaggacugauauuuagaacugauuaaaaaaauaaaaaauaaaaauaaaggaaaagacaaagaccuggccugguaaugcauaccuguuauucuagcuucuagggaaacugaggcagaaaaaguauaaguuuuaaggcuugccuggguacaaaaugaguucaaggccaacccugauaacuuaaggagacccuguaccaaaauaaaggcugaaaagaaaagaaaagaaggggagaaaagaaaggaggcucuagauguagcucagugguuaaucacucgcuuggcauccugugugaggcccuaggcucacucucuaguacuguccccucccuccccacagagaaggaugaaaggggugggcagaaaaaacacaacccuuuucucuuuugagaacauaguagaucugggcagcagcagugugacuuucagucuuguucugaugugaacuggcuguccgucuuucgguggagucagcccugcucuuccaugucugaggcucagucuuucuuugucagcacagagccccaacugugaguccuggucuuaucuaacccugacauuguccucagaggagugguauuugccucagcuuucaguauccugagcugaauguggccagagaaaagugagcaaaaaagaaacuagggaagaugacuggguucaaauccaggcuccuuagaaucacucgcuguguaaacucaccucacccaggugagaugggaggcugggcggagacacgcucuaucccugagauggccgcugucuucaccucccccuucccacuggagaaggaaagguugacccggcaggugggguuuauggggaaggcuaagguuggauguugauguggggcuggcucuucagcugaagaggcucggugacuuuuagggggcaucucccuaagccuuagucaccguugucuucaaucuccaaguccuccccuacacuucugggcuauagacuggacuggacccuacccuagggccucacccucuuuuccuccugccugcugggcagccaccacauaaacacugcagugugcuuagccccggagcaggaagacuucuguucagggacuggcugaggaauugcccacuaauuuuggcaguuccugccacaagcuugaccagaccaucagaagugagggaaugagaaguaggaguuagugagucaugggcagagcuauggggaggaagcccuuggcagaggugcccguccggggagccaguuucccuugcagugauggggagcaggggagcaggggcucuggauccuucuccccacccccaggcuugcucacucagguagcuguuccgaugagccccccaggggcggucuguuaaugguaauaacgacccugacugcccaaggugaaacccuggcacaggcuuuguuuuuagagagugcagcguucaggcuagggcugagcccaucccuggaugcaggugugggggaagagacacagcgcagcugucaaaauccagguggcccucuucucuuguguuucuguagggugcagcccgagggugaccagggugggagggugggauugcuuucugugccuuuuccuaaccccuuguccuggggcagggcagacaggcucccagucauuaccucaccgcagggcccuguuugccagaguagagaggaggaacagcuuggguggagagcuccaggcuaauuuuagacuuggagacucccaggcagcuggcugggacaacuggggucugucuccuugcagggagcugugcauguggcucuauaggucugcuugggguguugggugaggguggugggggaggggagauuggggguggggcacauuccugccucagccucugcuucagggaaagccaggcuggaguuagguuccucugcaccaagggcucaggaacuguuacuuuuuccaaccuuguuuuuccuuguguuaagauauuuccagucuccacguguccagguggcuuuggagacuagaaacuacuaauauagcaccccaagguggggucuuugaaacuccaaaaggggacgugagcaugcauauccagccucccccucaccucaauaccuagcuaaucaucuaauuuuauauuuuucaaucuuuuucccguuggcacacauauaguaaauggaaaaaaaagauugagucacacauggggauaaagacaugaaggucgcuguugggugcagucagcuccuugcuucuguuucccuagucccagaauugaguccaugguccuuucauuacccaucugaagcccaguggugacccaggcacgcugguggugguguuuucugguguuuucucaucgacucccgacccaggaaacacuagaagggaagccagaaagccggagagguuuuacaaaugagaaagcugaggagaacuuuguccaaggucagauaguuaaaaagucaaaaggcagaggcuggggagaugguuccgugguuuaaaagcacuggcugcuccucuagagaacccucguucaauucccaacacccacacgacagcucagagcugucuaacuucaguuuuaggggacccaucccaucaucaggcauggguguccugcacauagcugugcacagaggcaaaauacccguacacauuaaaaacaaacaaacaaaaaaaguccaaaggcuugccguuccgagccaagccugguugugcuugccugugaucccagcacccaggaggcuaagguaagaagauuaugaguuaggggucagcaugggcuacacauauaguagaaauguuucagaaaaaaagagggaaaagcuacauuugguucugguucugcucuaacagcuauccauacccucauucacucaacuuuauuaguuuauuuagaggugugugugggucucagaauuuuucuugguggcuucaaaguucugggcucaagccaaacucguguuuuagugacccaaguacuuaggacuacaggucugccacacauagugugugcacauaaaaguuuauuacucuggauacaaauagaugcugggaucguagcucaguggucagccccgaguugaucucuagcacugcagacaacaaaaaauccuccagacagcggagucuuggggugggggucagaaucugggaagagagcugggaauuugaagagaugcaaaaaaaaaaaaguuaugaaggaacuucgucugauucauaagcacggggguggauacccagauauaaccuugccagccaucucucuguuccuucuaauaucuuuacuuucaaauguaauugaaagucugaggaaguuuacagguuggagaaaguggucugguuaggucaggaggagaaaccuaagaagaaaacguagggggcuggagagauggcucaucggguaagaacacuggcuguuuuuccagaguauccagguucaguaacuaacacgcaccuggcaacucaaaacugucuguaacuccaguuuaggggcucugacacucucauacagacauacauucaagcaaaacaccaaugcacacaaaauaaaaaaaaaaaagaaaauauuuuaaaaaaauaaguaaauuagcaggcagggugcuaaggacuagguagagcuguaauaagaguccaccccgggcuugauauaugaccucauggcccugugggggcagaaaccuuucuagucccaguuuccagagggugaaagacugaagcucacagaggucccucaccuuauucaaggugucauagugaaucacgugcgcagucaggugugaaugccaugccggaggagggaagagauaaagauauauauauauauguauauauauauauauauguagugggcugguuggaaggcaucugggagggaggagggagaaucugucaccucccuaagcuuguuccucaacuuaaaagagagaugauacauuuuauuugucaauaauuuuuuuuuuuuuuugguuuuucgagacaggguuucucuguguagcccuggcuguccuggaacucacucuguagaccaggcuggccucgaacucagaaauccggcugccucugccucccaggugcugggauuaaagaggugcgccaccacgccugggugucaauagaauuuuaaaaguuauuccugguaucagaagugauacaaggaaggagaaauaagggcuaaagggcuggguucugugucugagaaacuuauaaggcaaagaagaacuguucugucucagauaacugcaaacuggggcgccugcgccaguuucccugccuuaggaguucuuuagagaaaagaaagggauggaacacaaaguggaaucuacauaaaggcagagcauugagggacaagagaaaagcuuuuacuuuucuuauuugauugaacagauaaauuagaaguaauguauuuguacuucacaugcacacuuguacuucugcgugauuauacagaaaugaaugccagcaaugguacaagagacggaguaggggaacuggagauaguuuguuaguauaaaguauaauuauagauucaguauugcuccagaagugaauauggauucauuguaaaucuguuuugcaaauaguaaaaaagaaaggacguguaagcuagacguggugacacaggugugugaugcuggcacuuaggaggcaaaggcaagugagggcuacuuacuguaggugcaaagccagucuggucuauguagcaagacccuguaucaaucaaagaagggguagagauauggcuccgucaguaaaguguccuuaucagcacccauguaagagcuggcuagcggcccuugugcauaaccccaacaugguacagauggacauaggagaaucccuggaaagucuucauuaacuagauagccucguugaaucguucggugagagacccugucucaaaaaauaaggaaggugacugauucaaccucuggucuagaaaggaagaaauaauugaagcugcaaaaggggcuggggguagggcacaugcuuguaguuguagcuugagauaggaggcucauucaugggugugugcuaauauugguuaccuagugaauuucaggcugggaggagacagagagagaagaggagaggagaggagagagagagagagagagagagagagagagaagaggagagaauaauaguaacaagaaaagaccuauguaguuauauauagaaugcagaaaaauauaccacacuaauguuggcuagagcaggcauagcugcaucaauuucagacagagcagacugccagguagagacuuaucaaggguaaagaggaacauuacacaaugacaaagagccaaguauuccuagaagauagaacaauccuuaaggucuauguguuuacugauagugucgaaauacacgaaucagaaacugauaagacuucaaggagaaaugaacagguccauuguuauaguuggaaacuuaauccuucuuucagaaacgcauccaucucuccagcaggcaaaaaaaaaucagggaagacagucgaguucagcagcacuguccaucagcuggauauaauugacagcugucaaucaacuggauauaauugacagcuguccaucaacuggauguaacuggcagcuguccaucaacuggauguuaacuggcagcuagcuguucgucaacuggauauaauugacagcuguaggcugucucguccacagauagcacaucacacauuccucucaggcucacguggaacauuuaucaggauaaaucacauucugggcuauaaaguaugcuguaacaauguaugaggcuagaaucauacacaaucccugcucaggccuuggagaauuagauauugaaaguguagguaagaagagaucugacauuaguacucugggcuuccacagauggaagcuauacaguguagcacaaacaaguuccaggaaagcagagggaacacugaaggcaggaguagaagucaguaaaaccgaacacagggaauuaagagaaaaucaacaacccaaagcugguccuuugagaaucucaaucaaguagguaagccucuaacucgggcucacuaagaaaaaagagagaugacagauuccuaauguuagaaauaagagaggguugacuguuauaagccuaaugacguugggagggcacugaaagaggacuuggcauuggcuuauaugcaagcagagagaccugaauagggacucccaggaccccccccccccaucuuuagacuccagugucgaggggagaggugacagaugucugcgguagggagugucuguggggccagguaaugugucuaaaauggcaagcuucagguucagugagcaacccugucucaagaaauaagauggcagcugagagaugguucagucauucagagcacuuccagaagacccaaguucaguucccaguaccuauaucaagaaucugacaauugccuguaacuccagcuccgggcaugggaugccuccaaccuccaagugcacgguacacaugugcauauacccagauagagagacacaaauauacauaacuauauuuguuuuuuugagauagggucucucuacauaguccuggcugcucuggaacuguguagucuaggcuggccucauagagaucugccuggcuccugaaugcugcugggauuaaagguauguaccaccaugcccaacaauaaaguaaaucuuuaaaaaagaauuugaacaggucgauacccauaauaucugaaagaaagaauuugcuucuucaugaaaagaacuagaccaucugaauaggcuucaauuuuuuaaaggcauagagccaauaaccuaggacaagaccaccagcccgggguucauggcauguacuaccaaaccuuuaaggaagauacgacuaauuugccgcauuuucuuccaggaagcagaagcagggggacacuugcuauuuugcucucucucucucucugcaucuaacaucaaccaaucucuaaaccaagacguuacccaagaacaagauccauuguggccagcucuccaauauaauugcugugucuugagagaauuuucuugagauauagguuucuccaggccagaggcucugaguagugcuagaaacagagacauuggaaaaggagguuagaagacccacagagccgccauuuugagacacaagcuguaagaagucagaguggaguacaggcaucugaggaccguggugguggagucgguggaugggcaggcugacccugcuguuagagcguccaguccccgauaagagcagugacaggcgagucugcuguacaguggaggcaguguggaaaacugucuucuuugacugggaacuaggaaaucaggggauccaaagggcacguagaguuuugguuggcuucuggcucuguguagcuuaaaugugugucauaguggagaauaacuagccuuuguacggugccauuuaugccuuuaucugguagguuuuauuuuuccuuuuauagguuaaguaaacugaggcugagaaaggguaggucucaggauucacagucauggucaguacauucuaccugacuugagauccuaauugcucuggaggacugccuuccugagguggcuuguguugggacucaacuggagaggucuuuuccauuguucuuuugaggguuugucuuuucuuucuggaacucuaguaacuucccugagucacuugacuuucuugcuuuuuuguuuuguuuugcuuuguuuuguucuuuugagacaggguuucauguagcccagacuggcuuccaguuugcaauguagccaacaagggugaccugauccucucgccuuuauguccagaguaccaggauuagagagaggcauuguguugauucauugugcugaagauucaacuuggggccacuaagccagaauccuaccaaccucagccugccuuuuuuguuguuguuguuauugcuguauauuguuauguguuuuaagacaggaucucacucuguagccuagacuggccuggaacgcuugcuguauccugccuguucucccauuuguaguaauccucuugccacagcaagugagaucccaggucugagcccccaccccuggcucauccugacuuuuugaaguagauuucaguguaguugaccaaugcccugcucugcuccccaaaugcaccugcagaauuaagaaaguuaaagauuuuuuuuuuuuauagauuuauuuauuuauuauauguaaguacacuguagcugucuucagacacuccagaagagggcgucagaucucguuacggaugguugugagccaccaugugguugcugggauuugaacuucggaccuucggaagagcagucgggugcucuuacccacugagccaucucaccagcccaaaguuaaagaucuuacuguaggcuuccagcaagcaguagguaaagugcaauaccugugaacuugcuucuauuuuuggcacaggaagcacucccugggauuccaggcccuugcgcagggccacggggcacagcuguaccugcuguauacgacggggauggcccucuucccaggguucccccugccgagcagagcagugugucugcacagauggcccaguggcacuccuuggguagauggcuugagugugcuggagcacucaggguggccuugcuuugguguaggauucuucucagauucagagagaccaucucucugaaauaauggggaucugccacucacugccuccccuucagcgaggagucaguucucaagaggugacagguggcugagccugacaaucuguuugaucauacacguuggaaggagauggcugacucccacaagcuguggccucuauccuccucacgcauuguagaacauacucucucaaugauaauaaaugaaaauguagacuaggcugggugugguggcgcaugccuuuaaucccagcacucgggaggcagagacaggcggauuucugaguucgaggccagccuggucuacaaagugaguuccaggacagccagagcuauacagagaaacccugucucgaaaaaccaaaaaaaaaaagaaaauguagacuaaaugagugagccugaaucaggcacuccuuggccauacucgcaguuuuucuucuuugcccuacuucccaagaacaaguagagauugguaguuuugugugaaguuuuccagguguuaaauauugccucagauccucuaaaacacuguaaguucuaaggagcuuguagcuccuaaauuaagguucugcugucuagcagguauacaaacuuugaggagaaacaauuuuaaaaaguuauucucuaggggcuagagagaugagggcucagcgguacagugcuuacuguacguggugguuugacugagaauggcccccauaggcgcaugcauuuaaacacaggguuccagcugguggagcuguuuuggaaagucuaggaagugcagccuugaugggggaagucuaucacaggugcuggcuuucagggagguuuaaagccccggcucauuucuucugcucaucuucuucagcauccuguuccauccuguuaugccugccugcuggacucuaacccucuggaacuauaaucgauaggaaacucuuugcugaugaguugccuuggucacggugugcuuuaucacauauguauuuauaacuaauacucuguguagaacaaggacuuaagcuuggaucccuagcaccuaugcaaagagcuagacauggcagugccugccuguuaucccgauguugguggggcauggacgacacagguggauccaaggggcuugcugaccauccagucucaaaaaaugauguggacaauagacaaggacacccuauaaugaccugucguccccaugugugugcagccagacauaccuaccuccacaggcauagaccacccuccacacacucaaaccugcgcauucucuugccagagaugcacaaaagcuccgugagcaggcauacguacuuaccggguuuauggaagaaagcccaucugagauuuugacaacauaaacugugcuugugcccuacaugauggcuccucccaugucuuuuaggugaaucagggcugccuauagaagcuccaguguugguggugggaagggaagguauuaauuggccaggacagaaugacaguggaaggcauggaugcugucgguguggacauucagcacacguaccaaaguaaucacguuaugcugcccagucgauggguggugagugguugcuuugaauuuccuugcugcccaucccuggauccccaggccuuccuacugccugcucaucaauggaccuccccauaguacuguguaguuggggugaccucuguuuucaggggucaguguuccugcuaucuaugaugcuggguagguacuuugaacuuaguccuggaugaaacugagugguaggccugacuccugacugggcagaguauuccuuaacgagucacuuaagcuaggaagcuuaauuuucuucaaucuuuucucuuuuuuaaaaaaagauuuaucuauuuauguauauuuuuuuuugucuggauguagaucugcacaccagaagacagcaucagaucccaaugaacuguaguucuagaugguugugacccaccaugugggugcugggguuugaacucaggaccuuuggaagagauccaguguucuuaaucauuaagccagcucuccagccucuucauccuuaaaauaggguucaguauuacuaauauuugaaggguaguugugaagaggauguacagauaugaucauuucuacaccgugaucaagaaagcaucauccguuuguauauggggauugaaccaggcucuugugcaugcugaaggaaauaucccaccacugugcuacacauccuagccccuccuuucuuggcuugucuuuuaugcaaaggcuuagagaaguuuggauccaagaacuaugggaugaggguuguccagugacaugaucuauuguucccuaaaaguuguuggcucccaguuagcccauagugaaccaccaagggagccugagaauucgaauacagcagcucuguauggggcccagccaucauuacaaaucacauuuugaugaucuugauugacaggugaagcugggagcuacccuguucaucagaggcagagaugucuucugacgauacuucugccuuuucacuuagacuaugcggcaggcagugugguccuuccagcaggaacucaguguauaggagagacugguggauucaugagugcuucugagcuggcuggaaaggccacacucuccauagaccugccccgugcccuagguaggauccaggucccucuaaggcucagugcaaaggguagaggaaaccacgccgggauaucuugcugggcuucacaggagacuggauggguguggauuggguuuucugaucaggaggaugagaucugauacagcugcagguuagcuugcccaucacauuccuuaggacacaggcucaguaguugacugaccugugaguugucaccuguugacagggcuuucuguguccuaagcugagauuccagcuccugcgcauuuggcugucgggugcucuaacuugaugcaguugucauuggugagcccucuucugccugccagucauguucagcacuuucuuucuuucuuuuuuuuucccagcacuuucuuaguacacauucaggguggaagcaaaguauucgauuacagccacagguaacaaacacucuggguauugcaucccaaaugauaaggacaaggauguuggggagauagugcugagagacaugggaagaagagugucgguucacaccugcaaucccaggauuuggaaggcugaugcagugggaucucuaugaguuuaacuccagcuuggacuauauaucuaguuucgggccagugagcccaucuugaaaggcagagggauaggagcaaacauaugaaaagaaugcagacagguaaaaggacaauccuggggugacaaagccaagaaggguacagcgaggucaaagcgagccuggggccuguggcuuaaucguaagcagacugcuuggcccuaggugacaucguugaauaaagucuauaugacagugaggaaaugaguaugcagaugaucccuguuacacugugguguugauguccuugugacuugucauccuugaucacccugcuugguuaaacaaguuccuggauaggaaacccuaccaagaugagauacaguguuucaacagacgcaguaagguagaaaguuuuggccuggcauucauuuccagccagcguuucccagcagugagaucccagggauuguggggcguugugcacagugacucaccugaccacaaggcuucccugguuuauagcccaaauaccuguuccuucucacuuccacaccucucaccacucagcagccacacccuacagucucggggccucugcugucuccaucaccaggcaggaaacugucacuuauacccucuucccgcuggcccccuccucccuccucgcuggugugucuccuaggagccagaguuuucugcgaucaguugacagauccucccugggcucuuguacaaagcccauuuccugucugugucucagauuucugaccuauaaagugaaccucaggcuuacagcuugcaguguggagcugugaaugaggucuuugggggaaauguuccuugccagaugaaagauggcacauugagauccucucuguaugucucuccgucucugucugucucucucuuucucucucucuugugcgcgcgcacacacacacacacacuccauccuuacuauuuaucauacagauaagaagucauguaggucuuggaacccucgaugaccccacuuuccaaaccuacugaccucguacagucuucagcucacccacccguaccccauuagaugcggccaagcaccuccuuucaccucugaagaaaccuaaguguaacacaggcucagggaaaagagacuugaggcuggggcauagcuuagugguagaacacuguugcagcugcucgaggccgagaguucuguccuuuggucuuuguguagcuagaugacacacaguagacaauucauuaauuacugauuaaaagaaggaaugagugcaggaguuaaccaugaagcuugcaguagcuuuugagucucugcuccggagaauacuugguggaguaaggaguguugucucuucuuaaguuucuuuacuguuaaagcuggcuuccuugccacuggguuuuuucacgucauugagaaagugacgguaaauugcgucagcaaagcagugacaagcacagugaggcuccguggggacuuguuggauuuucuuccaaaggaaccucuucguccuuugcucucuugcucucuguuaagguuaaaugaucccacugcucacugagggagggaggcgaggugccuggcggcccucagagagcuuaggguuugccuggggagaggagccaagcucuaccccgcugagcugagguggagaugcagagugcaggggcaggcccuggggacaguaguuauggguuuccacgggauccuuggcuguguggccucaucagcucgcucuuccccagugauaggacugugauccuauucaccucaguggcucuucuuggcaaguuuuuccccuguucuuuuugguaguggcuuguugggcccaguuuucagccaggaacaccuaagcucaggaagaggguguggaccucagaagaggcaaagugcagagucagaggagguccgaguggugccauuggccguucugagucaggucucuuucucuggagcaucagucagucaaugacaucaggccgcuuggagaucaucuuuaggcguggcacauuucuuugugcucaggaugacaacacaaacuuccaguugagcaggcagcuuucagaggaugagauuuuuauguccugucucaccacaugcagaguugguuauggaagauaaaguauaguaggaugagguggccacacacagggccgcauuuuuuuuuuaacacaauaggcugaauuaauuuuauuaauaugcaaaucaaauuauugaauguauggcccuugcaguuacaaaaaugcacagaugucuacauacuugagauguuugcuugaaaagauucuucaacagcaguuacgguuacacauccagccgccucaucuagguggagaugacgugcugacaggcugcuguuuacagggagguauuuugagcaucuccugacaaggggacaguagagauuaucuucuacauaggacgaggccgcugaggguuccucugugaagaguagguggacacugugacagugacagcagagaccgaacggauggagguggucguccugagccugacacccugagagcacugagagugggagaggccaggauguaagaaaagggugugaugcuacugagaaacagugcagugcucccaagccccuggaaaaacaguguggugcucccaugccacugaaggaaggcaugguaacauuccucacacccuuuuauauccccuuagccauaaaagacaggcauaacagccacgggggagacagucuccuuuacucccaucccuuuuuacaaagaucuucccaccuugugcccauauaaaauagguaccagacugaaaguugugggaaagaaagaaaaccaaggucaauaaaaggaagggaggagagcuggagaaagggugagucugggaaggaaagcucaggaaagugagugagugcaggaggaagggacaucuagagaagguugcaguggccucugggcugggagcuuugacacccacagucauccaaagcuggcagaggccucagccgugauuacagguguggaguggaagaggcaguuaaaggggcuggccaguuccaguuuaggaaucacaggcagggggaggggagagaaggguggucggcugcccucacaguagacaugcugugugcugaggugaagaagaacacguagacgcugggcagagcuggcguuuugccaccucugugcauucccugcucugugccaagugugcagugauggagcugcugcaccugugugugugugcgaaccuaugugugugugggaaccuguaugugugcacgggcuagaauggaguucaggucauccauguuaagucaguuuugagaucccuggguuaggaaacgaacaggcagaguggguuugaaguggaacccccuccuccccuagucucaaaucacacauuauaaaguauaucauuuucuuguugauucccaucauguccuaggaagggaugacaggacacuaaacaggaagcagaucaccuaugcccagaaaagauggcaacaagggugagcccagaagcaaauugaggucugauguguagcuccaucugccuauaaucccaggucaucgagagagagggcccacccaggugugucuaccaucuaccaccuaagcagccuuccugcuugaacucucuucucuucuaaugucugcauaucaguuguuuacuuacuaguuuuuacuacauuacuucugguggguggaagauggaucacagaagugcuaaguccacccaguuagcauauucauuacuucauaggguuaccuuuuuuuuuuuuuuuuuuuuuaacuaaacauucacuccuguagaagauuccuuaagaauauugugauauucuggacuggaguauacuuuaguuuguauucgugggacccuggguucaauucucaacaaagugugagaugugcgcacacacacacacacacacacacacacuaauaugugucuuaguuaggguuucauugcugaagggacaaccugaccaaggcaacucuuauaaaguaaaacauuuaauuggggcugccucaaaguuucugagguucugcccauuaucaucaugguaggaagcauggcaguauccaggcggacauggugcuggaggaggaucugagaguucuacaucuugaucuaaaggcaggcagaaaguguuugagcacuaggggcccucaaaaccugccuacacggugacacacccuccaacaaagccacaucuauucuaacaaggccacacuucccaugggccaaacauauuuaaagcaccacaccauguuauuaaaucuuuguuuguuuguuuguuuuucaagaugggguuucucuguguaacccuggcugucuuggaacucauccuguagaccaggcuggccucgaacucacagagaucugccugccucugccucuccagugcuggcuuuuaaauuccuuucuaauucuuugcccucauguccugacucucucuccuuucucugugcaucugcagucuuagaaggaacucagugaguauucuugcuauguaaugucugaacuauuuugucagcuuugaggcaacuugaguuuuaacuuucuuucuugaaugaaauaauaucuagugaauaaauaaaaggaugaauguccaucgagcugagcuuaucuaaggaaaggaccacaagaaggguagcacauaccuuuaacccuggcacucagggagaagaguucaaggccaaccugguccacagagggaguuccaaaaacaggagaaagaaaagaagagaaaaacaaaagaaaagaaaagaaaagaggagaaaagaaaagaggagaaaugaaaaaagaagaagaagaagaagaagaagaagaagaagaagaagaagaagaagaagaaaggaagaagaagaagaagagacagacgacacaggcagcgcaacagcucucauaacaccccuuuucuccagucuucaccccugaacuacacugcaccccuccccccugaucccagauuauagaaguuuuucuuuuccuucuuucuucucuucuaguucuaauuuuuugagaacugcuuugaguaaacccccaaaucaagaacuagcucuuguugagaugggguagauguuugucccucuguuggcuuggcuucugcaagccuuucucacugcuuugugagagagcucucccaccgagugagguggugucugcucaccacagcaccucauugucauggcggggagugucccaaagacccuuguuucgcauuacccaggccuaggauuucuaucuucagggagauaggggucugaauaggucugccucucaaacuguccucaaccuggauugauaggaagagaacaaagaccuacaaacaaagcuguguggagccugugugggguuuccaacucucccacgaagagacccagaucagacaagcgggagcucugccgcgagcagccucggccaucuucuucuccuuucuuucauuugcauagauuugagccaguuaagccucaguccucgcucuucuuagaaaccagacuguagcccggcucgccucugauuuuaaccucuaaaacacuacagguugcagcugaguaaucccagagauacagcucugaaaaaauccugugguucagcuuuuagagaggaaacuauuuugaauagaccagaggugauauaguauuguaagggaaacuacuuaaaguuucuucucuguguguuaaguguuggaucacagaauguguuggggugaacugcgguaaucccagcauggggagggcugaggcaggaagauugugggaaggauuugaagcuggcuuuugcuaugaaaaaccaacaguauuugcagugucccuaaaugucaucauuuuuuccccagguaaaccaagagcagaucacaaagcuaguaaguaaugaggccucguaccccuuguccuagcugagggcuucagucuuggcaaugauggaacacagcagaauuuuucaaucuugguucuccuguauuuuucuuuucauuuuuuauuuuucuacuuaaaaacauuuugcagggugguggugguggugcacaccuuuaaucccccuacuugggaggcagaggcagguggaucucugaguucgaggccagcuuggucuacagagugaaucccaggacaaucagggcuacacagagaaacugucucaaaaaaacaaaacucagaugguacacuucuguccucucagcaauucagguguggaggcaggaggauugaauguucaaggucauccucaccugaguagggagcugaagccagcuuggggugugugaaagccuguuuugaaaaaguggaauccuuacuuuuuguuucagugaugcuggcgauggagcccaggccuucaggcauggaucacaagggcucuccccuucagcuacacccagccaggugccuguuucuauggggauaggcauuuugccugaaugaauguuguguacuauauuguaccugaugccucaggaggccaaaagagggcauuagaucuccugggacuggaguuacagauaaucgugagcucccugugggugcugagaauugaacccaguucucccacuggaagaagaucuaaugcuccuagucacugagcugucucuccaguccuucccauauuuuauuuugauuuccuuuccaauaccagggcauuggauuggggauccugguauuggauccauugggccaccaggcuuccuugauguuucuccugguugugacagguuuguuuguuuuucaagacaaggcuuucucucugugugacccuggcucuccucgaacuuacucuguagaccaggcuggccuugaacccacagagauccaucugccuauguguccugagugcugggauuaaaggcaugugccaucacugcccugccagaugugacaguuuuaauuuuaauauuaguagugucccuuuggcuauauauggcaauuucccccauauagcuaucuugaacacuuucugaguuaauguauaugauauauacuuguguuaugacugugugggcuuuguguguacuagauguugagcucagccuugugugucugcuaaggaggcaaaugcucuaccaugagccacacaccagcaccuuacacacuuaaaaucaacugcuauaucaucccacugccccggcgaugaugaugaugaugaugacgacgacgaugacgaugaugauaccuacguuaagauagauaacucgaggcuaaguguugucuagagagcgagaugauuccugccaccuuggagcuucgacucugucauaggcaggucuagcugagguugggagggauagcugauguaggugaccccaguauagcucagggagagagccaagcagccuaagguucugcaguuccugcuccuugccccacagaaggaccuguuuuuaaaacugugugugguugaaacacccaugaaaacacugggcuuguccgaggaaguucugaaagagaaaagaacuugguuacuauguguccauuuaacaaugggacagaacuguggugugcaggacauucccuagugguggcaaucaagaugcuuagggacugcagcugaagguguagaucagcacacuuagcaugugagaggcccuggauucaaacccuaguacuuuguccccauaaaagaaaaccucuggggccggguguggugguugguaccugacuaauccgagcagaaccagacagaucucucuugaguuccagaaaagccugguccauaugugaguuucagaccagcugaggcuauguacuaagagccugucucaaaaagaagaggaggggagggggagggggagggggagggggagggaaucuuuggguagucaucauuugcaaugaccugggaaaugauuugccagaggucccaucccaggaagcagguuguucuucauuugccuuuucucuauuugaaucucuacagcagcauccgauucuuauuaguucaagaagauaaaacuucuagauccuauauaucccauaugaucacagaaggacuauuaccuauuuugaaacaacuuccuuuauaaauuuuaaucucagguucaggcaucucuccacucauccuccuaggaauuagucagugccucugaccuaagcccuuccauuaacccccagcauucuccaagacccuaaggccccaaggccgaggcuugcccucucagucuuucacuuccucccucugaccuuugacuuacacaggcccaauagcaccaggacugcuguccccucacccccacccccaggagacgacagacaauggauuccuuuugggauucuagacuugagaucuagacaacucugccaacagaggaaaucaauucucagagaugaaucaggaagccaagguccuucccuugaguacagucgacaggaccauuagucaacagggcaggagaggcucaggccucaagaaccuugcugggcuguugugcuuagggaagguagagccugaguuagauaaugucuuacccaacauguuuucugucgugucuugcagguuuucucaggaacccaccugagacacugcuaccucucuaguacuucaaagauggugggcgguuaguccugaggccccacgguccauugcuguaacugacccugccucccuuuuagaacacacaccccauuuccaagagggugguugaguucauugaacaaaagggcugacagcagagaaauacuuugcaagaugcaaaugcuuaauaauuaaugagcauuagaagccggccucgggccacuguguuuuaggaaacccaucugcuggaguaggacagagacuauuuucagggcaggagagacuugaggcaacauggaauggugaauggagcagccucccgggggauuuagaugguacggaaacccagauacagaauuagagaagaaacaacagccuugcucagggacucuucgcucucccaaauguugauuucauugaccuaaaucaagccucugcucccaugugcggggaccuauuuuaagagagucauaaauauacaaacucggaaaugccugguggugguggugguggggugguggcaagaggaugugguugcacaccgggacagcauccggcucaaaucacacucccgccccuggauuccaggcgggcaggagggauggcacagcggugauguuuacaaggaggugccaggagcagagagcggguguucuaaacuaaaccuagaaacaucacuguguuccugccucacgcacugcaaagcagacaaaaacgugggcuccggguggugggagcugagagaaagggagccuaguggccucuucuccaucacaagccuucuugccuuugccauccuuacugcacuggaauuucucacucaucuguagacuguuagacugccacugcuucuggggauugagaccugcucgacacuccuacguucccugcccuggccuagugaguccaguccaagguuauugagucaaaaaauacacuagucuucagcuuagagaaauacuauaacccuuuccuuacuuuucagguaaggcaagugauggucccugguugccuaggcuagcaucgaccaggccucuaacucaaaccggguuucgucagggguggagcaccaugagaaauagcuuuggguguuacuggguggagcugagauguggcagaguuggguggaccagagggcuccagcuagcuuugcacacucagcugauuuugacccucagugauagagcucuggccuagcaugugaggccccaggcuccuuugaagcacgcaggaauuugauaggaguuugcucagaugcaaaagcccaggaaauaagaaagcuuuugugucaauucuuugaggagguaguauggucuuccuuggguugacacagcucagggauggaguggcaacauucccuccaucuccauaguccuucaguuucuuccuaccgugaucugagaaauacuuggggagggggugucaccugagcugagagggacacaggcccuuucaagaacaaaucagucucuagugagauguuuacaccagcucauacccaagggugcagugugagucauuugaucuaauugguuuaauaaguaaacgaucugugcccaaagaggaggggguugggcgugagagggaggggcucgcuaccuacaaauccuaaggggucagcuuugaagagagggagaccugcugcuggcuuucuagggaucugugacaguucagcuggaggguggggugcuuugggagggagggagaacagagacccagaaguccugccugcuggcaaagagagguaguucagcuucucagugcccuuccuaaagaaaugaaacaaggaaucauucauugaaguauauaguucaguaggagcggggguugggcuaagugcucagggguagagcaaccuccaguaccaccaccaccaccaccaccaccaccccacccaccccacccccccgcaaaaaaaguacaauucagugcaaccaguauuuaauuucaaaacuuuuuuuuuuuuuuuggucucuccaaaaaggaaccaagcacacaguagcaaucccuccaucuucucucuguuccccagugcaggcaaccuuuuuuuuuuuuuuuuuuuuuuuuaauuuccaagaauuugccuauucugaacauuucauaugauggcccauguaauaggugccccauugugucuggauuuuuccuuucacuaagcaaacaguaguguuuucagaguuauugauguagcaugggucugaacagucgucucaguaucucuaggagauggguaucucuaggagauggcucuagucccugcuguaaccugaggauacccaaaugucuuuucauguaacuuagcacauccuccuguacacuagaagucauucuagguggcuugugguauaugguauagcauaaauaugauguagauaauuguuauacuauguuucauauauaauauuccaugcuugcauauaugcuguuuuguuuucuuuccuuccucccuuccuuucuaucuuucuuccccuccccccuucuccuccuuuuugugagacauggucucauuuaucugcgguuagccucaaacucauaauguagcccaaggauagccuugaacuuuucuuuuuuuaaagauuuauuuacuuauuuuaugcauaugaguacacuguaguugucuucagacacaccagaagagggcaucagaucccauuacagaucauuaugagcugugguugcugggaauugaacucaggaccucuggaagagcagucagugcacuuaaccacucagccaucucugcagcccagcuuugaacuuuugauucucacaccuuuaauucugagugcugagauuacaggcuuucccaccaugcccuguauauggcugcugggaauugaacccaggacuaaggaccugcuaaguagucacucuaacagcuaauccgcaucccuagcccuuuuugguuuugucuuuugagauauacauuuuuuuccuuuuauuuuaagauagggucucacuguuuugcuggcuguccuggaacucauugaccagguuggccucaaacuuggagaucuaccugccucucuuggagucuccaggauuggaucuaccugguucuguuuuuguuuuuuugagacacagauucccuauacagcuucagcuaccuugggacucacuauauaacccaggcuggcccugaacccauguucugaucuuccuggcucaucugucucccaaguggcuuauuaauuacugaugggcauuuggguauuuacaguuuggggcuauuaggacuggcacugcuaugguguugucaucgucguuguccuccuccuccuccucuuccuccuuuucuuucuauauauaacucauugauaggggagagcccagcuuauucugaguaaggaccucacuuggacaaguggucauggguuccaagauucuacaagaaaacaggcugagaaagccaugagcagugacaguacgcagcuccccucuauggccucugcaucagcuccuacuuccagguuccuacccuguguuucuggcugacuuccuuccaugaugaacgugauguaggagcaugaaccaaauugcccuuuguuccccaagcugcuuuugacuuuuggucaugguguuucaucauaacaguaaaagcucuaaugaagagagacacacauacacauacacaucuguguuuugaauagguuuuaaauguuuuuauucuauuuuuuuuauucauuguguacauguaugcaugggugugagucauggcauacauaaggaggucagaggacaacuugugggauucaguucucuucuuccaccguaaggauugauugaacucaggucgacaggcuuggugguaagugcuuuggucaucugagccauccuaucuccuaaaaaccaguguauauggcaaugaauuguuuccauguuuuaggaaguuauauacuaaugucugugcuucaguucuaacacaugugacccaacagucucauguuggaucuuagucucggaaucauagcaguugcauauguaugaagcauugauuggagacaguucaacggccauugguugagagguaauuugcucaaauguaccuuuaaauguuguuuuccagcacuggagauugaacccaggacucugcacacauucagcaaguguuucuaccacccaagcuuagucauaggcauccaagguucuuccagaaaacguggcuacuccaggacugagaaacaguagccccagcauucuuugggagcuugcuagaugccaguucuuaggucuccuacagaccauccauugcuccuuacccccucagugcuggacauggaauucgaggccucaugcaugcugagggagcauccuaccucugggccaugcucacagccucggagaugcuggacuuggccuguugccauuugcugagaugcacacauucaggggaccagaguuuagaagcauauacaagaguuugguuuugcuaaguuugcgcugccucaaagauguucguauagggacuggguacauuuaaaaguacauagaaggaaaugucagugcaaacguaaggaaguggacgauggcaagccauaucuacaggaccagugaggaaggaagggaguccccaggaagaacaagucccugcacggggccagccacaaaggugaguuaguuagugggguuugagauaggaaaugaagagcuuagcuuuuaggaaaaagacagaggaaggaugugugaauguaaaaggaaagaccguaaaggauguuguauucugccuggcagauucugugcucugggauucagaggagguaguguuuucaugcucauuuuauuucagagaaauacuuuaugguucuggccugggaaccauguguagcuaggggcgagcccccaagacucagaaauacaccaaccucaaaauaccuguuuggguccuccucacagagaagucuuccccgauuugcaggguccuuucuguuucauuguuguguacccugugaacuacucauccuggaugcugugcaaaaaacacaguugagccgggugugguggcgcacacccuuaaucccagcacuugggaggcagaggcagguggauuucugaguucgaggccagccuggucuacaaggugaguuccaggacagccagggcuauacagagaaacccugucucgaaaaaccaaaaaaaaaaaaaaaacacaguugggaggcgggacuggcuguggaaaugccgugcagggacuugaguuguggcuucuugcugcccugucacuguuuccguagcuccguccuccauaaaugaggcaccacaagaccagccuccucaggguuguguugaggauuaaccgagcaaccuguggacuuugaaaccacacaguaguuuggaucucagucauuucugagaucuggagcaaaguccagaaaucauuuaagccucagucuuaucgagaaagugguaccuuccugcuucugugcugggaaugaaugugcaaggccugggagagcaugggaagucaguaagccauagucugaguaccaaauggagcugcccagccucguauacacugagcauauauugaacacauauuggcugaauuuguucaagccccugaaugaugcauuuggaagaaaauaugauagcugacccggcaugaggcauauagcuaaaaaguagugggcagggauucaguccagaucucucugacucuuaacuugauuuguuauaccaugcuuagccaucagacaaagcagcgaggccccacauggugcuugguaauucuagccuguuggcugaauguaccuuucuuuuaagcuucuucugaaagcuuuaucuccacucucagcuauucucugcaaccaucagaacucuaacauacugguccaagaagccaccucaaaauagguaacagacugaagucucugugugaaagcuguaucuguuuuuguaugguggugaacucugggggaaauguagcucagugcuccaaccagcccaaggggauaaauuugcaucuuacccaacaaauugccuacaacagagucuuugagacauggaagagauaucccccuaagacccaggaaggcuaaacaguuaaucgcuucccaagagcuuuauguauuacuaggauacagaccgcagucagagaucguuaaacaucaaaguuuauguucaagaaggaaaaaaccaaaaaugaaagguccaaacucuccaccuuagcugucauuacaaguaccccaaguaggagaaagauccagagcccauguaaauagcagggaaaaugagacuggaugagauccagccagcaguagcggggaagaguggugcuuggcucaggccuuuaaucugguccuucuccugagcacaguguccuucuucucccuuuuggggauagggaaccgggacagucuggcccacuucugagcaguuuuugucagcucaucuacuuauaugcccuugguuuucucuuugguuccacuagaccuggcaccugaaaccaguccgacucugucuuccagaugaaugccugggguugcucagggccagggugaacagagcugagcuuccugcagugcuugggauaggcaacucugagaguucacucugcaagugccuucugaugugucugggcgcucacuucucugcuucuugcugaggaguuccacguggaguagggagucuuugaaugagcuauuugugcauuuccagucaacauccuuauugacacagcuacagauggaucagagguguauagaggucggcgccagcagucaucugagggaaucuagcaucagcgugaggcugaggacagcagagagcuuuugcaagugauguuuguuuguucguucauuuagccaucuauuuauuugagacaaggcugaaccugcaggagucucccugauuuuguaucccacuugugugcugggauugcugaaagcaguaauugacuaucagacaaugugacucuuuggguuggguuccuaacauuguauugacauaggaagaacucauagcaucauuauuuaguguacauaauggaucuccuuacagucuuuucaagcauacuuuguacuugauccuuuguuuucccuggucauuagacuccuuccuccuuccuccuuccguccuacacagucucuuucuacuaucaugacaacacaugacaucaugugacaagaacagacacacacacacacacacacacacacacacacauaugcauuaaacauaugagaaaauauacaguguuuaucuaacuuaucuuguuuaacgugagaucuccagguuuauccauuuuccugaaaauuacauaauaauauucuuugugguuuaaugaaacucaauuguaugaccacauaauugucugucugucugucuaucugucugcucaucuguuaaugggcaucuagacuguuuacguaucuuaacuauuaugacuaauuaugcaaugagcauggauguucagauaccucuuuugagcugacccugauuccuucuggaguacuauuaccaaggaguaauauggcugaaucauaugguauuaucaauugauuuagaaacaggaucucauuaaguagucagggucggcuucaaacuucacuucugcuuccgccucugaagugcucagacaccuggguuggcaguucuagcgugaauuuuugggcaucucuguaagugguuuuuguaguggcugcuuuaguucauaucccaucaggaacagucugggguuaccuguucccugaguccuugccagcauuuguuucgaucauauaucuugauuaggguuuagcaaauaugguuuguaacacaucaaauguuguaugucauaucaaacuauguauauaaaacaaguugacuuagugaaauucucacuuuagagccacagagaugaguuuuguauggguguuuguguauauguuugauuaguaguaguaucauucaucauuguccucaucauuaucugugugguuuuguuuguuucgguuuuuuguuuuuugagacaggguuucucuguauagcccuggcuguucuggaacucacucuguagaccaggcugaccuugaacucaccaagauccaccugccucuccuuccagagugcuaggauuaaaggcgugugccacuaugccuggcuagagcuaguuguuuuuugucuguagaaaaauauaaaaccaucacucaguaguuuaaucagccaucuugagucaaggucucauugacuuuaugaaggucagagcagacagcagacguaaucuuauggaauuaugaccaauggcaucugaaccaaaguaaacaaacaacaaaaaaacaccuacggcucaagcuuuaggaaauuauauuuacuuauuuguuuauaauguacgugugcugagugugugugugugugagagagagugugugugugugagagagagagaguguguguguaggucagaagacaauuuguggggcucaguuuucuucuacuauggggauccagcucaggucauccuucccccccccccccccaggacagugagaauacugcugaacugucuauuuucuucuuagcuccuuccagagucuaaaucccuuucucaagcauacuugcagcuguuuaucuuacugauuuaaaaggauucuagggagagccauugaguaacucagcaggcaagggugcuuacugcuaagccuagugacuucacugaguaacucagcaggcaagggugcuuacugcuaagccuagugacuucacugaguaacucaguaggcaagggugcuuacugcuaagccuagugacuucacugaguaacucagcaggcaagggugcuuacugcuaagccuagugacuugaguuucauccccagaaccuaugagagaacugacagcagaaagcugugucccuacucacuacauaaaauaaaauaagcauauauaugcuuaucauuacauauauaaucuccaggacuggcaguauagcucaguugauaagaguucuugcuuugcauauaugaggccuuagauuucauuguuaacagcacacauacauauaaaauaaauacuaccuuuuugugauucuaggaaugaacuuuagggcuuuaugcauccuagguaaguguuuaaucacagcuauaugucagccuuuauucauuuauuuuaaaaauugcuucuuaagccgggcgugguggugcaagccuuuaaucccagcacuugggaggcagagacaggcggauuucugaguucgaggccagccugaucuacaaagugagcuucaggacagccagggcuacacagagaaacccugucucaaaaaaaaacaaaaaacagaacaaaaaacaaacaaaaaaacaaaaaauugcuucuuaaccuaaagaaaggauuuuuuuuuucuccuaugugaaauguuaggagauuaacaugucaaagaaguacuuagugcgcuucuguguauguaaguuaugguuuugaaaaucauguaggaggauaauaaauggugugccagugaagucuaaugucucucaggcucuuaucuugcagacuguggccacaggucaugcccagccuugcuccuaaaaaccucagagccaucuucaugugguuagcagagucagauuuaggacugauccggccugucacuagcagguucucagauucucagggaaauacguccuccgagcugccucuggugaccgugaccuucuuuccacaagaaggcuuguguucucagagcccaagcuggacagacccagcaguauuggggacuugccaccagacucaccaacuagauggccucacuuguuagcaggcgagggaugggcucugagcuagaacagagaccugaauuuuugccauuggucuuucuccaaacuuguuuugugucucagauaaugacaccuuaggcuucuagccuuuagcuuucuaguggagauguuauuuaagcuuguagcuauggucucucagcuuuccuauacugcaacaagcugggguuuuuuuguuuguuuauuugggauaaagucucuguauguagcucuggcuguccuagaauauauugaccagaccagccucagacucagagcucugccugccucugccuacugagugcgugccacacacucugggcuguguuugaaucugaaguucugucucacucugucucuucuguaugaggcaagagccaccaugcccauugguuagaaaguuuaaccaaugacuguuuuccuuaucuuuucaagaaauacauuuagaacaccaucucuuuguauaacccaggggaaauaaucuaaauaauuaacucuaccaucuuccagauauucuauaaaguuucuagauauuguaauguuugugucuuugauaccucucauuauaucugcauuuguguacuuuagcugagcguggaggcgcaugccuuuaaucccagcacucgggaggcagaggcagucggauuucugaguucgaggccagccuggucuacaaagugaguuccaggacagccagggcuacacagaaaaacccugucucaaaaacaaaacaaaacaaaacaaaacaaaaaaaacaacaacaacaaaauucauucuuuaaagaucaagucaauuauguacagcuaaaggguucucacagggaagacccacacccuaccccuaaucccuucaccaccaucuccccccaccccccacgcacugauauuugaauggaauugcaaggcucucacagguaggacuggagguuugaauccuaagcagacaucagggguguugagauauuaaagauuuuagaaacugcuugguucuugaccuuucugaggccugauggugugauucccuauuuuauuuauuuuguggucuuuccccaauuuaucuugagagagagagagagagagagagagagagagagagaggaagaggaagaagaagaagaagaagaagaagaagaagaagaagaagaagaagaagaagaagaagaagaagaagaagaagagaaagaaagaaagaaagaaagaaagaaagaaagaaagaaagaaagaaagaaagaaagaaagaaagggagaggaaggaagaaaaauagaaacaacaacaaaacaaaacaaaggcaggguuuguaguccuggcuggccagaaauucacuguauagaccagguggccucaaacuaugaaaccccuucuucaacuccugaguucuccaaaaucagcucucgaaguuaccagugauuuaagcugaggcagauaggccugcaguucuagccacaucggaggacuaguuuuccagucuguguuuacuugcugaguuuuuauugguuguaccauauaccaccagugugcaucuggcgugauauaugucuuaccacaaguguuuaaagaauccagaaccaggcacauggcaaacaccuguauucuuagcacucaggaggcugagacaaaauuacaaguuccagacuagaccgaccccauuacacacauaugcacacucacacacagucauaccauauacacacucauacauacauauaaacacucuuacacacacacacauacagacucacucauacucacacacuuauaccuauacgcacacauacacacucucacacacauauacauacucacacacauacacucauacauauauacacacucacacauauacauacucacacucacacacauacauaugcauucauacacauacucauauauacauucuuacacauacacacaccuagugacacacacauacacugauacacacacccauauuacaauggaauauugcucagccuuaaaguaaaggaaggaaaauuugacacacagugcaauaugguugaacuaugaaauaauguuuuaauuaugaaauuagcuaaacauauaagaacaaauacuguaugauuccauguauaugugauacuugguaucaacccaccuccuaggugccucucagaccuaccaacuugguaaucgagauuagucuguguuauauguauuuucaacacauguccacaucucaaaguuauguuuagaaaagagaaagaaggcuagaguaguagugccuuuggaggcagaggcagguggaucuaugugagcugggggccagccuggucuacagagcaagcuucaggcccaucagagcuagauagugaggagugggggugagagagagaaagggaaaugagggaauagugaccacucagggacacuuggguugugacuuugacaucucugccacagcgaguauccacagggugcugugacagccugcagcugguugucagucucucagagugucagggucagugacugucacuucauccaggcccuagcccagaacugugaggagacacugcuucugaaguaacucuuccagcucuucacaccacccacucuuuaucauucacauguuuaggugcuugcucaaugcaacaggaaugagagagagagagagaaagagagagagagagagagagagagagagagagagagagagagagagagagagagagagagagagaguguguuaguuuugcuugcacagggcuaauuuucaggccuuccuaacucggcucaggugcagcuaaguccugugaugacauacugugccuugggccaagaaucaaagacugacuucagacugguccuucacacuggcuccccuugcagauuagacauucagugaacuuaccuuuaggucccugugccccugucaacaaaaugguaaagguucguggcauuuggaugaacauaaaacaaagccaagaauauuuagcggugacucugggaagaggaccugacccuuauagucuuaugguaugcacucuaugcucagugcauacaaaccccugaaguuuuacuuaagugaccuuuugugggaaggaagagggucaagucuaaguugacaauaaucucccuguggcccugaccggcuugaacucaguguagaccagguggcccuuugucuuccgagugcugggauuaaaggguguaccaccacaccuaaccccgauagucuuguguacccuccugucccaguccuucuccuucccaggaacagguuacagcaaccucaucugguuuuggcaagucccuuuccucagaccgugcaggccuagcaguuggcuggcacccacaucagauuguuuuccagccagauacagaaaagaggcucagacugcugagaagagaguauguucgguggcuccgugguagaucacuuuccuggcuugcucaggcccuacguuggauccccaacacugcaaacguguguguguguguguguggguggguguguggguacuguaaaagcagauaucaaguguaaugggcuggggaggcuaaggcuccugguuguugguccaaaccaaagcccuguggagcccaagaaaauguccuuggcuucgaggauucuucucuuuguuucccuuggauucuggugccuuuuuguacaacacacagaggguccuguguaagauacuucuuaggagaucuuuuugaaaagcaagcaguuucccuaugccauuguguggaggccgugaggacuucaguaaaagggaaauuuuguuaacaucaagugauugcuguguggugaaauaagacugugugucagaagccuguagcagagaggagcccggccagacgcccauuuguagccaugaugguuaucugugggugaaucacaugccaacccacuaguggguggagugggguaaugcguggaagagaaguuucugaagucugugucgguauuuuacuguaaccauccccaaaguccaggcucuugucauuaaguuaauuauuaaguauuuccugcuuguccucgcuugccuuuuuaaaaaauuacuuaagacgcagccucugccuccuguguguggcugugaugcugggugccacuguguccaguuuccuccucuuuccauagugacuagcugacaucucgccugcuucgcacagacauacgccccuguguuucccuuggcgugacuuccuggaccuucagaugaggaugguuugguuuuauuuguuuguuuuuauccuggcucccacuuuuuucugucaaugauguuucugucucuccagguccuccaacaauggaaaccauuuucucucucucucuccaucaggagaaagaaccucuguuucuguuuuuuaccugggaagaggccaagggaguguuuagggcuuuaagaguauauuuguuuuuagauuuauuuuuauuuuaugugcacgaauguuuugccugcaugugugucuguguaccauuuguguacagaguccacaaacgcuagaacagggcaucagaacccuuggaacuggaauuacacaugguugugaggugcccuauugggugcugggaguugaacccagguccucugcaagagcaucuagugcucuuagcaacugaacugucucucugguucuauuuuuauuuuuuuuaagcuauguguaucccugaguauagaugugggugugaguacaggugcuuauggaggcucaaaguaucacaucuccugaagcugaaguuaaaggugguugugagccauccaguguggguacugagaaccaaacuggguccucugaaagaacaggaaguguucuuaaccgaugagccaucuuuccagcccuggagcccaggcuuuuaaguauccacuaagguuucugucuuacacccuccagugccucugugggcaacauuaaaccuucagcgaggucuagugauauucuugcugaaacuucuccauggcuguuauacagagccaaugauuuccuguagugcuugcuucuccuagacucucauaccauaaagacaaguuuccuaaucacaagagauuuugcucguagucuugccugacauuucugagucuuugagaauaaaaaauccuugagcaacaucgugucaucagcauccggugagccccgccagcuugcugugucugcccguuugcauccagcagaacuggcuugcaccugcccugcguguggauacaagugugagcaccaggccaucuccaaggucuuggcaaaguggguccuuucauuaaccacggagcagaaagagcuaagugugugcgcgcuuucgcuccgucccagcuguuaguagggcacguggugcucaggaaaugccuaaugaucaaggguccguuggcucauuuuccccagucuucugauugauuauucuuagcuauuuauucuacguguuagacaaauguccagcuacugcagcccugaacucccuauuugaaagaccgcccagggaggucagcaguggucccauguuuuccuugaagugucucuuugucccauuucacaggaaggacagaccuaguggguucagaagagcaagccccaccagagggucuggaaagaaccuaagugacuuuugccuagguguccuugaggauucaagugcagaauaugggccagucuucagaguccugggcucucagcauuagguuuuccuggcgggucuuaaguugacuguaacugucauaacagugacuuguaaauggagccugaaauguuaugguuguuuaguuuuuuugccaugaugauaaugauaacggugauauccucaaggugacugggcugagcccuaccuucuggagucuacgcugaccgucacccaugcuuagggaauggaaacuuacugagcucagcuccauacaagcagaaccuguauucccagggcggcggcagcaaauagaaaggacaccgagggccucucugucuuuucuccucauuugcucccuuggcuuuaucuucucccuggauguuugugugagcaggaagcccuacaguggcuguagggcaggugcaucccuggcacuggcucagaugcccucuuuggggccuuuuggguagcacucaugagggcaguaggugcaguucccaagucgcuggcugcaagccucagcuugccugcaaccacagccaucccagcggcucaggugcuagccuggcaggagauggaggguacagcugaccgcacuucaggccccuggcuugaaggccugucagagagggaagcucccgagagcccuaccuguguuuaucugugagcaggagccagggaaaccuuaggacuccaccuuucuacucucugaagacauucccuccuccugaggagcugggcagccacaaugauccccagggccagucacgaacacaaacacaggauuauuucuguugagaaagaaaagguguugaauguucuugucugguucucuggcuagaguaggugaggggauuguauauuuggggcuccauucuccccuuugcauuucuuuggcuuuuacagagagaagauaguuaacuagugacuaaaucagaaaaggaaaggaaauggucuggcgugugugugugugggcgugugugugugugggcguguguguaugugcguauaugcacaugggugguaucaguagaagguaguuuagagaugguaggagaacaaggauggucugguguaugugugauguguguguguuguauguguaugugguguguguguguguacaugugugugcaccuguggugugugugcauaugugaaguguauacauguguguggugugugcauauagggaguguguacauguguguggugugugugcauaugaggaguguguacaugugugugguaugugugcccauggguaguaucaguggaagguacagagauaggcuggugcucauguguggugugugugugugugugugugugugugugugugugugugugugcaugugcacaugguaucaguagacaguaguuggagacagugggagaacagggaugggcuggugaaugaaugcuacuaggugauaaugauaaagguaaaauucaggaccuugaaugggaaguaauagaguuacgaucacagccuuucauucuggguccaaaucucagcucagucacuuacugucucuauggcuuuugggaagaucaaacaaacaaaaccagccaaccaaccaacaacaaacccuguaagcccacaggaguaaucugcgcuguggguguagcucagucaguagaaagcuugccagcaugcaugaaacccugagcucaguucucaguacucauaagcuagguaugguggugugugccugucaugagaaaaaaaggucuaaaauaacaaaauauuguauaacauguagcuuaaaagggaugcauaacaguauauauggauggauguauuuuuaaaaauaugaaaauaagguugggagaaagguuucagugagagagaggauaacaggagacgaaaggaaugaccaacauucaguguguguacaugugugugugugugugugugugugugugugugugugugccuaucacaaaagcuauauacauauuaaguacacacacgcguacacacucacacacacacucaaacacacacacacgaaccuguuagagaaaaucuaaaaaagaaaagguauugaauucagggaaagagauuguugagagacuauaacaguauuuugaaagacacuucuggguuuauaaucugauuaagccugguucugcuuggcccauaccuuucucuuacccaggagggagggcugagccaauguuaauuauacuuagcccauucuugcuaaaacugcauucaguucacuugcuccaggggucuuugugcucuguaguguuagauuauuuucuuuaaauuguacauaauaauuuguuuguuuguuuauugagaucuauuuauuuuuauuauauguguaugaguguuuugccuguguguaugucugugaacuacguguguacucaguguucacagaggucgagagagggcaucagacccccuggaguuccaggugguugugagccaugaugugugugguacugggaauugaaccuguguccucucaaacagugggcagugcucuuaaccauggagccaacucucuagccucagcucauagauuguuaagcaucacaaaagaggauugcauauauggcuuacuuguuuauuuauuagaaguuacaacuaaauuuuuaaaaaauuaagaaaaaacagaguaaucuguauuuaaguuaauauaaauauagcaaaccucgguacaaauagacauguauauauguguauagauauauguauauauguguuaacucguacauguucauuguuauggguauaguaauaauaauuuuuauugcaucaaguucccuagggcaucagcaacuaggaaagacgucaucacacucucugcccucaaagccuuaggcgugccgugcccugaugaccgucccccaggugacaugcccuccacuucaucuuugccugucugugacaugcagcuuccauuuucucaucuaagcccugcuggcuucaagccacagucgcuuuguccugacaaagacgccagcucucuccucaggcucucuccucaaguucuucccaggcacagaaccuuuucauccugugacucagggcugcuuucuggcucuuguaaauccaugccaagugguguggccucuugucucggccucuugucuccuuggccgucucuugucuucuaccagggcaaggauucuaccuccuuagcgccaucuuuucucuuugcaugguuaggcucuggagagugaauuucuagacagaccccagggcuucucuuugaagucgucauucauccuggaucuucaggucuguggugucuuuugaagaagguggaauaaccccucugggcugcucacaccuuuuccagagucaugggacagccauucccuccccucucaaaaguccuccccuguaguuuagagaaggugaaaagccuuucuucuagagaccagccccgagguggguaacaauacuguaaagaugucuguguccaccaugguaccccagugcacccauccccuuugacaccguucccuggcuccaccuuuccugguagcaggcuuggguugccucagucucccuguugaucccuagagcuggcagguuuggugggggggggggagggggcgcagagggaugggauggguggcagagaggagacauaaacuucauguccucuguccagccuuuaacuggggguaaacuugagucauccgcuguguuggauugccuccauccaggucuuucuauagucagguaagaucuguuuccacgugaccaagaaaauagaaaauggaguggagagaugacucagggcugacacucucagugaucacaggacuggaacagguucuguaggucuccacugggcucccuuguuguucaccaugaagucauguaugugcaugugugcucacauuaucugucguaauacaacuugaagcauggaguggguacaccuuaaaucccagcaccugggaagcagaggcaggugaaucuuuacgagcuggcggccggccuuaucuauauagcaagcuccaggccagucagagcuacguagagagccuguuucaaaaaauaccaacaccaaaaccaaaaccguaccuccucagcacggugcuuugaacauaauacgugcucauuaauguuggcugcuauuaguaucguucucauaguugcuuaagaguaaaagcaauacacauuagcacagagcuuguaaggaguucaguugggcauuggcagagguuugaacacauucuuguguagcgugcugggaaggggugugcauuguagucuuuauuaacaggcuuugggaauuuauacugacauggaaauuuaguaucaauuuuuuacucccucaguuguuugcuuuuaaauauauguauuuauuuauuuauucauuuauuuauuuauuuauuuauuuauuuauuuauuuaaagugugcuagggauaacacccagggccuuguacagccuccagcaagggcuccacacugagcuggcaagcauuuuguauccacuaaacuccacgcccagcccuuaacuguuaaguuggaaaugcuucuaaguguuuucagcaccugggguggagauggagcucaagccugcaguccuacugugggaucuggguaucagcggcagccuccacggugacgggcggugacgggucuucccacuuucccaucagugacgggucuucccacuuucccaucagugaccccgauguccacaugcuguauugacaagaguaucagcuggagggucaaggggaaagaguagagcuccugccugcagugcacauccaugcugaagacuguuguuccgggcacaggaagcuuccuggggauuuucuuuucacugugugaccuugggcugaccaccauaccguuuuaguuacuuuguuuuuucuuauuucugagagagagaguaagaggagaccauggaguuaacauauguuaagaguuugugaaaaaaugauaccaagggauauaugcguucuauagggucucagagagccaggaugauaagcuucaggccuuugaagucuguauugcccccaggaggguguuggcaaagcucuggcugaugguuaacuugauagccgagcucugugagggcagagcaugaggcccacgguggugcuuugucugacaccugagacuccggugucugucucccggcauaaaugugacaccugcuauaggaggaccagguccuggcagcugguacucuggaaggagaggcccagccagaagcaggaggaaucacuuaacaggggacaagugacaagugucagucguucaaucagcacauucuuuagcuccaguugcucccagcggggcaagcaauggcuggguauccacugccagaaucgauacagagacagagaugagaaggauccaaauacagcgccugugcccagagccuggcacagagcaugugcuuagugagcaccggcagggccaugggaaggugauggaaggaccacaaaguccgugccacagagaggacagauccaaguccccaccgcccugucugcuugcucucuggucagcaagcauagaagagagagucagagagcuccuggcucugugcaguuuacgcaauucuaaagaaguuagaauucuuaucuccugacucucaaauccaaacccccaacucaggaacuguuaggagaaagagaagagugucaagcacuuugugagucagacccagauaauucacuguucccagaaggccugguggauggagcagauguuucuauucccaccaucccaacgaaggaagcaaggugaaggagaugcuguggcuagcucaaggugguacaacucuguguugugugugugugugcgugugugcaguuagacccgucacucugaagccugaagacucaucuguugaccauccaaaugucaugucucagaacauguagguaaggggcuggcuccauuuaaccucacugaguuuccugucuuuuccuuggccacagagagagccuuuagacgaaaaggaagagaacuggucaauugagaguucuucacuuaguacagaccugaguucaguucuaaggucagcaaagaagccagggcuuuacagccaguaaguggauuagggaaaccaguggaugcucaguugccaagaagagacagcaagcgcauucuggcuaaauuagccuaucaggauucuucuaaaaaaggaggggugguggagccuggaaaaaaagcacaacaguuguuaugcaguggugagaaccaaaguucagaucccagcgcccauguaaaaagcugagcaucugacacaugugaaggggccggaggcaggggcaucacuagggcuugcuggcuuuaagucuugcugagaaaacaugaaccucagguuccuggagagaccuggccucaaauaggucuggagugauugaggaggacuccugaugccuucuggucugaaugcaugcguacucccuacacacaugcacagacacacacacagaggggacucacuggguguguguguguguuaagauuuguguuuuuguuuuucaauaugugucuguacauguauccuuggaggccagaaguucccgucacuuaagugugacugaauauuuguguaguaacccacagccuauguccauggcuaaggcgucugacuccaggacuucucaaagcucugcuaaagaguagcugcagaagagaguguaaaugaugacagacauuggcaugugaaggcugucuucucuaaucuuggaagacaaauagauccuuggcugagaacuccaagugccucuuucuauaucuguaagacaagaaugaucgcaccugaccuaacuccagcgucugaaaaggcucggaugaugccucugagaugcuuuguaaacacacaccauaaccacagaagaaaagcagccuggccccccaccccccaucaagcuccagucugugacuccgugcccaccccuccaaacaucagcaccuagcccucaugcacaaugugaugucuguuuucugugugguccguacuacuggcugugcucugugguugguuguuuugugggccguagucuggucuugcucuguagcccaggcuggccuuggauucagcaauccugccuuuguuccccuagauuuuuggugugucauaggcaucugccaccacacuuagcuguuuauucucugguuuuuguuuaguuagcucugucccuguuggagcucacacagggaucccgugacacuuaaacuguucuuuccccagggcggaugacugucaaacuccuuuuaugugauucccugccccccuccaggggugcuucauucugauuucuuuuuagcagagcuuauguuaugcuaggcauggacuccagagcugagauguaacccagcccuucaagggccucuuaauaaagcagcccaauggagacaccccugcuugcuuggguucucaccauagccuuguuacuguuuguucuaugaccccagauuggucaugucauuagcuuugcucccauuuuccuuaccuggaggaggaugacgugaucuaaacuagucugaugguucaugauucugacuuauggcucacaguguuguacguuugcuuacuuuaagcccaacaccccugcccaaccauucucccugucaucaagaaggcauuggcaucuagugacuugcaaacugaccccugggcuccgacucuucccacccuuaccuugccuuuguuuguguaggaaugcuugcuugcacaccaaccguuuccuguccccuccuucccaccgcaguucuuucuaccuccgcagaugugugcaaacuaaccagguacagagcagacacgagggugucgcacauagccccagaacuaaauuuauggaacaaauacaaaguccuaggccuccuuuauccucaucucccauaauccucugcugcugcccuggaagugggcuuugucaccauuucuugacugggccuuugagaaaucacccaccaugagcaacuagguaagaaucauguugcaguggaacccaggguauaugaccauagcccaguucaccuagcagagucccuucucugacuuagggaaggcacaggucuuucccgucaccugccucacccauuccauaccuaccuugagagguguggugaggagaagccacucaccucucuuaucucuaccucucuaaucuuacagauuuaugggcuccugcauuaaguuggcuuuguucuguuuuucuucccuuucacaggguauggcagcuggcgagaacuggccaaggcccuagccagcaggaacaucccagccguugauccgaaucuccaauucuaccguccccagcggcugagccucaagguaugugguagguccagucuguuuuccacccuccucgcugcuggaccauucaaggccauccccucaguuguuccauggccuuaagggaaaucuucacuguggucuaugcagaggggagacagcugguggaaccccaguugcaccuugaaguucuagcugagugcagguaucuaucuugccuuccucagagcccuagugggccuggucguuuaggauuuuuguucacacuauccuauccaaguuagagcuguuccagacauguggcgucugucucagacaacacagccuuuuuauuuuuuaaagauuuauuuauuuuauuuauauuaguacacuguuauuguugucagacacaccagaagagggcaucagaucccaguacagaucguuaugagccaccaugugguugcugggaauugaacucaggaccucugaaagagcagucagugcucuuaaccauugaaccaucucuccagucccagacaacacauccuaagcuaguauauggcuuagagauagagcuuuugccuagcuugauuucauccccaucuacacacacacacacacacauacauacacacacacacacacacacacacacacacagcauuccugcauauuagccagcauauccuagagacaggacugacccugaugauaguaccagacacauggugcugaaagccagagcccguaaaguagacaaaugcccuucccugcaaacagcuggggugcaguuugucacgaagcauuucucuauaguauugcucagguguagguuagggaaacugaaggccauucccauuuggacccucuucccaccccaaccccugcaaccauugaccauagagcagacauggauccccaaagccagaugagaccaaaguaacucuguagacccaugugguagggagggucuggggugucuuugaggggcucccauuuguugagaccagugacaagucuggauagaacuugggggugggggcugaaggaauaagaaaucacagcuccugcuccaagggcauccagaguccacuuuuucucaugguugaaaacuucagggaagugaccagaaagcggagugcauguugacaagccugacauacucuccucagggaugugguguaaauaaugaaugagacugugucccuuaagcugacaagcuuccuugaggcaggaacuaugucccaugaccccuuccuucuccacagucagcuucaaggagcccagaauccuguucugucuccaauuucuuauuaaucuuuucaccaagcuccuucucuguuuugcugauaggaccaagaaauugcccgaaguaggaguaggaacaguagcuaccugaaguggaacaagccuguccccuggcucucagagguaaaggucucuauagaaccuggucucuguguauaggguguguguguguguguguguguguguguguguguguguguguguguguauucugccugcguguauguguacuucugguuaggucagaagagggcauugaauucccuagaacuggaauuauagacaguuuugggugcugggaguugaacccugguccucuggaaccagugcuuuuaaccauugagccaucucucaagccccugaaccugguguuuaaagagaagggacuuaaacagaugaaaugggcacacaaacauuugcugcaaaccuacugugugcauauccaucucccaucagcuguuuugacucuguaagguaguauuguguuaaccgagcuuucuguugcuagagcaaccgccuggcacaauccacuccuaagaaucuucuccuaugaagaagaaggguaucaucgagcaugguuucagagguuuuaguucuagcuugguuugcucuguugcuuugggucaauguagcacagcacaucuugaugagagcuagaggaggguuauucuaacaucgggguguauagaaagcaaagaagacagggaagggcugguccuaauaucucuccagcaucagaccucugagaccucuuuccuuuaggcucuacugguucccaguagcacugcaggcugggacuuaugggcauuucagagacacuguugauccaaacuguagaggucauucauuauucuuauuuuauaggugggaaagcagugucuagggaguuuacaugacuuucacagcuaugccaauccccagucuuaaagauaacaaccuccccaagaguuauguucucaaaccauuaaaucccagcuauuccaggaagaaagaaauccauuguuuaaaaaagauuaaaaacaaaacaaaacaaaaacacaacguaaaagcccacugugcaaggcaacuguucuuggaaauccacauuagcauaugaaagauucugagaaguccugggcaaaucuguuuagcuugguuuagcucagcaggucccaaauuuauuugccccugaauugccuuugccuuuuccauaaaugccuguuaagauucugaaccaccgauguucuagaggagcaugcauuaggaacuggcuucagaaagcaguugugagggguccaaaaaaaaaaaaaaaaucacaccagguacagugacacagcagggcaguuaguuagucacuugagucugcacagcaaagcaacagucaaaaucccagccacucugaaacuuuuuacuuaugggcauugguauucuuuuuauuuuauuuuuuaaugaacauguccguguacaagauaccauaaguacaugcuuaugcccaaacucuggaauagcaugguguucugggacgucauauuuuacagucaucuuggggccugggguagagacgacuuuucuuggcugugcggugugggccaguccauugucuuuguuguuccugcugcagagugaucucacagcuugggcgguuugauuuccaacccacccacacaagggcaagagugaaagagacaacguuagccccucuacgcugugauacugucuguuuuaaagcccagugggaggguggguuacaaugcugguacaguuguucuaggugacaucaccagauugcuggagacagugugcugagccauugcuguaaagaucaguugcucugguaucuagccuucacucuauuagagcagcuuggaucaguuuucuuuuucuuguuuuuuuuuuuuuucuuccacuuuuuuuguuguuuauuuuugagacagggucucauaucgcccaggcuggcugcacgguugucucaacuguguaguugacaaugaaccugaacucuucccaacccucugccuucaucucccaagggcuaggguuacaggcaugagccagcucuuccagcauauucccauucucucucucucucucucucucucucucucucucucucucucucucucucucucauuuuggaaauaggaucucacuauguagcucaagcuagccugaaaguuaugauccuccagccucagcuuccugaauacuggaauuauaggcaugugcccucguuaucuguccuagauugacuuuuuguuuugagaaaaaagagggcuuggcugggcuggaacucacagaaccugccucugccuauagaguacugagguuuaaggcaucugcuaccacacccugacagaaucaacuuuuuuugcuuuugggguuugguugguugguugguuuguugguugguugguugguugguugguuuuggagacaguguuuuccuggguagcccuggcuguccuauucuguagaccagacuguccuugaacucacagagauccaucugccucugccucccaugugcugggguuaaaggugugugcccucacagccuggccagaauugacuuuuaaaagaaauaauugggggcuggagagauggcucacugacugcucuuccaaagguccugaguucaaaucccagcaaccacaugguggcucacaaccacccauaaugagaucugaugcccuccuccggugugucuaaagacagcuacagugaacuuacauauaauaauaaauaaaucucuuaaaaaaggagagauauuuauuaucuuaguacauguauguggcuuuucggugguaaaugaccgauuuccguggauuucauuuuuaaacgucaaaagauuuaaaauccuuaaucuucauagaucuucagagaaucccugauuuccuaggacagggaggugaguaacagccacuccagcccagcuucuccaucucucccauggcugggacuucuguguguccagcucaguggcucuuggaauggggugcccacccccuuugcaguaugccugagagguugaaguuaguggagagucuugcucuaagcgaacacuucaggccuugccuuucuucccugggcagcagccauagcuauuguccuuagugugucagaggggacuaagcagaugggacagcugggacuggguauggaauaccuguccuuagaaacuuccugguacaccggcaaacuccaaugccagccaucucuucuguuggucagugggcagaucuauuagaacacucugucuacccaggacauuccuccaaacaaaaauaauuacaagggucagacgguaguggugcaaaucuuuaaucccaguacuugguaggcagaagcagacagaucucugugaguuuugaggccaaucugaccuacagaaugagugaguucuagaacagucagggcuacacagaaagacccugucuuuaaaauauauauauauauauauauauaauuauugugguaauuauuuguuacaacaaaauauuauuauuaaaauaauaguaauaauuauuauaaacaagaaaaaaaagaaagacaguaguuuuucucuugugaucuuuuuuuuuuuuuuuuuuuuuuuuuugguuuuucgagacaggguuucucuguauagcccuggcuguccuggagcucacuuuguagaccaggcugaccuuggacucagaaauccugccucugccucccgagugcugggauuaaaggcgugcgccaccacgcccagccucuugugaucuuuuuuuuuuuuuuuuuuuaagauuuuauuuuuuauuuauuauauauagguacaaugucgcugucuucagacacuccagaaguaggagucagauuuuguuacggaugguugugagccaccaugugguugcugggauuugaacuccggaccuucggaagagcagucgggugcucuuacccacugagccaucucaccagcccaccucuugugaucuugacuagaaguaccuuccuaacccagcucuuccacuguuuuuaaauaaauaaacaaacaaauaacucacugaccuuacuccgaccccugucgucuaaccgcacagugacacguugaccgguacuaagaaugcagugguggaauggcuugcucuagauucagcuucuauaagcauuuguucauucucagacauaacucagaugugcugggacacaugggaaggaacuguuagcucuucccagggaaggcacagagggccuuagauguauuugagaaaacuuuugaggacuaaaaaggagccuaacgaggaaaccgcauuuguacaagcguggaaagcugaggguugggugguucgggggcaaagacugggagugggaagucaguagggcaaggagggugugugcggugggggcugggaaggcaggucagucauaaagaucacagugagaugaucuuuaugacgaugugacuaaagucugaagucaccugaaguuuuuagcugcagagugaccugcuucaucagaucaguccaguugcucaggacaguccuggggggcaguaagaacacccagggcaggggagacgccaccaucugccuccuccugcugcugaccuggaaagcccaguaagucccagcagagguggaguagaccuucccuucccugaauaccccuucugcacucaccuucuccauggaguaauugcuguguguucucagggagucacuuccugagccccgauauccucccuucuaaaugagacaagcugacaaguacuuucucccguacggccagcuguaaguuccaaaccaucacaagcuuggaggaggggcuggagagauggcucagugguuaagcgcacugacugcucuuccagagguccugaguucaaaucccagcaaccacauggugucucacaaccaucuguaaugggaucugaugcucuuuucugguguguaugaagacagccacaguguacuuauauauaauaaauaaaacuaggaggaagcccaccccuucccuggccuucugucuaugucaggcaaaggagaagggccaccucggaggcugagguuccagagugccacaucuuuguuaguauagagucccuaaaauggaacaacacaaaacacaaauucugauguaguugucagucugggucugaggaagaagacaguguccaaggauccccaagacacccccacagucggagguuacccacaaaaguuugaggcucagccaaauacuggguagagccuaccucaaagaaaaggcuauuucucucuuccacucuccuucccugcuucccugagggcuuccuauagcaccucaggcucucuuggcugagcuggauugcuugcggaggagcugggagaaauugguaucucccugcccucaggccaaagcugcuuucugggcaaaaaccccuucucgugccaagugccaagucugacaucguagcuccaggcuucacacagcugacggcucugcucugguggccgugcuccccucaagucagagaaccagagcucucugaccuggaggucuccuggggaggggacagaagcagaccacuuggagaagacaacugaauccuuuaagcuggacuugaggaauuuccccagaagcagcauaaaguccccauucuuuuccuuccuuggagccucuaaccgccucccaccuaccaacccacagacuuccucacccaccccagcccccucccuacauuccugugagugguggcuacuucccaaggucccaggucagagagugacaagcuagccucugccagucagugaggagccugugagcugcaggaggcccugagggggcccccagauaccaccauggauuuccucagaugcuucccccagccagaguauggagaccacuggguaggugaggucaugacaggcagaaggcugcagagccuuccucuccugagaaacagggcaggcaugauaggcaagcccuuggcuagaaccugaccaagcuccucccagcuccuucugucacuugcaucguuuugccacggcuauuaagccccuugccugcacgugugugcaugugugcgugugugugcgugugugugaguguguguguguguguguaaccucagagucaggccauagggcugauguuagcuuuucaucaggacaagcauuccugagauaaccaacucaugaacaagaaaacauuguguaggcucaaggguucagaggguuaauccuaggccugcuuggcccaguuccuuugacuuguggcagcuuagugcauccugguggcagaggacugacuggcgagucaugaaagauaggaagcagugaggaucccaguaaucccuucaggggcaccgcccuauaaccuaaccuucuccuauuagguccucaccuccuaaagcuuccacaucuuccaguaccaccacggacugggagccaagccuuccauagaguauucgagaaucacuguguccacuucucacucacugcccccucucugccccacacaguuccggggccacgccaaccuacauguguuugaagacugguguggcagcuccauccaacagcugaggaacaaccugcacuucccacucuacccccacgugaguaccuguggggauguuuguacauggugccuggaccacccucugugucuccugcaucucaugcacuccaccugccuccuucccugcuucuucucaguccaucacagucggucuuacucccucgaucucuugggccuucucuuccucuguccagaagaucuuuuuugucuucuccuuccccgagacucuugccaccugccgcugggcagcauuucauucaguucaggcucucuugauguuuauccaagggcaacaugugcaucguacacggccagcuggaccgagaagcgaguaggaucucauaagcacaccuaucuuguacuccacccaccauaccacaccccuagucucccaucggcugccccccucuucuccuccccaccagccuugaguagaccgaguucuucaacucuucuuccugauucugagugacaguucaucuuucuugacguagauccgcacaacucugaggaagcuggcugugucccccaaguggaccaacuauggccuccgcauauuuggcuaucugcacccuuucaccgauggugagggagucccgaagccccacuccucuuccugcuuccaccuuccuggggcaggaggguccuagaaacauaacccugagcccuuguuacuccaucacggagggaggggaaacuaaggcauagugaaaucucauccaguauccucaggcaacugccccacccccaaagccuggaacuggcuggucuacauaauucuucuccaucuucauauugcucccccagaauguagaguccccucccccaugcaaaaauggcggguagggcaagucacugugagugaagaaaaucaaugugcagguguaacagaggcguucagccuccgugccaaggcccucuuugauucacccagacacucugcuguugcccagggaaaauccaguuugccaucgcugcugaugacaaugcugaguucuggcugagucgugaugaccaggucucaggccuucagcugcuggccagcgugggcaagguaggaccagcucagcccuugaccucucauuggcccuuggaggcggguacugaugugguaugagggucuugggagccuccuugaccauuaaugucauugacaugaagaagggacagaagccacacauggugccccucagcucuguccuacacugaaaagggcaugggagauguggacagaauggggacccagcuauauacauuuuucagguuccauuguccccgagcccaugcuaaggauucaugcuggguugguugccuaugggaaggcucccuuccauuauugggggcagaaguguguuggccggcaauccuuuuuaacucugucuucccuccuuugcuauuccccucuucccccaucuucucucuuuuccucuccuuccuucucccuucucuccccacuucuagacaggaaaggaauggacagccccuggagaguuugggaaauuucagagucaaauuuccaagccagugagguaaguaggguggguuaccacccacacucuugugagccccuccagugccaggcgugucagcaugagagauccaggaggccccuugccaucuucaccagcucacugcucaggguuaguaugagugagaauccacaccguuugucuaagcagaagccaucggcccugccuuuccucauuuuauaaaugguuuuuagacucuuuuucucacgagugcauuuugccuacauguauguacaagggugugccguguguaggccugguguccucagaggacagaaggcuuauuggauccucugaaacuggucuuacagaugguuguaagcugcuacaugggugcugagaaccaaacccugguucucagcaagagcaguacucacucauaacuucuaagcugucucuccagcucaucccccacccccacccucauuucagaggaggcgauugagacccagagcuuuguggcuggauggaaggccacacagauagugacacucaaggcuagaaaacaggucucuuuuuuuucuuccuauuuucuuuagaccuagaaaugcucgcacucauaaagacugccuagugcuugcucuggggcuucagagagggagucccuacagggaacuggaagccugaccuugaagugauccuaggaaaucugaccucuuccagccuacagccacuggaauggcauuaagagcuagccuaugaacuuagcucaacuucagcacgccaccugguggcuugcacauucacaggcgagaccauaucccagcuucaagggacagggagagagagagagagagcccuugguacuuggugugcccgaguuauugugagugcucugagcucucucagugcuuugcauggacccuaaaggcuaccugguccaaauuacaacugcguugcucacuaccugggcgacuuugggcaaauuaccaaagaucaccgugucuuuaagccgaagacugucaggaaaagaaucauguauggucccgguagcagagacuacucacuauggcuuuaaucaugggugccaugucacugggucucccagugaacuucugaacuauuuauauuuggcucuuucaaaaggaaagacaagguuaguugucaggaguaggugggggauaguuaaauagcaagcaccugguaggagaaaggggcacgggggaggggggcgcuugugggugggaaagguggaugauggagguggcuagcugaggaaaagccuccguuuccugucuuuguccgccaguuuaucagccucccucagguacuacuuugagguccugcacaagcaaaaugaugaaggcacugaccacguggaggucgcggugagugccuuuaucccucuugacaacccauccccccccccccacguucacguaccuuucccagcauucccuugcccauaucuuuugaacacugucccaagcccagcguccuccaaccucugugccuuuccucuaauucuaguggagacggaaugacccuggagccaaguucaccaucauugacucccccuucuuaucucucuuuacaaguaaguaggcucugccugccugggagcccaggggcuccauuagggagaguguggcccaugguaaggucagaggggugggaauaaaguucagauauguagaggacggguaugacagaguuccaaggaaggaugagagccugagagaccuuacaguuagggagacuuuacucuccuggguagaggucuguuuaaugguggugguggugugugccuuuaaucccagcacuuaggaggcagaggcagacagaucuuugugaguucgaggccagccuggucuacagauggaguucuaggauagcuaggugcuacacagagaaacccugucucaaaaaacaaagacaacguacuaaacauagauguggucucagguugguuuguuuguuuguuuaagggggaaggcaagcagucaacucccuaggggucuugauggagcagaauuucuuaaaucucucccaacaguuaucccuguuagccugagaaaucuacacaugauuccagguauauggguccaaaauagguagacacaccaaacauucauugauaacagaucauaaggacauucauuuuacagugaugcuuuugauauaccaauuauuaaaggugaaagcaaauuugucuguggaugaaauauauauauuuuauuuuuacaugguuaaaucuuggugcugaaaagaugucuuaaacuccaguuucaaaggauuugauuccuucuucugcucuccaugggcacauagauuuggguaaaacacucauacacagaaaauaaaauuuaacaauauaaaccuuuuuuuuaaaaaagagcacuaaguguucuuccagcagcucugaguucaguuccaggcccacacaucagcucacaguuaaucugucuuaucccagagaucugauggccucuucugaccuucacaggcaccagcacauaaggcguauacucacacagacagacauacaaacauaaauauuaggccagguggugguggugcaugccuuuaaucucugcacucaagaggcagaggcaggcugaucucuguaaguuccaggccagccuguguuaucuaguacauuaaagaacagccaggguuacaugggggggggggugacccugucucaaaacaaacaaacaagcaaauuauuuuuaaaaauaaaacuuuguuuaaauauuugaugcuguaugauaugcagcaucuucuagucuuuucaaauaaucaauauuguauauguaugugugcaugugcccggggcacacaugugcagaggccagagaggacaucgagugucugcuuuuuugcugucuaccuuaucccguaagacaggaccaucuccuggcgagauggcucagcaguuaagagcacugacugcucuucugaagguccugaguucaaauccaagcaacuacauggugacucacaaccaucuguaacaagaucugaugcccucuucuggggugucugaaaagacagcuacaauguacuuacauauaauaaauaaauaaaucuuuuuuuuaaaaaauuggaaaacaaaaaacaacaacaaaaaagacaggccuucucucugaaacugaagcucgccacaguggcuaggcugcuuucgugugagcuuuuaggcuaaaggcuauguucaacuuuuauguguguacuggagauucaaacucaugugcauaaaacagacacucuuacucacugaaccauauccucagcuccuugaucaauauuuuaguuuuauaaucaucggugcuggguguacugcuuuguauaaaucauugcugagagcaccucauucaacauuagugguacaaaauagaaacuauguuaagggucauuuugaaaauucugucccaauccuaagccaaaauucacuugauaucuuucuuuuucuuuuucuuuuuuuuguuuuguuuuguuuuguuuuugagacaggguuucucuguguagcccuggcuguccugcaauucacucuguagaccaggcuggcuucaaacucagaaaucugccugccucugccucccaagugcugggauuagagccgugcaccaccacugcccggcacuugauagcuuucuuaaguguucaagucuuuguuuucugucauuaaucuguuauguuucuguaagagcacacaaugucaugugcacaguaaaaacacccuaucauaacauucaguaguuuuguaccugagcaaaaguguuucagggauuguucacuggccuugcuagguguguggcaugugucggauguucggaaccaaggacgaugcugguucuggaaccuuuuagcuauugaccuuuuuuuuuuuuuucaugaccaguuuucaaaaccagaaaccuuuacuauugacacaucuuuuucauggacccccccccaccaccaccacccagcuacagcacucccuguaggagcuugaccaccagcuuaagcuguggacuggagaagaaaagagguagcccgagcagacccgaggaauaaaaaugccagagucugauccccagucugggcugugauggagaagacucuaguuagugggcugugcagacaagggaugccuggggaagccuggcucacugugaucacaugacauucacagaugguaugagagaggcugcccucuagagaauggaacuagauuacaugggugguaacaucuuucccucuuaccagagaagccuuaaguucaaacuccagcacagccaggaauacccaggaaguacuauacaggaauaccaaggaaguacuauacagguguaggcuaagugaaauuaaauaguacagcugaguauagguuucugucaggucaacaguagagcauuuugaggacgacauaucuuuuucuagucuauacagaaucgugaugugagcugaccauggggcagagcgggccuaaagggagcuggcuaaagccacaaguuacagggcaucugcgggcggcugacagccuaggcuuuaccugcaggaacacagagauuguguuugcgacccaccacuugccugccccacaaagcaagcuugauucuaucaggaccuacagcuuucuucuguucucuccucccugaacacagaugagaccauccuaaggauggaugaggugggccauaucccacagacagcagccagccauguaggcuccuccaacacuccuccccgggaugagcagcccccagcugacaugcugcggccugacccucgggacacccucuuucgagguaaguccuuggccacauacuuauugaucaccacaucaaggcucucuauguugauagauaggacucaggagaccuccggacagugguggcgcacaccuuuaaucccagcacuugggaggcagaggcagguagauuucugaguuggaggccagccuggucuacagagugagacaggacagccagggcuacacagagaaacccugucucaaaaaaccaaaaaaaaaaaaaaaaaaaaaaaaacaugucuacaguagcucugaagacauaaaaucuuuucccuuuugaaguguaaaacagcauagauaccaaaaauauaagagcauuuauguccaauucugugaugcuacaaaccauuauagaguagacauuuguccaaccaccacccaagaccaaaaauggaauuagaauccagagccccuuacgaauuccucccccaccacaaaugucagucucuuuaugaaucccaacuggguuuuguuuuuguuuuuguuuuuuguuuuuugcuuguuuuucaagacaagguuucucuauguagccuggcuguccuagaacuuacucuguagaccaugcuggccucaaacucacagagaugaccugucucugcuugagugucgggauuaaaggcaugcaccaacaccaccuggccuuggaucccaccaacucuuacuauuagguaaagaaucuguuagucuuguuuugaugcugaggacugaaucugggguguugagcugagcaugugcucugccacugagcugaguccccagcuggucauguuuacauuuuaaaggcugacaguguacccuguuuuuucccuuaaaaauaaaagaaagcagcagccagaugugucaccuauugacagugcagcagucaggaaaauaaggcaggaagaucuuggguuugcaaccauagcagacccugccucagaaaaacaaaaccaaaaaaaaaaaaaaaaaaacaccaggucaggggagaaguucuugaaccaaggacggaaauccacauagugggaguauaguaaguggggggacaaggggggcuugugccuccuagugucauuagaccaugauccauacuguuccugugucuugaguccucugcccucgucccugaggagugguggcaguuuccuugggacagacugacucaucugauugggacuacaguugucaucaaugaauauaaauggaagcagcuugaguggggacaucaggccucucccucaaccgggagccuuuguggcccuaagguguucaugcucaaacuucuucacacacuucaauccucuucccuuucuguccccagugccucugaucgccaagucccaucugcgccacguccugcccgauugucccuacaaacccagcuaccugguggauggacucccgcuacagcgcuaccagggccuccguuuuguaagucauguccuuagacggaggaggacugggagaaggccugcugccuguggcugcugguguaggggacaggggauggacuaaagcugacucuguguuucucguguccuugcucaguagacaggauggccucucgggucccuaugcugcauuccuggacaggcucacuaagguguucuggagacccugcagauacucugccuuggaaucuacccccacccccaauucugcagccuagugaccgcccucagggccacacaaaaaccuauuuugcuugcucagucccagaaacuggguagccaguggcauuuuaaacucauagacaagacacuuagagaaaugugcuggaugcaaaugguagcuuuaucuguguggagagugagagagcaaaaagaguaugauaaacccaggucuagacuggagacaagaaaagaaggaagaggucaagggucacagccaggccagagagugggugagcuauaauugaggacauuuuuggcaguggugagcccagccuguguuuaggggggaagggaaauaggguguagagcagacucagugucaugagauaaaggcucagagauggaaggaggguuagguggcagagagugaauggucuugauaacagugaagggagacagauggcccaaggagcuucacuaugagaaguuuguucuaucccagaaagagcaggcaugagaagaccgauucaaggcugcauaaaugugacugucagcagggcagcagcccuccccaggauucccccucugaugucugcccuuauuuuuucugcuuuuagguucaccuguccuuuguuuaucccaaugacuauacccgucugagccacauggagacccauaauaaauguuucuaccaagaaagugccuaugaccaggacagguguguggcacugggugggacaggcagagggaccgggggucucuguaggagucaggagagcugcccaggcuggaaggaccgauccacacugaggguccuggacucuccucgugugcauguauggauacacccucacagaacauacugccccagcuccuccacugcccugguaaaaccuggaggagucuggugccuguccacaugucccuuccuccuccagguccagcuuccaggaauauaucaagauggacaagccagagaagcauggcccggagcagccagguagagcggagaaugcuggcuaaggcugccagggccugccuagcuucgagugguggcgguuucuuucuagggaacauuccagccauacaaauccccuugacugaucuccuccucacaaucugggagcagagagcagcacccacaccuuccauuucagagccauguagaggguagagcuuuucauucacuggagguguggguagcuguggggaccccuggcucugguacacuacugggaagcaugguauagagcagucccgucuugcuguggccuuacuucaugaggcaccggguauggcugaggccccuuguugaggccuaaauguuguugauaccagugagguucuuuagacaauccagcucacaaccuucugagaggggggauuuguuuuguuuuguuuuguuuuguuuugaucuuuuccuuguuagcauaugugcuuuuggcuuuuaagacaaggucucaugcuugcauucaggauagccuaaaacuuacuauguagaccagguuagacccaaaaaaauuugugauguuccuccugucucuaccuuccaagugcugugauuacaggcauauaccccccaugcugucugucagucuugauguaaauaacaaaaaaacuagggguaacugagguaggauagcuuauccaggucacccaacaaaugacucccacucccccuccauaugucacauguguaacugucugcuguuuguuuuccgggaagaguugaacauuccugaagugaagaaugguuguuauuguuauuagcagguuuggaggauggccuucuagaagaaucccaguaugaagacguaccagaggaaauccccaccucucaagaccagaauacugggauacaagggagaaaacagaagacuauuuccaccccggggcugggugucacugacuaccaccugcggaagcucuuggcucgcucacagaguggcccuguagcgccucuuuccaaacagaacucuacaacugccuuuccaaccaggacaagcaacaucccaguccagcggccagagaaaagcccugugcccagccgagauuugucucauucugaccagggggcccggaggaaccugccucucauccagagagccaggcccacuggugacagaccugggaagacucuugagcagucccaguggcugaaucaaguggaauccuucauugcugagcagagaaggggagacaggauagagccuccaacccccagcaggggcuggcguccugaggaggacguggugauagcggcggaccaggaaggagaaguggaggaggaggaagagggggaagaugaggaagaagauaugagugagguguucgaauaugugccuauguuugacccaguggugaacuggggccagaccuucagcgcucagaaccucgacuuccaagcccugagaaccgacuggaucgaccugaacuguaacacaucgggcaaccugcugcuuccggagcaggaggcccuggaggucacacgggucuuccugagaaagcucagccagaggacccggggguaagguaaagggcuucccuggggcuggggcaggggcacgccguugcccucacgacugccaugaagcaggguuucugcugcaggaauguagcagaccuuugcugguauucucggguguaagaagguuggagcugugucuagcaaggcuugguagacuggugucugcccucugagaaggagcuugggaagagagaagcaagcagagcaggcugaaaacauaaggcccagccucagauggcaguuagaaggcaugacuagagcucugcucucccuccccuucccucuuaggugucauguugugcccccucccucccaccccucauacucccucuuauauauauauauauuuuuaaucagucaagaucuuuucagagaaaauuugcauacuauuaaacccaguaugcuggcauguacaaaaugcugguuuuaaaaguaccuucccggggcuggagagauggcucagugguuaagaacacugacugcucuuccagagguccugaguucaauucccagcaaccacaugguggcucacaaccaucuguaaugggaucugaugcccuuuucuaguguggcugaagacagcaacaguguacucauauaaauaaaauauauaaauaauucuuaaaaaagaaagaaagaaagaaagaaagaaagaaagaaaggaaggaagaaaacuuucacaauagaguucagcuaccacuagugucuaauaauucuaggacuuauccauuaccuuaauguuagcucagguccagccugcacaccaaccaggcaagugcugcccuccugagcuauaucuccagcccuuucuuuucgaaauagggucucagucaguuauggaggcuggccuugaauuaacaguguagcccgggccuagagcuuaaguuccucuugccucagccuccagagcagcuggaauuacaggccuguaccugagagaaaaaguccccucugccaauuauuuuaaaacagcuauccaucccaccaugguuauuccaguguuagcgcuauccugccucuccgaggcacccuguaccuguuaguuguccugcccugcuccucccuccaucuguucuucccaggcucugggaacagcaaugacugcucuacucugugggauagcguuauugcuaugacagauacaugaggacccgugguauuugucuuuccgugccuaaauuauuuguucuacaacccuacccauauugcucugaaagauucugcuuuuuuaaaaaauuuuuauuuauuuauuaauauuuauuuauuuauuauauguaaguauacuauagcugucuucagacacuccagaagagggcgucagaucuuguuacggaugguugugagccaccaugugguugcugggauuugaacucaggaccuuuggaagagcagucggugcucuuaaccgcugagccaucucaccagcccaagauucugcuuuuuuauggcgaaauaauaucccauucucuacguaaaccaguguuguuuauccauucacuuauggauaagcauuuugguuuaauuuuugacgauugcuacuggagcuacaguguacacaugagggcagauggcuuagucauacugaugccagucccuuuggguagugggauagcugcaucacauggucacuccaguucuaguuuuuaaaggaaccacccugauuuuuucuuuagcgacugaacuaacuuacacucccaccaacgugucuuauuugucuguauccucucuaguggcugccacucugucauuugacagcugugacagucuuuccagggugaaaugguuucauuuugauuuuauccugaugauuaguaacacugaauuuuuuuauguacuuguuagccauuuuuuuaaaagauuuauuuauuuauuauauguaaguacacuguagcugcccucagacacuccagaagaggacaucagaucuccuuauggaagguugugagccaccaugugguugcugggaauugaacucaguaccuauggaagagcaguccaugcucuuaaccgcugagucaucucuccagcucccuuguuagccacuuuuaaaagacuuauuuauuuuauauaugugagugguuugucuuuauguauguaaguacaucguguaugugccuggugccuucagaggccagaagaggaugcuagauccucuggaacuggaguuaaagaugguuguaagccaccaugugggagcugggaaccaaaccuagguucuggaagaacaaguguuauuaaccacagagcugccaucucucuagcuuauuuucuuuggugugugugugugugugugugugugugugugugugugugucccuccuguguccucuuccuaagugcuaggauuagacauaugcuaccaugccuggccuuuuguucuuauauguggacuugacuugucuggaacuccucacugugagggugaggcuggccucagacucuuaacgcaaaacuccugauucugucucccaaauucugggauuacaggcauauaccugggggcggggguggggaggggaguagagagagguuuuuuugagaccaagucuuguagauccugccuggcuguacacuuuguuuucuuuaaaagguaucuguucugggguagagaggugcucagcggguaagagcauuaacugugaaaacuuuaggggccugaauucgauucccacaugaaggccuggcacgccgcugcuuggacagguacagguagcuccacuaagauucccuccacaucuguagaggcuguccgccugcaugugugcucugucuaucugacggucuugcucauuuuggcuuuuuguugccugugugcuuugaggcucacacuugcuaauccuuugcucagagcaauguccugaagcaucaccagcugcuuucuuuaguuacaccuuccuuucugguccuaaauagagauguuuaagccuggagacuuagaguugaguuuugaguggugagaaaugugggcgugguugugggcgugguucuaucccucugcacacgcaguguggaggaagcuguccagcagacaagguguguucugcugucuuuguugcagaucagcugacuguaaaugccugauguauuuccagguuccuuugucccucuccauugaucgaccucugaggggugguguuguguugagcaccccugugguugacuguguguaacaccguaguaucaucuccguggaguuuuccuuuaaucaugugacgugaccguuugucucuccugaugaguuuugggcugaggucuauguuuuuggauaucacagcagcacuucuguucugguuuguuccguuggaacaccuuugccauccuugcaccauaaggaucucuguuugauggagagaugagcuuccuggaggcggcaaauagaugaauagaguuuguuguuguugaagguuuauuuugaucccagcacucaggaggcagaggcagguggaucucuagguucaaggcccaccuagccuauggaaugaguuccaggacagucugggcuacaccaagaaacucucauaaagaaaaaaaaauuuuuccccuuauuuuucuuuucuguguaugacucuuuuguccguguaccacauguguacagcgccugcagaguccagaagaagggguuggguccccuguggcugguguuacauaugguugugggcugcugugugugcuagaaauucaauacaaguccucuggaagaguacccaguacucuuaacuucuggcucaucucugcagacccaagauuuauucuaagugguaugucaaugaggguggggguuuauguggcuacagacacccuccaugucuggaaaagccuggcagguccucuggagcucgguggcuguaauucacccggcacccaacucaagguccucugaaagagagcagcaggcacuuguaaccacugagcuaucuuuccagucccuggauccuguauuuuaauccauucuauuagccuguauuauuauuauuauuauuauuauuauuauuauuuugacugggggauugagaccauuaaugaucagagugacugaagguguauuaauuucuaucauuuugaugauuuuucuuaaugugggcugaucucaaggagucuaucaccaagacugcuuguacagugagccuuagugcuuugaaggccucaaugaucauugugcuucaggagcaacauuuuagacggaggaggcagcgaggcuuaggcaggcuguauaucuuguaugagccucuacagcuaaccgauggcaaagcaaagacaagaaccaggaucucugacaacuggcccugcagacuucuaccacaugcccucugcucacucuagcugcccucugugccacaggagauaccagcugcagcgcauugugaauguggagaagcgccaggaccggcugcgcggggggcgcuacuuccuggagcuugaacugcuggauggccaacgccugguacggcucucggaguacguguccacuagaggcuggcggggaggugaccacccaggcagggaggacacagaagcucggaaccugcagggucuggucuggagcccacgcaaccgucacagacauguccugaaugcccaggauccagagcccaagcucugcuggccccaagguuucuccuggaaccaucgagcugugguccacuuuauugugccugguaagccuuagcagggugggguccuggugcccaccaugaacacugggucuguuuucuugauuugaucuuccaacuggguucacagaagaaaacgaauugaacguuguugugugguuagcaaacaguggaacugagaucugaugcugaguugaggcugguacuuucugucguguaggucuucggguuggaugugagcaucaacuuggguuguuguccaggaaagaagagugaggauauuauacagagugggauuuauuuugaugaugaugguggugguccagggccugccacaugcuaaguaaggcacugagccccaccuccugcccuaguguggucuuucuaaugagaaaggaaaacauaagacaacguguaacaaugugaccaggcaggacaagggaugagcaguaugagaagauggguagauagcaggccuguuaaagcuggccaggguugcucugaugugucccaccuaagacugucuccaaggccaggccuggaaagugcggagggagcugagcuguagaacccccaguagcuggcgaacccugccccuucuuagagucucugugcugcaugcuaauggauuccugugguugccuuauccccuuuaaagguugaugggacuccugacuugggucagugcugagagauguucacccuuccuuaacucuugcuguuuucuccuuaccugaccuaccuggauagugaagaaccaggcucgcugggugcagcaguucaucagagauauggagagccugucccaagucacuggagaugcacauuucagcaucauuaucacagacuauagcagugaggacauggauguggagauggcucugaagagguccagacugcggagguaaggaagaccucuggcuacagcuggcuuuucacuuuccugaugucccaggaccacugcucagaguggaaccagaagccacagccagcucuccccaguaccaauagccagcuccuacccacaacccaggagcacccaccugugcucuacugugugucucuacugugugucucuacugugugccuuccaacucccuucagggcuccuacagcugaauccuuacacccgauccagcguuucuucucuuccugcagcuaccaguaccugaagcugaguggaaacuuugagcgcucugcuggacugcaggcuggcauagaccuggugaagguaacggggccucaggggggcuugggugaucaggagacuaguuaggagacagacaguuggaaggugcaguccgcugcuuggcagggcagggguugggacauagggcuaugcuugucacauuccauuacugucguaagauaaccugagugcccuuguuugcuugcuguugcugugauaaacaucaugaccagaagcaacuuggggaggagaggggugacugguucacauaucuggagcacgguggaccauugagggauggugggcaggacccguggaaggaaggugcuuauauuauaggcuugcucuuccuagcuugcucggcuuuaacuuuauaaaaaagauucacuuauuuauauaguuuauggauaugagcacucuauuugcauguaugccugcaugccagaacagagagccagacagaagagaaccucagaucccauuacagaugguugugagccaucuguaucaugucguugugaagaguugaacucaggaccucuggaaacgcagccagugcucuuaacugcugagccaucucuccagcccucauuuuaauuuuuuaaauuaaaaaccauuucagaugguuuugagcugccauguaggugcugggaauccagcccagguccucuggacacugagagccaucucucuaguccuacaucuugcucucucauacaacucacgcugcccaggggugacaacacccacaguggucugcacccucccacgacagucaugaaugaugaaaaugccacgcagacuugcccacaguucagucugauggagacgcuuucuucaucgaguuuccucuguccuaggugacccucgcuugugucgaguugggguaaaauaaacaaaacaauccgcacacuggguuaaaugaagaugaaguuuguuacuguucgucaugccuggaacaauacucaaggccuugugcaggcuaggcaagcucccuuccacugagcuacacuuucagcucugaggaaagguucaucugguucauggucaccuugcccuguugcuuuugggccuguggggccaugaauuauggcagaggacaaugcucaccucauggcaccaggaagugaaagagaaggaggcugggaaccucaauauccuagugaucuaaauucuuccuguaagucucaccuccgacagguucccauagcaccacagguuggaaagcaagccuuuaucacacagcccuuggcagacaccaagaccauagcaaggagcaaccuugacacuacauugcagacccagcucuacagggaacuaaguaaauggcaaggaaguguucuccccauuguuagagcccucagacuccauaaaacaugggacaaaaguuaggcguugguacauaccuguaaucccagcucucuggaggauaggcaggagguccugaguuaaggccagccuggacuacacagaugccaggugagucuuugcaagauagcaugacucugucucagcagaaagagaaaguaggagaggagucugaauucacuaaguccugcuacaagagauuguagaaauuugcccuguguuuggcuuugugugagcugucagucgcuccagucucccagcucugguccaagggucugcuaacuuugccuucucuauccccaggauccacacagcaucaucuuccucugugaccugcacauccacuuuccagcaggaaucauugauaccauccggaagcacuguguggagggcaagauggccuuugcccccauggugaugcggcugcacuguggggccaccccacaguggccugaggguaagccuugcccuggauagggaggaggugauaguugaccuuggcguccaacacgaaggcuggaaaaguucacaucuaagcaucagcgucuuucccauccugccauccugucuugucugagcuuuggacagaccucaggcucuacugacaaccacaguagcaggcagagcgguggcacuguccucccccagcaugcagucaucugacauucauacaguaucugcugcgugcuggaugcugugcgcaggaagacaggaagguggagagacaaaguagaugagaagggcugcuggggucacauccuaauugccagccuacagucggguugugacaucagccauggucacagcuauguuugaucuuaagucuuccugggggguggggaggggcuucccccagacaggucagggacuucccuagcucucagcucucugccucugucaccccagucucuaccaucagagccugugggaucccaguguccaacucaucucaucggugucuugucugcccacaggcuacugggaaguaaauggauuuggacugcucgggaucuacaagucugaccuggacaagaucggaggcaugaacaccaaggaguucagagaccgcuggggaggggaggacugggagcugcuggacaggugacccuggaggagggccuuuagggaucugcuagagcuccagugccaggggcccucagggcagcgaggccagggccacagaacuuugcugccgauucccagggcacaagaaaguauauggaaguacacucuucaggagguuagcuucaccgacacgcagguugucuauccagcagaggggguugguaucucuacugugcgucacagugugagugguugguuguguugucagggguaaaacaagagccuggagccagauaaugaaaaugauguucuuaggaccaggggagcccccaggcuaagaugagcauucucccagaacaagcuaagaugagaauucucccagccagagauuguguuccuucuagccauagcugcuggaggcgaggccgaaagcuguagaggaugcugggaaauuggcuaaaggucaggagugaguuggggccagcaaaauaagcaaguauggauccuuaaaugacaauuggauauccaggggggucuggguuccuugaggugaggaaggagcggguuuugaaaagaaguaauagucucagagaagaaggagagggcuggguuauagagcaccugcuuagcaugaguguggccuuacacucaguucuagguauuaaacccaguacuaaagaaaagaauguauauauacaauauaugcacagggguaggguguguguguguguuauuugcuacucuugccaucauugugacaaaguacccaacugaagcaacuuaggagaagaugauuuggcuagcggggucauuguuagggaaggugucgcagcauuccugcggacaggagcuccugacaucagagggagagacagucuggaacuaagacagacugaagcucauaucccagcacauguugugccuuugcauccacucauacauuagcauccuuagccuagugugguugcauaugcugcuaaccccacccaacuggggagcuggaggcaggaagacugucauaaguucaaggccagccugggcuacacagcaagacccccacuccccaccucaaucccacauccccccucccccagaaaagaaaggaaagagagaaaugggaggacucaggggagcaguggauuuguucagcaggugggucaggaaaguguuccugcagggcuguucggggaugccaggcugugggaaggggaggagaagguggcacuggaguuucucccacauuugcaugugacuccuuuuucaagaaguuuguucccaagaggaaagagagaggucucaaccuuaagauaugcccuagaggggaaagcgagccucuaacugccagaaggguguccacagaaggaaaaaggaacgagaccagaggcaccaggggcaaugcuacuuccugaggcagguagcaagguauaauaacuucuggguuauuauaauaggcaggucucauugcccaaggccucgcuucuccuccuuaccaaacuccuguguuccgugccguugucuccauuucucagaggggaaaccgguuugcaaggugguugauuuuuuuuuuuuuuugauuauuugcccccuucucucucccccuguaaagcaucaaaggccuaaaaaccagaccugcuuugauuucccucuggagggaagaaaagggaacauugaaauaccgagaguuaaaggugggguagggagaguuucagagagcucgugucaaauaacagucacagggagccacaucccagaagaccccgaagcagaugggagcgcaguguagcaguuacugucccauaugcccuuugugcuggggcuuugugcuuugaugcagacuuccaaaauaguucuuaacccuccugcugucuuugccaccugaggaaagggcugcuucccucuagcugcaguccaguuugaaguaaaggccucuuuggaaagagacccugccacugccaacugcucagaugaaaguguugccuagccugggugagaccuuggcuuugacccccagcacuggguggcacccacaccuguaaucccgguuuccaggagggcgaggcagaagaaaaucuugaguuugaggccagccugaguuacgucacaggaugauuucccauacacgacaaacaagagcaggaaaaaagucggaaaaaagcggauucuccaguuccugucucugcugauacuguaaaugcaauuggugugugcuggaaacuguucugcaugcuacaaaugcaaaugcaucucgugugugaguguguguguguguguguguguguguguguguguguguguguaauuagagaggaugagugaguauauauaaauacacagauuuauaaaauuauugucuucucuuagagagagcaucuuugauaggcaacucucugacucacacagcugggacugcaacccaagcaggcuggcuccacuauaccuggcuugcuggagggaagcaaccagagaaaggaaggcagggucugacaaacauguggaagggugggucccucaggggcccaguugcucuugggugccuguugccuggguaccguugugugccuccuuuugcuggcucacacugcccucuccccuccaggauucuccaagcaggccuggaaguggagcggcucucccucaggaacuucuuccaucacuuccauuccaagcgaggcauguggaaccgucgccaaaugaagaugccgugacgccgggugggccagccgcuuagagcuccuugacuugcgguugaccucagugcccugcuugcugcugaggagggacucugaggaccugaagccucagcacuaauugcccucuccaccgggaacugucccuucaugcagggauaggcgagcgccaaggcuccucugcugcucaccaaguugacagauggacagaugcugggcagugaggucaggaagacaacaccugcuugcuuagaauaccaucuuguccacuaaggugcauucccacagcccagugcuccucacagggaguggugacugugaaccagaaacuucaaugggacagauuuuauuuggggugggagggggaauguggguaauuuuuuaacagagaaugaagacuucugucuagacccagcaccgucuggggucaagcuguacguugcagaccucagacccacccugaggugcuggucccaugcagaguacuuccagcuccaggcccagcccgugccuucuaaacccacacaucucuccugguggcuacugaacagcuggccuuaacccaaucgggccaguaacccaagucggacagacagagaguucucuagacuggaagcccaacacugguggcaucuuccuacugcaguggggugucgggugggaaugggugggcagagggcccauucucccaagugucugacauacgggcugguguaaaaccagcaagaucaagcaagaagaagaaaugccccuucuccuuugacucuccugccagguaagacccggagagaauaggaaggcaucaccaaaggugacaugaauagccuuucaguuacuuaagagagacuuggggacggacucaagcaacauagaaaggcaggaagggaaggaaauguguauacugcaagccuagugcccuuguggccuugcccuccugcagagagagcccagccucccagcccuaaagaaauaaggaggugaaaccgggcccucagauaaagggcagggcaagguaugggacagacaagaacaggggcaggaaaagcuggaaaauggcuaaguucugagaagaagcagccugcaaccccuucuguccaccugauggcgcguacuuagcuguacuaauaaucccgguccucucuggcuggagacgcucugcugcagcugcuucaccaguggugcauugaaugcugggcauuaauuaagcucagucugugaagggggauggugagggucagggcaccaucuuucugcugugagaaauggcugguggguaugcagcagggccacuuugcagagcgugaccacuaugcugugaaucaagagggccgcaucuggaguugcaggacccacguggugggcucugagugccaggagcagagcuuggcacauccaagguggggcccucugggaacccaccgggccuuucuuugaagcuauccgaagggcagggccgucuguuucugggcugcagcuuuuucuccugccugcucaggcccucugcccuuuagaaaaggugcacaggaagcaggcuaaggcugcagcagaacagcuggagcgccgggcuucucucugaaaccagaaacuuugggcccugugcucgaaggccagagccgguggcugcagcccuccuguucuguccuaaggacuagaaucccccugggccuccccacccugcuugccuccucccucccaggucuagugccuugugucugacaucuguuaccuccuuaccaucugccuuaagagagaggaaagugccguggguggggagagggaggagggcauuaaagucagcaucuuagaaaacaagcggcuguuuccuucuugcccaaucaagguaggaaaggguuggguggaagagccagggguguuccuaagccauucaugucccucagcugucugcucaagga

SEQ ID NO: 3338 - RNA, 1071 nt, Mus musculus
uaaucuccaacaaucuuucacccaaaacaccuaaaacuggagaaacuccuuguaaaggcuccccuggugccuuucaguuguaguugcgccagggaaaaaacgguauucaaauuugacuuggaagacaguuaagauugaaugaagugucaguuaauugugacuagggucuuucuagguagagaaagguccugaggccaaagucacagaggucacuuaaaaaaaaugugucucagccccacagcaagcuucgaaagagcgccuucgaauaucuugacggugacuggguuuucuugguucacagaguccaugucuuagcucgcaucuucuuucagucccauaucccucaucaucaccccacacacccucccacauaacuccaagccggugaguacgccagggaccagcucucucuggccccaccucuccccuucccucauucucuagggggcggggcccaccugcgccugggggcggggccaaggcgugggcgggacagguagggaguaagguaaugcucggagcugagagaaagcgcccuaacugcagcaagcaagcgcaggggccggagggcaacuaggagagccuccugggcagagcgcuggagugagaaagaagagagggagggagguggcgggccugcgacgaggagaggcguggagcggacacuuggggaggaggagcccggcuccgcggccggagaacgaccugcgaggcacccgcgcagcccaggaucaccccaacgcgucgagcaugagcagucggcccgcuggagagcgacccggggagacuggcugugcgccgcgcugagcggcggagccgggccggaacgacggguggguagcgggugcuggagcggcaggcugggcgaagcgccauggggagcccccgcgccgcguugcugaugcugcuccugcgcccgaucaagcugcugaggaggcgcuuccggcugcugcugcugcucgccguaguaucggugggacucuggacucuguaucuggagcugguggcgucggcccaggccggcgggaacccccugaaccacaguaaguagcgccggggggcgaggaggug

SEQ ID NO: 3339 - RNA, 40055 nt, Mus musculus
uaaaucaguccgccaccgcaggaaacaaaaucccaccgccgccacgucuagucgggucuucucuccucgcucccuuccaugacggccggcggagcuuuuuuguuuuauuuugguuuuuuguuuucucacagcuugccugucaaaguucugcgcccuccguccaccccgggugcgcggccccucaaggcgccgcgaccucucucgaggagaggcgagggaaaagcuaccccgcaagguggaacgcgcgcuuccggcgcgcggaggaauguguaaugccucggagagcagagguacugcuuccgguaaggggcuuccgguuccucuuugugucggggguggggacacgaacgcaaggugggccccuccguggcuagucggccggguuuguucguucuccgagaccuguuuuuaacaucguugucuagguuuggacaagugacgaacucuuggccgaguuuccgcgucuccguuuccuucuuucgaaugcuagucuuguacaacucguuucgcucggucgccuucguacggguuucucgcuucuccgugaccaauagguuucagcccaauuccgucauuacaugggccggccuucaccaccagcugcgacuugcuuuuucucacgacacugggaaccuacccauagagggccuggccuugcuagucuagcuguuggcagccaucccgaaaccguauuugaguaguaagcagggccugaaaacgcuugcuuuguaaccaacccauuucaguuugguaugaaacuggucaccuugucagaaaccucuacuuggaaggccgggcauaguugcacacgcauagaguuccgaucagcaauggcugguuuaaaaaaaaaaaaagccacguuucugguauacgguccuacaguuccuuuaugcgucuaagccugacucuacaagguugaaggcaagaaccggcuccaaaguuauccugugcccuccacauccauauaccuuuauggugaugaagguagaugcuuuaggggcaguucgagcugcauaugaauuugaggccugauuaggcuacgggagaccuuguaaguaaggaaaaucccugugugguggcucaggacuauaaacucaauucuggggaaggagauguagaaagagcaccauaaggccacaugguacacuuaucgaguuccagaauggucaagaauacgggguaagggccagaacaguggcucagcugugaagggcacuugccaccaagcuugaaauccuaaguuugauuccuggaaccccaugguuaaaggagagaacugaaagcugaccucaccuucacgccagguccacauacauucaucuacaaauucacacauuaaguaaucaaaggcuggggggguuggaguggggggguggcuaucagguaaaacgcugacucauaaauaaagguucuauucugcuagucaggaucaggaaugcaaggaaauggacucaggcuaguuuguucaauuacuuucuguacuagaaauugaacccaaguccuugaacauauuagguaaauguguccugagcuguaacuccaguauagucuccauuucuugcuuaaagaaaaaagggaaaaagugauauacagagaaaaaauggacauaggaagguaugaugaauuauauacaauuacuaaaauauuuuauaacaagacuuaggucauuuagcauuuaaucugaaaaaaaaagaacuaugcacaucaaaagagaaauaguaaaauucaaaagacuguuuuaaauuuuuguguuuguuuuucaagacaagguuucucuguagagccuugguuguccuggaccucucuguagaccagacuggccucugacucccagagauaccccugccucuaccucccaagugcugggaggagcaaaggugugcacaacuguaccugguauacuugaaaauuuaaaacucaucaaaaguucuuucauuacauacgcaaucaaaauauauuguuauuuggcuggggauggagccugaaggaucacaacuccaagaucauccucagcugucugugucaaggcugcccugggauuuaaaaaaaaaaaaaaaaaaaaaaaaaaaaaaggcaacaaaagaagcaacuuuuaaagaaaaaugaauucaucucaaguaaacugaggaaaauacauuccaagcaccacauauucaucuguaaguuaccaguguuagaguagaaugaaauuaguaucuaagucugguaaguauuuggcaagacugugaauuacggccucugauguauuucauuuuacuuuugagccagggucucucuguuucauccaggcuauuauuguacuggaugcuaaugaucuuccuguaucagccuccccaguaucuggaacugcaaguauauacaguuuauuguuuaaagccucacaucagagugacaggagugggcaaaucucauugagugaaaaauguuaaaaaaaaaagaaaacccacagaauuucuaaggaaauggcuuuuaauucccacggugggguagugggguagugggguagugggguuguuugauuuugcaguacuaaggauugaagccagggcuucacagguagguccucugccacgaagcagcuaaaaauaucgugucuacauggcccagagcacauguggaaaucacagggcaaccugcuggaacccacauggugaguucucaccuccaccguguggguuccaggagcugaccgaagccaucagacuugucagcaagugccuucguuggcuaaaccaucucagcggccccuuauccauuguuuuaaacugaauuuugauacagggucucacuaaguugccuggugugcuaucuuugaacugaauucuccuuccuuaguuucuauaccugguuaguccucaaacauuuugucaacagcccauuguggcuggcugguggaggucuuuaauauauuaacacuuggcagaggcaggcagauguccgaguucauugacagccuagucuacagagugaguuccaggacagcaggcuacauaggaaaacaugguaacaaaaagacccuuauaggggauagagaaauggcucuauccccucaccagacaguagcauuugcugcucuugcagaagaccugaguucagaucacaucagccacgaugagugguuugcaucugucuauaaccagagcuccaggagaucuaaugcucucuuuaaacuuaugagggcacauacaugugcagcauauacacacauguauacauuuuuaaagguuuauuuauuauuguauguaaguauacucuagcugucuuuagacacaccagaagagggcaucagaucucauuacggaugguugugggccaucauaugggugcugggauuugaacucaggaucuucaagggaacagucagugcucuuacccacugagccaucucacuaaccccccucauguauauauuuuuaaagaucucacuguaggauagcuauagcugguaguaugaccucacuguaguuuagccauaccugguagucuggcauucaaggucauccucugcuacuuacuaaguucaagaucagcuugggcuacaugaaaucuugucucaagucaaaauaacauguauacauuuuaaaaguacugaaagagccaaaaaacuuuuacuuacauagauuauguauuuguauauuuauauuuuucauauaauaauaauuaaagcuaacaaacuuagcauggcagauaucccauaauuccagcagaacaacaagacauaagaaucaaggguuuaauccagccuggaauacauaguaaguuuaagauuccuccuccuccucuuccuccucagccacgcacaccccagugaagucuucuuggcaggccgagaggccuggaagcgcucacaaggcaaagaguuucacagaaacucaccuccuggagcuuugguguucucauuaacccguauacucauacccuauucccgcguuagucugguguauggaucuaugugcucucuuuuaguauuauuauaagugccuuuuaagauugaauucugacauagcuaagccuucgccaguguuccaacguccuagaaaguccuugagcugaccaugggcuuggaauucaauguugccuauucagugacauucagaauugccucugguauuacacuaucacuuagaauaaaagccaaguaagucgcucccauauacaggaauuuacaaugguuuaggaaguagaucaggcggugguuuuagaguauugcauuauucaugagaugguuagcuagagcagaacucccaaauuagagccauggcuugggugugaaagcccuugcccuaggaguguaaagaccucacaccuggcuccuaagacuauagcugaccuuagauagggcugacauugucucaguuguuuuauugcccaguuccugccagucuuuguguuuacauuccucuguuuaguguaagagucaguaagcauucgguaaccucauuuguaccuugcugaugugucaccuaacuucccuauuuucuucuguauaaaaaguuugaugcucgggcuggugagcuggcucagugguuaagagcgccaacugcucuuccaaagguccugaguuaaaaucccagcaaccacaugguggcucacaaccauccguaacgaaaucugaugcucucuucuggagugucugaagacacacuacaguguacuuacauauaauaaauaaauaauaauaaaagauuuauaaaaaaaaaaguuugaugcucaauuugacagaugacauucagauucugguguugugucugucugucauucauuugccgacuccuuguccaucugcaacuagagacucguuccacacagacaaagggacccagagggucugcagcacucuuuuuaaaaauuggaaauguggggcuggagagauggcucagugguuaagagcacuggcuguucuuccagagguccaauucccagcaaccacauggugacucacaaccaucuguaaugggauccaaugcacucuucuggugugucugaagucagcaacaauguguguauguguguguguguguguauauauauauaauagauuccucuaaaaauuggaaauauauaggaaggaaugaaccaugcuuuuuuuuuuuuuuuuuuuuuuuuuuuuuugguuuuuucgagacaggguuucucuguguagcccuggcuguccuggaacucacacuguagaccaggcuggccuugaacucagaaauccgccugccucugccucccgagugcugggaucaaaggcgugcgccaccacacccggcugaaccaugcuuuuaaaaauaguauuuaugcuauaauuuauaccauaauauuaaaauuuuagauuuacuucaugaguguuuugucugcagguauguaugugccuacugcccacaauaggaggucaaaagacugggacuugucuccagucaagggauuacauauucaaauguuaugucuagucagucucauuuaaacaucaggaggauauaugaagagcugagggugguggcucaugccucuaaacccaacacuaguuggggaacccugucucagcaacaaaagaggauauauaaaaggaaguuacacaagaaaggaucaauucugcaaugcauaguagcauuacuuuaaaauuuggaaagcuugaaaauugaagcuuuuaugccuaugucaacuucaguggcucacugauaaguguacacaauuuuuucaauaugauauuucaaauaucauugguuuuccuauucaugucauaggaaaggauaaagagaaaguuuauaguuuuuccuucuuuguuauucuauuuugguuagucccugggaaauucuuggagucaggcuugggugagaaguauaguucagugguagaauacuuguuuaccauuaaguaaccaugauuccuuuuuugguuuuguuuuguuuuguuuuguuuuguuuuguuuuguuuuguugagacaggguuucucuguauagcccuggcuauccuggaacucacuuuguagaccaggcuggccucgaacucagaaaucugaggccugccucugccucccgagugcugggauuaaaggcaugugccaccacgcccggcaggaccaugauuccugaagccuuaguucagucgcagggugaauccaaugacugagcaaacaagcaaagagccauuaaaauguguuuggagucagaggugaugagcuauaauaccucucuguguguuuguuuuguuuguuguuuguuuaaggguguaguucugcccuagaacuugcuguguagacccagcuggcugccccugccucccauacacugggcuuaugccugagucccagaauuugaggguagaugcaggaggaucucugaggcuucuacacagcaagauccaagcuaaacuggauacauagugaguccugguuugguuccucacacccauaugguggcucacaaccaucccucuuuaauuacaucuaagcuaaggcauagaaaacucugucuccuccucuccucuccucuccucuccuccccuccccuccccuccccuccccuccccuccccuccccuccccuccccuccccucaaacuccugauccuuuuuaugucccuucucaggaauugggauuacaggcuuuuacaacuccguaggauuuguagaacguuucuuaggcucacuugaaacaaacuaaaggcucacucgaaacaaaugauaauguguacuaaacucuccgaggaguucucgugauuauguaugucauuuaugcaacagguuucauuaaaggaaaauaguuaagugaguuuagacugaguugucaaaacgaguucuaacagccaagggauacuuaccuccccccuccacacgcauucugucuuugcgcaaugcugugugcagaagagaaacuacacuucccaggaaccucugccggugaggcgcaaggcaagaugggaaguacugcugggugaacaaccguccuauuggugugcaaccuaaaaggccgccugagcucgugagcgauugguaggauuuuguagaugcucgcugauuugaguuguuuuucgguugcguuguuggacgccagggguuagcacuuggugaguguggauuucagggaaagggugaaaguuuuuuggggaguaaauauggugggauaaaagccuuaguaaucagugcggaagggagcuacaggagacuaaaccuagggccagucaaggaaagauugucuguaaaaagagaaguuuccgggacgcggagagcuuuaagaaugacugagcaaagaucugcucaagaacuguaugaacuugccagagaacaggauccagacguccugagauggacggaguuccgucuccgucuuccucccacuugcuuaagcuucgauuuccucguuugaaaaauaagggauaauaaaaauacuucagaaagugguuaugcggguaaauacgacuuuuuagggacgggguuguggccaauauguagaguguuugcuuagcacgccugugcccucaauucgaucucuuacaccuacaaaacagaaacccaucaccuuuuauauaaauagaggcauuccugccuugcaagguaggauuaagauggcuucugucugccuggaagauagguuaucauaguaaaacugcaaauacaggcauuuaucagugaggggggaaaaaaagcuuuuaaauuuuuuuaauuauucguuuuuguuuuuugauucgggaaucuuacucugcagcccacgugggcuugcaguucacuauauguaccagacuggucucaaacucuuggcauuauacucuugucucggucuucugaguguugggaguacaaguacacaaucaguuuaugguuuuucuguuguuuauuugagacaagaccuugcucuguuccgggcuugccuggaauucaacucuguacccuaggcugcccucaauguugggugaucuucccagugcuagcuuuuaaugacagaugccacuacaauuggcuuucuagaucgucuugaauggaaaaacucaagaaagagauggaagaaauaguauuuaagaugaauuuuacaugcagaauacacuugauuaagugaauuuacuagaguuguggaaggaguuauaauugaacugccaggaagcucaugagcaaaggcauagaaccaagaacauuaugugccucuggcgugguguauaagcuuuuaaucccagugcucgggagccagaggcaggcaaucucuguaaguuuuagaccagccugguuuacauaguuccaagccagccguagugagauccuguccaaaaaaacaaacaaaaaaaacauuuuauaaaaacaggguauaucuggggaaagagauaaaaauaagucagggaagagagguuaggcucuaaaauagaaaguucugaauucuaggcuuuauuuaauguucgugucuguaaguagccacuugucagcuugugauuuuuuuguuuuguuuuguuuguuuguuuguuuuguuuuuuuuggaacaagguaucuaucacuauauaaugcugguuguccuggaacucaggcuggauaugagaaucuagaaaaguauggccuaaccuuucccuuaaaucauuagacaggggcuagagggacgguucaaguguuugagaacacaggcagcucuuccaagggaccuggguuugauucccagcacccacauggcagcucacaguaaacaugcaucuagugcacagacacacaugcagggaaaacacccauacacauaaaauaaucauauuuuuaaaauuauuagagccaacaguauaaaaaugguauaagaggacucagcagguugaggugacaacuugaggcugacccuccuagagauaccagggaguagggagagaaagcugacucuuuagauguacauacaugcccacauacacacacacacacacucaaauacacacacacacucuuaaaaaaccaagaugaucuuuccuccucaguuacuuguugucaguuaagauggaaauuauaaucauacagauuuuuuuucugcuguuuuuuaauuuuuguuuuguuuuccuggugcuagaggauuagaacccugggccucacauauccuggguaaucuuugucaaagauaaaaaguagaaaaagcaagucaaacaaaguacuuuuggcucucuguucauucuaaauuuggcaugacagucuccuuaauuuccauggacuauauugcuuauuuuuaaaaguuuuuuuaaauuuauuauuguguuuaugugugaguauguagaggucggaggacaacuuuguggggguuuuguuuguuuguuuuguuuuguuuuuucgagacaggguuucucuguauagcccuggcuguccuggaacucacuuuguagaccaggcuggccucaaacucagaaaucugccugccucugccucccaaauucugggauuaaaggugugcgccaccacgcccggcuagguucccccaccccaaccucuuccccccccccccaacccgggauuguacucagguuggcuaagcugucucugcagccccuguuuggcugauuagaaucuggcuggguauaguaaugucaaccuaagugaugugaguucagguguaggcaggcugagacuggccgguuccaggcaagcccagacuacauagcaagauccuguaacaaacaguuugagugagcuugaguguacuaggugugguacuaguacguaccucuaugcauggugccuugaaguuggaggaaagaagaugggaaguucagugccaguguagacuacguccuguuaagguauggguggggguauagcguaauuuuuugcucaguauacacaaaacacugaaguugauccgaagaacuacauauauuauguaugguggcaaaugcauucuggaguuggaggcagaaggaucacagguucaggucauucuuagauacauaggguguuuaaggccguaaguuacacgaaaccuugucaaaaacaaacgaacaaacaaacagcugggauguggugguucugaggccagccugguuuacagagugaguuccaggacagucaaggcuacauagagaaacccagucucagaaaaacacaaaaccaaaaaaaacaaaaaaacaaaaaaaacauauuuagggcuauagcuuagugguaaauauuugcuucauaugcauaaaaauaagauaaauuccccccaauuguuuuuuuuuuuuuuucuguacuacaaguuggauaagcaguugugaaaacacccaguguuggucugaaugccacacucuccacagaagucaaauaugguaacagagggaacugugcucuauagccuauauuuacugaucucaccucuuccuggcccucauugugauuuuguguaucugacugauagguguggagaagacagcaugaacuucacuccgacacggacacccaucugcagaaaguaagauauuugcuuacguaugaguuguuaauuaaucaauacuucuguagguuuuauccagucgguauaggagauaaggaagggggcagcauacuuuucuaaaucucaauucucugcuuuuauucagaaucuaguuuuugugagagugggguagguguguguuuuaguuuuguuuuuuuuaagacauuuucucugugcagcccugacaguucuggaacucacucuauagaccaggauggccucaagagauccaucuaccugccucugcccccugagugcuggaauuaaagguuuuugccaccaccaccuggcucagaaucucgaucuuaaaacagcuucccaauggugauggcaagcauccuuaaucccaggaggcagaggcagguggaucucuaaguuugaggccagucuggucagcguauugaauucuaggacggcaagagcuacauagagagacucugucucaaacaaaacaaaacaaacaaacaaacauaaccucuuuuuggaacuaccagaacucuuucagugugaauggaggagucccagugaugguaggucuugggucauagggaguaaccaauauguagauaagagauggauuugccacacagccuucaucccucccagccauagcuccccucuugcagaguguaagaacuacucuuuuguuugguugguugguugguuuugguuuuucgagacaggguuucucuguguagcccuggcuguccuggaacucacucuguagaccaggcuggccuugaacucagaaauccgccugccucugccucccgagugcugggauuaaaggcacgugccaccaugcccggcuuacucuuauuuuuuaauaacuuauuuauuuugauguuuugcuugcauguauguguguuugagaguauuggauccuuugaaacuggaguuauagacacuugugagcugccaugaagugaugagaauagagagcccagguccucuggaagagcagcagugcucccaaccaccaagacagcucuugaguucaaguugcucucguauuuguuggccucuuuuucacucuuugaagauaagaucuuauuucugucaugggcuuuuguguccggugcuagggaugugcugugcugggguguuggccuuaugugugccaagcauguguucugcucucgagcugcagguccagucccuaagagcugucaguaacugaggaaguguuagguuucugcucuacugaugcgcuacacuccagcugguagcuuacugcaugcacuuggcuuacuuagagagggacauguauauuauccacauucauuagcuguaacuggcaaucuugugcaaaguuucugcacucuaaugucuauuuugcuaugguauaauuuauuuaugugcacagauauuuugccugcauauguguuugugcaccuuucgcacaauugauuggauccccuggaacuggaauuacagauguugguuaugaagugccaugugggugcugggaauuaaaccuggguccucuggaagaacagccagugcucuuaauugcugagccauuucucuagccccauauauuguaaaaucuagaaugccaagauggauugguuuucauaggaggacuucugcacuguuucuuuuuguaaaauuuuuuauuugauugguucuuuuuuaaggggggugguacuugguguuucaggcagucacauuaaagccaggcagugguggcacacaccuuuaauccuagcacuugggaggcagggggguuucugaguucaaggccagccuggucuacagagugagcuccaggacagccagggcuacacagagaaauccugucucggaaaaccaaaaagaaaaaaaaaaaaaaaaaaaaggcagucacauuauaugauuauauguagcccuggcuugccuagaacuugcuaaacauagaccagguuagccuugaacucagauauaccugccucugccuuugagauaaaggugugcacuaccaccacagcucacuguugguuuucuagcucuuacuguguuagcuuaagucucuugcuuauuauuuauuacuuuuuaaugauguauuauuggaggacacuuguaugccagaagaaggcaucagauccuaccauagaugguugugagccaccaugugguugguuggaauugaacucaggaccucuggaagagcagaggucuuaccacugagccaucucuccagcccccaagucucuugacuauuaagaacaaagaaacuaaacauuuccacucauuccucuuuuucuuuuguguucuagguuggccuggaacucaguguagcaaagggugaccuuggauuucuuacucuccuucaccuccugaguacugggauaauuuuuuuuuuuuuuuuuuuuuuuuuuuuuuugguuuuucgagauaggguuucucuguauagcccuggcuguccuggaacucacuuuguagaccaggcuggccuugaacucagaaaucugccugccucugccucccaagugcuggaauuaaagacauuugccaccacugcccggcucuggauuuuucuuuucuuuuuuuuuuuuuaaagauuuauuuauuuuuauuauauauaaguacacuguagcugucuucagacacuccagaagagggagucagaucucauuacgggagucagaucucauuaagggugguugugagccaccaugugguugcugggauuugaacuuuggaccuuuggaagagcagucgggugcucuuacccacugagcuaucucaccagcccucuggauuuuucuuaacaauccuaaauucacuaucugucucugucuacugguugcgugcucugccucuugcccuaugguugacuuuauuuaauccuguguacaauauugaagcaaaaggcucuuggauuaaagguaugauaaggcugagccauaccacaacuaaaaacagguuuuuccaguaaauagcauagucucaggguucacagugugauuaaagauccugcaacaguacuguguaguauccauauauauuguuuuuaaauguuauuuuuaaccucugguguuuacuuuagauaugguuuugucauuaauacuuagaaaacaauucauaaaaauuuuuacuaacuaguuggcucaaacuuucaaugcauaugaacucuuuuuuguuuuguuuuguuuuguuuuuuguuuuucgagacaggguuucucuguauagcccuggcuguccuggaacucacuuuguagaccaggcuggccucaaacucagaaauccgucugccucugccuccugagugcugggauuaaaggcgugcgccaccaugcccggcugcauaugaacucuuaacaccacuagauguggugacugauggcugugaucccagcauuuggaagauagagacagguccaucuuugugaguucaaagccaaccuggucuauacauccaggucuagaccagccagggcuacauagaaagacucuauaucaaaacaaaacacccauaacaccccuuuuauucaaaaaguuauguuuuacaaguguucagaggauuuaauauaugcugucuaauuucacauagaauaucguuugccucuaaacguggugcuggcucuggcuuuggugauaccaacagguggaagaaaauggcagacucaauggagucaacaccccugccuucagucgaggaucgucuggcuguccuuugcccuucucaggagcuucuggaguauuaucagaagaagauggcuaacugugagucagagaaugaagaucugcugaagaagcuagagcucuacagagaagcuugcgaagagcaggugagagagagagagaauucccauggguccuggugcucacugcccaggccucaauggaugcugaugcugagcucucagucuaaggagagacccgucucaaacaaaaaguuggagaagcaauggaggaagacacccagaauuaacuucugggucacacaugcaccugugggcacgcacacacacagagaaagagaacaggggcggcauguggcauucucgaugcugaugcuguugacugugaaaggaaacuuaaggguuuagucauuaauguucagaauuaccaaucacacgaguccuguagcuugucuuuccauuugccuuccuuuccucccuucuuccuuucuuuuagugguagauagcgaaccuagugugaagccugcuuaccugaugcucuaucgcugagccacacccccaucucauccuuuugcuuuuuagcucaaaugugugcacaccuaauacugucacuugaauucucuguuggugaaacuaucaguuagguauguuccuacacgagccgguaaaaguaucauuuagucuccuguauuacuugucgucuuggaggcuuacugcuuccuucugcuaacuuaggccaggccuggaaguggcuagccucuguacaaucuaaucuaggccuagaauguuuccagccucugagacuugcugcugaauaagcucaccuuuucuaguucuuucugaucuccaguuggcugauucaacucagcuguucuaucugaaacuccgcuccaagcugacugauucaaucugucuuuucucucucugccucuccuuaauugcucugcuugaccucagaccaacucuggcacucuguucuaauuuucuagcuccuucucauucucuggcucauucugucuucaucugugucuagcuuguuaucucugcagccugucucuguaaaauucuccaguaaaacugcugcuuccucuccugugcuucacugcuccuuaaacggcuucccuucccccuuucuccucaugagauuucagcacauccuguucugucacauauuuuucugauucaucucugaucuguuacuuugucugccauucaaucagauaucacuuuucaaacacggcugcugcugcuucuucuuucuucuucuuucuucuccuucuccuccuucuccuucuucauuauuauacggcugcugcugcuucuucuuucuucuucuuucuucuucuuucuucuuucuucuucuuucuucuuccuucuucuuccuucuucuccuucuccuccuucuucuucauuauuauacauaaauacacuguagcugacuucagaugcaccagaagagggcgucagauuucauuacaggugguugugagccaccaugugguugcugggauuugaacucaggacuuuuggaagagcagucagugcucuuaccugcugagucaucuugccagcccccuggcugcuuccuucuacaaacuaacuuuaccuucacuuuuugggaauaaaagugugugcuaagggcugacccacaccacaacuaggaacaguuuuguuuuuauuuuuguuuuuguuaucaguaacacaaucuugggauucacagcaugaucaaauauucuucaacaugaacugacuccuccauauccacuaagagguuuccuuugagaccuaauauguuuucaacuacucuuuuuuuuuuuucccagcauaaacuugaguggaacuugcagcagagggaggaagagauugcagaauugcagaaagcucugagugauaugcaggucugccucuuccaggaaagggaacauguuuuacgacucuacucagaaaaugaccgacuaagaaucagguacuggcucagugguuaagagugaguacugcaaggguccgguucccagcacccauguugcgcagcucauacccuccuucaacuccagcuccagggaauccagugucauguucuagcuucugaggacaauguaaauaugcacacagagucacacauguauacaagaauuauaaaaauauuaaaagaaaagaggcagguacugaacaaacaggaaauguuagaaugaaaacuuuuucuuuucuuuuucuuuuuaauuuauuuauaugaguucacuguaacugccuucagacacaccagaagagggcaucagaucuuauuacagauguuugugagccaccaugugguugcuaggaauugaacucaggaccucuagaagagcagucaguguucuuaccaccgagccaucucuccggcccaguaugaaaacucuugagucacacuuaaaugaugaaauauaacuacaguuauugucuuagucaggguuucuauuccugcacaaacaucaugaccaagaagcaaguuggggaggaaaggguuuauuuggcuuacacuuccaugcugcuguucaucaccaaagaagucaggacuggaacucaagcaggucaagaagcaggagcugaugcagaggccauggagggauguuuuuuauuggcuugcuuccccuggcuugcucagccugcucucuuauagaacccaagacuaccagccuagagauggcaccacccacaaggggccuuucccccuugaucacuaauugagaaaaugccuuacaguuggaucucauggaggcauuuccucaacugaagcuccuuucucugugauaacuccagcugugucaaguugacccaaaacuagccaauacagucauucucuuugguuguguccucaggaaacaaacuuggauagagauuaccuguaagacaguugcuagggagguucucacuaaaaaacaucucugagcagauguuuuuggcagauauuaccgcggagaauguuagaacuaugguagaaugguuaaaggccagccccauaccaagcuguaggauuagaguggucauuccuuuuuguguuuuguuugguuuuuuugcuuuuugucuuuuuucaaaacaagguuucacuauguagucuuggcuauccuggaaguagcucuguagaccaggauggccuugaacucauagagaucugccugccucugccucugcuucugccucugcuucuguggugcugggguuaaaggugugucaccuccacucaguuuaggguggucuuuuacaggcaaaggauucugacuuuugugucuugauauugaacaauuguuggguguaguuuguucuccugaagaagucauaaacuuggaguuuuuucaaaacccuuauuuucuuugucagugugugugugugugugugugugugugacgucugugggggugcacacuugcagcagcagcauguggaggucagaggacagcugugcacuugguuuucucccuccugacaccucaccagcucccaguaguucuugaugaagggauuggcuagugggagagaaggucaugaacagauggauauuugggcgaaauguacuuuuggagccgagagacaccucacuauuuuagccuuuuuguuuguuuucuuuggugguuguuguguguuuuguuuuaauauuuggaauugagccuggggccucgugcacacuagacaaguucucuacuaaggagcuauauccauagaucauuuuuuaaaauuuugggccaaugccucaccaaguuguauagaauaucuuugaacucuguauagcccagacuugcaccuuggaagccuccugccucauccuucagaguuuauaggcuuaccuccaucagccuagcccaucugaacuauuucuaagugcuugguagaaguaaauacauucacauugugguacaaccucugcaacguuuuccuauccccacacugaaaugcugaccauuaaacaguaccuucuguguucccucucaggucuuggcuuguuuguguuuguauuauuuuuguuguuguuguuugugacaguguuucucuguguccuguguccuaugcccuguuuucuggaacucacucuguagacucagucugucguggaacucaaagauccaccuaucucugccucugaggagcugggauuaaaaccaugccccacaacauggcuuaagcaccuuuuccacuauuuuuuacccguuuauaugauguugcaaauguaaauucaaguucuuugcuauuuuuuuucuuuugguguaguuuuguucauuuuguuugcuuacugaagcaagaucuuguucuaugacccaggcuaaccuggagcucacugugugguuuaggcuauccucuaccuuguacuccuugugccucagccuucugaaugcuaggauuacagucgugagccaccaugccuggcccuucuguugguuuaguuuuguuuuuuguuuuuuuauuuuuaauuuuauuauuauuuuuuauuuauuuauuuauuuauuuauuuaauauaugugaguacacugucacucucuucagacauaccagaagaaggcaucaaaucccauuacagaugguugugagcuuccaugugguugcugggaauugaacucagaaccucugggagcacugucaaugcucuuaaccucugagccaucucuccagacccuuguuuuauuuuugaugcuuuuaaauguuuccuuauugccgcuucaguggccaugugcacaaacauacaucccagcaugcaggaagcagaugcaggaggacucuucccccuucaaucacgugccugugacuguccugccagccuuugucucccagucacuaggacuaaauauaugcuccacuguguucagcacacacaugcauguaugagucugcaugucaguggcugacaucagguguccuccaucauauuuaaagcuauauauuuauuuuaaaaccaaaauaaauuaauuaauuaaaaaaaugguggcacacaccuuuaauuccaacucuuggaagguaguucaagaccagccuggacuacaaagugaguucuaagacaucuagggccacacauagaaaccaugucucagaacaaaacaaaacagaaaaagaaucacacccagcacaauacuaauuuuaugugaaugaauguuuugccugauugucuccauguacagauaugcacgugcgagugugugcggggacacacauacacacacacacacacacacacacacacagcagaagucagaagagggcauuggauccccugggucuagagucacaggugguugugagcugcugaaugggugcaaagagucaaaccuggggugaaugcagaaacagugcucguaaccacggagcccuuucuccagccuccucuugcuuuugaggcaggguuucucacugagccugaagcacccgaguucugcuaaacaagcuauccaguguccuuccguugcuaccuccucagcacagccgaagucaccuuuucuuaucccacugaggcauuuucuggcugguuuuuguuuuguuuuguuuguuuguuugcuugcuugcuugcaggguuuagccaaggcugcucuacaauucuucaucuucuuuucucaguuacccagugcugggaucacaagugugccauuaugucugguugucuugugccuuggagagaaugugcuagcaugcccuaaaauauuuccuguguucuguccaugugaaacaaucgaguauaucguggauagcaaauuuacuaucugcucaaaaguuaaagaauugccaccaacgccgggcgugguggcgcacaccuuuaaucccagcacucgggaggcagaggcaggcggauuucugaguuugaggccagccuggucuacaaaguuccaggauagccagggcuauacagagaaacccugucucgaaaaacaaaacaaaacaaaacaaaacagaauugccaccaccuagggaaggacuuuugaagcuugcucaugucuacucaugugcacaugaacugcuuucuucuuuggggggauggaaacuaaggcauuugccucauuaguccauguaccugagacccaguuaaucugcucuagcaaagacucaucuggcauugaagccuucuuuggacuuguccagaauccacuugcuuuuguuuaggucagaguaaugaaugaaagaaagaauuggugugcacuuccuccaggaucuuuuauccuuugucugucuugaccaaguagggaaagcuaguuugagacguuucccauuggcuugccuccaaagaaaaacaaaacaaaacaaaaccaaccaaccaaaaaccccaauuuccuaauuuggaaguugugccaauuaccaaguguguaccuccuaauuagacauuggaaacuggggaaaugagucugaaaaucuaguagacucacugugaauuagaucugggccaaaauuugauuacuaggaugguccccauacaccuggugccaugauguugcuucagguuacuagguaacagcaucuccugaggcccuguacccugcaggccuugaaauacuuguggaaaaacagggucuuguccugggagauaaggcucuucuucagauuaucgccuggaaaauuagaaagaggguauaguuuguuuuguuuguuuguuuguuuuauguaggccugacuggccuaaaacuuccaauguagaucaggcuuccaacucaaagagagaaaucugccucccaaggacugggauuaaaagcaugaacuaccaugcccagugugauuuuuuuuuuuuuuuaauuuuaaucuugcuuauuacuguggugugcauguguguaugcguguguaugagagagaguaagagaacaugcaagcagggacauuugugccaugguguauuaugaagucagaagacaacuuuuaggaaucaauuuuuuucuucuaccauggguuucugggaaugaacuggucccaaguuuguucaguguacacauuaauucacugaguccucuugcuggcacagacuguggggucgucuuuacaguuuuuguuuguuuguuuuagaggagaguggccaccucuuuuccuuuuugauuauuguaauuguuuaaccaaagacccguuaauuccuccccuguccugcucuuaggaacaggaugcucuguaaaucaucuguccuuagcucugagaaaucccuguugagcuugcuuccuuggauuguuccugacauuagcuguguuagguugggugccuugggaaacaaacugcacuaugggauuuucuuccaggauguuugcugggaaaagucugccucugaggaaacaaggggagucuggcugggcagauggagaaccuugacuguaauuugguuauagcaggucccagucaauaccaugggggcccugacacugagccaucugcacugaggcaaagagaauggauguuuauuccccaucccagccucacugagagggcacugcaggcaggcugucccugaggaugggaggcauaagcaggaaagcaaguguccuuucucuugagcaguucugaagggagaguggagugugagccacgaggaagaccaacuacuguaaucuccuagaaacagcuaagaaauuauucccuggccccuucuuugaauuccugaauugaaauacuuaaucuucuaauagcuagagcugagguauagaucucuuaaauuuuuaacuuguggguauagucauuuuuaaaacaccagaagcuggggauacagcucaguuguagaaugucugcaucgagugcacagagcucuugguuuguccuuagcacuucauaaacugggugugguggcauaggcagggucaaggaucgggguuauccuuggcucuacaacaugcucaagugugaccugggguaugugaggcugucucaagaaaauauaaaaucaagaaaucuugaauccuauucuguuguuuuuguuuuuguuuuguuuuagaguacuauguaguccugacuaguuuagaacucacuguguaaaccgggcgugguggcacacgccuuuaaucccagcacuuuggaggcagaggcaggcggauuucugaguucaaggccagccuggucuacaaagugaguuccaggacauccaaggcuacacagagaaaacccugucucgagaaaaaaaaaaaaaagaacucacuguguagacuaggcuggcauugaacucccagagaucuuacugccucugccuccuuugugcugacacuaaaggugugcucuaccacagcuggccagaagggaaauauuuuaaauagaaacgguuacuuacguggggguauauaaugguuuuuuuuuuuuaugagaauugcagagaacuggaagacaagaaaaagauucagaaucuguuagcucuggugggcccagaugcuggugaagugaccuauuuucauaaggagccuccccacagaguaaguaauuucugcuauggcauauaugaugacacaggugacggcccauaaucaggacaucucgacuugagccagccagcaucuagugaagguuuaaaccucuucucugcaaaaaccuuuugaagauuauuuuuucaauauuaagaaacugacaagggggcuggagagauggcucagcagguaagagcacugacuguucuuccagugguccugaguucaaaucccaacaaccauccguaaugagaucugacacccucuucuggugcgucugaagacagcuacaguguacucauauauaauaauaaaucuuuuuuuaaaaacugacaaagaacuagagaaauggcuuagcaguuaacgcauacugauucuaagcacccacauggcagcucacaaccgucuguaacuccaguuccagggaagcagauacacucuucgacauguacacaggugaaacaccuacacauaaaaauuuuuuaaaucucugaaugcucucucaagguauaacacauuuucagugugaagaaagucuucaauaguuaguccugcgugucauuugcaggggagggggcugccccguuacugggaggcagaccuuaauuuuaaauuaggcuuuuauguguaguucuuugugaacgcuacuaagcuuaguacauuuucuucuuuaaacaugauuuuuugcuauugaaaauaauggauuguaaagauuauuagaaguaaauuuaaagugucauaauucugaaaucucagacucucuauagauacagauuagucccuaacucuugagaguaacuugcugggaguuugaagacacugagaaaaguguugauuuguuuucaucguauguuuuaauuccaaauuauaccacuguuggugaguaaggguacuuuggguuuuuugauaaggaagaaaagaaaccuaaagccuagcguucggccauagcucaccggcagaguuccugcuaagccagcgugagguucuuguuuguccccagcacuaggccagagagaacagagagcaaacucaugcuuggacaggcagaugucucugcugagauuagagaagaaagcaaagcuagucuuugugaaggugacauuucaauacuuaauuucuuuucaaaucuuuuuauacuuauuacaaauuaauaguggucuuuaucaaaaacacacagauagugagacacacuuuaaucccagcacuugggugguggauacaggaguaucaggaguucauggcuagccugcauuauacgagaucuggucucaaccaaaacaacaacaacaaaacuccacauagaaguccauucuuuuuaaagauuuacuuauuuauaauguguaaguaauguguagcugguguuguuguuguuguuguuuugcuuuucagacacagcagaagagggcaucggaucccauuacagaugguugugagccaccaugugguugcugggaauugaacucaggaccucugaaagagcagucagugcucuuaaccaaugagccgucucuucagccccuauauuccaauuuuaaaaaauaauuuguguuuauuuuaugugcauugguguuuaccugcauguauuucugcaugagagugucagaucuuggcguuaucgacaguuuugagcugccaugugggugcugggaauugaacccagggccucuggaagagcaaucaaugcuuuuaaccacuggggcaucucuucaacccccuauuucuauuucuuuuucuuuuuuuuaauuuuaguuuaguuuuguggcucuaguuuuugagacagucucacuguguaacccuggcuguccuggaacucucuuuauagacggggcuggccucagacucacagacauccaccugccucagccuccuaaguacugggauuaaagaugugggccauggggcucagugguuaaaaguacuuacucuugaagaggaccuagguuaaguuuccagcacccacaugcuggcucacagccaucugaaacucuaauuccaaaagaucugaggacaccagccaugaacaugguacacauaauguaugaaggcaaaucacagauaaaauaaagaugugggucaaauuuuuacuuuguguguuaaaacaaacaaacaaacaaacaaacacaacuacacacacacacacacacacacacacacacauacacaaaccccaaggucuaaauauguaauuagacccagcaaaucugcccagcagguaacccaguuuggccucgcacuugucaucugagggacauaccaccuugcuuggcugcuucucacucuuguaaaguauuucucuguagcaugaucagauauuccuaauuugcauauuuuaacuauuuucuuaauguccuugucaaagaacaccuuacuuuugugaggaggggcugcauuuugagacaagaacucccuuuguacccuugacuggccuagaaguuguuauauagaccaggcuggccucaaauucauagagauuugccugugucugacucccauaugcagggauuagaaguauacaccaccacagccugcucaaagagcauguuuuaaaauauauuuuguuaagucgugaugugaaguuacugaucauuaauuaguuuguauuuaacauuggauuuuagcaaaaaaaaaaaaaagguuacuuugcccauguaagaguuuccgugauugucuaucaguuuugaccuauuuaacuuauaaacguuagauuuguaaaguuaaggcuaaaggcuaaaagcugcauccucacacauacggagcccacuucuauuccucuuguucuuuaggucagcauucuccagaagacucugcaggcugcagucgcaugugagccuucugcuuccaaagcagguagccaccguacuagaaguucucucugauguggacuugaaaaucccacugcaggcaauuagaaaaaaugucccuacuagacagacagaguggcuggcauuuguaacaaugucucuggcagucuaccaccauacacuuagacaacuaugaaaggagugaacuauuguuuaaugcaagggguuuuguuguuuuguguguguguguguguguucauauggaagcauguguguaugggugugcauuugugucagugccagaggucuauguuucaccuuguugagacagagacauuguguuagugacaggguaacugguagauagccaucaccuuuuauaagcacuguguagccuugucuacuuuuaguuauuuucauauauucaauuguugucggccauaguuaugcuacugugcuagaaaccaucagacauuauuccagcuaguuagcuacaccccuguaccaucacccauccuccccacugcuccucuccaugcccuucccaggcucuagcugcaccaucacccauccuccccacugcuccuccuccaugcccugcccaggcucuagcugcaccccugcaccaucacccauccuccccacugcuccuccuccaugcccugcccaggcucuagcaaacucauucauuuuuuguugcuuguuacucuuccuuuugaaaaucguguagcaugucaaaaccaaaguguuuaaauuugaguuuuuaacugaggaaacauucacaacugcagaggaauguucugccaaaagauggaugugauuacccagaugaaaugccgcagaauuaccauaaagucuucugucugggaaucgagcaccguaggucucuaguguguucuuuuccuucucuugcagguaaaggaaacuaaacuccuucagggucagugcuggugcuugaguagcagaaguagaaagaagagcugagcagaguuuuugaugaacuuuuguuuucuauuuuagauccuggaguaagcaaaagacaaguaagaauaaaggacaaggagggcauuucugagcgccaccagagggacacagagaugcugcuccugcaggugauacacucguccugagggacauagagacacugcuccugcaggugacacacucguccagagggaaauagagacacucacccugcagauggcacaauaaccuugacagaccauuucguuucucuccacacaaugagccguguguaauguacccuugcuauuauaugagaacuaucucuuugcaccuggauuauauucaggcaucacuggggccaagaauauugagauuauucuuaauauuuaagcacucuuuuugucuagcaaaguuagaaauauauuuuguuguuuuuguuuugaguuuugcuuuguuuuguuuugagacaaugucucucuacacagcccuggcugguuaaccuggaucucauuguguagaccaggcuagccuccaacucugagauccaccugccucugggauugaaggcaugugccaccacaccugguuuagaaguaguuuuaauacagauuaaauaugagcacuaauguaggagagaaaguccuacauaguggcacacuuaggaaccuguggcaggaaaauauacauuugagaucugcugggcucuauguagggaacaguagaucaaguauggcuaccuagcaaaaugcuucuucuauauaucuucuccccucuaagagauaugagauggaagugaggguucugcuguuaugugguacgugaagagaaagacucccgagaugccugacuaagucauguggaagcuuuauucacugcuuccaguuuguuagaguuuuuuuguuuguuuguuuuuguuuuucgagacaggguuucucuguauagcccuggcuguccuggaacucacucuguagaccaggcuggccucgaacucagaaauccuccugccucugccucccaagugcugggauuaaaggcaugcgccaccacgcccggcuuuguuagaguuuuuaaaggcaucugugcaugcauacagaaaggcaguguggaaaugaaggccuuguucacagaagcagaaagagcaauuaaguggucaggaaguccccauagccauuaggucacagacucaguguauagagcuuaugccuggucuagagacaguuuacuaggaauuuauggugaauuuaugguuaucugagugagcagagaccaguguuuccaagauggauuuaucacuuaaaguauucuuaggaauaucuucacaauacuguauaacuauaguucaguaguccauuaauuacacugccacaggcagccuauggcuguacaaaucuggaacuauacagggaaugaaauuuguuuagugcaggguuuuguuguuguuacugugugugugugugugugugugugugugugugugugugugcgugcgugugugugcgcgcgugcgugcgugauggacuguaugguauguuguauaugguuguauaguuggaaggaggcaaggggaaaacaguacugcaagccuugaguuucucagagagaauaaauacccucuugcacuuacacuuuaaaaucauuauuuucuuucuuucucuuuuagagauuuauuuuauauauauacacuguagcuguacagauaguugugagccaucaugugguugcugggaguugaacucuggaccucugcuugcuugacccugcucgcuccagucccuaaaaucaguauuuucuauuugaacauucuagagugcuucuggcauccuuuuuagaucauaugcuaaguucuaucuaacaaaaccauuccaaaguaagaauucccauuuguuugucuuuuguuuugcaacaaggucucaucacguagcccuggcuggucagguaccaggcugcucugaagcuuauagagauccuccugcuucugccucccgagcacugaggccaccgugccuggcuaggguuuacuuugugaucggccugaggagacuauagagagaguagcacaaggacauuugacaucagcacugggguuauguucauuuauuuagugcauguguucuaaaaucuaggaaaauaauaaaccauuaucuuacuacuaggucauguaugucauuaggaaauuuccaaucccuacucgggggagcaauccauugacuuaaaauuauuucugccuuuggccaauucucaaacgucaaaaaagccagaccccaagaaggaaauuacaucacacacauuuugucacuguguguucguguaacuagggcaucuugucuugucuuauuuugagacagggcuucucuguguggcccuggguguccuggaacucacucuauagaccaggcugaccucaaacucacagagauccaccugccucugccucccaagugcuggauuagaagcaugggccaccacugcccagcuaacuagggcaucuuaaaaggaagacaguccucuaaguucagaaggagacaaugaaguaaggguaacggggugggaagaaguaggcuacagcuuuuacugugugcaauggagaugaacggcugggugugaacaaauaguuggugcuuguacagcccaguaccauuuauaaggcauuagauaaaaaaggcaacugggaguuagugggaugccugagcugcugacgugcgugucaggaagugugagggccggagcccacaucccuagcacccacagcagaaagcugagguggggacuggugcgguggcuuagcaguuaggaacacaggucccagguucgauucccagcaccuacaugacaacugacaacuuucuguaauucugauguccucuucugaccuccauggcacacauaaagcaaaccguauguguaggcaaaacauucauuuauuuauauauuuuaaauaaaaagaaagaaagaaaaucugggcugcagcacaugucuuugaccagggaguuaccggggagugaagaaaggcagguccuuagcucacuggccaguccgagagaaaccacgcuuuaagaaauaagguggagggcgauuggaagagacacguucauucucauguacacacacagguaugaacagaacacaggcauguacaacauacguacacaguagaucagaacugagauuugucuuuuggugccccuuccuccuguuguucugcgccuccucagcccccuggguuuccuuugugucuaggaagggcucucugaaguccuagaagcaggaaugguaacucaguccucucggcccauguagguggaagcacuucaggcgcagcugggagagcagacaaagcuuucgagagagcaaguggaggggcucauggaggacagacggauccgagucgaggagauccaaguucagcaccagagaaaccaagagaaaaucauggagcuaaccaagaggugcggacucaagaaauaccguccuaacgggcguccuguuuuucugaauggcuuaagagauggcucagcuguugugagcacugcucuuacagaggacccagguucaguucccagcaugcacaucagguggcucacaccaucuguaaguccaguuccuggggcaucugccaccucugaccuccacagaugaacucacacagguacacauuaaaaaaaaucuaagccaggugaugguagcgcacaccuuuaaucccagcauuugggaggcagaggcugguggaucucugaguucagugccaaccuggucuucagagugaguucaguaguaguggccuagccuaggguguauugagcccugaguucaccaggaauaaaaaauaaagauuaaugguuauggggauagagagauggcucaguuguuaagcgcacucccugcuuuugugcaagaacccaguucaagucuuggcaccugcagcccccgccucuccaguggugcuuuaguuuaguuugugcuucggugagguuaauaauuuaggaacaguuguuuuuagcaagggcaucacuaggcacagcaagccuugagcugaagacuuacucagaccaaauccacaucuccguaauggcuaguguggcuuuaugauggacccccccuccauacacacgcacacacucauacacacacgcguguaugcacaugcacacaccauguggcguucuuacaucuuuguucccuggcuucuuucuguugaccucaguccuacccugugugcagaguagccacaagauaugguuugggguuuguuuuuuuguuuuuuugagauaguuucccucuguagccuugacuguccuggaauuugcuuuguagaccauggucuagaacucauugacccgccugccucugccuccugagugcugggaucagagacaggcauuugccauccccuagcuugaugauuuuuguuauguuguaccuaaccaucucuuuucuccauuaaacaugcuuaaugcauuuuuauuuaauuuuaacuuuccagauagguucucacuauguuucucugccuggccuagaaaacucuguguaguggaggagguuggccuugaaaacacaggggucccccugcuucugcauucucaaguacuggaaguacgggugccugccugcccaucaccacgccggucuccuguuuagcacguggcuguguguuuaaguguguagggauagauguguguguuagauggaggccacaggucacccuugggugcuguuucuuguuuuuugacauggaacacagccaggccugguguucauugacauggaaaacagugacuaagcucagcuacggucaggaaggccagggguuugcucgucuuccuccccugcguugaggauuuuagguuucuuacuuggaggagaguugaggucuucaugcucacucagcaaaggcuucaccaucugagcguuuuuuguuuuuuuaauauuuaugauuuauuuuuuuguguaugcauguuuuggcugcauguuugucuguacaccacuuuccaugccuggucucugaggaagccagaagagaaugucgcauuccauggaacugcggugcugggaauugaagcuggguccucuagaagaacagcaaauguuuuuaaccauugaacuaucucuccagccccaaauuuauuuauuuuugagacggggucucuaggcaggcuggucucagaauccccauguaaccaaggauuaccuugaacaacuuagaguccugucucuaccuuccaagugccaggucugcaggaauauuccucuauagcccaguuaugaagugcugagacuugaacucaggacuuuguacaugcugggcaaacacuucaccaauugaguuaacauucccagcccuaaauuuauucaauuuugguuuugggguauuuuugaggcagggucucacuauuuagauuuggauggccuugaacucagagaucuguccugccuccuagaugcugggauuaaagacaccacugagccuggcuguuuauuuaguuuugggagcauauuggguauuaaauggggcuucacacaugcagagcaagcacuguaccacaaagcuauacucucagcuccuaauaugugauuuaaaaauuaaaaaaaaauauuuuagcuuuuaacuauauguauaucuaggagucuguguauuuaugaaugcaauugcccauagacuccacaagaggucagagcaguauguacugucagccacugaugagccaucucucgagcccaaacuuuuuauauuuuauauuaguuuuccaguauguaauaaccaucuuuuuaaccugaauucucaaauguacacucaggaacguuucuauaaagacaaaucuaagccaaggagcaugauagaugcaaggcaguuccccaaaucaagcauguaaaacugucagugaucagacuguguguguuuuuaaaacugcuaauauuucaaaauucauauuguacaguuuugccaggugguggagguacacaccuuuaaucccagcacuugggagguggaggcaagcagagcucugaauuugagcucagccuggucuacagagugaguuccaggacauccagggcuacauagagaaacccugucuccaaaaaaaaaaaguacaacuuuuaaagaccuugucauccucuuuggaauggcccugugauugagccgugcagcgagcaucuccaugcucacagcucuucucucuuucguagucuccaucauacccaagaacugcucuacgagagcaccaaggacuuucuacaacuaaaauuugaaaaccaaaauaaagagaagguauggaugcuugagaaagaucaccugaugucaaagauuacgcaguauagagcgcaguguaagaagaaagaggacaaacuuggaaaaguuguucccauuuuacacgagagucaucauacucaaaaugaauauauuaagguaaugucguucuuuccuggaacaguugagaaacucagaauuccuugggguugaggugaagcucaguugauagaaugcuugcauagccugcugagcaccuggguuugauccucagcacugcguaaaaccaggugugccugucauccuagcacugcguaaaaccaggugugccugucauccuagcacugcauaaaaccaggugugccuaucauccuagcacugcauaaaaccaggugugccugucauccuagcacugcauaaaaccaggugugccuaucauccuagcacugcauaaaaccaggugugccugucauccuagcacugcguaaaaccaggugugccugucauccuagcauuugagagauuagagacagugaucgaaagggccuccuuuggccccauguugaguuggagagccugucagagacucagagaauuucuuucuuuuuguggggugcaggugugggggagguucaagacagggauucucuguguagucuuggcuguccuggaacucacucuguagaccaggguggacuugaacucagaaaucugccugccucugccucccaagugacagagaauuucuaagagccuauaaauuauuauauaugauucauucaguucaugaagcuaaauagcaauaaugucaugaaauccauaaccaagaguagcugaucaugaugguaacugagaauugaguauacuaagcuagacagaauucaagaccaaauugugaaguagacucugucucaaaaagaagacaaagccgggcgugguggcgcacaccuuuaaucccagcacucgggaggcagaggcagguggauuucugaguuugaggccagccuggucuacagagugaguuccaggacagcuggggcuacacagagaaaccuugucucaaaaacaaacaaaacaaaacaaacaaaaaaaagacaaaaauaucacauucauucauucauuuccugauucaacauauggacuagacucuggguauaucccuguguaaauuagacagucuuuuuuucauuguuuucauauuuuagugaagaaggaaaaucaugugauuuuauguuaauaagagacuuauguaaggauuguauuacuuguuggaacucugcuucagaacaggaccuagggacauccccauaagacuggugcuuugcugaggccuguaauauagauuaggggaagggcauuccuggcagagggggaaagaaguuccauguuucagggaaaggaaggaugcuaucaugacuguaaaauaacaaggaauugggggcuggcaauguagcucaaggaacacaaggcccuacguuuaauccuuggugccacaagagaagaaaacaaggaggaacugacaugugagccccagggaaguuggcagaagccaauuguagauggccccgcaggcacugugaggaauauaaacagcucuagggauuaugucugggaagggcuguauaagaaaguagcauaaucugaugggaagcucagccuggguuuagcuggcuuccaagucacuguguggcugacgauagcaucuugcuucugccuccugagugcuggucuucugagcaugugcuaccacaccagcuuaguauuuugaagcaggaggcucauuguuuccuaggcagggcuuagacuccugggcuccaguaauccucugccugccuuacaggugcugcguacacuuguguauauggauuuauuuauuuauuuuuauuuuuaaaauugcauuuauuuaugugggauggggggcaaagcaggaggaauggugcgugaacauaucaugacacaaaugucagagaacauucaggagucaggacuuucuccuuccaucaugugggcgggaugcugggcuuugggacaagugccuuaguugcugagccaucuuguggcucuccugguuuaagguuuuaaaggauugcuuuucuggcucuuucauagaacacuuauaauccauguuguugauguuucuucuuuuugaagagcuaaaacacauagugcccuguucugacuuccuccauugauagaugaggucgugggcacguaagccaaaccaacccucuccuucccagguugcuaugggugugaugucucaucacagcagugguaauccugaucaggacgccuggauuaccucaucguaaagaucucuacuucgggacacuugagagaaggauagacaggaaagcacagauguagcaggacucugggucucuccucacaucuguuuuuacagauuugcucugaaaaccuuuucgucccuucuuuaccacagugcuauuuugaauuacaaauuugacuauagggcugagcauuaaaacuuuucauccuuuuggccuacagucucuuaaggauaagcuaauacaagagaaaaagcuguccaacauguaccaagaacagugcauuucccuagaagaggaacuugcucgaauucgggaggaagaaggagugaggagagagaucuucaaggugugugguguuucacauugggcugaguagaacgcaggcugcugaggagagucuccucuucauaaacucuucaucauucauuuuuaggaucgcuccaacaagaugggcaagcgcuuacagauaaugacaaagcgcuaucaggccuuggagcaucgacgagcccuagaaguagaaggcuucaagacggacauuaagucucuccgacagaagcugcgagaccuggagcaaaugcucuacaagguacuguugcuccugaguuaggacaggggaaccaggcugggacuguagagagauggucagcgugguaccucagagggauggccacagaugagauguagauuucaguaggguguguguaagaguaacagagcacuggcuugaucuccagcauuacaaaaaccaauaggccgugcuuuguccuuacuugaacaacaacagauuaguaaguauccuugaauccucucugaacauuaguucaacaggaacacuuuguuggaaaaacaaaaacagacauaacuuacaaauuaucaccccucacaauucaacuaaaugaaaagaauuagguguauccaggaagugggggcugggcagauggcucugugcguaaaaguugcugguugugaagcgugaugacccgaguccccgggacacauaugaaaaccgagaacagauguacaucugcaacccagggcugaggaaagacaggagagcccagggaugugcugggccguaguauagcccuucaucacgcgcauggcugagugcacacucucagaagaacugcgugggucuuauuugggguuucucucucuuuuuuuuuuccucucucucagauuuuucaaaaaagcauuucucucucuguguuuguaugugggggggguuguuguaaugauuuuguucauuuuuauuuuauuuguuugcauauaugucugugugaggguaugagauccccuggaacuggaguugcagacaacugugagccaccgcgugguugccgggaauugauccucccagauccucuagaagagcagucagugcucuuaaccacuaaaccaucuuucuuuuuuuuuuuuuuuaaggguuucuccaauuuuauuacauaguacacuugcaaauagacauuuuaucucauuucaaaaugucuuucuuugauacauuuuccuaugcauaauguauaaacuuuaugaaauccaguguuuucaaauaaugguguugugaguacacgaaguuucuacuacaugguaugauaauuccaaucuauuaucucaaauaacucaaccuuguucaagguauaaauuuagggaauuacauacuuuucuuuuuuuuuaauuuuuuucuuuuccauuuuuuauuagguauuuagcucauuuacauuuccaaugcuauaccaaaagucccccauagccacccacccccacucuccuacccacccacucccccuuuuuggcccuggcguuccccuguacuggggcauauaaaguuugcguguccaaugggccucuuuuuccagugauggccgacuaggccaucuuuugauacauaugcagcuagagucaagagcuccaggguacugguuaguucauaauguuguuccaccuauaggguugcagaucccuuuagcuccuuggguacuuucucuagcuccuccauugggagcccugugauccauccauuagcugacugugagcauccauuucuguguuugcuaggccccggcauagucucacaagagacagcuacauggguccuuucgauaaaaucuugcuaguguaugcaauggugucagcguuuggaugcugauuaugggguggaucccuggauaaggcagucucuacaugguccauccuuucaucucagcuccaaacuuugucucuguaacuccuuccaaggguguuuuguucccacuucuaaggaggggcauaguauccacacuucagucuucauuuuucuugaguuucauguguuuaggaaauuguaucuuauaucuuggguauccuagguuuugggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauucauuccucuguugaggggcaucuggguucuuuccagcuucuggcuauuauaaauaagacugcuaugaacauaguggagcauguguccuucuuaccaguuggggcaucuucuggauauaugcccaggagagguauugcuggauccuccgguaguacuauguccaauauucugaggaaccgccagacugauuuccagagugguuguacaagccugcaaucccaccaacaauggaggaguauuccucuuucuccacauccacgccagcaucugcugucaccugaaucuuugaucuuagccauucugacuggugugaggugaaaucucaggguuguuuugauucgcauuucccugaugauuaaggauguugaacauuuuuucaggugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggacccauuugucaauucucgaucuuacagcacaagccauugcuguucuguucaggaauuuuuccccugugcccauaucuucaaggcuuuuccccgcuuucuccucuauaaguuucagugucucugguuuuaugugaaguuccuugauccacuuagauuugaccuuaguacaaggagauaaguauggaucgauucgcauucuucuacaugauaacaaccuuaaaccaucuuucuagccccaagaauugucuacuuuuauuuuuuauuuauuuauuuuuuuuugguuuuucgagacaggguuucucuguguagcccuggcuguccuggaacucacucuguagaccaggcuggccucgaacucagaaauccgccugccucugccucccgagugcugggauuaaaggcgugugccaccacgcccggcuuugucuacuuuuaaagugggaaaauaacugagugaugaagugcuuucccagagaccuuuugguaucuaggaugccuucagagcuuugcuggagauuuaagucacugugaguccuaaguaguugcuguguucugaacaaauaggaaagauaugacacuuucugucacuuuuggcaaauuuaccaauaaugcuauuauugguuuuauuuauuuuaaauguuuuuuuaaugcagacacguuugucauggugaguguguggaggucagcguaccccuuucaguuaccucaguuccccaggcaggguggcaagugccuuuacuaacugcugagcaaccgugaccucacugaugcuguauuggucauuuugcccacuguuuuguucugaguguguauuugagaugguuucuugucagccaggcuguccucaaacugcauagguagccaaggagagcccggaacucuugaucuucuugccuucuucucccaaaugcuuugacuaauuaaacauuuuuauuuaacaaugcaucacugaagaauuuuaguacuacauuuaucauauggaaaaaagguagccccucuucacccuuagcuaauucucucucucuuuuuuucaacucucuaggcaaccaugaacaacacccauggagaucaggaccuggccaugcugugugaaguccgugacagcaacaggagagcucauaagauacagggggaacugaagaaccucaagucuaaaguguuugggcuggagaaugcgcuuaggcugugcugaugacuccuuucaggguuggcuucuggagaccugagacaaggucaccugugcccacaaaguggaccuggaguuguccagaguaguggcaucaauuuuaauaaagaugguguuaagggcaugauagcucacaccuauaaucccagggcuugggaaucugaggcaggaggauugccacaaacccaugguacaggcagguggaucucucugauucauggccagccugaucuacaauagugacuucuaggccauccaaggcuauuuaaugaaacccugucuacaaacaaacaaacaaacaaaaacaaaaauaaaacaucaaaaccagagaggaaagaaggaaaacaguggcaaaccuggcucuggcacagcugcccuggcugacugcagucucaccauccugcuagccuugucuuuuauauacugauaggcuuuucugacuuuaaaaagucagugauggggauguagcuuaucuggugaagugcugucgagcauacagaaagcccugguccugcuagcuccccuaaagccagguuugguggcucaccuguagucagcacuggagagagcccaugugggagaaucuaaguucacauucacccuuggcuauauggugaguuccaggccagccugggcuacacaagaccacgucuaaaaaugaaaacaagaaacaaacaaacauacaaaaaagaaaauaauaacuuaggaagagccguuuugcugagcuugcuaagugucagugggagaauguguuuccuggagaccaaagucauucacugaagucauucacucaggaauuacauacacauggaaagucacagacuuagcugcguuccgaguuacugaccaccagggggcagcauagcccuugcucucaaguaaaauuggucaucaagaaaagggugcuacuuuauguacagugggccaaacuguacaaaaugauauuuuaugugaaaaaguuugacauuuuauccauaguuuuaaauuucaaauuaagcauuuucaauaaaaugggugguuuaaaacauc

SEQ ID NO: 3340 - RNA, 24365 nt, Mus musculus
cgggggagccggaagcgggacagaggaggccgugugaagccgacgagcgccaguccucggccgggaaagccaucgcgggcccucgcugucgcgcggagccagcugcgagcgcuccgcgaccgggccgagggcuauggcgauucggcgcugcuggccacgggucguccccgggcccgcgcugggauggcugcuucugcugcugaacguucuggccccgggccgcgccuccccgcgccuccucgacuucccggcuccggucugcgcgcaggaggugagagaagccgggcggagcggggaugcccgggccgucgggggugguggagaggacggcggaggguggugaagaggugucagaggggcgggcgucgggagggccgucgggagugcggagggcugucaaaggugcugagagccgucgcgagugcgaaggggcggacggcccaggcucuggcgggcccggggaggcugaaaguccgcccuaggggcucggaggacggucccgggcaugggcgcagcguggaggcgcgcuggcagcgacuccgggaguggagucgcggugagggggaguucuagggaaacuacgcgggcggcggagucacugguagcgcgaggcggggugacaauuccgucugggccucggaauuggaagauggaggcaccagaggcuggcagcucgggauggacauggaccuaaccuuggcaggagcugaaauaaucuggacuggccccuaacuccuugcuuccugagcagucaauccuccagcucucccaugcucaggugccccagccuggccucggggguccccacagguuggguagugcgggcgagcccagugcccaggggaaucaaacaggauguggguugaaagaugccguccaucccaucuuuuuuucaccaccacgugugucccagaaccgagccugccaaaauugaguuaacauguguggaagucugccaguuuguuacugccagggaggaccaccccacccccacgccccgcugcgcucuuaggaaacugacacaccccuggcgguugaaccuuacuuacugucaaaacaaagcauaacaaaaaaacagcgaaccugugcaaaaccuagugucuguuccacgcauaaacuuuccucccugucucccuucaagccuucucuuccuccacugguuuuuccagccccuuccccuccacuuccacagcugaccccaggaacuguguccagucgcugagucggaggauaugaaacaaaaggauaguucuuaucuaauuuuguagauuuaccaaaagaggguggggagagggugacuauuuuuacuggaaaaacuguguuuuuuaaaaaagucugagggcugcugggaaaugucauagugcuccccguacugggaaagucagagugacaucuucagacagggccaaagugucaaaacauagaggauugcuguuugugucuggcuaguccuuugccaagggccucacgauacaaguaaacugaaaguagagaaagaugauuccugggacugcaguguccaggaugaaguugucuuggauguaggaacgucuugcaagagugcuuugcacaaucggugugugcagaauccagggaggagaaaaugacccccagcugggcuguuucucacugaaaagacauuugagcaguucuguuccaaaccaggagccucagaaacauuucgcuuaaagcguucaaaaaucucacugguggaacgguaccugaaacaagcagggucaaguggaagaugggggcaucuguggaacagcagagagagaugggugggagcugagccaaaauuuuaggcugugaggucuguggaaguucacccagacccucagcuacagucccugccauaaaucuugggggucuuaguuuuuuuaguuuuuauuuauuuauuuugaguugaguuuuaguuuaguuuuaguuuuuauuuauuuauuuugaguuuuuguuuguuuguuuuuguuuuguuuuccagacaggguuucucuguguggcccuggcuguccuggaucucacucuagacuaggcuggccucaaacuccaccugccucugccucccaaguaccaugacccagucacaguuuuuauuuuuaacuuagauuuugguuuuugguuuuuugggcuuuuuugcuuguuuguuuguuuuauguguguuuugccuucauauauguaagugcgccacauguaugccugguguucauggaauuaagaggacauggaucuucuggaacuagaauuacaggagguugugagccaccauaugggugcugggucucucuguaggacaagugcucuucacugcugagccuuucaucuuuccagccuccuuuacuugggaagcugcuggcggcuacauuucucugcagccucccuucugucuucuccucuauugccucacagacaacugggcuccacaggccgacggcuuccauuucuguuggcuuugaaguccuuuuuaaaagacgcuagagcuguggguguggcucaguggucucugaguuccauucccagaacugcacagaggagaaacacugcccccccacccccacauacacacauacaccaucuauacucacacacacacauacacacacguacacacacacacacacacacacacacgcacagauaucacauacaccauacacacucacucucacacacacacacacaccacauacaccauacacaccauuuacaccauauguaccacauauaccauacacaccacauacaccauacacacucacacauacauacauacauacacacucauauaccauauauauauauauauauauauauauauauacacaaacacacucauacacacauauacacaccacacauauaccauacacauacacacauauacacucacauacaaaaacacacucacaccauauacauauacacacaaacacacaucauucauacauauagacacacaucacacacucacacacaaauauacacaccauacacacauacucauacacaccauauauauacacaaacacauaacacauauuaacacacuaaacacacacacaugcgcacacacaccguuuuaguggacaaaguaugcuuuauuuccaucaugagaggacuggaugagacagcucaaagggaacgggccacuuucacuugaaaacugacuuagaagucagugacucccuccugugacuggaaggaaggaggcuucagcuuaccugcuguguuccuuggucccugcugcaagcacucgggacuuggugaguguguguggcauaaaguacaaaaacuagaagaagauggaagggcccucuguuuuccaagcagugguaaacugaggacauugcacauguuuggguuggcuggaauucgcaccucaaaaccuggaugacuguaauguccccacagaaaccaacccugaagacaccagaagugauuguaguucccggaauguuuuuuuguuggccugccuagguaggccucuuaguuccccauuuacugccauucuugaggaagaagcccuguaagcagcacccgggaguucaccagcgugaaugcucacacugcucacagacaggauaucuguuaccauugccaguucguuuuccugagugcuugugguuuugacuugugguagaaugacuguuuggcaucgccccugugucuuguggucgccggaagcugugcucagcccuucuacucuucccuaaguuaaaaaguuguguucugcgggugcuccccugguggacuuuagcaucaauuaccaacgagcaaaccaaagccugguguucagucagagaagaccuggaccuaggcaagccuccccauccccuguuccuaaguccuguguccucaccuugaaggguguagggaggggccuccucauggcucugucugugaaggccucaggcugcguacacugggugcucugccagccuguaucaggcaguuggcaaugcaugcucaaugcccagagcuaaacacuucuucuuuuaaucauccugcucugaguacagaggagaagucuguguguuguaaacaucccuuuacuggaggcaggguagcagugcuggccaugguucuggagcaaagcaggcucacuguagcucuucaaccuggagccaccuggcuacucuccguaacagggagacauguucugagaugugucuugguaggugaucuaauccuggugugaacuucacagaguacacauacgugcauagaccuggaggguaccaucagcgcagccucuugauguagccaaagacgugguaagcagauuauguaagacugcugccagcauuacaguuuacagugaacuuuuaaaguauaugcuuaaaauaaugauaaaaagcgcaguucaguauuagcugcugucauaaucucuucaucauucugaauauucugugauuucuccaagauggcuaacaaugccauucaaugguauucgucuuguuugauugcuugguugguagguugguugguuugguuuuguuuuuuaagaggguuucucucuuguagaccaggcuggccuugaacagagggccacuagagagacacugagguuuuuguuuuaaagagcauauuuuguacucaccuucaaccccaggacucagucccugaguuugaggccagcguggucuacagagcgaguguacagcagggcuguauaaagaaugaguauccuucauagaguaugaguguccuucuguuugggggaaggagugguugguugguguuggugccuggggccguacagggcgagcaugcgugcauuuaugcuguugggauugaaccuaggucguacauguccuuaaacauuuccuagugacuuaccccuuagucccaggaauagggcuucugaaaggauuaaggagacagcuggggagcaaaucacgggcagaacaagaucuauauuaguaguguccaacgaugauaccaaaugcauuuuauauuaagaagauuuacaggggcuguuggugguucacuggguaaaggugcuggccaccauaccucacaaccugaguucaaucccugggaccaacaaagugaaaggaaagaaccaacuccugaaaguuaucucccggccucucuguaugugugccugugugcaucacacacacaauaaauaaaaaugaaaaaaaaaaguuguagggacugagagacuuaguggguaagcucuugcuaagcaagcaugaaagccuguguucagauuucuaccgaccacaagccagguguagcagcugugccuauaaccccagugucagaggacagaaacaaguggauccugagggcucacuggccaucuuagaacacugaguuccaaauucacugagaggccuugucucaaaagaauaagguagagaaagacccugucucagaacaagacaagguagagaaacuacaggggaggcgccuugaccucaaccuccggcucccacacaccugcacacaaguacaugugcauaccucaacaucagugcaaauucuauauugaaauuaaauuauaaauaaaaauaaauagagguggaauagauggcucagugguuaaggauacugucuggucuuccagaggaccagcguucaauucccagccaccauaucguggcucacaacuacuuauaauuccaacuucaagggauccugcuuccauuucuaacuucuucuggcaugcaaaugguacacagauacacaugcaggcaaaacaccaggcacauagaauauauauuuuuuaauuuuaaagaagcauaugucucuuccccaaauaauauucucauuugcucaccucuuuuuuuuuuuuuuuuuuuuugguuuuucgagacaggguuucucuguguagcccuggcuguccugguacucacuuuguagaccaggcuggccucaaacucagaaauccgccugccucugccucccuagugcugggauuaaaggcgugcgccaccaagcucggcgcuuaucucauuuuuaaaucuuuuguuuagauuaauaucauaaacuuucaucuuuaaauucauuuuuaaauuuuauuuauuuacauccuaaauguugccccucaaagauuuuuuuaaauauuuauuuacuuaauguauaugggugcacugucgcugucuucagacacaccaggagagggcauugaaucccauuacagaugguuuucagccaccaugugguugcugccccucaaagauuuauuaauuaauuuuacauauaugagugcucuaccugcuuguacgccugcaaaccagaagagggcaucacaucccaauauagaugguugugagccaacaugugguagcugggaguugaacucaggaccucugguagagcagacagugcucuuaacugcugagccaucucuccagcucuuuaaauucguuuuuauuaaguaauguagggauuccuuuuuuaaaauuguacugggauauuuaaaacagcucccuaagucacacucaagccugcuccccaaaggcaggcacuuauaauggacuuguuuguuucuuuugacaccuauguuuucgcagugugccuuuuuacucaccccggguaauagaggaaacaucacuugcuccagaucucugcuuucccauuacauuuguaucaugguuugauuuucagcuuccuguuguuacagcaaggcagcuguugucucuagugaggcaagagaugcacuuugauaaacauuuuucugguaguuacuccccucuccccuucacagaugaucacacauccaacuauuaacaagcaagacugaaacuguagggcuugaaguaucaagcuauuucugucaguuguagcaagcuagucagccaaguguuuccaaaccccucccacuuccuccucuugucaggauagguagcaucuugcccuggauuuuaaguagcuucugauggguaagaaagagggagucccccaaaugcaguauagcugcuguuguuucuguaagagucccagucccaggagcaguuucuguccugugucccaguucacaggagugcuggaugggaagagaggagcaggcuuguaggacuuaaucucagaacaugguaugcugugugucugugggaacgagcagagacaucgagauaggucuuguuuuacaccugcaaggaccauuuggcaggcugugauguuagcccagggcagugaaggacaguuagucacaaagaacugggagacguacgugaagucuggaccccaagagcaugugaacuggugccccaaacagguaggaaggacacagaugaaauaguaggcucagaauggauccuggcaugauaucauccuguggccuauuuuaugaaugaacccugaggcaucacaucgccgaguccugcacucugcucccucuggagagacagcugucaaucaguguccauccuagacacagugcgguacugugcacccgucauccaggccuugccucugcugcacaucagcuucaugggauggugugggccaaucuggguaguucaggccuggaagucacagaacuugaauuccagagcuuccuugcuaucuugccagcagugacagucacuccuuagagucccagauuccagcucuagaggauguccccuaucacuugugacagagauuggcaguguugccagugaacuaugcauaaugagucaggguuucaugacuaagucagaguucuguggcauuuccuaaacugauggccagucugagaacaccagcccaguguuuacaguguuugugaagcagaagugagaagugaaggucuguuucaucaucucccauauccacuuccugcccugcgucuuuacuccugugguuaguuuaauuuccagcaauagugugaaguugguguuagaguauucugauuuuuuaaaaaagauuuauuuauuuuauguauguaugaguacacuguuagcuguacugaugguugugagcuaucaugugguugcugggaauuugaauucaggaccucugcucgcucugguugaccccacuugcucuggucggcucugcucucuccggccuaaagauuuauuuauuuuuauaucuauaucacugucuucagacacaccagaagagggugucaaaucucauuacagaugguugugggccucuaugugguugcugggauuugagcucaggaccuucagaagagcagucagugcucuuaaccacugggccaucuuucuagcccaacuacucugauuuuauguugaagaaauugaggcuuugaguaagguggugauucaaccagggcucuguguguguguguguguguguguguguguguguguguguggcgcauaugugugguguuguggugugugugugguauauggugugugugugggggggcagaacaguuauuuaaacuuuuccuaacaaguuuauaaauuugaugcuucaccucugaggaaaauuagaaaccuuggaauuuuaagaccuucuuuuccagacacccucucuguuuuguaguuuguuuuuguuuuuauuauuauuucuuuuuauuguuucaauucccagcccauaacaguuauucagaaagccuccaagucuagcuuugcuuggcagcucaugccuuuaguuccggcaaucaggguaguggagacaagcuguucucugugaauucaaggucagccaagucuaggauauucugucccccaaagaugcgcccucucccaaagauaaaacgccuccaguucuguuugcugucugcccaccacucaccuccucugcuggacaaagaggaacaaaagugcagaagacuuuugacuacuuggcagcagagcagcucccaaaagugagcugggagggagacagggacugugugaaccgcucucaggggccugccaggcagcggggccacugggagccuggcccuucucaucgguaaucaacacuuccuuucuucccacaggggcugagcugcagagucaagaauaguaaguccucuuuuuuguuucacuuauugccucaguuaauacagugagggccucccacugacuucacagggcagccuccugugggcugagcucuggauggggguugccaccgucagcugggccaucuucguuauaggcaucugugcuccaugaggaaaaccuucauucauuaugcaaaaugcagucauucccccucugccaucuggguuuuggauguugccaggggugguacccuagugcaucuaacuaugccugucccuuucagcuugucacagcaucaguggugcuggcuuggcuugggguuuuuguuguuguugguggugguuuauuuguuuguuugccuguuuggcuuuugucucugggaagauuuucccuaugcuggauauagaacccauucucucagucugagcagacaagcucucaccucugagccacaaucccagccccugccuuuguuuuaaggcugaggcacauacuucaaaugucagugcuaauuaggagccgugacaaauaaaaaggcggaagcucucacugcgccccucccuccugugcccccauuuccaauggcugccucuuuucaaaacccuucuccccaaacauuccuugguucuuuguccgcagagcucugggagcaucccagaccagcauuagaaaagagcaggcuggcugagagauugccacggccacagcuggaagguugagaacagcugcagcccuugaaccaaguugaaacucauagcaggucucuggacccucuaagcagaucuuagggucuugacugcaggucugauaguuguucuccucaacagguacuugucuggaugacagcuggauccaccccaaaaaccugaccccgucuuccccaaaaaacaucuauaucaaucuuaguguuuccucuacccagcacggagaauuagucccuguguugcauguugaguggacccugcagacagauggugaguggccacaucugccagcgccuggguuugcccuugggaggagaccacugcugcuucuguuugguacuggaaggcuccauuguuuauccaaggagaacuuuuccaguguuagaugugugcccacagagugucuucuguucacacugucuuuaugaaaggccuucccuugcaucaacuuuuuauuacacaggaagaaaaaggcaagugguuaauuuuacaaauaauuccaaauauuugguagaaaaaaugauagcgguuuucucucugauuuucucuuagcuuaggagccagaacuuuucaaaacacauuccggaccuccuuaggggugauuagcugcagaauuucugaacacagccagccccagaucugugaaggggcaacagcaggugcucucugugggucccuagcuggugcucucgaugacuccagcagccucccacugggagggugagcguagcugcuguuagcacuuugcccuguggccagggcucugaccacaugguugcagaaucuuugcugcuuccugcuauagacugucucuugucccacuaggagguacuuucugcaaggccuaggaggggggaaguggggaguuagguaacagggcagauggggaagagacacacccuggcaggggguuggucugcaucuguguccccuuuccuuccuggccugcagccagcauccuguaccucgagggugcagagcuguccguccugcagcugaacaccaaugagcggcugugugucaaguuccaguuucuguccaugcugcagcaucaccguaagcggguaagaugacagccucacugcacuguguuccuaagugacaccaguacaggcuucuugucccaaaggcacaccuaacugaaagggugaguucaagaugugagccauagugaggggcagagcccggcacaccugcuuccuauuauuccucccacuugaccaaagcucucaaugaggcugguucauucucgagagugugugcguacgugcgugugugcgugcgugcacgcauaugugaauggcauggccaucuacugguagaauuuuuaaacagacagaaaggacaaagauagugugccucuaauguaggacucugugguuguccuuuuguuugucugcuuguuggcugauagaggugugacauugggacuugguacacaguggcggagggcguuguaugaccaucccauugccucucuuccucaguggcgguuuuccuucagccacuuugugguagauccuggccaggaguaugaagugacuguucaccaccugccgaagcccaucccugauggggacccaaaccacaaauccaagaucaucuuugugccugguaagugcccuuccaagcagccacuugguacugggcucugggugaagcagcaggggcucaaacagcagaggcuaacucugcuucacaguggcugcagacccaggggcugcugugccuccagccgaggccuuuaugucucgaaggcuauuuguccucuguuguauggagagaccccagaguguguuggcaagaagauucucuccaucugugcagaaaaguagcuuccaucucaagugcucaguggcaaggugcuugucuggguuugauccacaguuuuacagaaaaaaggaaaagaaaacaagaauaaaagaaaauauauauaugggagaaaacuggaguaaaccaggaaucucugguuacaugaagcaagcucugaacucaggaggaauaugcuugagucaggagggacuccuaaaagaagaggcugucacugccagccagguugccccaauuugaugggaucucuggccaggggcagguagcuagcccuggaacaggcugugaaggugugucuuggaacagccuccccagaugcauaacagucuugcucugccccccuccccuacuguguaaaaagucuguaagaacaggcugggugugauggcucacaccuuuaaucccagcguuuaggaggcagaagcaggugaauccuugugaguuugaggacagccuggucuauagugagcuccaggacagccagggcuauguagagugacccugucucaaaaaccaaaacaaaagcaccaaaaucuguacgaacaaauuuccuaaaggcagagacuuaccaauuucucucuuauuggggucggcagacugugaggacagcaagaugaagaugacuaccucaugcgugagcucagguaacuggcugaccuaggagaccuugaccugggcacuacuguaacucgcacucaguaacuuuaacuugcacuuaguaaaguuggguauguguacaauuguguacuggcccauacacacaugcccacguaggcacacguaccuccccucacuuccaaccugcacugugcgcccuuggcaggcagccuuugggaucccaacaucacuguggagaccuuggacacacagcaucugcgaguggacuucacccuguggaaugaauccacccccuaccagguccugcuggaaaguuucuccgacucagagaaccacagcugcuuugaugucguuaaacaaauauuugcgguacuuguauuucauacccuuucagacauagauuaaaauaccucucaaauccuucaccuuccuccauacugguccuagcuaauccuguugcuagagcccagccuggacucaggcacacuugguagcucucuuuccucucaggagguagagcgcgcuggugagaagaguaguuuaugaacauagguaacauggcugaggaaucgucagacuauaaaucuaaauacagaagucuaaaucucgaagugaagcucauauugaacugcagaacggaagaggcagaaucaaagucucugcagagccaggagggagaagcagauuuaagcuggucguaagauacguaguuguuaacuaaaauuuuauuuuaucccaucaauuuagugggaacuugguuuaauaaacucaguugauuugcauucaguagaugcaagguaaaguuuugcaguccuuaaauaacauaaauuaaacuuaaagucugcuuauaccuuugaaggccuugggcaaauugcaucguaaacuugagguuaagggaacuaaauacuggaguagugggaggguuaaguggcaagaauccuucaguggcaagcucagguacuuuguuuuuggaggcagaguuucucuguguaguccuggcucucauagaacucccucuguaaaacaggcuggccucuaacucaaagggauccaucugccucugccuccugagagcugugugcgcgccccaccagagcgcagcuauguuuuguuacuuucuauguuuucuugauaguucucuguuuugaggucaucucaucuauuacugacuccucaguuaguauucccccuucacugucccacccacauucuccucaccccauucaguccauggucucuacaucuccacagucuugccuggucucucuuuauuuggcuguguuuauugaauuuuauuuugaauuuuaaaaauaagugaaggcauuuauuuaaggaauagaugaggccaggugagagcagagagagugcugugcacccuauaucccugcuguauauacauagguuggagcccuaggccccagcagccagagcaaagagaggacugcccauuacuaaauaugcauauaaguucacgucaggcuagucacucugcugaaauauuaacuuuucuggacuagacaucaggaaaccauuucucccucuggcaguuauaagggaggcacugguccacagagggccacuuucccagcagacaccaccagggucuuacucagcuagcuucuuccaccccucucuccagcccaggcaagaagaauuccaucagcgagcuaaugucacauucacucuaagcaaguuucacuggugcugccaucaccacgugcaggugagucgggagagcggugggagagcaugggcagguggccuuccuuccuucagagggaacagaaacaaggcaggcauuggggagcuccagccacuccugcuaggagccucugcucgcagcaccauucugccuuucuccugcugguccucccagccugguaggggcuuuacccuuugguauggguaggagaccuuauugaaaacuaaguagggaagacggguugagucuuacuguauuucucaggcuggccugaggaggcuaccuuggcuugccagcagcuggauguaggugcacacccccauaugcuguucaacagugguguggagaucugagccuggccaagcagggucucucgcucacagauugcuucuuuugccaugaggguauggguuggcaucuucuucaccuuucugcucccccagguccagcccuucuucagcagcugccuaaaugacuguuugagacacgcugugacugugcccugcccaguaaucucaaauaccacagguaggagagaaagagugguucuuggugugugugggguaaggcacuguccacuggagaggaguucugacuguggggagagggggguuagcuuagagcugcugguaccuaugguggagugcagaugacaaccccggguucccuccucagugccuuucacuagcucugcacccgaaggcagaggacuuaaccuuucuuaucaacuguuuccuuggccaaaaaauuagauagcuauucucggagaguuaggacuauguaccauggaagcacuuuaacaugccaaguucuaauaugagaaaaauugaggugcagauauuaauuugcccauauucacauaccaaagccauaaccccagguucuuacuugagcuuauagggauuuguagagguuggcagccacaugucccuggcucucugcuucugccacaugcagaucagacaggggccagugugacacugugguggacggagcccuggccccuugggaagaggcuccauggagaaggcuacaccaaguguagcuaugccugucugcagaguuaagguugucaucccuaucuaauggguggaggucaucagugggcaucucugauagguuaaggccauugcugggcauuugugacuggcuuagaugauugcucaucauuaagacuaacccugucccuguuuccuuuuguucuauuacaguucccaagccagguaaguccuuucuucagucaaggucauucccaagggaccacaugaggucccagcugaucccugggccaucccagaaggcauacugcauccacagcuagccagagggugacaucaucaguguagccugguacaagccauagcugacagggccugggcuggggguguggggccccugcccagacucacugugcucuguuaguugcagacuacauuccccuguggguguauggccucaucacacucaucgccauucugcuggugggaucugucaucgugcugaucaucuguaugaccuggaggcuuucugguaaggacuacgccguugcuuccccguucccucaggcuucucucuggcaaaguggcagucaucaugauacaggcaccauaaggcuguggugaggauugaagggggugaugaaugaggggucuuuccucagagccaggcgcauggcauuugcucaaggcuguccacuacagugaaauuuuguaaaaguuaguauuucuaaagucagcagguuggaaggaccuaguguggaauuucccugcaucagccaugaucagucaaacagcagccuacacaacuucauccccaaguccccagccuuugccucugaggucagagaggaaucugagggacagcaggguguggcugaaaggagcagacccugaacucacaagggaagacccucacucuccaccagcuuuguagucacaggagaccuaaucuuagauuccauuuccucuucuguaaaagaggacacucggaccuccacgagucuagaguaacccugcucauucccugucuacuccugcccuggcugaguuuuaacagggagaagguguguugccuaggcugacccuguccugugcuagaauggaucuuugguccucugggaaaccugccuccacacuugcugauguucauccauaucaugguuuaucuugaauugugggguccacagauucugggaagggucacaugacauuccgugugaugucgaaguguguccagcugcuauuacauuuucuacggcuuccucgaguguccccaccacagggaagagaaaaggagaaaacucacucacuagucauuggaguaucuuugacaauccugagcaaaggcccaaagaacagggacugaaauuaagagucuaaaucacuucuuuaggaacugagauguaacucagggguagagcccuugcccaauaugcccaaggcccugguuucccucccggucacugucauccaaggagagcaauuacuuaagagucuaguucccuuucuuuacuucaaggacaccaggaggaggaaaugucgaaaggaccaugggggcugcugcugucaggaaguguuguaagaugucugcuuccugcauggacugcccuucccuccaguggagucugcucauagaggcuugaguggcaggacugcagaaaggggccagggaguccaccccagcucaggucuguggcucccagccuggagaagccacagaagaauccagacccuagcugacugaagggcccagcacuucgcacauaaccuugagaaugucccuccauagccccacuccucagaaacaauggggugucagaggcaucagucccuguucaccuagcuuacuggagcagcugacccagggcucacaccuacacagccacaagaccuguucucugcagaggcccagaaaugucuaguggucacuggcugguguugcuccccuuguccaccuguaucauuaagcagccguccaucagacaucugugagcccuucaguuguuguuucucuuuggaauaagccgcuccauagauuucuuuuccuugcaggcgccgaucaagagaaacauggugaugacuccaaaaucaauggucaguagcgcaugcucuguggggucugccugcuuucugaagccugcuggguuccugggguagauagaucuguugugucucuggucaaacuccugaguccuuucagaaggcccuauccuuacguaggacacaagucuccaccucauacagagagggcuuugggaugcuccaaacauccuucuuaauuuaauugcuuagacaaagaagagaaggugaacauuuuucagggaaaacccuuccugaaugggcguuucucuuccaugggcauuguaccuuuaauucuucugauuuauuuugauuuaugaggucccacuaugcagccuuggcuggccugcaacuuucuauguagaucaggcauagagaacuccugccucugccucccgagugcugggauuaaaggggugcaccacuaugucuggcuuucuaccccuuuuucauuuaaaaugaugaaaauaucagccaaagaccagcuggcgcuauguggaggagacuggaggcagcgaggagggagggagacugguuccugcucacacagggcccacacugcuuccucauauaucacaaggcaacauagcagcaucuggucuaccagaaggcuguuugccgaagguagaaagucagacucugccuucagugcagguaguucacaggcugacucuggagccgugguccucaaccuuccuaaugcugugacccuuuaauacaguuccucauauuguggugaccccaaccauaaaauuauguuuguuguuacuucauaauuauaacucugcuacuguaauucaugacauaaauaucugauaugcaggcuaucugauauacaauccugugaaagggccguucaacccccgaaggguuaagaaccgcuacucuagagagcaaugcccagguccaguccuuggcaugaggaucagcacacguuucuuugucucuuccaggcaucuugcccguagcagaccugacucccccaccccugaggcccaggaaggucuggaucgucuacucggccgaccacccccucuauguggaggugguccuaaaguucgcccaguuccugaucacugccuguggcacugaaguagcccuugaccuccuggaagagcagguuaucucugaggugggggucaugaccugggugagccgacagaagcaggagaugguggagagcaacuccaaaaucaucauccuguguucccgaggcacccaagcaaaguggaaagcuaucuuggguugggcugagccugcuguccagcuacggugugaccacuggaagccugcuggggaccuuuucacugcagccaugaacaugauccugccagacuucaagaggccagccugcuucggcaccuacguuguuugcuacuucaguggcaucuguagugagagggauguccccgaccucuucaacaucaccuccagguacccacucauggacagauuugaggagguuuacuuccggauccaggaccuggagauguuugaacccggccggaugcaccaugucagagagcucacaggggacaauuaccugcagagcccuaguggccggcagcucaaggaggcugugcuuagguuccaggaguggcaaacccagugccccgacugguucgagcgugagaaccucugcuuagcugauggccaagaucuucccucccuggaugaagaaguguuugaagacccacugcugccaccagggggaggaauugucaaacagcagccccuggugcgggaacucccaucugacggcugccuugugguagaugucugugucagugaggaagaaaguagaauggcaaagcuggacccucagcuauggccacagagagagcuaguggcucacacccuccaaagcauggugcugccagcagagcaggucccugcagcucaugugguggagccucuccaucucccagacggcaguggagcagcugcccagcugcccaugacagaggacagcgaggcuugcccgcugcuggggguccagaggaacagcauccuuugccuccccguggacucagaugacuugccacucuguagcaccccaaugaugucaccugaccaccuccaaggcgaugcaagagagcagcuagaaagccuaaugcucucggugcugcagcagagccugaguggacagccccuggagagcuggccgaggccagaggugguccucgagggcugcacacccucugaggaggagcagcggcagucggugcagucggaccagggcuacaucuccaggagcuccccgcagccccccgaguggcucacggaggaggaagagcuagaacugggugagcccguugagucucucucuccugaggaacuacggagccugaggaagcuccagaggcagcuuuucuucugggagcucgagaagaacccuggcuggaacagcuuggagccacggagacccaccccagaagagcagaaucccuccuaggccuccugagccugcuacuuaagaggguguauauuguacucugugugugcgugcgugugugugugugugugugugugugugugcguguguguguguguguguguguguguguguguguagugcccggcuuagaaaugugaacaucugaaucugacauaguguuguauaccugaagucccagcacuugggaacugagacuugaugaucuccugaagccagguguucagggccagugugaaaacauagcaagaccucagagaaaucaaugcagacaucuugguacugaucccuaaacacaccccuuucccugauaacccgacaugagcaucuggucaucauugcacaagaauccacagcccguucccagagcucauagccaaguguguugcucauuccuugaauauuuauucuguaccuacuauucaucagacauuuggaauucaaaaacaaguuacaugacacagccuuagccacuaagaagcuuaaaauucgguaaggauguaaaauuagccaggaugaauagagggcugcugcccuggcugcagaagaacccgagagagccugcggguggcgucugggcaagaggggaguggccuguggauugaguauuaggaaggagccagagcucaggguggagagagcucuguggggcuagggugggagcagcuggggacuccucucaugaguggaucuguugcccuacgggggaggaaacuucaugccaaauauacccagaagucuucucagaucaguucuuuagaaagagcugguauagaaaugggugauguaaaacuugagaagcaggaagaggcgugugaaauccugugcucucucaagugcuggcugccaguccgugggagggcugcggcaugugauucuucaugggcugcagccaccagaucccuggagagcucuaccucgggguacagugagggaguugagaaagaugugaggguagugggcaugggggcguggcauaacaggagaacucgggaggcccucaaggucagaggaaaguaugucacuguauaacuacaguaagagagguuguuuaaaguagcuccagggcgcccucauggggcagacagcagccuuguggcguagguucuagagaaugcacaggucuuccuagacuuaggugagaaaaggaccaugaaaugcugugggaagcacgaauucagugauugugugugugcauaugugugugcaguaaugaagacuuaauaaaguugcuguauugguaagaacucauaguuguuauugaaucaccucuuaccauaggucagacacgucuugccuagcauuagcaagcccugagguuccaagucucacuguguggccuguauucaacccugcagcagccaagugagaaagagaaagccccucccacccaucagccuuucccagcucuauuucuucagaaauucaggcagcaagggcccuuggaucuagacaccagucaagccuauggcaucugccacccuaguuucagauacgaacuuaaacguaaguucucccagcagcaaaucagccccacaucagcccagaacugcucucuaccaugucugacuccacguagggcucccagcccucagcuucuagcugcugucauuagaucauaucaguacauuaguucuucugcucgauuucuuucuccugagaucuuauagagacauccauacaucauacaguucacaacugucccuuugcagcugaguggcuuggcauauucagaguucagugacaaacaguguaaucagcuuuagaacacucguauaccccagaaagaagccuggugugccuccccccgcacccccaccuccucagccccagguagcaccaggucugcuuucuuucauuuucuagacaugucuguucuagauuuuccauauacuaggaucagaauucucaggggcuucuuggcucauguucuucauaccacuuccuccuuagaggucuuugcucaucaugaauguuagaaauucuagaaacuggugccugcugucagacaaacaccaagaucaccaagaacaucaaaaccauuccuuuaugcuuguauuauucugaaccgugccuaaugaaacuguuuuggccuggcauggugccacauuugagucucaacaggaguuccacgccaaccuugguaauaguaagacccucucucaagacaggaaacaagguggcuccacagguaaaggggcuugcacccccacccccacccccaccccccaccacagcuuugauguccuaaguucaauccccagggccugccuggaaggagagagucugaucucaacacagauuucauggcuggcacacacacaugacacugaguauguaggcacacaugccaguaacuaggaaugagaggaccccuguuugggagacuagguguggcucagcaauagaguacuugucuagcacacaugugccucaggaaaaaacagaaaaagauggcggaagagcacuugcugcuuucucagaggacccaggcucaguauucagcacccacauggcagcucacaaccgccucuaacuccaauuccaggggauccagugugcucuuuuggccucuucaggcaccaggcauacccaugcacacagugcacauacauacaugaaggcaaaccacucacacacacaagucguuuaagaucuuauuuacacacacacaccccccaccaccaccaccagaagccagccgcugccaccaugugcugcuuucuuggcucuuugccuaucuccuagaaaguugcagggugaggcuuaguagaacacaucagucagcacgugaccagggggcaugggaccuguacuccugacaggcauuucccugcaucucuaggcaaacuccugagugcacucuccugucuugagccuaauugagaaaugagguguguguguguguguguguguguguguguguggugguggggaugaacaaggaaagaguaagggacaauuagaggugaccugggugucacuugauagaguguuucaguccagaucuaguuucuuggcacugcuucggaaggcucacacgcaagucccuuagccaggcuuccagcugcauuggagcugacaucugugaugggagaggaagguggguuugguuaguuuuuauuuaccugugaaaaugaaacagguaaggucugcggcucagugacagauggcucgcucagccugagacccuggguugcauccccagucccggaaguaagacaagaaaacuugaaaauaaaguagggacucaggaggagggugguauccuggagacgcaaugggcaguuagauucccauucuaaauaagugaaagagcaggcuuugcccuacccuggcgccuccagaggagaccugcucaccaagggccaccaggcgauacuguaggcuccagccuguguaagagagcaacaucccaagagcucuuuggcacagucagugcaaggcuggcacugaaauucaggacuugcgucucacaagucagacguguuagacagaaaguuccuuacaaagagcaucccggcccuguucagaagcugagcagcuuuagaucaacaacuuucccaggcuccagguugcucucucuaaaaagggcaccacauuaguuccuaccucauagcugucuguaagggacgggugaaguucacaugagaggagcugacuucuccacacccaggaagugcuggaacauuuuaaccacaaccgggucccucuguggcuccuccaucacacugcugccucuccccacaggcccagcggcuuccucccucagucggagccucugaccugguucugggcuugagcagcuuguguguccucaggcacugcucagccucuucuucugcugcuuccugcccucucccucuaguguuugcuuucugagauuaucaaagcuaucucugcgcaggauuggcucacaccaagugaauauaucauugugggaacguagccacagggcagcacacuagagcguguuacggaagauucuauucuggaggcuaacacaaggagcuggcaggguagcaugcuccuggcugucacaucaccccauccccaaguggcucccagggccaucuacuugguccugcucuuccuccagcucucucaauuguggccucugcuggcaccagguccccaugccagcccuguccauuuugaacagugaagguggguggucacugcauggagagagccuuugucuguuacuggaacuuggcauccucuguuucuuugcuuacggaugaguuaaggucuugucgagccugcccuguccacuccucaccuggauacuuuuccuauaggaucacccuuggguuaugggcaccuuaguaggagguggauccuucaucucagacuggagaaagugauguaaccguggucugagaagggcgugaccacaccuuggcaagaugcuuccauugguuaaccuuuucuuccacgaaaccagcuuagaaagugaaagucaguuuugcuuucagcuacaauugagcuuaaacacagggaauguugaccccacugagcagcugacaucugaaggcuccugugaagugaagcucuaagaggugacagaagguggcuuagaguggcugcagguggcuucaguagcuucuuaucccccagugcuucaggaaaaggagcugcagccaccgacaggugacuguugaggaaugagccagcggcucugcaccuuggucuggugccccagggugugauuuuguccucuuccuugucagcaguacugcaccaccaccauuuaccccggggcagccucccugucccuacacuaaaccaguccuccagagaucuccuccaguuuucucgggugucucugaggaacuccagcugaccagagccaacaggcacugcuggcuuaccuggaagaugugucuaaauauguauaacaggccuggacagacuuaggaagaaaugaaagcgugcugcuacauuguccuggaguuguuuucuguauauauacauuuuggcuugugagauuuaucacacgggcuugagaaaaaacaaaccaaaacauuuugguauauacaccucauuuaauuaaaaaaguguucuuaccuuuau

SEQ ID NO: 3341 - RNA, 29205 nt, Mus musculus
uucucgaucuauugguugagaaggcuacggccccuuggucaccaagccggaaccggaagcgggguuuauaaaguaaaggaagcuggaccucccaggguuuucgucucagguuugcuccgccgccacuuugaacccagauucgaagcuguccccuggccggacuuugccuucgccauggcgcucagcgaugcagauguacagaagcaggugagggccagguuggguguagcgcagccgcagugccguccggaggacaguguugacguuugcuuugcagagcagggucuucggguggccugcguucaucgggcgagccuggcggaccgccgacacucgggcgcggguagugugugccgggaugguucgcagacccaggggagugagagggccuugcaccgcaucucacgugacugcuggucuccugcuuccacuugccugucacagagcccgcagcugacugccucccaucucgccagccccccuuuuucuggcguuuccacgcuuaauccggaagaguuuugugcagagguuaaaaguauuuuguuuuuguuuucccugaagcgcuauuucacuauaguacaggaaagagacugaggggaaagagcagcuugcguuucguuuugaggaucuucguuauuuaaaucgggguuauucaucuccagacguaaucaugaaccuaaggugcacauuaauauuugucgaaugagaaagccuuuuuauuuuacuuauuuauuuacuuauuuauuuuuauuuauaugaguacacugucuucagacacacaccagaagaggaauugaacucaggaccucuggaagagcagucagugcucuuaaccgcugagccaucucuccaacccgagaaagccucuucugauugcacucacaagccacagaaaugaguuagaguuuauggaaaauaguacuuaaaucaugaguucaggucagggucuccugaagcccaggcugguguacaaucguuuuaacugagaaugggcuuggccucuugauuuucucucucuuucuauuucuuucucgaucucuaauauacauuggugauuugacuugcuuguaugucugaguugagggugucagauccucuggagcaagaguuacaauuaaaugugagcugccauguggaugccuggaauugaacccugggcccuuuggaaggucagccagugcucuuaaugguaaccacugagccccccccccccuuuuguuuguuugguuuuguuuuuccaagacaguguuucucuauguaacucuagaacuuguucuguagaguaggcuggcuucugacucaacgagauccuccuuccucugccucccgagugcugggauuacaaacaccacuacgacccagugcucucuugcuccuuacgccauuucucuugagugccgagaugcccaguguuuuguacauaaccugcauaagguuguauuuuuuaagugcauauaaucauuuuuggggaaauuuauuuaaaauauuaaauguacauugaaguuuuuaaauauuaggacuauuauaauuguaguuguguguaguccuagaugguucagaaguagucugagucaugauuucaggccagcagcgcuucagaaccugacuuuaggcucuaaauucaaucaaacugaagggacauaaagcccagccuggggauaagggagacacaaggugcugacagugccacaggggaaagugcuugugcuguugacagauagcaggucuccugggcugcauuuaguagucauugccagugggcuuuauugucucuuuucuuucuuucuuucuuucuuucuuucuuucuuucuuucuuucuuuccuuccuuccuuccuuccuuccuuccuuccuuccuuccuuccuuccuuccuuuugacguguuuuaucccuugguauuuugaaguacacucuugcucuguagugcuggcuagccugguaauguguagcaagcacacuuagucuccugccucagccucccaagugcuaggacuacagcuccucacccacacugcgugugaguuuucagaaaaggaaauuaaaagcuucaguuuaaugucuagagaacuaagucuauuguuuccucucugagaacuaggaaaauccucugacuaaagcacacuugugaaucuuccuaaauugaacagugguuuuuugucuucgauguuccaucuuuuuggcaaaaauauuuuuccuuuuuauuuuuaaccaaauaugcauuaagaauaauagggugguucuucuuccuugugcgaguggguggagaagaagggagaugugguaauuacggaagggaagucgggguaacguccauggugaggguuaggaaacuacaacauuuucacagaacccggggcuuaggagcauuaaucacugcccgggguuuuagccuaggaaaaacuuggugcacuggaaacaagcagugcccucacaugcucuuagcuuagcagucacaacccagguccuccccucccccaauccccaguucccuucucuuuguuagaaugugggaggccaaguccuccacaggagaacuauagugcaggaacaggggaguguguuuaucagguucuagaaaauucuuuucuuauguguguguguauguauauguguguguguguguauguauauauauauaaaaugaaaguaaugauggaaucuuguuuacagccuguacccccuccugugagaauagaggccuuuuggcuguuguuugagggucauauuuuguccuguggugguagggcuuugacaggucuuggugaacaaguggacagguggucugccagugaguaacaccacagagccaaggacagugugguuuuuuuaguauauucuuagaauauaguccaagugccaagcauauaguaggugcuuaagaaaucccagauuccccuuuucccugucauuuguaauguccccggaccccccaacuuaaugucugucugguucaggacaguggggcugggcucagguccuccacuuggugggcaagcucugagccauaaacucccuucccuucacucaacauuugcuuuuuguuuuuuauucuuaaucuacagaguauggucauuuauuauaucagauuuucuaagggaccagacuccagaaaacuuuauuagugggauagcagagaggagaaaaagcauuuuaaaggucuguuuuucuugucccccuagcucagggguggaguuaaauguccuuaaggguugagucauuucuuagucuuugguugacuguaaacaggcuccugccugacuuuaaaugagugccuuugcuguaggcuaggcuggucaaggcggaucuguagcugagguccagcacagccaaggaugcggggaauacagguuugaauugguuucacccagccaauucaagaagcugaaugcaucuuggagcauuuauaaacacugaucacuugguuaaaggaugucugugccuuugagacuggccucccucugcagucaggcuggcucacagauucaccugccucucuguccccugugcugggauuacaggcgugggcugccaugcuuagcuuuuaaaauacuuuaaaaauaacauuuauuucugucuuaggaucuuuauugcugugauaaacaccgugaccaaaagcagccuggagaggaguuuauuucaguuacacuaacauucauuucagaggaauucagggcagggacuggaggccggggaugaacaacugucuuaaggguuuguucuucauggcuugcucagcaugcuuuucuguguaucccaggaccaccugcacagauguggcaccacccgcaaugggcugagcccucccacaugaaaucacuaagccagaaaugucacucaggcuuggguaaagcaccucuuggcaagccugacagucugaguucacucccugggaugcacaugguagaaggagagggcugacuucucuguggcguaugcacacucgcaaacaaauggggaaagagaauccaggggcuuaggugcuugguagaggagguacaaaguacccugggaacacaacagugggggguucaggagguggcacuaagcuggggccugaggugguguuagccagguggagacugguucagguggaagauggggcauauuuaaacacccucaggugaggaggaccugacaugagaggccaugauaacagcugcaucuguagaggcuuccguuguugguuuguuccggauggugcuucagagggagguagcagucaggcuuguaucuucuacagccugcacuggccacgggauccugauugccacggaaagugccacguagacaggcaggccuggaacuugguaauccucuugugacuaccuaaugacugugaaguuacgugucauugacuucucuuacugaauuaaaacauaaugucucuucucuuuuagauuaagcacaugauggcuuucauugaacaagaagccaaugagaaagcagaagaaauagaugcaaaggugagauuguuguuguuguuguugcuuuucucaacacaagauuucucuuaguggccuugacuguccuggaacuggcuuugucuguagagcagguggcgcucacaggggugccugccuccgccucccgggugcugggacuagaggcauguuucaccacuguccaggaugugucuugcuuuuauuaugucauacaaagaaacuaguuucauuagauauuacacuuauuauuuuuuuaguccaaaauguguuuauugggaagguucccacucaucuugaaucagggccuccagcacugcucccuccugaagcagcauccuucucucagccuugcuuuuucaccuguaggcugacagaggacaguggagcagccaucacacaagacuacucuuugugcauggcuaaagacccuggugauuuuacagcauccugggcauuucacguccauaaaguaggaauuggggcucugcaccaggcgcuuuuucuucuuuccucuucucuggagagggaugaaggggauccuuucugagaggcauguuccuguagggaggucgucaccgcuggaaaggccaugcuuauuaagauuuacuuuggggggcuagagagaugauggcccagcaguuaaccagcugcucuuucagagguccugaguucacuucucagcacccacauggcaacucacagcuacacccucacacugacgugcaugcaggcaaaacacuaaugcacauaaaaaugaauaaaucuuuuuaaaaagaagagucuuuuuuaaaaaaagauuuacuuauuugucugcguaugugugugacugcauaaauuuaaauuggcacauguccacgcagggguccuuggaggccagaggcuguuggguccccuggagcaggaguuggaggagguugaaagcugugugcugugggugcucagaccugagcccagguccuguaguagagucuuacucgcguucucacgcccggccaggaagaacacaacaaaccaaaaucuucugcggcaaaacuuuauugcuuacaucuucaggagccaggagcgcaaacccccagccccaaaagcgaaagcccccuucuaacaucuuuaggagccagagcgccagagcgcgccagagcgccagagcaagagcucuauuguuuacaucuuuaggagcaagcgagcaggcgccagagccagagagagaauggcggaaaccccguccccuuuuuuaggagaauuauucuucgccuaggacgcaucacucccugauuggcugcagcccauggccgaguugacguucacgggaaaggcagaguacaaguagucguaaaauacccuuggcacaugcgcagauuauuuguuuaccacuuagaacacaggaugucagcgccaucuugugacggcgaaugugggggcggcucccaacaucucccccuuuucuuuuaauaagagcaauaggccacccauauuaaugagaguggagauagaggucaaauccccaguguguagguaaaggagccauguacaggauuagcucuuaggcucacaggcuuuuacccagagcaacccugaccugcucccgugucguuuugccuggagagaaggacacuuggacacucaaccuucuugaaagaugacaugucucccuagaauaggcucauuuuaugccgcagagcccuucuauugcagugcuuagccgugcaacucucucgggcugcugaagcacacucacucuaucccgugcaaugagacuagccucaugggauauaagagcugaguggccagcgaccuauugccuaagcauagauauaucaggggaagcuccauguucuaguccugcaagcgccugggcaauaaccaccuugucucuccuaguuugggccuuaagcuuacagaccaaucaaagaagcaacacuaauccacagcaaaguguaucucuaaauaauaucaaucccacccauucuuuaaagaagggaaaugcugaggagauccaauuggguaauccuuuggucagggacagguccaagcgcguggaguugaccugaagucucaauucccgaaggaucuguucaaauucagccguccaauucuguaacauauacugaaaaagacuuuuugacaaauuagcugcccuaguaaaauucucauacugaauggaaguaacacacaaucccggaaacuuuuguuuacaccccagcugagcuauuugccauaauacaucuaguuguuucuggacaagaucuaugaguugauuaaccagcaugagaccucucuguaucuugacauuagcugaggccuguuuaucuaugacuguagucacugaggcugacaaaguguuaauggugucagucaucuggaccuguccagacagagccaagacugucugaaucaaggcuaaacccaguuccuaguuagugguaaaaaagcaggagaauacuugagcauuauacaucaccgucauugggaguggaaaugucgacauuaucccccaacgcugcucucucuuuauuauugacgcccuggacaucaccaagacgagggacaucaguauucccuuggucagucuggauuuuucgggugagucuuucugguauccaaaauggguugucuucauucugugggaaaacacaaaccgcuccccuggaucuuaucaaaauaggauccgggccauaccauuuauuaucaaggacauuuuuccauuuaaccaucucauugggccuaucuggcucugaacaaugacguucagccgcaguauggccaugagcaucaauauuuaaaaaauugaguguaaagagugccauagacacagacacucuuggugcucgggguaaagucuccucaaaaguuccccucuucuguuuuauaagauaggcuuugagggugcgaugcgcacgcucaacaauacccuguccuugaggguuguauggaaguccagucagguggguuacguccaucugacggcagaacugcugaaauuuuugagacguauaagcugguccauuaucagucuuaaggaguuuggguuucccccaagcacuccaugccucaaggcaauguugaaucacaugugaggcuuuuucuccgguuaacggagaagcaaacaugaugccagaacaugugucaauggacacauggagauauugaaguuuuccaaaggaagaaacauguguaacauccauuugucagaccuguagaggucgaauaccgcguggguuaauuuccacaugaggaacuggcaagaacucacagcaguuuugacauugaguaacaaugucacgggcuucuuuucuugucaaggagaaacgacugcguaauguuucagccgucacaugaaaauuguuaugaaaauuucuugcagccucuaccggggaugauagggcagcagccaccacuuuaguggccuuaucugccaaaucauuuuccagagccauggggccagguaggccugaaugggcucuaacaugaguaauauaaacaggaaaucuucuagauaacaaaacuaauuguaucugcugaaaaauauuggcaacucuacuggaaggcuuaaucacuccagccacuucuaaaagauuuacugcauuaaccacauaacaggaaucugacacaauauuaagggguucuaaaaagguuuuuaaaacuucuaaaaccacuaaacauucuaccacuugaggugaauuuucauuauauuguuuggauaccacuuuaccauuagccacauaggcaccuaugccaguuuuugauccaucaguauauaccacaaucccauuuuuaaguggguuucuuacuguuauuuguggaaacacaacagauugauuuugggcaaacuguaaaauuggauguuuuggauaaugguuaucuauuuguccugaaaaggagguaacuaaaacugcccaaucauuagauguggcugccaagguuugaaccugugcagcgguauaagguacaauuaaaagauauggacuucgcccaaagugggugauugcugcuuuuaggccuuuaagggcaagcugugcaauugcaucaggauaccaaucuauuauuuuagcuggggauacguuuggauggauccacaacaauggcccauucugccacaaaacugcgguuggcaauugugcugucuuaaagacacacaaacugaaaggcugcgaauccucaauacguuguaauugugcauuuuguaaggcuuuuuccaccuuuuguaaggccugguuagcagcuagaguaagagcccuaggggaggagauaugaggaucuccuucuaaaauaccaaacaaaggccuuaacucagcggaaggaaucuuuaaaaaaggccugagccaauuaauaucucccaacagcuuuugaaaaucauuuaagguauggaggugaucucuuuuuaucuaaacauguaaauauugauuucucucaaaggaggaaauaugugugacauccauuugucagaccuguaauggccugacgccacgaggguuuaccccuaugugaguagauaaaauuugacaacaaucuaaaggcauuauuaaguaaucagaaucauuuuuaguagaaccaaucccucuugcagcucuaggaauaccagaggaagaaaaaacagccauguaggcuuggcaaaauuauuaguugagcuauucugucccuuugugauauagaaaagacaacuugaggacaagaacagagaaccugaaguuccccuuuauaaucuugaucuacaacuccaggguagacaauaagaccuuguaggcugcaagagccugccucugucauacuggccacaaaaucugagaaugacuccugaggucccuggaugaucuuuguuaaguugugcaguggcuucaccugcucgggagagcgccuuccaggcccuaauagccuuuucaucugauucagaacuauuaagaacuggcuccuugaacucaucuagugaugaguauaggcuccuucuccuagaaaccuccgcugauugaucuuuuuucuuuucuuuuuccuucuccuuccuuccaaucucuccccagguauuuuuaccugaccuaaacuuuuccucagguucaagacccguggaaaggccuguauacuuauuuuguguaccauauuuucucuuugcuccuacucucucuccccgcuuuacuucugauagauuguccugaauuucaucuagaauccgcccugccuuaaccacuugauaacaugugaaaaggaacaaaagggcuccuaacacuagaaaaaauuuaaggccaaacauaccuuguaaagccauuucccacuuuacuucugauagacugucuugacuuuccuuagaaaguucaagaccagacuuaccuuguaaagcuauuuuccacuuuacuucugauagacugucuugaauuuccuuagaaaguucaagaccagacuuaccucguaaagcuguacucacugguacucucguuccccagcugaaaaguucugaauucaugcaguugaauccuucucaacagucugcuuuacgggaaccuuuauuaccgugacccgcaguucugguucuggaaugagggaucuuccuugcgccggugaaacucccgucccgaguuuccucccggguuuuuucuucccggauuuucucgucccggauuuucucgucccggaauucggcaccaauucuuauucgcguucucacgcccggccaggaagaacacaacaaaccaaaaucuucugcggcaaaacuuuauugcuuacaucuucaggagccaggagcgcaaacccccagccccaaaagcgaaagcccccuucuaacaucuuuaggagccagagcgccagagcgcgccagagcgccagagcaagagcucuauuguuuacaucuuuaggagcaagcgagcaggcgccagagccagagagagaauggcggaaacccguccccuuuuuuaggagaauuauucuucgccuaggacgcaucacucccugauuggcugcagcccauggccgaguugacguucacgggaaaggcagaguacaaguagucguaaaauacccuuggcacaugcgcagauuauuuguuuaccacuuagaacacaggaugucagcgccaucuugugacggcgaaugugggggcggcucccaacaguagagcagcgcgugaccuuaacagcugagucaucacuccacugccacuuagauuuuuuuuuuccaacugcauuuuuguugggggguggggcuguguagagcucagagaauaacuuuccagagucaauucucuccuucugccauguagguccuuggaucccccacuuuuuuuuuuuuuuccuuugagucagggugucacucucccaggcuggccucuaacuuggcaauguagucagaacugcccuucaacuccuguucuugacucccaugucccaaguacuggcacuguaguuguauacccaucuuacccaucuuacgccaugcugggauugaguggcauucaugcaagcucucuaccaaauggcuagaucuuucccuagguggagcgauggcucagccgcugggagcgcucacugcucaugcagaggucccgaguucaguucucagcacccauaacaggcagcucacggcuguaacugcagcacaaggggaucaguucucagcacccauaacaggcagcucacgacuguaacugcagcacaaggggaucaguucucagcacccauaacaggcagcucacgacuguaacugcagcacaaggggaucaguucucagcacccauaacaggcagcucacgacuguaacugcagcacaaggggaucuaaugcuucuggccuccgugggcaagagcacauaccuacacagaauuuaaaauaauaaucacauucuuuaaaaaaagaaugugaaaagcaggacaugguggcgcaugccuuugauccaguacucaggaggcagaggcagguggaccucugaguuaaagaggccagcccggucuacagagugaguuccaggacugcagccaggguuauacagagaaagccuaucacaaagaaagaaaaaaagagaauaugaaaguucaaauaacugcuccaagcccugaauaauuaaaucaguaauauuucuaaagucauaauuccuuuguucuuauauuuaagauagggucucaugcaccauaggcuaacuuuuguuucuauguagguuaagaugcuuugaaauuuaaaaacaaauuuuuaaauuuuuuuuuuuuucuauguguaugaguacauuguagcuaucuucagacacaacagaagagggcaucggauccuauuacagaugguugugagccaccgugugguugcugugaauugaacucaggaccucuggaagagcaaucagugcucuuaaaccacugagccaucucaccagcccccuaaaaacaauauuuacacuuauuuauuaugugcauacaugcucaugcauuguauuuuuuguuuguuuguuuguuuuuguuuuucgagacaggauuucucugaauaguccuggcuguccuggaacucacucuguagaccaggcuggccucgaacucagaaauccaccugccucugccucccaagugcugagauuaaaggcaugggccaccacugccuggcacauuguauuuuuuaaauaaaacaaagaaaaagcacagaaauacacacauacaaagauacauggguaugcacacaaaacccauaaaaacaauuuaagaaauaauagacacgcaaaggacauguaagguuaaaaaaaaugcccaaaguauuaugagacaguccaucucuacagguaccaguuuguucuguguuggccauuugugccaggcaggaggccucccugaagucugguuugaauaacccaaugaaaugcugucucaguuaggguuuuauuacugugaagggacaucaugaccaugccagcuuuccuaaaggaagacauuuaauuggugcuggcucacaguucagaggucuaguccauuaucaucacugcaggaagcauggcagcaugcaaacagacauggugcuggagaaguagcugagcguucuacaugugaaucugaagcagccacuaggccuggcuugagcuucuaaaaccucaagcucaccccaaccccagugacacacuuccuccagcaaggcuacaccuacuuuaagaaagccacaccuccaauaaugcugcucccucugacucugugggggcuauuuucauucagaccaccacagacugcauuggagaaaacugauuuuuuuuuucccuuuuugagcuguugucaauugggggauagcuucuggcauagggaugggcgcuuguguuccauuccacugguuuacagcucugcaggcugccacugucucugugagcucauguguggcaguccucuuguguccagaaggcuuuguuuccuuggugucuucccucccucuggcuccucccaccuccucuuccacgggguuuccugagcccugaggggaaggguuugaugaagacaccccauuuaggacugaguguuccaaggucucucucauuguccagcugugggucucuguacuuguucccucuccuacaguaggaagcuucccugaaccugucugagggacacuguuucuagccaguguggccucuccauguacauuugugccccugcguauguguucuaguguuuguguggaagucaggggacaacuugugguaguucucuccuuuaccacguugguccuuggguuggaacucaagguugucagauuuggcagcagguaccuccaucugcuaagccgccucgcccaucccagucuucaaguuuguuuuuguuguugcuuuugagacagggucuuacuauguagaccaggcuggucccacacucagaaaucugccugccucugccccugaguuuggggauuaaaggcgugugcuaccacacucaguuuuggaaucuuucuucuucuucuucuuuuuuuuuuaacuuuuuaaaaaaaagauucauguauuuaucuuauaugacuacacuguagcugucuucagacacaccagaagagggcaucggaucccauuacagaugguugugagccaccaugugguugcugggaauugaacucaggacuucuagaagaguagucaauguuuuuaacugcugagccaucucuccagcucccaguuauagagucuuaucaacauuugauucacuaccaagagcguuuacaggcaucuguaguagcacauuccugaaaucccagcauuuagaaaguagaagcaggagaauucaaggccacccuaggcuuuguuaguaucagucucaaacagaacaaaauugauaaucuuaccgcugccugaagauagagccaggaggauugcccacauguugaugaccaggaaaagaaaauacuccuaaguaauggcauauauaaauucuaauguuaaaaugacugucaggguuggagagaugguucaccggcuaagagcauuacuguuguuacagaggaccaggguuugguuccuagcaccuguauugauggcccagggccaccuguaacuuuagccccaggggauccaauauuguccucuggccuccauaagcacuuguguacacauggcauacacauuucaaaaaacaugccaaugcaguggcacggacuuuaauccuaguucuugggaggcagaggcagaagcaggugggucucugaguuugaagccaaccugguuuacagaaugagaguuccaggaaagcuagagcuacauagagaaaccuugucuugaaaaaucgagaacaaaacaaacaaaagaaccucaaguagucuuugaggacuauuuuuguguugcaauagauuuucuguuucagauaagggcuaagugaacauaugacaguauuccugguuccugggagauacaaauacaagggucagcccaguccaguguaaucaagucuguuaacuuuccauaggcagaagaagaguucaacauugagaaaggucgccuugugcaaacgcaaagacugaagauuauggaauacuacgagaagaaagaaaagcagauugagcagcagaagaaaauguaagugcaugguggcuagcccacugaacuaaagaagcugggauguuguagcccaggcuggccugaacuugcugguccuacugccuccaccuuccaacugggaugacgggcauacgccgccauaagugacuuaggcagugcuagggaucagaacuagggccugguguuggacaacccgcugagcuacguccucagucauugagcuuuaagucaaugaaaccaggccacagggaguaggucagugcgacaguccuugcuuaccugugcaggaccccagacuccauucccugagaucugcucuucacccaaaggaaaguucaaaacgcuggagacaagagaacacuguggaacagaaaccucagcuggguggguagcuagugucugagaccggacgaucauaaguuuacaaauggcaagaacaaacaggguccacagcuagaccuuaucgccaaaguaaacagaugaaagaaagcugggcauguggugugcuccugcaaaccagcagaguuccaggccagccagagcugcacagugagaccuugucucaaaagcaagaaccaaauugcagagggaacauggaaaccucacagggucaccugaagguuauuuauuguuuaucaaggcccuuugcucuaacacggaaagcugugugugugucuguagucauuguuuuuuauguuguauugauauucuuccaucccuuuuauagucagauguccaacuugaugaaucaagcaaggcucaaaguccucagagcaagggaugaccucaucacugugaguagcucccaguagcugugaaacuagaaaaugcuuauucucgugcucacuagguaacauuuacagauaaugggguguuguguugcuuuuguguuugguuggguuggcacuuuuuguuugcuugcuugcauuugugaaagugucucaguacgcaguuguucugaaccuugacccucuauagccugaguccuagugcaggguuacaagcauaugccaccaagcucacguuuagggacucuguagagagaauaacauuuguucagcagaucauaguacuagauauuaacaauagacaagcaugauagcagucuguccuugaguuuggugaacucuaaccuaauggcauguaaaacaggauuagaucauacaacagcaagaagcaaggcauagaguacacgagggaggggcugaauacaaggccagauugugaaaccaagagccaggccugcucucaauuuaaaaaaaauaaccccuuuaaucucagcacucaggaggcaggggcaggggcaucucuugaguuccaggccagccuggucuacagaguucuaggacagccaggguuacacagagaaacccugucucaaaaagaaauguuuuuuugaugauguuuuauuuaguggacaguaucauaaacaaaguacauaguaugaaagaguguaggcuccauuuaacaagaaaacugucauucagaaaguauugcggccuguugggaaagaaaagccuacuggaagcgagcucguagcucagcagugccaucucgaguuaggguuagagccuggcaggauccagcugugucgccgcuugcugugaccgcacaagcuucuuacaaauggaaacaucagaggucugcaggcacaguggcacccccugugacaugggcacugagaagguggaggcaggaagaauguuuggguaaggccagccuggguucuaaugacccuggaucucacauagaacggcggucuuaaugggugcagagcauagcgggguugaggccagcuugggccucaggguuaagauccuaucucaaaggaaaauuuuucucaugcguuguccuugugaauuucucuuuaaauguauggauuccggucucgaaaaacaaaacaaaaaaaaguauggauucuuugccuguacguaagucagugugucaugugcacaccugguaccuuuggagucagacucccuagaauuggagcuacagagaguugugagccagcacuguaggugcuggaaaucaaaccucugcaagaauagccaucucgggccgggcgugguggugcacgccuuuaaucccagcacuugggaggcagaggcaggcggauuucugaguucgaggccagccuggucuacaaagugaguuccaggacagccagggcuacacagagaaacccugucucgaaaaaccaaaaaaaaaaaaaaaaaaaaccaaaaaaccaaaaaaaaaaaaaaaaaaagaauagccaucucuccaguccuuaugaaguguguguguguguacaccuguacacucacgugucugcuugcucuucuuuucuuucuuuugaaacaggcuuucucuguguagcccuggcuguccuggagcucacacuguaaagcaggcuggcuucaaacucagagauuuuccugccucugccuccugcgagcugggauugacagugugcaccacagccacccaucuggaugugucugucugauaauaguuugaugucagauugaccuggaaaacuuuguaaaauucuuuguaaagaacuuuauuuuaguucuuuuauucuacaguaaaauacucaccgggguuggugaggcauggagauguucuccuuugaaacuggaagagugagcaagccucaugucugggcacuucuggcacuggugugacuggguccccagcaccacaugaaacugggcaugguggugcacaccugcauccccaauagccaguggcagagauggggagcacugggagguugaagccucccuuggcuacacugaguuccaggucagcuauggguacauaggaagacugucaaaaacaaaaaggaaauuauauguaugguuguuugagcaaccgauuugugcaggcucacugguaaccuaggagagacccaucccugucuucccugugcuugccuggaggcugggggacagggggacgguguaguuccagcuugguuguuccuuguugaccuacacauauuuaaauaguuauucauuuauuagcuugcuuuguuaaagccagugacaggacccagggcuugugcauguuagcaguacuucccuacugagcuggauccccaacccagcucuacucaggauuucuuaguuguuuuuggcuuuuuuuauuauuguuguuuuguugagacugaaacaggugugucacuccagcucuuauuuauaaaaguauucacgcugggcgugguggcgcacgccuuuaccccaacacguggaggcagaggcaggcggauuucugaguucgaggccagccuggucuacagagugaguuccaggacagccagggcuacacagagaaacccugucucgaaaaaccaaaaaccaaaaaaaaaaaaaaguauucacaguugaauugugucuauauaguuacuguucaggggugagacccacacuuugccaaauaccagcauguggcuuggacuggcuucgauguuccuguauagccaaggauggccuugaacuuccuagcuuccugccuccacucagugcuggccuuacagggaugcaucacagcggccaguguucuguauugggggcgggugucuaagcccagggcuucuuacaugcuaagcaaacauuaccaacugaccuacacccccagauuguugcugguuuggguggugguggugguugcuugguuugguuuggcuugguuugguuuuucaagacaggguuucucuguguagcccuggcugucauggaacuugcucauggaaccaggcuggcguggacucacugagcuccaccugccugugccuccugagugcugggauuaaagguguguaugugccuggcugucuuuguuuuagaccaggugccaguagcuucgaaucuggaacucccuguguaguugaguaagauucuggacuccugaucaucuuuccucugacccagcaaugcaagaauaaacuaccaugccagcucugacacucagcaguccuucuucccugucuggauuggaauuacaggcguguagaucuuuuccagguuucuaggcagcucuagacugaacucucuaagaacaagaauggugugucuuucccaccagcacuuagcagugcauguagcagucacacacguuaucguguguuuagugaaaaaccuaacagaggagugugaggugaggacauacgcuggauggguggcuguaagguagauggaacucggauggcacaaggauggaacguagacauaacacuuuuuuuuccccacucuuuguaggaucugcuaaaugaggcaaagcagagacucaguaaggugguaaaagauacgacccguuaccaagugcugcuggaugggcugguccuucagguaugcuuggaugccuaggcugcugugucuagcugcaauucugaggccuuuaaacacaucugccagaggccagcuccauugucccuucuuacugcuuucucuuccuccuuccugugucugugguguguuccacaagaugacaauaguucuugucuaagacuugaaagugucauacuauuuccuaugauuguacaguucuuucuaccuuucuaguuaaaucuaccugccugcaguuuuaaaguuucccgcagugauuugaccuuuaaaguacuuggcuuuaaucucauguuuagugcugaggucauaguguggugguaaaggcagaaugcuugcuuagcaugugagagacccucagguccaacuccuggcacugcagaaaggagaaaagggcuagcaguugccugccccuggguuaggaucccuuuccuuuacucguguuaauccagaguguuuguccuugguccggcuaauaggacgccacuggaauuucauuggccauucaaagucucugguuccagugugugucugguguuaauaccaggcucugcucucugaauucucgggcugccuguugucuuugcagagcuucccgggcgacaccggaagaacugcaggacccugcugugccacauuuuccacuauggucucauagauuacuuuuuacagggcuuguaccagcugcuggagccucgaaugaucgugcguugcagaaaacaagauuucccuuuggugaagguaaaaaccuuuguugauauuaacaguaguuguuguugcuggugaacaaagggggcgaagagauugauucaguugguagagugaugucacugagggagucagggcaggaacuaaugcagaggcuguggaggagugcugcuuacuggcuugcucauccugcuuuuuuuuuuuucuuugaaacagggacuuauauauaccuauuccuggcugacccugaacuugcuauguagaguaggcuggccuugaauucagagagauccuguuaccucugaaucuagcuggaauuaaaggcaugugucaccacagccggcuuucaccugcuuucuuguagagcucaggaccaccagcccauggguggcaacacccacaauaggcugaacccucccacauauucuuaccuacaggacagaugucuuguggggacauuuucccaguugauaguccucuuaccaagggacuuuagcuugugucaaguugacauaaaacuagccaagacagugauauauaauaguaucccguauauaaaauagacugggcacaggcaggauggcucagcaggaaaguguuggaaggacggagccaauuccugcaaguucuccccugaccucugugcauacacaaauaaauacuguaaaaaucaaaguuuuaaaaguagcccagggggcuacagagguggcucagugguuaagagcacugacugcucuuccagagguccugaguuaaauucccagcaaccacauaguggcucacaaccaucuguaaugagauccgaugcccucuucuggugugucugacaagagugacaguggacucauacaucuuuaaaaguaauccacaguuuacuuguuuauucucuguaacaguagugucuucugucuuucagcgucugucuggucuagggcuuccuauguggaccaggcuggccgugaacucaccuggcucccaggugugucacagugccuggcccucaccuuuugacuuaagauuucugaaacuggaaguuugcuuuucuugcugcucuuguugagcagccacaguugagagguagugcuguggcauggucgugcuuagcacugacucaccaccaacagucucugaaguggcugcugugagccgaaugcuaaaggaagcuccaucugcugggucuuuugaggauuucuaggauuuuuuggguucucuaggugcuuguguuggucuacauaccugcccucaaugcacagaagguucucauaucuuuucauacucuuucaauacuuuaauuauuaauuuuuuauguguauggguauucugccugcauguguaucugugugccaccugugugugccuaguguccucccaggccugaauggggugauagguucucuggaccuggacucaaaugguugugagcugcuuuguguucuggcaauuauauccuaguccucugaaagagccuuuguucuuaaucuaacuagcucuccagccaagugaauucucuguaauagcuguugaaaggaagugaagccucucuuaguaagaggugccauccucacuuccaaagcugccagauccccauccccacugugcagcugauaccacacugucuucugcccauaccucacaccugagcucuguggcacugucccuggagucccugguuuguccauucaguuccaggcccauuggcuguucauggaugagccucugccucuuccucccaccugugugugugcacacacuccuucuuccucccaccugugugugugcacucuccuccuuccucccaucugugugugugcacacuccuuccucccaccugugugugugcacacuccuucuuccucccaccugugugugugcacacuccuuccucccaccugugugugugcacacuccuucuuccucccaccugugugugugcacacuccuuccucccaccugugugugugcacacuccuucuuccucccaccugugugugugcacacucuccuuccucccaccugugugugugcacacuccuucuuccucccaccugugugugugcacacuccuccuuccucccaccugugugugugcacacucuccuuuucccccucuuccucaggaaacacugugaggaccucagcagcaaagcucgauuuuaccugaaacucuuuuauuguuuucuguuugcuucccccccgcccccaggccgcaguacaaaaagcaaucccuauguauaaaauugcuaccaaaaaggauguugauguccagauugaccaggaggccuaccugccugaggaaauguaaggaucuuucuguuaaaucugcugcuuguuaugggaauggccuuggugcugagucuuuuaaaaacucuuuucuuuauuguuauuauucgggguggggggagugagucccaguugauuugucuugcugcaacacuaugacggaaaagcaaguugaggaaaagguuuauuuggccaacacuucgagaucacaguccaucauuggaagacgucaggacaggaauuuaagcagggcuggaagcugauacagaggucacagagggggcugcuuauugacuugcuccuuagggcuugcucaaccugcuuuccuuuuuuuuuuuuuuuuuuuaaagauuuauuuauuauuauaugcacauacacuguagcugucuucagacacuccagaagagggugucagaucucauuauggaugguuaugagccaccaugugguugcugggauuugaacucaggaccuucugaagaucaggcagugcucuuaaccauugagccaucucuccagcccccucaguugggcccucccccauugaucacuaauugagaaaaugccuuaucuauagcuggauaucauggaggcauguccucaacugagucuccuucccuucugcuggcucuaguuguaucaacuugacacaaaaucagccaguacagugggaaagcccauccuggauuuaguccucagcccuaagaacacuguuuucuugggugaggucuuugcugcaggagaaagguguggcuguauccuccagguaccugcgucuguuuuccugucauuccuucaagcuggucuugaggucagggcggcaacacuuugugcaugggaguguggaacauaauccuguucgcuguuggaaauuaguguuggugcccagagcuuucugucugacaucacauugcuaccauugccuagccuggagcagggucuugggaaaccuugagcuaaauggaaagagcugaggcuuggggcugugacaugguugagaacgaacauuggccgucaaaaauagauuugggguuugaggguuuguuuuauuucuugcuacaccagguagaacccaggaugucaugaaagcgugagucagauguggguuugcuuuacucggcugagggcugucugaguggugaugcaacacuuauuuugucucuuugagccuuggcuucaguuuugguuuuuuuguuuuuguuauucuggugguaagaggaugagacaggauuucauucuguagacuagguugguuuuguucacagcagccaggaggcugggaucacaggcauggcucaccaugcccagcugacuugaguaaauugaagcauuugaaaugagaucaugucuaggcgugcucaguggugccgaugugcuguggaaacugagcagacagugcagagacaucagguacagggcuggcugauccuccugggaccuugucaucagacauguauugaauuucagagagcagaauagcaaugacgugggcuggggugcagcucgguaguugagagcgugcauagcaggugugagaucaagucccaucaucagcaccaaagacagacaaagugccgaugcuucccauuguguaguaucuucaagucuaagacagcacugucauggccagguauacuaacauuucccaauugacacacaggaaaagcuaggcauggggcaccuuccuguaaucacaguccuugggaugcuguagcagaagauugucaggaguucauggccagcaacguggagaugcacauccuaccagcgguguagcugccaaccugggcaacauaacuacaccuuguuugaaaacagaaaacaaaaauuggcaauuuucaugcuaugcaagauaaauaggucaagaucugcuaguuucugccagaugacaagaggcaggcaguucuuaucugaaggaugcguggcuuucagagccuuuugagguuuaauauuacaguuaagagauugcaggcuuacuguuuuggguuaagugguauuuguuuaaugugguuacuacuccuuuugguuucucagagugcauuuccucaucuacuacaucucguacacgagacucagguugcugugaaguuaggaagcuguaggcucaucaggagugcugugcuugcucaggaggcugaucaccucucagccucuuggcuccaauugaugauagaguguuugaggccaguuugaaccaugcagggagacccugucucaaaacacagaaggaaagagaagaaagcugacacucagugccugcugaggucauuuuugcuuauucucucccuuccuguccucacauucccccacaaaacacccaggagucaggaucucagcagagcaacaucuuuagugcuauggagacuggaaaaaaagagggaggcacagaaagggggagauugguacagcuguggccaucagccaccgaacaucccaaggaggaaguaccaauccuuucccaccugugcauaauggcacgugccuguaaucuccacagaagcaggaggauuuuagaugguaaguccuaggcuagccugggcuaccuagugaaauguugucucaaguaguaucuggguccuugucugauaguccauuuaucuugguaauugacagaacuggucauuuguaggugaaucuuguuccccaugguuccuugaaauacaguugaccuguguaugucucuugagugcugagaggcuuugaggagugaggugacacgugaggguggcuagaggcaggcacuaggcagccaggcauguugagucacuguccuuccuuugucagcagcaugcaggugccgccucuccauaggcugccuggugacucauagcuaagagaauugaagcugguuucuaccuugcugggaagggcuggcuagaauugaacagcacgcugcagccccauggcugugcucaacagucacuguacccugugugcgagcacugugaguucucucugacgcugugggauuaguguugcccugucuguacacuuuacaugccgaggcuguccugugcugaggguaggagucggguaagugucgugucauggacauacaucucaagcccgugacauuacuuccuguguucucuguagagcugguggcguugagaucuauaauggggaucgcaagauaaagguuuccaacacccuggaaagccggcuggaccugauagcccagcaggugagugcagacucugguuacgugucggcuggcacuuacugcagagaacucaacgcugaucuucaugucuccacauuuguacacugaacccaaggauacaagccuaaagugcuggucaucuuccagacauggguuaacaguuucuguugacuuucuuaaucccuuauuuaggaguauaguuucaacugggugugguggugcaugccuagagacaggcagaucucugugaguucgaggccagccuggucuacagagugaguuucaggacagccagggcuacacagagaaacccugucuagaaagaacaaaaacaaacauacaaauacagaguagguuagccagaugugguagcugauugggagacugauggaggguuacugugaggccggucugagcugcagguugggacccugucucccagagagugcaguaugcugaaaugaaagugcgugucuuguagccagagcacuugugcaucaucuucaggaggccuagagcuaguuagcccucugugcuagccaguccugcagauggggaguuagcggagaugagagauaaauagcucagugaguaaaguucuugccucauaagcuugaggagcugaggucuccugggaggcuucauccaucagcagcagaugcagagacucacagguaaacaucagcaggagcucagggagucuugggggagagugggguaggggugagcaagcuggaggggucaagaacaccacaagacgacccacagagucaacuaaccugagaccaugagggccagaguguggccaccaaccagggagcaugcaggagcuggacaaaugugcagcuuggucuccaugugaguccccuaacaaguggagaggggacuggcugucuuggucucuguucccugccauuggaccccuuuccucuaccuggacugccugguuaggucucagugggagaggaugugccuaguccucaugggacuagcuguuccaggaugggguuccuguucuccaaagagaaggggagagggcaauaggaggagggaucuguaaggguaggacgggggcggggggcugugauuaggauguaaaguuuauauaaauauauagaaaaggaaggaaggaaggagagagagaaagaagccacauaaagucaggcauggugacauguuucuaguuccagccauggggaagcagaugcaggaggauucuuugggcucguuggccaucuacccuagcugagucaugcaagccccagaccaguaaaaaguggauugcuccaaaggaaugacauuugugguuguccucuggccucucucgcacacauucaguucuuuaccaguaccuaaagcuguauuugauggagcacaguaaagaaacugcugacaugacccuuccaugauaaugguuaaggcuuuuguuguagaaacgagaacagccagaggcaucuggaagaguccagaacagaaggagaaagacguagacuggacauggugagggcuagcacagugggugagaaguucccauggagcuaucaagggagacuguacagugugggaggacagaagagaucugugagaaaaguggggcagaagggaacagauggcugucugggagcugagaaaggcuaggauggcaguguggguuugaaauguguaacagcuacuugggauacugagggagccuggaggccugcaggggcuuugacacacaaccuauaucccuucugccagagugggaacuacuuucacaagauccugagcaaugcuggcuuuuaucaaacuuccagaccauuggagugccugagaccccacaaaagccaaugugguuacucuuaggggucacacucauccuuguaacucucugucaagacaucaacagacuccaucuaagugcccuuugcagccaguccuggaagggguucacacacucagugucacagacugaguacaguaaugacuucaggucuuuccccuuuugugagcauagucugacugcuuaacugucuggcacagugcagcagauaggacaggucugaugugcuuagcaauguccuuuccccacaugguguuaauauugucugcaacuucccugacugagguccugauuuacugacuucuuuacagaugaugccagaaguccguggagccuuguuuggugcaaaugccaauaggaaguuucuggacugagcuucaggaggagcaguucccccacggcuguucuccuggagaagcagauuaucuguguggcuuccucuuucuguucuaauacugguaaucaguggacacccucuacagcuaaugcccucggcucagugucaacagcagggccacuuggugugggcaagaacccagccccagcucaucugaggccacagcuguucacuggguuugcagcaggacgggagggucagaugugcugcacggccucacccaggacccauucuuucccuguccugcucuagucuagagugaguugugcaugcugucccugcucuuugggcauaaagugcaugugggacucacauuccuccaggaacacuaccuucgcuguuacuguuuaggucuagucuuccuucucuguaaaugugauuuaaaaucuaagccacaaauauucuuuauuuauuaaaacagagggcuuauguggauuuaguuguuguuccuuauguaaggcaccgaguuugugauuugagaguaaguuccacugggcacgguagcccacaccuguagcccuagcuguggugggaggauuguuugggggcagccugggcaacaggaagauccagagaggagcuaucccaaaucccugccguacauuaaccugccuguccuggaggcuggacagcuuuguguguguguguguguguguguguguguguguguguguguguguguguguguuagcagugggugccagagccucauagggaagcagaugcugcaccgcugagccaugccccgcaaccuguggccugugcaucuuugggguuuuaccuaucuugucuuagagagaauaaggccguuuucagauggauuaucugcauguacaucggcguacucccccagacccaaguuuuacguuaggugggacuaauggagguucuuuucaguuuuguaguuuggcaggguugcauacaguguaggcuggccuagaaugugcucacugauguuaugaccuucauguuuccuauccucccguccucagcuacuaaggacugggacuauaggcacgggccaccaugguguuggggguggaauccuuugcuaacugaccuguguacccagcucucauuccuguuuucuuagggccuaacaucauuuguguggcuucggagaaaugaauugagggccaugagauuggguuucuugguguugacauggccaugaaagguagaaagaggugagagucaaggguaggaacuggagccagcaccugcugcucuuccggaggaccugaauucaguucuuagugccgugucuggcagcucacuaccaccuguaacacagcuuuaggagguccaaugcucucuuggggguuacagauacacagacauguaaauuaguaaauaauuauuuuuuaaaagcugaacucuuucaguguacaauuuccccccaaccacucuccacucuagaacagcaguuggaagacaguaaugaacugucuguggggcccaagaaggcacagcuugacucugcagaaugacagucaucugcuaugcugauuacaggacaaggauuuaaccagcuuuauuucagaucaugucccacaagcaucuauuggaagggaucugggcccauacuucagggugaguaucuggggcaggaccgcugcugagguggccagaauguucauucaggcucucagacuauugcugaugcccgcgagggcacaggugcacuucugaucuguuagggcggcaagguuaggauugacgcuaaacccucacaggacgauucugugccacacuugccugcaguggggauguuaguguggaagagcccuucugucuuacugcacacgguccugccauaguacauaagagguuggggcuuccgaacaucucugguucagaaaguuuaguuuucauaaaggagaugaaggcucuacucgcuuaguaaaaugggucauuucuucugagguagcacuacagguuagagaccacguacgucagagccagcaucuuauacuuccagcagugccaccuaguucccuagggccagaggugacagcaagaagugacacauagauuacucaaagcacuucaagaugcgcucuccgaugccaaugaaguagacgcccug

SEQ ID NO: 3342 - RNA, 680 nt, Mus musculus
uuauucauuauuauauguaaccacauugucacugucuucagacacaccagaagaggguaucaguucucauuacagauggucgugaaccuaccaugugguuucugggauuugaacucaggaccucuggaagagcagucagugcucuuaaccacugagccaacucuccagccccaaucuauuucuuuuucuuucugguugauaagcauucaguuuaucuuggaccacagguuggacaugcuuuuguagagucaagaaacaaacauaagaaacuauaguccaggcagcuugccaggcagugcgaguaaaaaauggauuacuacuauaagacucuuuuuaucaccauggugcccggauccugaguugucucaaccuagucauuccacccugccuuuaaauugcuuuccuaacuuucaggacaaucuccuggcagcccuaggaagugcagucuugaccaguaaccugagggcuuuaguacuccaggaacgcaaaagucugcagaacucugcuucugcuaugccaccagcuucuugucccacacaggggugagcaggcgugcgguggugucuaccucaucacccuucgcccuaacuagcaccggaaaugacugggugaagauacuuaugaaguccagaaucgaggauuuaagcggcuccuggaaagagaggcacaggacagcuucg

SEQ ID NO: 3343 - RNA, 25126 nt, Mus musculus
aaugcggagaggucgggaucaaguaugacaccccauccucacgagggcaggucgcccaggcuuuggggacucuggggagcgcagguuccggguguaccuuccuuccugucccccguagcgagccgguaggacccuuggguuuccgcaaaguguggccagucggagggcggagcauccggagggcggggcuaucacaggggcggggcucccgggcgagcacgaggaaagguagguggaguagagcgccgggccgaguguggcuccgcaaaccuuugccuuagcccguucgccgcccgguaccggcgcagcggcgucugcguggugaguaugcccacccuacugggcgcccccacaguuccccucugggaggacggggucggcacggagcucaguuucguaugcuaucgauccuucgugauggcggggcucuugcgccuugauggaggcggggugagggcgccggccacagggugccaccgcggagcugaggggaaggcacucacucgaaggccuggggcgugcgccacucgcggucccccucagcgcucgguccugguccgcuucgggcaggccuccugguggacccgggguccccgcggucgcgcgccacucggcaggugcgcgcagagcuggaaaggcgggccugaggucucgcugcgcuccgcuauggccacccacaaaaaucaacaaggaacggcuacagcccacaaaugggcccugcaaaagcccuggaaccccaacccagggaacacagaccuuggaagacugcagcgaggggcaccuuuccuacacccgugggcacuacugugugcacagcucacacucacgccugaacugugaggaaguggcugaccccuccgcaucuccaguacccaaaaugguuugaaaaugugcacagacugguugcugauguuuuuaaaaaguuuguugaaugguuggcugaauaacccuauaggauucuagaagaaacccacagucuucagccaccaaguggccugggcccacaaggauucacacauucguucauucauucuuucguacauucauuuacauacucaacaaauaaguguggaccagggacggaucaggguagaacuuuguggguggugagaggcuggaaugaagagcucuguaaaggaccaggugguguugaguaugggacuucuaggcugggcuugaccuucaucugauaagccacauaguucugagucaagagcauccugaggacccaggcagggcuccccuacuuucccaggcuacugccuggugccauggccaggauugcccuuacuggaagacuaccuugaagccgggucuaggauaagcuagcuguggaauggagcugggagaaaccacaagaaggauguggacuuuccacauuccagcucuacccaaccaggagacuuugcagcccugccccauccccugggacuuggucccaggcacuacccuggcagucagcucugaguguuuccauggggggggggggagccugauccagugcuggggcugaguucagaggcuuuaauacuugagugggcugagcucuaagaaggacucggcuggguggugguggggaagcaggguggcgauuguguguguccuggccucuacugccucucuugcccagagagggaauggcagggagguuggcuuauuacagcuggguuagcaggcauuucacccacugacgcaaggugcuaucuccuggcuacugcgggguggaguuggguacaggcuuuggugauggcaagugaagagaagccggcuggauguggcaugcucuauaaagagauuuaaguagccccaagguggccagguuacuggagcucugaaggaugaguugaggguguaccugaaaagugggcuguuagggcaguuacuggcgaggcugggggaggggaagugaugcucacagcuugagguuaccugguuccucuuauuugcaagaaagaauagccuacggggggggggggcacagugcugggugccuggccuccggaaggaaggccugaugacacagccuuuuagaccuuccgaagggcacugcaugcuuuuccagcugcccuuuugcucucuagugggaagcugaggguuggggacccacaucuaggcuguguucaagaccaaagagccauuccucaucagggagacagugaaucugaugguuccaaggaugagaguuggaaacugcccguccauaagaagcccccacugugggucuguggucacuggacauuuugucugugguuguaucucuggccaccauuugcugggccguggcuguggagggcagcugguguuucuguuucuuucugggcacgcugccuggcuggccagucucagaggccacauguauuuuuccucauagucugaaggagacagauaaacugaagcuucagguuggagggcagugaugggcaagugcuauacagagccuucugggucugauaagcccacagagagcuuuguuuuccuucucaaauuucuuuuuuuaaaaggcagaaugucgcccagacuugucuccaacuccugcucaacaauaccuccuugcugggccguggugggacaccuuuaauccaagaacucaggagacagaggccaguggaucucugaguuccagccagggcuguacagagaaacccuccaacaaacaaacaaacaaaacaaaacaaaagaguacuuccugccucguccuccuaaguacugggacuacagaguguaucguuuauuuuaauuaacucaugucguauuacaauaauuagagacuagauuauuacuuccuucuucagaaagguacauugggcagagaggggcuaauuuacuuacccagggucucaaaaucagguggaaaacucccaguuuaacuguaccaccugauucucaggcugcgcccugcuucccaagggagguccaucuguggagcccaauaguccucggggguaaggaacagagaggaugcccacgguguuguuugcuuuuuuaacacuagggaaaaccccggccuaguguuuguuccaugugcauucugccacugagucagacaugcacagccccuuccuguggacucuucccccuagcagguagagggagacagggcagcuagguguaugaauggggaagcuggaacuuuagugccagggaccuuuauggugggguuucccccacgaaccauccuggcagauguccacagcagaugucuccaguucacugugucuuacucucugacucuucucccucgacuuucgcugguccaaacagggauauuuccgacaaaagggugguagcaucuacccugagcuaaacaagaugaaaggcaaccauuucuagaggugcugccaucuugaaaauugaguucuuaguuggcuuuaugggcauuuauccucacagacauguuagccuuccaaaaacauucaaacaaaaccaagugaaaucaagggaacagaaaacagaggacaaguguuuugugcucucuucucuucucccaccccucucccucucccucucccucucccccuccccaccucccccucucugucucuguuggugucaagugacuuccucagucauucucuacauuucccugugugugacaggacucuucacucaccgauuuaguagacuggcuggccagugggcucuagggauacuccagucucugccuccccagcacucggauucuaggcucagagcacuacacuagccuucccaugguccucgugaucccagcucagaccccuaugcuuauauaggccuggaguuuacagacugagccauauccuagcccugguuugccuuaaguuacccuucuuccccaguaaugcaaacagacauuaggaaguacuuaggagccagguguuucccuacuggccccuggaucggccuaagaagggcagugugcuuucuggcacuaugccuggaagggugaggauagcuaaacccuggcccaggacugggcuguguggaagaaggcagccaaauguagugagaguuugccuaucugugugucgugagacacaggacagaugcuuuuuugcaguuuccugcauaguuucucuagucuggagggaucuccuggcccauagugggucuacugucaccaugauggccacagccagggaaggccuguacugccuuaggcuacuguucccuccuucagugacaaaccuucuuuguuuuugauuuuuuuguuuuguuuuguuuuguuuuuuugguuuucgagacagaguuucucuguauagcccuggcuguccuggaacucacuuuguagaccaggcuggccgcgccuaguuuuguuuuugcuuguuuuguuuuguuuuaugaggcagggucucacauauaccugaggcugguuuuugucucacuauauaccugagacuagccuugaacacuugauucuccugcuuccagcuucccaagugccaggauuacaggcuucaaaucuuucuucagaggcaguaaaagaacagcugaagccuggguacucgagauuccagcuugugugauccagagcccuuggcuguaggcuuuuaccugagccagcaguuuaguuuucauaacugguguauacauacauguuucuccuguaguggugcuguucccaauaaguacguuaccucagcccaccuuauguguccucagaacagacagcuagccuuccaaggacaagugugacugaugggguaaagggacccuggaacucaccagagccacccuccucuagcugaggacauagaaaaccuuuaccuggauuucugugggaacuucccaacaggcuuuuccuaaccagucuuggaaagguguauugagacugggugacaccaucuggaagaggccuuggaacccacaggagccuaccaugccuccucagucuggcguguugcuaucuuauagcauagaccuaucuucccuugaguucuagacaaggcaaguuucuggccaggacauggucuuguuuuucuuugagcaucuucuagaaaccagggagaccauaccacaaagcccuuacuggacugacuacugcaugcgcaccuccaggagcccaucucaucaggcaaggugacugcuguccugucucucugauggaggccauugccccuuuaacaaacgaggaaaggucgcucuccccucuaggguguggaagacaggaaauggcuguuacccaaugcaggcccacugccagcucugcccucagagcacggugcagacaguccagucguccuccauuggauucucugcugggcuaggcacucccagucccucuguggcuaagcuaagaaaaagagagaaaaaaaaaaaaagaguaaagcauuggggguggggcaggaagagagcacaggcgugcaaacaucgcagagcggccucugagacaucugucugcgccccuguuggcucacccuuaggacaucugacucccuuucugcuagccaucuugucccacccaaugcuuagauauuucagaagccucgguccuggguagggagggaaagcaggucucuguaucuuauaggccucagacaaccaggacagccaucuucugcaggccuagugaggccccagggaugggcagcuucaguggcauggugcacacgcccuuuuccacaccacccuuuggcaagauuacuuucugugcuaaugguuaaaggcagaaaccuuugcccacuaagcaguugcugcgccccugagcuacgcucucguucuuaaaaccauuguauugcugguguggugggucaagucugugaugccagcacuuggcaggccagggcaggaaugagaaggagaacaaguuucaaagcaaggcugggcuucauaguaagaacuugucuccaaagcccaaagaaagggcuggagauacaggacagcuggcagaaaccaggcacagagguuggcaucuguagccccaacacccggacaguggaggcaggaggaucagaagggaagaccguucuugccugaacgucaaguucuaggccaggcugagggccaugccaggcucucuacugucuauguauguggguguuugcuuacaccacuuucaaaccuggugcccaaggaggccagaagauggggucgaauccccuggaacuagaguuacagacaaauaugagcugcuguguagguucugggaaaugaacccagguccucuggaagagcagccugugcuuuuaacaacugggccauuuuuccggcccauauucauuuuuauuacguguaguuguuuauuucauuaugggacaucccacagcaugcaccuggcuaucagacuugcggaagucaguucuuucuuugcccaguguggguccuaaggcuucauucaguucauguuggcaggcuugugcccccugcuuuagaugccacgucaucuccagccacucacauauucuugcuacccguuccuugucagauacuuuguagacguuuccuccccaggcuggauuugaacucacugugcagauccgucuguccuguuuuagcuuccuggauguugagauuacagauaggaagcaccaugucugacucgguuuuaucuucucaggagugucuuuugaaucauaaaaguuuucaacuuugaagacuacguuagguaauuuuuuuuucuuuuguuacuugugccucugggcuaugucuaagacguugccuaauacaagauaauugagacuuccucucguguucucuuuuuaaauuuuuuauuuuauaaauuauguguaucgguguuuugacugcgugucuguguacuaugucugugucuggugccccaagaggcccagaaaaggacauugggucuccugagccuggaguuucaguucugagccaguggauccugggaaucaaacccagguccucuggaagaguagccaguacucuacugcugaaccagcuacucuccagcccccacccuucuuacacuuaggucuaucuguuuugguuugguuugguuuuuaagaauuuguuauucaggggcaagagagauggcucagcaguuaagagcacugacugcucuuccagagguccugaguucaauucccagcaaccacaugguggcugaaaugggaucugauacccucuucuagugugucugaagacagugacaguauacuaauacaucaaauaaauaaauaaauaaaucuuuuuaaaaaauaaaaagagaauuuguuauucaaagccaggugcaucucuuugggaggcuagccuagucuacauaguaaguuugagaacagucagggcuacauagugagaccuaucucaaaagaaaaucuguuauucagacuggagagauggugacucagugguuaagagcacuggcugcucuucccgaggacuugugugacuccugguauccacaugggagcacgccacccucuguaacuccaguuccaggucaucuggcacccucuucuggccuccacgggcaccaggcacagagauacaugcaggcaaaacaccauauacaucaaauaaaaauaaaauaguuuguuaucuuuuuuuuugaaaggaaagacaaaguuuuacuuuuaaaaaagauuacaagcaccccaaauaacauguaaugaguugaguccucgcaucucgugauuuggguuaggauacacuaacagcagccggaauaagcauaccauauugacuguccuaaauuauccaggcuagaguacuguaaggcuggcugcuacuucauaggaguugcuaauagcuauuacuacuuuuccauaaauaacgccccugaccuuuaagaaaguagaagggaacagcuuacucccuuucuuucaaagaauuuuuucuacuugacuaauaaaaaagucagcacugauauccauuacuugcagaagacacaggaaacaggugacaaacacuccuuaaagacacacaagauaagaagauggaacuucagguacauagcaagucgguacaaaaagcuagauuugauacucuuaaaacgugaaggguccuacaacggcauagagaaauaauuuaaugccuuccagaacagaacucgagcucuguggagguuuccuauucuaugggggcagaucucaugccaacccacagagcaggcgcuucuaccuccuauccguuuaugcgguaguuuucauggauuucuggcuggaugucacacacagaggccaagaggucauucaggacuccaucccuguucugcucgaagugguucuggaggacguucaucuuccccugggucuccucuuccaccucacugcugcagcugccaugagaccccagugcugcagcuuccuuggccucugcaguacuguucaauuucagccuggcggcuucuuuggccugcuucggccuccgguucuuucacuugcaggccuuggacaccuucuuggcugccugcaguagcugcuggaugccccgcaacugacucucgccauugcugaggggacuuugggcugagaaaaugaccuaagucaaccaacggcucaaacauagucagaagccccuccguuugaugucauuuaaugagccuuucuguguagcuucaggucacucccugaggccuggaacacccugaaucuuuucagcuuuucugcugaauuuggcugucaccaggacagacugcugagggaguguguuaguacuccagaggagcccaguugucacuaugacuggagcagcgcagucuuguuuguggcacuguugggcuaugucugcucacugacaguugggaucaguuccucuuaggugacucauaacuguugcgguaaaucuccucccaaauaugccccggcaaugaaaacacaacacaguucauaugaauacaugcugugcgccuagauugggcagaucuaccgcuacacuaccaucuuccacaucuaugagaccccuuagaacuugcgguuucuccaggccuugugcuucugcuccacuuuuccccuucuuucuccuugucuguguccucucccucuuccauuuucucuuuguucucuccccccaccuuccgcuccaccuucccuuuuaucagcccaaacuucagcuccccuuuauuuuacaaauuaaggugggaagcagguuuacaggaaaucaccugagugcugacuauguccuuguucacaaccacucucaggagaacggaauuaacaucaaauauaauuagccccagggcuaucugcaacacauaacaacuaugucagugugaucuggcucuaucugcgagaguugacccucuggugaugcccugacugagcguguccugugcuugcuaaugcuguggugcugccccuggaugguauguccacggccaacauauguccgaaaggaaagccccugucagcuguuguuuuuuucaaauuuaugucuaugugugugaguauuuucccuuuuuguauaucuguguaccacaugggugcccagugccuguggaggcagaugccccaguacugguguuacaggcaguuaauaugagcugggaauugaacccagguccuuuggaagagcagccagugcucuuaacuucugaguccucucugcagccuucuuagcauccauuuuuaaucuuuuguaugacaucuggcagagguaggaauucaugccuuuuggggggauaguuggcuaucccaguguccuugguuaaaacugucuguucuuucccuggcgguggcccgggucagugucugaugaacucgaugcucacugcucucugauuucuucaaccaggcccgcaccuucaugacgucaugacgagagcuaugggaagguuugaaaucaggaaguacaagucugucauccacuuuguuccuuuucaagaauggcgauuuuugaaaauguccuccgcguucauguauggauuuaggaauuguuugucacuuucuggaguauuuuuuauaggaauuguguggagugcuguagucugauaguguguugucucuuccagccccugacaggugcuugccuuccguuguuuaucucaacaaguuuugcaguuuucguuuagugucuaaugcucguauaacauucgcuccuaaaugcuuugugcauuaauuuuguucacggcacugggguugcucucaagcucucgguagacguguguucuacuguggagaugcaggccgggucuuaggauuuucugucucuugguagcacaauaaucauuucauuuuauuuuggguuaugaguaguguauagaaaaacaggacagcaggggcuugcucucugcuacuuuguuuucuucaugaauuccuugggugcuguguguaaggucaugucagaucacuguguucaggggcuuccagaagauuccacugugcagcuaagcuugaaaauugcugaggaagcugggcaccacagcaccuaccugucuuccugaggccugcaagguagcgccaagaguagaccucgcuggcggcgugccuggcaccccccgccugccauggaacuugucuuggucuaugauugguacaugauagacaaagaggcucuuuuuugucacaucaaggauucagcuuugugaccuuaacguuuguucaucuuuaugaauaggugacauagcugcuuucuguuggggggcugggagagcacacccgguugcuggacuguuuucucugcguccuuggucgcaagcucgguugaacuguuuuguguccaaggagaagaacagcauccguuacuggaccugugaguuugggucucuuuguccugccucccucucccugccugccuaugugugcucguguguguguguguguguguguguguguguguguguguguguguguguguagagggaaccucaauugagaaaaugccuccaucagauuugcuuguagguaagcccgcaggguauuuucuugauuggugauggugugggaggucuggcuuacuguggacagugccgcuccugggcagguggcccugaguucuguaagaaagagccugagcaagacauggaacaagucaguaagcggccccccucccuggccaugacuccagcuccugccuccagguuccugccuugacuucccucagggggagggggacggggacgggaccugagaguuguugugcugagauauguacuuuucuccccaaauuguuuuuggucaaguguuuuauuacgauagaaaguaaacuaaaacacacucuccccacacacacacugacuccaccccacacaccgugaacacagggccuugaggauuccagacagcuuuguuuuguauuuauuuugggacaaggucuuagaaaguugaacuugugauccuccugccucagccuuuugaguagcugggauuauaaucugugucaccgaguuuguucuugaccuaaguaguugagaagagccuuugcucuuguguaaaugggaaaaggugcuuuagucacagagguuuaggcucuggcuucucacugaugcagcaccaacuggacgagacauucauacaaauuaaacauuuuaggauuuuuaaaaaguguguuucaauguuacauuugcgguaagaaugaaaauacaggaauuaugucggugcauuggguguuguagauuugugugugugugugugugugugugcgugcacagaguuuugaacugaagguuuugcucaugcuaagcaugugugcuaucacccaguuccucugaaaaagcaucucuaauagaaacugcccauucucggggacuccggguagcagagcagcuuccgcuacugcguguugacuuuauugugcucuuggcuuuuuagacauugugggaagggguggacaaagcucacugcuuaugaaacagucuggguuugugucauuaauggauaaccaugccuauucucgugcaugugacccuguguuaauuggauguccuaccaccuaaugcuucuuacaacacuugauguuuacuguuuccaaaauuggaccuagauuuagaaaaaacaaaacaaaacaaaacuugauuugcuuauuucuauuuugcaugcuggggauggaaugcucaggccuuacucuugcaggcaggcauucuaccaucaagcuguguucccagcccuuucaggagccugacaccuaaagcugagcuugggcaauccuggaaaaucucagguguggccauuuguauuguaaaaagggaaaauuagggagagauggagggauggauacuggaaacugaacucauguccucugguaggauagacagaacacuuaaccacugagccuucugcaacccccuuuagagagagagagagagagagagagagagagagagagagagagaaagagagagagugugugugcgcgcgugcauguguguguuacacacagaggccagaacagcuguccuggaacucacuuuguagaccaggcugaccucgaacucagaaaucugccugcaucugccucccgaguucugggauuaaaggcgugcgccaccacggcccagcuuucaagacaaauucuuaaccgccaguccaucucgccauucuccaaccagucccuuaaaaauauuuuuuuuucagguguugagggucuauccccgggacacaggcauacuaggcacggcugaagcacugagcuccacaccacaauuggguauuauuaccgucuuacccucuagguuauugauaugcugcagaauacagauauuaaugcaggcacuuguccacaggccuuuguccagugcagugugguuauuaucuuacagcuauuggcagucuugccugcgucucuaaguucuucuguuucucaucaucugugcauaugguucuuugucauuugaguuuuguuuauuuacuuauuuguuuguuuauuuuuauggagacaagguaucguauagcccagccuggcuuccagcucacaguguugaagaaggcggccgggaacuucugcuuccugcgugcugcaguuacgggugugugccaucgucuccggcagcccggggcucugcaugcaugugaggcaggcacucuaccaacagggcugcaucucaagcaccugggcaguuuuagcacaguuccuugguuucccauuaaguaaugaguuaaauauuuaacauauguccauuugaaaagauggaaaacaacuucuccuggucacucggcauucaucagccagaagucugggaggcuuuuucuucucuggaucuccacuuggcggcguucucugccugcucuguagccuuugauaaguggauggcugggugcccucuccguaauauuuaucacauuuuucucgguuacuuguauagauaaaccucagcagggcaggggcacaaggacacccagcucuguguaacaguacuuuguaccuuccucccuauuggugugucccaagucugcacuucgggugggcgggguuuugugaaguucagaguuuucagcuacuucagggcuuuuggcuucuacaguacaagagaaacuuccagguuccugggagagugaguuggagucugaguagugugacccacgugagcugcuguccauuccucuuacucaggacacagcucucugcucagaaauagcucucucgucccaagacuccaccugguggcuucuggaagaaguggccucugugaugguggagauugacagcucugacugugauugacagcucugaccaccaugaggugcaugcaaagugcuuucacaccugucuaauaauucuggauguaaugagaaauaccaagcaagguguuuuuuuuuaauuagaauuuuuauucaucacuguguguauaugagggaggugaacucaugcguauggagggaagagggaccuggaaccggcuccucuuugaccuuucacauuguuccagggauggaaugcaggccaucuggcuugcugacuggcacauucaccagcucucuugcuugcaucugaucuuagcuuuuuugagggaccucuacacuauuuuccauaguagccauauuaauuugcauucucaguaacaguauauacaaugaauggauauacuuuuuuaaccaugcaacaaaaccuuuauuaacauuuuaaacagauguuccgcuauuacugaaacuuuguggggguuggggcgggggcagguuucgagacaggguuuuucucugaauaguccuggcugcccuggaacuugguuuguagaccaggcuagccgaaaacucagggauccaccuccuucugccuccaggugcuggaauuaaaguucuauaccaccaagccuggcuguacugaaacuuauaauuucuaaauucaaaugcacaaaugguuuuaguguagaguaauaccauuagugccuacgggaaauuuaggcugaagaacggagaccaugugugggcuugagucuuuucuggaucaaaaagaguauggucaucuuucagcugcuugccuguaacgaugagcgucugcuggguggggugggaggugcccuccuaauccugggucuuacccuucacauucucugugguaucagugggcucuaccucagggucugggucuucacaaagauucacaucuuuuuugggggagggggugcguugagacagcguuucucuguguaguccuggcuguccuggaacucacuuuguagaccaggcuggccuugaacucagaaaucugccugccuuugucuccugagugcugggauuaaaggcgugugccaucaugcccggcaagacucacaucuuaaccuguuaaugaagggauuaaagugcaaaguucaaagcacaucagggcaccuaguuauaagagccucugcacuggacaaagcugcucgucuggacauccucaaugaaguucuucaaugacuuugguccagucagcuaugguagaucagaagacuugcauggcgggcacguuuuaccagccaagcugccuugccggcuccuccagaugacaucuucuucccauuaaguuggaauacauacugugugcuuugccucaucguguggaaagaggaagugguuggugguuugggggcacugugguccuguaguguagaugcccugcagucuugcaggagugugugacuagcugggaaacccacuaaccagugugaggauuagcagcagcaguucuugugggaagcaccaguuggccugaucagacuuacugaacaugggaagaaagcugagcucuggagaacuggccuggggaugcccaggucagugccagcggaggcuucaaggaggaagacugcagaccugacucacugggucuguguggagagcaaacaaaugagccaaagccagcgguguggcugggugugccucagcugcaggugugacaguguccuguaucccgcggggccccgcagaggcauugcuuuagggaacagccacccauggcuuguauauguccuuuuucaggugauucccuggacucugugagcuggcagugcuuggagcuacacagcuugugccauggacucugagguuagauucugguaucuuuucauuuuguucauccuggguguccccguuaagcaaccugaccccucaguugucaggucuggcaagguguaccucagauaauccaacagaguucaucuccacuggcaccugauagggacuuaguacagaauggggaagggggacguccuuccagaaggacggaacggcgugacugucagcuugguagacauagcaagggcggcacaaaggcgggacagaaaagaucuggaagguucccuuuugccccagucaggggcugagcugggcucgggcaauagugcuuucuagccucccaguaucuccugcuguccugcagggccucuugagagugggccccuccuggacaacgguagacuugcugcuguccccuucuucuaccuuggagcaggaaagcugaggcacagaagaaagugaaaugcugacauuuucucuuacaucuuggcauuugacauccuugccccacaucagaacuuguaucuuauuguagauguuucugacuuuaugacaacuguuaugcacacaguugagggacauuaagugaagcagguuuugcuacuacguuuuuuuguacuacagggacucauggaacaggcguugcugagugcuccuccuuuuuuuuguuuuuuguuuuuuucgagacaggauuucucuguauagcccuggcuguccuggaacucacuguguagaccaggcuggcuucgaacucagaaauccgccugccucugccucugccucccgagugcugggauuaaaggcgugcgccaccacgccuggcgcuaagugcuccuucauagugcuccuacccagggcugcuuuuguacacaccauagaacuggcagagaggccggugagcaagacccucccugcugccucugauagugcacaugucccccugaaaggcacaggcagagucggaccugggucccugcuuccuagaguuuaucaggcauccugugucugcucaugagggagugaggggaaagaggaaccgcuugcugcuaggagcacagcccguacagucaggcucagcccugaacggaaacauggauggaacugaaguaaugacauuugccugccaccccagugucccugagaccuucccucgaagcagcuuccccagugggugucuucaggaggggaucuguagaagguggcucgauagccccuuggugucuucuguuuggcaagcacaccacagccuguuucucugccccugggccucucacuagggcauuuagauccuccgaguuauugguugucacaggccauugugacucggguccaacugugcucugacccaggcucccgugagccuuccugacuccccuuccaccuuaggucagcaacgguuccggccugggggccgagcacaucacagaccugcugguguucggcuuucuccaaagcucuggcuguacucgccaagagcuggaggugcugggucgggaacugccugugcaagcuuacugggaggcagaccucgaagacgagcugcagacagauggcagccaggccagccgcuccuucaaccaaggaagaauagagccagguagguccuggccuuguccaccucaucccaaauguagccuuuacugacccccaaaagcuacaagggcuuuuggagcucagucucuaaccuuacauugucaggcuggugugugugugcaugucaugugacuccugucuuaugaucugcaugugacugcccccaguaauguccaguucauaugacaucgccuguaucaggacaacuaauuagaaaguucuuccuucugaugaguccugaguucucuucaggucuggaccugaggauccucucuggaccaauauuuaaaacaugguuuuuaaaacauaugucccaaacaguuauaguacagccaaaguauggaaauugauugucuaguuuaggcuucauugcugugaaaagacaccaugaccaaggcaacuguuuuuugagggggagggggcuucgagacagggugucucuguguagcccuggcuauccuggaacucacucuguagaccaggcuggccucgaacucagagauccgccugccucugccucccaugugcuggcuagguuuuuuauuuuauuauuuuuuuuuauuucuuaguucuuuccugcaacuaucaagucauucagaaaagaggagucaagagaggggaugagguacauuugaaauaaaaaacuauaaugaugauugguccugcuucugccucccuagugcugggauuaaaggugugcgccaccacgcccagcccaaggcaauucuuauaaaggacaaauuggguugaggcuggcuuacaaguucagaaggucaguccauuaacaucauggcaggaagcauggcagcguccagguaggauggugcuggaggaagagcugagagcucugcaucuugauccagcugucaucuuccgggcugcuaggaggagggucugaaagcccacacccacacuucuuccaacaaggacacacuuccuaucagugccacuaucugggccaagcauguucaagccaccaugcuggucaagauguuauaacccagaagugccaucagcuucagcuuguggaguuuuggaaaguagcaaggcagaguccuucguccugccauucagaucugggaggucugggacauugcuagucuggucauggcugccagguaagcauccuucaauagccacacagcaccucauuuguguaggcuagcugaacuuucaauccagugaaaacuccugccguuagagucauuuugccuccuaaaugaaacuuuaacauaugugacuugcuauuaccuaaagagaugaccgaguauugaaguauccugacccucauuuccagauaaggaaacugaggcacagcagagaaauggcugaccucagaucaaacugcccaugcagcaggagcaaggcucaaccaagcugcuccuucaucagugcagucaccuccugcuaagccugugucacucggcugcuccuagccuucaccuguccccuguccccuguccccaugcuguguuuacagcaacugaggagaccucccuaaaggcugaggugcagcgagugcucagagcgcugugggcagcaugcaggugggcaucacugagaaguucuucagaguguacaggccuggcucgggcucugcuccuccagcacguucuggagcugcaugauuuuuuuuaaaaugcuugucugucugucugucugucugucugaguaugggguaugcacaugcccuagcauauguauggagucagagcuggcuguuuuccuuccaccauguguguccugggaucaaacucaggucaggauacuucaggacucuaagcacugcugcccccgaucuuggacacagaggcuucacugcccucuagugguugcaagggagaccagcagcuaguuuggcuucccuaccccccucuggcuaguuuauuucuuuugagacagggccuuacccugccuagccugaaauuuguuguguugaccaggcuaaucaugaacucccagaacucugccugcuucugccaaaugugguucauuuuucaaaugcccugaagugguaucuugaguaggcugggaugugacagguauucucuacaagcuggguuuuaccauagccuugucuccgaagcccaccagugagccagccagccaggccaaaacugaagagaagcgccaggcaguccaggaaaggcucaggaaguucagggcagcgggaggaggcucuggcugugcgcaggugucugucacucugugccauacccgcuucuuucugcaucaguccaugccagacuucaaagccuggcuuaagucacgagacuggggaugacgaggcuuugcagacgaucgaucggcugcagauugggagcagggcaaaguaguggcuucagcaagccagugagcagcugagucugccuagaacacucggcgaguaguggauuuaaaucacagggaaccggaagccaugcaguuacugucaccuaagcagaagcagugagcaccagagaggccuugaggagagcaauguggugaccaugugacaggcauggacugagggagggccuggaguaccgcugaaugcugaagcaguugcccacugcauuaaagcagcagugacacaggcaggacacaggacaggagcacccccaaccccccagcccccgcagcagcaagcauauaaucugggacaggccugcuucuccagccagguucugcuacccaggccuucccugcacccggggaggggcggcacucaugguccucacuagggcaggugcggagguaggaaguggccugaagcuguugacagaaccauugcugagucuuguauuuguugccuaaacagauucugaaagucaggaagaaaucauccacaacauugccagacaucucgcccaaauaggcgaugagauggaccacaacauccagcccacacuggugagacagcuagccgcacaguucaugaauggcagccugucggaggaaguaaguaugacucuggucugggagccccucuuaugggacauuucggaagugugggacauuuuuccuugucgaaccagucuuucccaggaaguaaacccuguccuugacugcccgucagcauggucucuccaaagaauuuagucagaguacagagcuuaggagucaggccuccaggaagaucccugaaguaccugaucuguacagauacucagucuucucuuguggcgaacuccaugucguucccccagggugagcaucugcugggcugugugguuagaaucagcacauggaaaccgauacaaguccaccucuugcuggguauacggugaaggacccaaagcucguuccucagcaccggguccuuccuaaagcagagguggaggggugguggggagaggggagagagagaaaccaaaccccggggcugugaaguaccugcccaaggaagaagauucuguucuuaggacuuccagcagcugaaaucguggcugcccucaccaucuagauucauugugccuacauacagccugucuuugcuggcacucucucuaccugccacucuccaguggcugucaaagacacacacauuugucaacagccuugggcuccuccuaugggguagauucuuuaaugugagccacagaaccugaagcucacuuuccaccccaccuuguuuuuuuguuuuuuguuuuuuuguuuuuuuuuugaggcaggguuucucuguauagcccuggcuguccuggaacucacuuuguagaccaggcuggccuugaacucagaaauccgccugccucugccucccaagugcugggauuaaaggccugcacuccccuccccauuuuuuaaagaguuaacguuaccuguuucugcgugcaccucaugugugaguacaugagcaugcuugcagguacaugcauugccaucagauccccuggagcugaaguuucaggccauugugagcuguugccuauaggugcugggaacugaacgggcuccucuggcagagcaguacaugcucuucagguccagggguccaguaucuuccuuuccugccugaagggaagauaacauguagccccuaaagcuaagcucacaguaacaugagccuaagaugugcucguguccagccaauucuguaagcaucugagugcagggaagagcucagacgcccauaugucaguaguguguacaggcuacucacuaaccaugcacuggugagucuccacgucccucucuggucuguggagagugaauccucuaucauuuccuccacccaacguucuuagcuauuuaaccaccacuccccucugaaaggcugcuuccuccuuuggccugauuuggucucucugaaggaagagcaucaguaaacugucuucuuuaauguacaggacaaaaggaacugccuggccaaagcccuugaugaggugaagacagccuuccccagagacauggagaacgacaaggccaugcugauaaugaccaugcuguuggccaaaaaaguggccagucacgcaccaucuuugcuccgugaugucuuccacacgacugucaacuuuauuaaccagaaccuauucuccuaugugaggaacuugguuagaaacguaagagccagcagugacaccagccccugccugcuugccuacccuauucuaaugcagcagagccucugcugaagccccucuggccugcucucccuuuugaccacccgcagacugagagaggcaaggcuguuucacaccacugaugggaaccgagcaagcuggggggacguggaguguuuaggaagaugacuaagggcucagcccccuaaguguguguggugugcacauggaagccagaggccauuauugggugccuuuuuaucucgcucuaccuaucuuugugagguaggguugguucuccgugaagucagaacuugccgguuaggcuaaacuagcaaacccugggcuuccacugccugccuucccuucccucacugggguaccaguuguuuaauguguauugaugcucuaccugaaugugugccuguggaccaugugugccugaugccuggauagccaggagggugcugcaucaucugggauugaguugcaagugguugugagcugccauaugggugccaggaaucugaacucgguucuucaggccucuguagcucuuacugagccaucugcacagccccagguauuaugaguaaucagaaagugacuacacuuauuugugugcgcauguugcugugggagcaugugugcugcagcauagucggucaggacgacucugaggucccagggauugcacucagcucaucaggcuuggcacuguaagccauggcccaugacuuagauucuuucgaagggcgcuucccgaggauggagagagaaacugauaggaguaauaaaugaguuaagugagaaucgcugucaagcucuccaguaagccugaggacgggcccauugcuaggguagcccugaguuucuauugcgcaugcucaggaagugguuacacggagcuaagcccaaggucagucuacugagacugcuggaaaaugaccacguguucuuagagucuugugcucugguuacacaaacccaagugggagcuggauggagauaccuaaccugcacuaggauuuuacaauguuugggauuuuagaaccugucagaaacauuauccgagauucuuuuggggggaggggguuuuuguuuauucugggugaaggcagaguccacauucccagauggcaauggaaugcaaggcaauccuccugccucagcaucugcaggcaugcacccccacaccuggguggguggagcagaggacaggucucugugugccaggcaggcacuguugacugagcagcagcccagugcuuguuuucuaacgcaccguauccuccaaugagacuuacucugcugccucuuucuuaggagauggacugaggagcccgcacaagcccgauggugacacugccuccagaggaaccgcgaccauggaaagaccuuggccugaagacaggucccagagaacagcugucucccuauuuccagguggugggaaccccaagcuggugauucacuggacaucucugcguucagcuugaguguaucugaagaguuuacgccggcuccugcauccacaccauguaccuuuguccuaucagcuguauggguucccacuugggaaugaaacuuaacagcaggcuguaaggcagaaaagcaucuuuguaaugccaagugacuguuccugagagccagcucugggcugucuucaccauguaggugggcuucugucuaaggagaacagcauuaggagaggugcaucggcccaugagcgugaaguccacccagccuaguggacacugaagugcucacaaggccuccaccugccuuuguaaaagccgaauggcugaucucaaaccaugggaagcccgaccgccccaccccuccucaccccagcguuuagcuguuucaggggucagcuauuaucucaagauuucuauccaaguggaaacaaacugaaucaugcacacgacuuaucuguguggugucaguuacacucaggcucuugcuacggaaugcaaagaacaacucacauaccagugucaaacagaaugcacagaagagaccuaaaacagcagcaggucacucgguucacaaaaggugacucccagucaagucugacacacugucuugguuguagagcacagcugccauccucuuucccuggguaacaucacagaagauuccauaucaaaagcaaauguucccuccgcuucuguauuucagagacaaggccucacuguauccucaagcguuguuacgucuugugcugaacuuugcuuaaagcugggaucgucagcacgagccgccacagccuacaaguauucuaguucugaacucaucccagccaugguggcugugauggcuuggguguaucauaccuguaaauuaguggauuuuucuuuaggaacaugaccuuugggugaguauaauugagaaauuauuuuaauucagaaaguacuuuucauuguguucuaaaaauaugugaauugucuuaagugguagaaauuuguuucuucaaaauaaaaggcucuucucuagauguuugggagagcuguaucuccaaaugaccuaguacaucagaaggucagaccaucccagcagaaacacacagcuguuugggucacaguucugagggcugucuuuauuccagcgacuucacuagcucugcugacuggggacugaggugugguuuuguaucccaggaccauguuuucaacacugaaaggcaaaccaagagugcaugcacuuuuagaauaugaaacgugaccugaaauaaucccccaaguaaauaguggacaaaaagaugagucaccaguuaucauaaaaucucguuuuauugucaccuccagggugcuuccccccaugauguugcuucuaaaugaaagcacaguuuguagacuugaauugucacuugccgauaaagaauagauugggcacaaaguagacaacaguaugggaaaggggccggaacaauuggaacaauucgcaguaauagagugagcagaucagacagcagcagucagcuguuggcgcacacugcaaaugaacgcugccuggguuaaaugcuuaugcuaguuuaguuuuuuuuuuuuuaagauaggaucucaaguguccagggcuagccuuuagcucugagccuaguauggccuugaacauugucuuccugccuucacccgaguacugggauuacagguacguauuccaugcccaggauggaacccaggauuucaugcaccccgggcagacauugauagcuacaucuaccugacucugcuauguuaaggauaaccauuccaguaccugggggacaagauaccagaaccacuaacaaacugaguuuaaucaaggaguuaggagaaagaggcacuuuuagucucaaggaagaaaaucauggguugucagagcaggggaaauauagguccaggagaaaaaggcuggccaacagauggcccauggauguaggaccacacagacuguuuuaggccucacuaagggagguguguagcucaccuuccugggggaaggcauccacaaaccugucaucucacaaugacaaaacguggcacuggcaagaaaacuccauggaucaaggugccuuccaucaagcauugggacccacauaucggaaguagagaacaaaucaacuucacaaguuguccucugacucccacaugcacacuguggcaugcagccacacacacauaaauaaaugaacagcuuuucguauca

SEQ ID NO: 3344 - RNA, 2775 nt, Mus musculus
auaguggccccuaacuucccugguccagaaugcaaagcagucugucagcccuagaggaccaugacaagauuaagacgccacuugugcagauucggagucccuuucugugggcaugguggccaaaggugacagauccuccuugcccccuggaguuacagaaaagccagcuuaaccgugagcacgcaugucaaugcgcacaucuuaagaacacauuacguggguuuccuuggugaccccgguaaccuccugcacaccuagaagcagcguuggcugcauauugagaacgucuguugcauggagguaggcaaaccuacccaaggccaccauaccaugucccaaugucaccuaccaccugcccucauuggccacugcugccugcagccugggccugcucuuguuccaugucugugcugggaaaaaaaggaaaaaaaaaaaggacuuaauucauuuguagacuuuguucccccuguuuccgcuucuccauucuuguggauuuuuuccuucuuuccuauuguuccuuucucacuuuuucuguuuuuguccucugcuuguuuuuauuucaccuucccugucccucuccaccuccaaauuccucuccuccucucccucuuccuuuuuuuuuuuuuuuuuuuuuuugguuuguuuguuuuucucuguuuccucuugcucuuccuuguuugguccuuuuugaaguugagcccaguggcgggacuccacggcguagaccucucuccuucugcccuugcuguguccaggaagguaacguaaccucgcccacucuuccccacugccuccgaggggccgcagccaccguaguccaacagggagccaaggcccagcaaacgucccuccucucucugacuccugcuagccccacgucagaaugucaugaguacguggcaguuucuuacaaggcacaguaucccuuugacugucuaagggaggaugggaacagacaaagagccuguggcuccaguguccgcaggcaguuccccugcgguccugucuaccguuggugcuuggggccuugggaccaguaagcuaaaggccagcauauggagggccaggaacaggggaggaagccccucuguggcaucaguuugucuuggcagagucaaggaauacuguccuuucaaagacuggucuacacagauggccccgaguucuguuguuuuuuuccuccgaccacuaaaaacccaaacuucucuaccuuaugucuugcugagugugucuuguuuuguuuuaaguuugucugaucuugaagucuguuguggugauaagauugucauugacaaggcaugugugggcaggggaagggaguguggccaugacuaaccccugcuaaccucuucucugcucuccauggcucucacaugugaccccccccaaucccuuauccccuugcucaucagccaugaccgagcuccaacauggcucaugagcggcaucccaaugucuccugguggaauuuggagucuuuacaugcugggagguggggaaggaggggaugacggacuuggugugcucguggcuugucacucuggacagcuugcaugccucagggcuucaucuccauggccacaggggcacacugugcagagacccuccagaagggaugcguggaacugggcuguagacugcuugaaagccaaagacccaagucuauuggugcggggaaggagagcuugggcccccccaagaccuguaggcaagcucgacaggccgagauggagguguccaucuuugagaguagagcucaaggccaaggggugcaugucugcuuggcacggggcugauacuaaccauugcuugugucaguucugucuccagaguguggucgcuggcuaaagacuuaguuaggccugacaugcaaccaacagacaguggaaaagcuucagccuuugccuagugugaaggaguuaggaagaugcgggcaagaguaaugaagagucugacaugggaacagcaccuccccgagaaucguccauauucucauguuagggcauuucucuggccuggaccauccagccauauaagcggaggggacuuggagaguucuagucucucaccgggaagcccucagacauccugagcucuguauaaaaucauuuaauccugggaugggaguguagcucagugguggggcauugccuggcacauacgaagcuccguguucuacccccagcacccagaaaaccacucagggaaguuugugucuacaugagagcaaagagccaccaauacagugugcuuccaaggcaagggcauugggcagcuuuguacaugacacgggacuuuguuacuuccuggguggguugaugccuuagacaguccuuccuccacgcuccugcugcuguuaagcucagggguguggccacuccugauggacacucagggugggucagaaguugauucaggacagcucgagucagcugcuggaacgagagcaggaacagcuaccguccucagcccugggguccgccggggagaaaucacagccaccucgauggccugugacuaccacacagggucugcuggaguguuugccaagcugccugcuaagaagagcuuucuuagggcaagggauguagcucagugguagagcacuugccugauaugcacgugucuagugagugcagaacagaucaaagaaauggcaucuaccagucagucuaagaagcgugggaaagcgucaggcacaggugcccaggcaaaagcacacuuaaaagcaggucacuucagagcaagcucuacgacugggcgugguggcacacu

SEQ ID NO: 3345 - RNA, 969 nt, Mus musculus
agguauaaccccugugaaagagucauucaccccccccccccaaaaggggcuucgacccacaggcugagaaucacuggucuaggaugaggccuaaggauggagacugacgaccaaggguacuucugagcuuuuccaauaaaaucccagaccguucagaucugagccugaggccacaaacuggacuccugacacugugguuacaggugaacuugcugacucaacaucuacgcuagacccaggcuuccaggaaacucaaggcauggaccuucuuuucuauagacagugccucaaagacugggccucuguagugcaugacgcugaagcacuuugaguuugucaucuuggaagacaagaacgcccuaucugcuucugcccuggccucuucaccuuccgugcugugaggcccucuggggguacagggugaugcuaucccauuuccacuugcgcaucauggugucccacggucagcacauaccugggcucggugcagccgcuucaguuccuccugcuuagccugucuccgagccgccuucugcacacgccucgucagcuuggcacucagcuccuccucuguguagguucugggcuagagagggugagagagcaccugagcccaccgcacgcagguggaagcugguuuagguggugaguuggcauggucucagggaaucacugccugguagccagcugggcaugguaggugaggcugggccacagacuucaccauaauugucccugcugaagucuuaaauaccacaggguacagcugugucacacagaccccaaugugaggcauuuuaccucuguggcagcaauaagaggcuuaauggaggcugcauguugggagaugaaaccacagacaugcagaaacuccuucggcauugagaccaucguggccauauacgcauuccugugauuuucuuaaggugcuguggugauuguaaaaaaauacaacucaguaacacguuu

SEQ ID NO: 3346 - RNA, 5493 nt, Mus musculus
ugcagauuagcaaucacuguuuauuuuuuuaaaaagaucuaaagaagcguggagggaauugaaugacaguugaugacaugagggaauugaaugacaguugaugacaugugugcucauaagaagcaccacagaggucacagugcauugaguuuacugagugaggcuguguuggaagggacagccagcccuuaagucuccaugacaucaugacccugggagguaauggucuucucugaacuguaauuuaauugcugggcuuccaaagugaggguaacccuauaauuagaguguuauucugaagacagaaaugagcuaaugcaggucgagaaugcagcaguguuuggcacggaagugcuccguaagugguagcugaugaacacauucaugcgcuuggccauaacugguauuuucagguacuucaauuggacccucgucgaucuuugugauagcuucugcuuuauggaggaaacaaaacagagacggccucugaggucacgcuugucacgcuuuaccccucuccugguauugugucauaguuuccagguugggucaucagcuucagaggagcaggguccuggacuugcauggucaugcgucguggggagaagugcauucuggguaguagugaaugcagucugucugcugggugaagauuagggagagcugaggugugacugagagagaacaucccuagcuugccaagcucucccaucuccccucgguguguuggcagguccuucccucuccucccucccucuuccccccccucccacuccuccccucucuccccucugagaacuggcacacaaguggugcuguuguucucaggugguggacaccagaacaaaacugaccaaaucaucuaagagugaugccgucccagaggcgaguggaggaggaugggcuagaacugccuuccaguagaucacuccagagggcuguggcucagagaaccaggacuggagaguugaugucuccuaggugcgcacugaugauuuccgagcaacaggcugugaguggcagaaguccugguguccguguugaugaacucacaccugcguugcauggugcuugaagagaagaaaucguugcagcauucauguccuuugccaggguuaaaaaaaauugcacauuauuugcaugggauccaucuccuaugcugugucuaaaccuuguuaggucauguuaaagucuucggauucucuucagggggucgaggugccuguacauccagguuuuaggcaggucagucugucaccgccagcaugaacagaccuacuguagucuacuguggugauucuguaacagcugcacgugcgucguacugagagcuuuagcacaaggagcacagcaggguaggagucuagagcagcuggucucaaccuuccugacgcugcgaccuucaaugcaguuuucucaugugguggugacccucaccauaaaauuaugucauugcuacuucacaacuauaguuuugcuaccauuaugaguugucacguaaauaucggauaugcaggauaccugauaugugaccccugugaaaggguaguuugaucucugaaggggucacaacccacaggucgagaaccccuggucuagagcaaggcaacaccaaguguccucccuccucagacaaccaugcccauagaaaguggcaccacugucacguggcuggaauuacagccaucugggcuggugagucacugcugucuuggugggcagaaccucaccuucgaaaugcaagguguagugucaaucaacaugggcagugaugggggcaggccagacuccaagcuuugaaccuugauggacagacagcaggcaucacccgcacuguuucucguccacacccaccuugcccuugucaugagacauuaaaguauuucuucccucugcuuugggucuggcuucuccaccuguacucugaagugugaggcauagggaggccuugcugaggcuccugcagccccaccuucccgcucagggucaggauccugcuggugagcagugggcuggaaagcagagggaggagccuucccuggggaagaaggcaggaaagaccagaggcuaaaaauaggcaguugugagaaccugggagugcucccugaggccagccgcgcaccucccacgauggcugggcucugugcacaggguguuuagagguccuugucaaacaaauaucauugacacccuaaaugucagcuuuuacugugcaccccauauaugauagucugcugaccguccgauguguguuacccagucaucuagggaugcagguguguguuccaucccugugcaugugcccacaugugcucacacgugcauguaaugggugugucugcauguguguggcgcucggaggccuugccaaguucuccauuuaucuacuuaacagugcuucacagcaagccucuuugggucaaaucaaagcaucucccaggacuggguuugggccagugaaugggcagccugggucaugggcugcacagggggccucgugcugcggaacacaggauggaaggcaugcuguguuagcuguucucgaaaggucuugaccuccagcugccucauuuuuccacuuuuccuccaagaaguagggcuguuuucccacuaagguaaaauccgaucucccuuaccugaccacgcaagcaagucaguaggcuugcccugguuaaaguggcaaaaguucccucugugccuucugggcaucuagaggguucucuaaggagaauccauuacagcucuugcuggcaacuauuucacacucuauguuguguggaguguccccacaacaauaggucuccagaugaugcugagucccgucuccuguccuaacuucucuuccaugucugcuuuugugucccucuaugagucugucugucguucccacaagcugggaaaggucugcucuucugcagacugccccuggcuaggcucugguccucccugucuugacuucugauuagccaacccccacggugagcaauagugccugggcuugggugacucauuccauuccuguugucucggcccgcucacuaaauauagccuccccuuucucccaucccuucaucuucccaucucugggcagaaaaguuacccagcuuguggucuucgauguggugggcuaggcaggcagcacccugggugagguggggggcuucugcuugcugccaccaggcugguguggaggacaccucaguucucaggacccuguuuggaguagugggucuguguuaccagggcaaccagaucucaggguacagcuccucgcagugccaguccuuugugagaccguuguuuuauuugggaggaucugggggucaguaagaaucgauggucuaauguggguucuucauuauccuuuuagggaaacuggucacacagccccaggggguuaaggagcagagagcucaccagcagguguugguccugucugucaacgaaggagccccaccccagccagccagagucacagugaacuucagcuugggcuuagagccugaggugucccuuuuuuuucaguuucaugugccuggguacauggggcaaagugaacucaggccuuuauuaugguuuucaggcaggacgggucugccguagucuugccacaucacugguccagucgagcuuggggaaggaacuuccccugcagggaccaccuugagaaaugguagcccacagagcuaggagugggaaagggaaccaggucuuuguuuuugggagcuguggagaauaauaguccauagcaguuggccccugaagugugucaccuaccucugucuagccuagacuauauuuguugucauugucauugucuuuuuuuuuuuuuuuuuaagagacagggucuuaauuacacagcccuggcuggccuggaucuugcuaugcaauccaggccucaaauucugagaccugcccuuuucugcuucccaaaagcugggguuaaaggcgugcaccacacccagcuacacugguguugucuuaguuuugcuccuacucccuaauuuuaucuuugucuguuuauuugcuuguauuaaguuagucuggcuucggcuggcagggaaugcauuguuuaguccaaggugaccucagaccugggauuccccugccucagcacccuaaauacugggacuacaggcguagaccaccacacucagcuagccucgcugugucauaaagaaagaguuacaccguguaugauggagauauuuuaccugauuauuauauauuuaaucuauguaucaguugcauagagaagguuguaggagcacagagguggacuguguugucuaugacacaagcaaugauauccguguauccauguaguuguguugagaucucuguucuuguccggcccucgcccaucucccgucacuauggggugcuguguaaaaaaaaaacggcccuuaucaugcucaacugcaccuuccguuaaaaaugcaguugcccagggccgagggugcaaaccuugccuaacuuccaugcuucuugggguugguuccacagcacuguaaaaaacuguaacuaaaaaccuagacaaaacccaagucaaaggaaaguauuuauccuguagguuugcgugucugguggccagcgugggcccaugucuuggagcuuguucccuucagccuggucgcuguuucacauucaggaguccggcugcguggcugcguggcugcauggcugcauggcugcauggcugcagagagugcuuugcagagcagagggugggucgcucugugcccucugccuccaguuuuauuguuagggcuucuuguaauaauauggcuuguggauacacacacacacacacacauacacacacacacacacacacacacacacacaccccuccuuucugauucuaaccuuggccauauagcuucauucauaagauugcuaauauuggcuggaggaaaguacaucgccaaggcccaggaaccuccagcccugaugccccagcagaaaccggaucuguggauuguccacauucucuucuugucugcccugcucucucugacgcuuggaaccccuggaaacacaccugcacacacaagcuuuccuggaacgcuggcuccuugccuggcaaggagagcugggaaagaugucaccggccgccucuuggaacaaaggcuuccacugucagcuggagcgggggaggggacagguacgcuccccgguggucugggacacacagccagccggagcauuuuagauuucacauuuuucuuuuuccuuagcaagcucuucccuggugcuucucggcuugcuucuacaguuucacacagaaacggggagaagaaaguacccaccucauaccugcgcugcccguugccguuugcagagccuuguucacagacaaaaccugcuccaccuugacuguggugauuggugguugaugaugucauggcguaacacucugucugugagaaggccccagaagaggcagcagagcuccugcuccuuuguucccuucaauggacgccucagcug

SEQ ID NO: 3347 - RNA, 3051 nt, Mus musculus
ugguugguucggguuuuuuuuuuucaagacaagguuucucugugugucccugguugucccaaaacucacucuguagaccaggcuggccucgaacucagaacuccaccucacaccacugcgacuucugaccgugguaucucacaacagaggaaacaaagcccagguggaaaagaaacaacccucugcaguguaaaaggcuuuaagacucaugccuguucugaaaagaugugcgcauccaaaggaucgcgacgcuggcacccacagcccacagcaggccaagugcaggcuuccuuguagagcgauggaccacgcauacuuucagaaccacgacuaaaaaccugaccaggacauuccuucucccagagcccgcuucucacucaugaaaaaagaaagauuggggggcagagcacgaccuuccaauucuacuucuuaagaaugucagcuuauucaaaacccagugauugccuaucauggauaaauagucggucucgucccuggagucacuggagcugauaagaagaaaggagcuauucuacucgggaagaaaggucagcaccgcauacaggugucaucuucacauacauuuuaaauauuuccuaccagaauaagaaccuaacaucaaauuucucucuguguccagacugagugcccaggacugcugagcaggcucaggaaguaaacgagcuugccacacaugccugauggccuaagauagauucauagaacccaugauggaaaacucugggaaguuguucuaugacaucuacacacacacaagcacucacacacgcacacacauaccauauauacacauacacacacacacacaccauacauacagacacacaccauacauacacacacauauguauguacacacacauacacacagggguagauauaaauuuauuuuauauuuaucugauuggguuuggaggggguagcccugcauguguguuugugugccacauaugugccugguaccugcugaggucaaaagagggugucagauccccugggacuagaguucacagauggucaugagccaccaugugggugccaggauugaaaccugaauccucugcaaaaucaacaagugcucuuaacuagugagccaacucucuagccccuuaaauaauauuuucaauaaagacauguugugcccuaggaaauauaucugcagccuuaaggcauucucuuaaggaaauuaaacucugaaaauagcauaguaacguaauaacaacacuaacuguuguaauuaaaaauuaauuuuuucaugacucuagucugugggaggaaagaaaaccuauaaaauuuuacaguuugucuauuccauugugauaaauuuaguuucuaaguuuaaucuguuaucugacauuaguauuauauugaauaugguuuaaacauucagaaccuagcucauaagagaauuuauguaggucacauuacugucacgcuagcuccuagcaauucugagacaaccuucagcucuuucaucaagaggcuaaccugggcuacauagugagacccugucucauaaaaggcagaaggggguggauggaaagaaugaagcucaguaagcaggguuugccuaguaauuuccccuuuggacucggccuaguuuuagaagccaauucucaaaacagucacaagcaaucgauucucuuuuucucugugucgagcuuccuuuccucuuguccuuucuuccuggagaacugacaauugcucagacagcuugaggaugugaggguccaaggccgaacccacuucugcccucgccuaagcuugccaucuuccuaccaggaaauuaagaagcuguccaugcuacacgucaccuugacagauggucugugacuaagggaucgcacucuaucucucaccauagaaaggucuauuaaucuacccucauacuccuguccaagcccagcccuuccugaccacagcuuuguuuauuuaaugaucagaucagcagcaaacacugacaucagaacaaagggauauaguugaggguagagccugugcucagagcucagcuuauaugcggcccugggcucaauuuauacacgcgcgcgugcacacucacaccuauacacacagucacacacacacagaucaaaggcuaaccaguggcuuaguaauguaagucuuagccuuuguaauggguuaaagccaucacuagagucaaugugcaggaacuaccaacauccagucucucugcuuuacuaugagacuuggaaaagcucaccauuuccucccaucuacuuccucaaacguucccucccuaaaaccuguucuacucauucuugcuuauugaggauauuuaaauaaggaacuacugaguuuuucuaaauaaaccaauaacaagccuuuacacaggucauaguaggauuacagagagucugugaugguugugcauuuugggggaguaggugguaagcgggagagaggaggguuagaaacaauagagucugaaaauauccaugcccauugggcggagugguaccuaccugugaccccacuacuugggaggcugaaaaagaaggauuuuuuuuuuuuuaaguuauagucuugaauuugcuauguagcccaaguugucuucaaacucagagaucggccugccucuaccucccacguacugggaguaugagccuccccccugguuuugaagcggaaggauguuggacuggaggccaaccugcacugcauaguaagaccccgucucaaaaacaggggaggggauguaacuugguuugucuaaugaauuccccuuucuggauugccucauauagcacaaaaugaauaugaauuaucaaugaucacauauauuacguauuugucucgguuagggugacuauugcugugaugaaacaccaugaccaaaacaaccuggggagaaaaggguuuguuuggcuuacauuuccuuaucacuguucaacguuaagaaaaucagaacagaacucacaugaggcaggaaccuggagcaggagcugaugcagaggcuguggaggagugcuguuuacuggcuugcuccacauggcuuucucagucugc

SEQ ID NO: 3348 - RNA, 15173 nt, Mus musculus
uagcgaaggaaggaucacauuucucaggacaaaggcauuucacuaaugguuuagcuuccucaucuuuuccaccccaaagcuggcgacccagugcguucucucuggaagauggcagucucugggcgcgagagguuccccgaagcuucacagacccaagagcccaggacuacaacucccagaauccuucgcuccagcgugcgcgugcgucguaguggcuaagagggguggagaggagguguccaccgucguggguuccccgugcaggucuucuguugucgcgcucucuacucugggaguuucggugcuuuuagcaccgguccagggacaggaggaacuagugcugggccuucggcagcacuagucuugaacagacagucuugaacaggccagugccccaaggguuaggcugucagugagcgcaggcugugcccggguccagcuccuuccugguccuuccuuaggaacagaccuggagaggcgcggaggggaagagugcgaggcuugcgggacaucuaccaggcccaguccgaauuuccaggaagcucccgagaagcuguccuccugacgugugaggagaccuggucgaacccaggcuggcuaugaagagcgacgccucgacgucugcagccccuuugaaagggcucgugggcccucugcggagcagcgagcccgcgcucgcccuccccgcugugucccccgcggugcaccugcuggaagaggcguccgaccuguugguggugcaccuggacuuccaugccgcacuagagacuugcgaacgagccuggcagagccuggcggaggagcccgugaguggcacguacgugcugagcuauguuccguucuggauccuuuuggggaggaacucgggucucugaauaucuggcauugugagacugcgccaaccacacaccuugcuuucccuaagggauccucuuugagagaggcugguugcucauccugcacccgugagacuguacaaugaagucaaaucaugcaacaauuuggagggacgccacagucaauucuuggcucaccuuuucagugcaggacaggguagaugucuuuuaaguguucagucgugaggagguucaguaagcagguagcagccuucuuugggaacacaccuccuauuuaaccuagccuuggcagguuauagaaaaugggggguagagcggggugucaaggcaagaagcacacuguucugguccuguugcaggacugagugaauuaucuuuagauugcucugucuaaugcauuggccuccucugacagcuggagggcaccauuucucuguggaguaaaccuuccuaagagcugugugaggccacgcuaauggcgggaguagucagaauaguuaacugaagaaaagcaaacacuagagagacuugacugugguuuuagagggaugaagguugcacacccgaauguugagggcuuugcuuaugcccauuggauguaauuuuauaggguuuuguuuuucgucuucauauugagacaggguuucucuguguagcucugaccugcaacucacuguguagaccugccuggacucgaacccagagauccaccugccugugccucucaaaugcugggauuagaggcaugugccaccacugcccggcuggacauagacaauucuaaaagaccaguuaagcuccuauaggagcacccagccagaagccucaccccaugcccuuuucacagucagcacacacuuaacucccacucuccgccagugagcacgugcauguucacggugugcuguucccacaagguuaccuuucuguuuguucaguucucauuccacuuggcugcagagaugugcguugggccauagcucgugugccucuaagagguuuccagaacuuaacuccaggguggaagggcagcccaagagaccaguggugaggccugggccaauaaauaacagaaaagguaaaggugagcagccucugggucggacgcuggcuuccugucccagcguggaagacggaguggagagaggggaaacagccugaaccugacuuguguuuucucuugucagcauuguggaggugaaaugcucccugugugugguggggauccaggcucuggcagaaauggaucgauggagagaagcccuguccuggguccuccgguacuaccagguuccugaaaagcugccucccaaaguccuggagcugugguagguccuugugcuagaaccaggucagggucaaaucauggguccuccugagucagggucuccugacuccuuuguccucauucccagucaguucccuucgaauucgggucucacuguguucagaccucacacaauggcaguuaaggaugagaggcgggcauuugggaguaggauggaagaagagagagcacacccagauaguagugaaacaggcugacaggaggacagagccaauugcgcuuccugaugccuccuggggaucucuaauucuuagaauaaauucagguguauguggguauguguauaagugguauguguauggugugugugcaugugggugcacaugcauguguggguggagaucagagaaggguacuuggaggccucuaucacucucugcuuuauuccuuugacacagggccucucccugaaccucacauuuuuucuuagcuaggcugauagccagcaaacgccaguugauucuccuggcucuuccuccucaaugcugggauuacaggcguggguggggccacauccagcuugucacguggcugccaggguugcaacucugggccucaggcuuggacagcaaauauuuuccauuuugucuuauucugcguaaggguguuuugccugaguguuugucuguacugcaugcauuguaugucuacacuacaugugugccuggugcccacagacgccagaagacggcauuggauucccuggaccuacgguuacagucaguugugagccuccauguaggugcugagaaucaaaccuggguugcucaggaggaacacccagugcucuuaacuucugagcaucuuuccagcccucagucucucauucuuaaaaaaaguuacuauuauuuuuaaaaguuauuugugugugcacaugaaugcuggugcccucggaauccagaagauggucucagauaucccagagccugaggaaaaccugaggugguuuugagcugcccaggaucguugcugugaauaaaacucuagggcucugcaagagcagugcucacucuuaaucacugccuacuaccccuagccucuaauauuauuauuaauauuuuaaagauuauuauuuauuuuauguauguaaguguacugucacugucuucagacacaccacaagagagcaucagaucccauuacagauggucgugagccaccguguguuugcugcugggaauugaacuuuuggaagagcagucagugcucuuaaccgcugagccaucucuccagccccuggucucuaauucuuaacaguguccaugcuccacagggacaggcuggaggaccugggaggguaggauuauagacauuuguaguuuugaagauaaaccccuauagagcacugacucuucuuuugggggggacuguguuguuuggggacacagcauccuuuuauacagcaaaaugaaagagcccggagcugugcuggauguggccagugccuggcuccaagauccagauaaccagggccuuccugauuauggaucgcuggccagacuccacguguuccggcugcugcuacccucgggucgcuugucagaggccgaggaacuggcagugcgcucugcggccuucagcgaggagcagcggguagaagcgcuccaggccauccacuuagcacggcagcagcacacgcaagagcacacgcaggagcacucggacucccaggagccccagaagcugaggcaggaagguaggacaucagggcuuuguggccucugcaaagcagucucguggcauccccucgacacugcugaguuucuuaagcugagaaacuuaagacuaaacuguguuguaugcaaaccaagccagacucugaaguuggagcgcaaggagagagucucacaugggggaggugguguggggucuccugacccugacuugucucuugaaaagagaccccuuugggucugaucaggcugggauccucucacuagauuuuuuuccuuccggcucgcugguauggagcugucacuccucccucaaacacuggccccaauccacacgcagccaacucuguaacucacaaaguaaaaauggccuccuucuucagcugugggucguugugcccagccuccuaucugccuucacugaacuagagcuuuugaguauuuuguuuucucagcugaggucugccucguucuuuagcacacaguugugcuacucgcuggcucccgguagcaucccuacagggccguggagcggacuugggagugggguuguccuguugcaggaacuuuaaaggcccuuggcccagaccauccucccugcucaggcccuucagacccucucaccucagucugugugugaagacuuccagggcuagaaaaucaccucucuccugaagcagggccuucugguuuuuacaucaagauauaauuuauuuaaauuaugucuuugaaaguuagcauauagugugugugugugaguaaacuugauuauaucaaaaaagguugcaucccuuuauuuugugguggaauaaguaaauuaaacaaaaauuuagauauagcaaauuaugguugcaaauuaaaaagacaaaaccaaaacccagaaguuaaucagguugaaaggcuguacaguucagugaacuucuaugcaguuagaguauccauuuggaaaagaagccccggguucacacugggguuauacuguuauacuaaauacauuuuugugugcuuaucugccaccagaaacaaaguaaccauuucagagcagaacuagagaccaguuagcuguauccccuauuucagcacuuucugucuuuggacaacuuagggaucauuaagccuucuucuuuuuaaaauuuacagagaaaccuauuauuuuaauuggaaacuaucaucauguucuuuaagggcuguucaauguggaccugcugggaucgauccacuugguugcagguugugcuuucagggguugcccagccccaccaccauugucuuaguugcugugacaaaacaccaugacuaaagcgacuugaggaggaaaagguuuauuucauccuacauucuacagcacaguccaucacuaaaggaagucagggcaggagcugaugcagaggccauggaggggugcuugcuccaccggacuugcucagacaucuuucuuauacaacucaggaccaccaaccagcacagggauggugccgcccccuugugggauagccucauccacgucaauaauuaaucaagaaaaugucccaaaggcuuacccacaggcaaucugguggggcauuuucucaggagagguucucuguccccagaugauuccagacaugagaaugagcacaaccauaacccgugugacaaggccaggaugucucucaggacgggcgucucauucaggaucccagucuggagcgcucucucucucucucucucucucuuucucucucucucacuuucucucucucuuucucuuucucucucuuucucuuucucucucuuucucucucucucuuucucucucucucucuuucuuucucucucucucuuucucucucuuucucuuucucucucucucgcuuucucucucucucucucucucuuucucuuucucucucuuucucucucucucuuucucucucucucuuucucucucucucuuucucucucuuucucuuucucucucucucgcucucaagacaguuuuauuucuuuaauguaugugaguacacuguugcugucuucagccacaccagaagagggcaucagaucccauuacagaugcuugugagccaccaugugguugcugggauuugaacucaggaccucuggaagaguagucagugcucuuaaccgcugagccaucuuuccagccugaguucucuaccgcuuauauuaaaggcccuccauuucuucguguuaaugugucacaauuauuuuacacaagucaguccguaauacgaagaaugcguacacagaugcguaaaucuucuguccacugacugcaucuucauacagccuguccuuaaacaucuuggguagcuguggaccuaccagaucacauagauccacacagcucagggggagaaugcuugccaagcaucuacaaggccgugggacccauccucagcacuacagaagccaaaucaaacaaaccuuucaguauuuccuuuugaacuacuuagugaacugugcaaggaaaccauucucacucgguuuggauggacucuccagaucugauuugccugacucacccugccaugaugcucugucccccggccagguucguucucccagaaguugcugucgcugcugaugcugcuucgccggcucuggggcuccguggugagccaccuccucucgcagcccuucagaaagggccuccuggcugccuugauccucugccucuugauucuacgguuugacccaggugagugaagggcuguggcagcagggucccugggagcaggugcggccugggagggagccaccuccugugacauugagccuccuccacaaagaacaagagucugccuccccuggagcagggaccaggccuagaaccuagagagcaguuggagaacauuuccuugccgcccugcaugcugauggauucacccaggcacuguuccgucuaggggcgaccucuagucagaauguaacauuaagaagcuuccuucucccuguuccuccuccuccucccuccccaccguuuucucuugaagaaguuaucugugaguaagggagauugucccacaaggaaccaucacagaaccucacuggacaggccuuagccugcucucccgagugcuucuccuguccucaauucccugggcucccucuagcccaagcuacacagccacagagccugccuccucucucaugaggggcuucuggcugcccgugcacucagauuuccacaggugagccccggcuuguguccaccgaaggccaugucacgaagagcaguauuggagaggcucuggcuuuugaucagcuauuguaaaauaggcaugggagccaggcgugguggcgcacgccuuuaaucccagcacuugggaggcagaggcagguggauuucugaguucgaggccagccuggucuacagagugaguuccaggacagccagggcuacacagagaaacccugucucaaaacaaaacacaacacaacaaaacaaaacaaaacaaaacaaaacaaaacaaaacgggagcuuccuggagguaacaccuagaacaguguguguugauccaagcgucuucuggcuagcgugacccugaaauuguaaauggaagucugaugcauuuuagaagauguggggaaaauuuuugaaacagcuaaaugauauucugguuuauagaauuuucccugaaaauugagccuuugugugauuaaucucuucugccucacugugagguggaggugagacuugggggaaaaacaccuguguaguggucacucugauucggagacacugggccaccguuaggugacugccauucgagaaacauccuuucccacuuuagaaaaaaaaaaagucuugcugcauagcguggaguuucugccucccagaugccgggcuccccagugcaucaccaagcccggcuucugcuuuacccucugggggugguuaacuacuuuucucaagaauuuagauguaggacaggauuaugcaacuuucaaaaccaaggagaaaugagaaaccuuucauuuucuuucaccguugguugagaaaucuaauuaccagagcaacuagaccagagccucacaguuugccugguucuaaagcugccaccuuuaacuuuagguaccuguuucccucacuuccccucgccuuuguuggacccugagcaggaauguccccucuggacagcucuguugguuauacaggaaagccaccagcagcuuccagugacagagcagaaaugacgggugggcagacacacccaagugggaagcuggcaaagggaagugauuuccuggcugucccagacucucugcuuugcauacuugauaagacuuccccuuaacccgggucuccuaaacaguggcgaagaaagccauucaaacuuggguguguacugagcagcucagagcuuccucaccugggugcagggaacuugggagaaggaggucaguuacuuuaaagaaaaauaacagguguggagggcuggggugagaguuagguagcauauggcauacguccacguaugaaggacuggguuuccuccccagccuuagaggaauaagcaccuuucuuucuucccccugcucccacguguaugugagugugugagugugugcaagagugcaccagcaagugcagauguucacaugcuugcaugcuagagguugauguuggcuacuccagaugaugaugaugacaaugauggcaaugaucaugacagccaccagggauuaagacgagggccucauacuggcaagcgcuuuacccacugagccaucuccuuggcccuaaaugcugcuucccuccauuuagaggggcaggucugugugugucccauggccuugcccaggcuggccucaaccucgagucccagcuggggcuccugucccagcuuucuaaggugcugggguauuuuuucuguuuaagaaagaaauaugcauuccuuacuugagaggccagggcugagcucagacccacgcuugccugcuauggacuaaggccuggguucaguucccaagcaccaccuagaaccuggcgagguggcucacgccugaagucccagcauuaagagaagaaagcagaaggcucagcuuggcuauccuugccugggcuacaugagaccccgucucaagcaaaguaaaccaaccuccccaagucaaaccaacacaaagguagaaauauguauuuccuguauguuuguuuuuaaagucuauaauccagacaaggaaacgaaacaaaugguagaguuuucuuuauguucacuguaguuaauuugugguaaaacugucacagggcuccaaccugaaaagcaaagaaaggcgcaaguguagugaaaguuccagauggcucuccccgcggcagccgcugcugucagugguauuaguuauuucuuucgggaaguagaguugaggcuuacuagacuuuuuuuuuuuuagacuuaaaaaaauauguaugugugugcaccauaugcauuccugguuuucuuggaagccagaaguguuggauccccuggaacuugaguuacaaaugguugugagccuuuaguguggguugugagccuuuaguguggguugugagccuuuagugugggugcugggaacugaaccuaggucuuuguaagagcaccaagugcuuuuaacuacugagcuaucucuccagccccaauuacaaauuuuaauaaaggccuaagcauucgaguuaagaaagaggcauuuggaagaaagcaagacacaccugagacacacccaagacggaaacauaguggagacuucucagagucacccguggcuguguaacuaucagaaagauuaagauguaauaaaucagaacuuuuucucccuagaauauuuaaaguuacuguaauucaaguggagaaaaccucuuagagaaagagaaguuccuuguuguuggagaggcugugacuagcaggaggccuggauguguuuucuagcuaccauggaggggccgagggaagaacacucaugauggucucucccuucccuacagcagcuccuucuucgcugcccuuccucuaccagcugacccagcucuuccgccggauccagaaggccacacuuucucggcucuacccccucgcccuccgggacugagugguccuaccuggcugucucuaccucuuacacuccacaucuauagaagcggagaaguugagcccagugccuggguccaagauggcaccuugggaaugggcccauugguucuagaaggagugaccaaggcaggugagccauggauggcugacuuugaacccucccuuugguaucccacuguggcuggccucagagggaguuugggaacaguggugcccgaggcccagugcacagaacacaagucuggcugcccagaacacugcaacagcucaucaaaaaggaggguuaggagcagggaguggggcuugagacagucucauuucuugacaaaggcagagggugacuuuccagaucuggugcugagggaucugggauuuacagauuuaccucugaaaacugcucuacagcucagaauuugaauuugaguaagaccagaggucccucggucccccacuccccuccuccauacccuucccccacgccccucccacagaucaguucaccauccccucccauuggucuggcaguagggcaagaggcuuucugcuagaggccuuuugcuguucagaccggauauggcuucugacucacccagguggccaccuggagcaaagugagccugccugaccuuaucucuggggaaugugaucuuucuuggugccgcugagucuuagcucaguuuuccagcucgccaggggccaagcucugcccucugggacccagugucuucccaccacaccccaccccaccaccuuuugaucugucuagccaacugugucacaccacugucucuccuugauccuuucucuggguccuaguugugguccauuguuugaauaaugcccuagucucucugcucguguggugugaaaaguaggccaggcucagggcugacagcugaaaauggaacuggguaaucaggugagcugugagaaccgugggggcugggcagaggggcugggggguggggcaaagggacaaccccagggaggaggcacugcgugcgugcgcuucagccucagcauuucuguguaaaaaaauacaggcuccucuggugccgccaggaaggagguccucagccgcccacccacacuggaucccugacacgggauggcaagagugcagaggcuuugcuagucuuuuguuggcugauauuuaggaacugugagucaacagcuuuucucuagaagaggaaacgucacagaaacuuacuuagaauuccaucuaaacccugaagacuuggcaacuagguucaucauuuuuuuuuuuuuuuguaugccuuuuaaguagacccuagaucacacuggggagggaaaaggauucaggaaggguugaaaucccuugacagugauuccuucaguguugucgcccaacuuggcccagaacaccugggcuccagugcugagcuccgcccuccagcuucgagcgucugugacucacacaccuuaugacagugguuuugaagugaggaccuacccauucacugcccuagaagaaacuccuuaacggcuuucauggcccacaggauacaaauccagauucuuuuuaauagaaacuuaggccaguguucgcacgucuggcugacagcuccuuuacuguguugcccuguucgcugagcaggcuguacucuagcugccagguccuccucaggccucccugugauggcuuagcuguaucugcuggagggucuuggagcagcucugcucuagacccuuggcuuuccaggcucucaaggguuacccagcauucuuugcugcccagcccaucuccugccccuccuguagugggggccuggugguggguggugggacuguuugccucuuccagugccguaagcuccaugaggcugcagaguguuugagucgggcuggcauuccugugugggugacuguuggccaggguucugcuuucucaucuguaagucgguucucuucucacagggccucuucuacgaguaaugggcacuuaggacucuuggcacuuuugacagccacuaggaagaguucucgugagcagugguauucccaggcucagcugagcauggguggguccucagggcugaguggacugguggaagagggcaugcgcuucuggugcugugaaacccugaacagaucggcuugucuuucugcucucuccugaugcuccucacaguuguucugcugguggcccauggggcucuguuuauuuuuaccugacugcugcagggcugucuguaccuuaaccaccugccuauccagccaggaacucgaaucccaaacuguugcuguuacuuuguccuuuccaaggauguaggcugguccucggcucugggcuuaaagaggucagagugaagggagggccuucuugguggguccagcacagcagccaucagccaaagguagcuuuugagcauuugaauugugugcggcucauccacguggacacaugcuguaauuguuaaacaugcacacuggauuucaaagaccaaguacuaaaaaauaaaauaaaagaauggaaacacaaagauuuuuauauugacuguauguugaaauaauauuuuagauauauuggguuaaauaaaaucaauuaaaauaauuucaucuguuucuacuuucuguagugaggcuucuagaauguuuaaaauguccuaugcugcuugcauuuagauagugccauucaagacaccacacacacuggcuagucucagagcggggaucaguguccacgaagagcagugcaugcugggacugggagaugcuaggucuagagagucucaguugcagaugguaucuugcagccaccuuuuuuaguuaacgaaacugagacucagaaaggugaaaccauuuguccuaagucacagccugaauaagacccaggccuccugauccucuaguuuucuguccccccacuccuaaucuucucugucauucucuauauggaguucauuguuaauaggaagauguaucagggaaaacugauagaauugaccagcccucaggugucugcagugugugauguggaacagacauucuaacuugaggaaugccgagcauagcuggagcagcugucccaugguuagacaggaggcugggcugguguggguggugggaucagguggaggcaggcaggcaucaggauagccagcaccugaaggagauguguaacauccccugcucuuugcacguauaugucugcacauauguauaugaagaccauuaguauacuagaguuuuacacauacaaaacaaugccuaagguguagaagggucaucaugggacacaaagccugucccuucugugccuucauuuccaugcuccacuuucugccccagggcaacugcugcaggguccucagauguauuaacccuuccuucaaguuuuccuuucucuuacacagugaaaguacacuguuuuacgcacccuugccucguuagaagaaacaauggaaaaccaaaaccaaaaccaacuucacugaucaaggugacuuugcccccugugcacacaggccgaccugccccauuuuuucauaguuguaugacaagaucacuuucuccuuuaaagacaaaaacaggcccuggggagauggcucagugguuaagaucaccuguuacauugcagagggcgucagugugcuuccggguaucuacaugcuggugcagccaucggcaucucuaguuccaggggaucugaccuccuugguuaucaggcacacagugguacaccuacauacaugcaggcaaaauacccacacacauaaaccucugaguuaagaaaacaaccaaccucggggcaggagagauggcucagcgguuaagagcacugacuguucuuccagaggaccugaguucaaaucccagcaaccacaugguggcuuacuaucaucugcaaggagaucugaugcccucuucuguugugucuaaggacagcuacaguguauuuacauauaauaaacaaacaaacaaacaaacaaaucuuuuaaaaaagcaagcaagccagcaagcaaagaaaacaaccaaccuacugaccaaccaacuuuugugaugguguccacaccaccacauggccuggauuggccaauggagcccuggaugaagugauaguucuguuucaggcuccugagugcuaccaccacuggucuccaaaauggucagagcucuuuacugucacaagcacagcguggcugcucuggccaccugguugcugcccagcagcaaugucugugugucuggguggagggcagggugauguauauucuggaccugcagauuuuuccuaaacccacaggcucccuugaaagcugccagaaaaaugacugaaagagaaaggucuaugggaacagugucuagggaauggucagcccgacuuuccacuguuuguaaaaagcugcagggucaguggacuucgaccucccagaguggugaguuuuccucugccuuaguuaggcaagcugcuuguuccuggcccugcucauuggaaguuaacagacaugcuuaaauguaggcaggcccccgugcuucucucccuccgugguuugcuccccuuccuugguacuuugaauuagaagguaaaagcaaugagcgugaugccucgagaagcuuagaaagcccugcccuggguuaaguagauccagauggugucagccucugcgccuuuugauaaaacacaagcuuggcucuuuuauggcgcuggggguaauuuagggcaucacaccugcuaagcauaaccccucucaucagcuaccauuuuccucgucucagagcauuguuucaaccuguccaccuaucugaagucuugcuuuucacaaccuaagugccucucguaccaaacugaaaacacacaauacaguaagguucugagagagagagagagagagagagagagagagagagagagagagagagagagagagagagagagagagagaaaagagaagauaccuaucauagugauuguucuauauuauuauuaaguaugugauuaauuucauacuguauccaacuuauaaacuuaacauuuuauuuaacuauuagguaugugaacaggcauggcacagcaucuguauggaggucagaggaagaaaaccugugagaguugggucuuuuccuucaccauguggguccugggagucagcucagaucuucaggcuuggauguaagcaccuuuaccaccuccugagccaucuugcuggcccccaauuuauuaucuuuaucacauauauguauauaauaaauauaauaagga

SEQ ID NO: 3349 - RNA, 2469 nt, Mus musculus
uuuaaacugagggaccugaaucgcaaugccuugaggacuugcaauucauuuuaguuugcugaacaggaaguucaauagauauuuuacacuuguaggugcauuuuaacuuuagagccaaccccaugauucaaauuacuagagaggcauaauucuuucuucuaacagaagauguauauucccaaucgaugacaaaaguuaacuuuuugccuuguaugccuuauucugcuuagaguagcacgaagggaauuucuagucuucaugugacugaguccuauuagucaugaaguccugacuuucuccccuccuaucagcugugcugcuccugcagagcaagaggacacaguuuuccagcucaccacuccucuccuugugacacacauuguuuuuuucuuccuagacacuaccuaguuauguggcaguuuggucauucuggucgucuaaacacuggacuucuucuucuucuuuuuuuuuugaaauaacaauauaagcugauaaggaagaagaaaaaccgagagauguggggagaguggggagaugaacacagaggggaugccccucuccucuauuuuaagcuugcucugagguccccuauggaaagaugaguuagacuguacuugcuuugcaggaaggcgccggccagcagaauccauauugcugagcuccaccuguugacauucuccccagggguauuuguccccaacuugacucaggucuacgaugccacuguggaugggaagagaggcuacaaaauacaugcaugguguggcaaacuaugucucuuucacauccguggccugcugcuuguuuagcagccgugugccuuacagucagcaguaucuggaaacacauuuuaaagcagugacucuaagaggcuggcaguuuaagcacagcccaggguauauguuaguuuugggcaauaccaugguuccuaguguccuacagaugccguccaguuuccucuaauucuugguuagcuuugcuuugggucuuuuguggggagauuucuagggcuugagccccacggggaagccucccuccccaucccccagugugcuagcagaucucccuccccaucccccagugugcuagcagaucucccuccccaucccccagugugcuagcagaucucccuccccaucccccagugugcuagcagaucucccuccccaucccccagugugcuagcagaucucccuccccaucccccagugugcuagcagaucucccuccccaucccccagugugcuagcagaucucccuccccaucccccagugugcuagcagaucucccuccccaucccccagugugcuagcagaucucccuccccaucccccagugugcuagcagaucucgggagguugacuugcuugcgugugacugugugaccuuugacuucuguggccgguauuucugcuuuuuuucuaagaacauuguuuacaagagaccgagccugacaagcaauaacaccauccccaaggaccucuguaauuuacugcucuggauucucccugugaccucucacgcagcccuucaccccggcagagagacuucccuaaaauuauugcaaaaaagaccaagaggggcaucagauaagcaucuagaaagccaugagcuuggugauaauaaugcaaguucuagaaacugaucugccucucacagggaagguauuuccugcucccugccccugagagaaacacacaagaagccccuuuucauggcacagcuucauuugcuaugucugccaacuugauaauuuccacuaucauuuccucuuucuccuagccuauccuuuauuucucuucagccuuuaguuucuaagcccucaugaugcucccgucucagauccauggcacugacaugacaggcucacaccgccauggcccuuccuuuucaccuuuauuccccucucccccugcccgagcauacaucccuuacaucugcccacccuuguucauucaccugcuucguccugcagcccccacuccaugcccaugcccuggucuugccaccauagcuucuuaccaacagauguccugacguugucuuuggcggacucgugugucauccuguggccugucuucuuucucuguuccccaggugggcaucaacuaccagccaccuacugucgugccaggaggggaccuggccaaaguccagcgagccgugugcaugcugagcaacaccacagcaaucgcagaggccugggcccgccuugaccauaaguuugaccucauguacgccaagcgggccuuuguacauugguauguuggagaggguauggaagaaggagaguuuucugaggccagggaggaccuggcugcucuggagaaggauuaugaagaaguggggacugauucguuugaagaagagaaugagggggaggaauuuuaaauauacacuugccccaugacuaugccucuuucuuuguguugguuccacucacagcaugcuggguuccuagugcugcg

SEQ ID NO: 3350 - RNA, 2469 nt, Mus musculus
cgcagcacuaggaacccagcaugcugugaguggaaccaacacaaagaaagaggcauagucauggggcaaguguauauuuaaaauuccucccccucauucucuucuucaaacgaaucaguccccacuucuucauaauccuucuccagagcagccagguccucccuggccucagaaaacucuccuucuuccauacccucuccaacauaccaauguacaaaggcccgcuuggcguacaugaggucaaacuuauggucaaggcgggcccaggccucugcgauugcugugguguugcucagcaugcacacggcucgcuggacuuuggccagguccccuccuggcacgacaguagguggcugguaguugaugcccaccuggggaacagagaaagaagacaggccacaggaugacacacgaguccgccaaagacaacgucaggacaucuguugguaagaagcuaugguggcaagaccagggcaugggcauggagugggggcugcaggacgaagcaggugaaugaacaagggugggcagauguaagggauguaugcucgggcagggggagaggggaauaaaggugaaaaggaagggccauggcggugugagccugucaugucagugccauggaucugagacgggagcaucaugagggcuuagaaacuaaaggcugaagagaaauaaaggauaggcuaggagaaagaggaaaugauaguggaaauuaucaaguuggcagacauagcaaaugaagcugugccaugaaaaggggcuucuuguguguuucucucaggggcagggagcaggaaauaccuucccugugagaggcagaucaguuucuagaacuugcauuauuaucaccaagcucauggcuuucuagaugcuuaucugaugccccucuuggucuuuuuugcaauaauuuuagggaagucucucugccggggugaagggcugcgugagaggucacagggagaauccagagcaguaaauuacagagguccuuggggaugguguuauugcuugucaggcucggucucuuguaaacaauguucuuagaaaaaaagcagaaauaccggccacagaagucaaaggucacacagucacacgcaagcaagucaaccucccgagaucugcuagcacacugggggauggggagggagaucugcuagcacacugggggauggggagggagaucugcuagcacacugggggauggggagggagaucugcuagcacacugggggauggggagggagaucugcuagcacacugggggauggggagggagaucugcuagcacacugggggauggggagggagaucugcuagcacacugggggauggggagggagaucugcuagcacacugggggauggggagggagaucugcuagcacacugggggauggggagggagaucugcuagcacacugggggauggggagggaggcuuccccguggggcucaagcccuagaaaucuccccacaaaagacccaaagcaaagcuaaccaagaauuagaggaaacuggacggcaucuguaggacacuaggaaccaugguauugcccaaaacuaacauauacccugggcugugcuuaaacugccagccucuuagagucacugcuuuaaaauguguuuccagauacugcugacuguaaggcacacggcugcuaaacaagcagcaggccacggaugugaaagagacauaguuugccacaccaugcauguauuuuguagccucucuucccauccacaguggcaucguagaccugagucaaguuggggacaaauaccccuggggagaaugucaacagguggagcucagcaauauggauucugcuggccggcgccuuccugcaaagcaaguacagucuaacucaucuuuccauaggggaccucagagcaagcuuaaaauagaggagaggggcauccccucuguguucaucuccccacucuccccacaucucucgguuuuucuucuuccuuaucagcuuauauuguuauuucaaaaaaaaaagaagaagaagaaguccaguguuuagacgaccagaaugaccaaacugccacauaacuagguagugucuaggaagaaaaaaacaaugugugucacaaggagaggaguggugagcuggaaaacuguguccucuugcucugcaggagcagcacagcugauaggaggggagaaagucaggacuucaugacuaauaggacucagucacaugaagacuagaaauucccuucgugcuacucuaagcagaauaaggcauacaaggcaaaaaguuaacuuuugucaucgauugggaauauacaucuucuguuagaagaaagaauuaugccucucuaguaauuugaaucaugggguuggcucuaaaguuaaaaugcaccuacaaguguaaaauaucuauugaacuuccuguucagcaaacuaaaaugaauugcaaguccucaaggcauugcgauucaggucccucaguuuaaa

SEQ ID NO: 3351 - RNA, 43867 nt, Mus musculus
uauaaauaaccaagaagcugcaagaacaaguagauggaugcaugaaucaaugaaauugccuccaggacaauuccagagacuagagaggggaguguugcacaaaagcauuuguugaguggauggcaaaggcagcugggaucuuuguuaggcacaguaaagugggguuucugauacugguuacuuuucaccuuaaacuggaaugaguguaugugaagguuaaggcccaugcggugauauccugggauuuagaaauucacuguuuaggguagacagcaagcccaggacccuccuaucuccuguucuccagcaccuggauuauagguaagcauuaggaaacuuacaaaacagucauuucuccuggcccugauacuucauuuucagucaaucuaauguauaacaauaccucuaaagucaauaccuacuuccuaguuugguucaaaauuccuuucauggaagggagcuaaacaugggcuuugcgugaaagacagacagaccuucuguggcucagaacuugcuggcacacuugaauuauucaaaccucuccaguacugcuuaagcugcagccugcuugccaacucuccagacaggagcccagagcaucaauaaguggcugugggggaggagaaggcgauuaucaacuuuauuguacaacggagaaaaagugagcaguaacaggaaagugcuuaauccuucugggaauuccggcuaacgggucaggaauuaaccuuggcaguaacuaggccaucaaugaccccuucagagaauguucaaaaaaccucagcuuuguucagagaacucguguggguggaacccgcuguuugcauaaagccuagcugcuccucagcacguucaggaccagaucucuggcggggagcagggugcaaggcagccaggucuccaguccucucugcagcauggggaagcgcuggcucccaagccuggcccugcugccgcugccgccaccgcugcugcugcugcuguugcugcugcugcccacaaaugccucagcaccacagaaaccgugaguccaccgaacgccagaaacuugaauuuaaggcuucuguuuacucguuucuuucuuacaaaaccgugaccuucuuucucaucuccuagguuccuuagagcgccgagauuuguacaaauccuccucacucauuauuccuccucaucucaguuuuaaucauuucucuuuagcucucuggauuucggaauauccaaacuccccggugacacacagaaccuuuguagguacucuugucuucaggaccuccuguggcucugcugagacuuugcccuugcuuuuuccuuuacauuccucagggcguuugauaaaacaaagauuuuuuucuuuucaaaaucucuaggaaugauuucaaagguugauguugaugcugaaaauguaaacgacuuuuguuacaggaaaaaacaaaacaaaacaaaacaaaacaaaacaaaaaaacccccaacaacaacaacaaccccaaaaccaaaaaaacuauugugcaaaucagcuagcgaugaaaucugugcuccaaagaaacgaaccaaggaauguagagagacagauagacagacagagcaggucauacaagaagauguacaagaaacagugacaaagacauaguuauugggaacuuuuucuuagggcuucuauuuacacauaagacaaauguuacuuguuuaauggggaauauccagcuaaaggugagagcaccacgguggaagaagagagcacacaauucucaauauaaauguaugaaucaugaauauauuuuuuaguaaguuauguacuaggacuucugaaaauaauccaaucauaagaaaacauuuaacacuuacaaauuuauggucacacauauaaaggaagaguuacuguuaaauuuauauacccacagguaauauuucauauuuauauuaauauuaacauauauauauaacacauauauguuaauaaaaaugauaguugaucaugagauauuuuuaagcauaaggaaaucauaguauaaacuucuggauaguaaguggcacagaaauuagaauuuuugagcauuacaaaaagaaccuacacauuuuauuuauuuauuuauuuauuuauuuauuuauuauuuuauugugguuguccauuuguuuugugguuguuuguuuugagacaggauuuauguuaauuaugucugacagcauccccgucucggccucccaagucaugagccacaucucucaauaucuauuguuaaguaggugauacuaccuauaauauuuaaaauucuauggacuagcuaaaauccaacguaagugaaauuaagccuuauuuuaggcuaucaagagaguuuacuguuuaaaauuguaauaaaaguagaaguuaacuugagaguacagaagaguuggguggcaucuaaagacauucuugagaguugcuguuugaaacuggaggguuggucuuuagucauacaugauugauaaauggucugcucuguuccugaguuuccagaggcuggauuacauugaaauggagcuuuucucuacauuugggaaggcaaacucauaugauagaaacauccagguuggguaacccacaaagacuuagucgucagcaaccgcaaccgagacucucaacuagugacucuuuuugugagguucagcuuucuuauuugucaaauagaaucacauucuugauguggaaguuuugcaagcuugcugaauacaugugcauguuuucuucccccacugcccccucaacaaagaugaucacugguagguggugugguaggggauucuuaguucauccucugccuucuccucccgaauaacuaaggaggaugaugguggcacugugauggcacauagagaugcucauagcaacaaccccuucccgcuccucuaacugccuuccuccuuccucagaaucuacauggugaugguucccucccugcuccacgcuggcaccccugagaagggcugccuccuguucaaccaccuaaacgagacaguaacagugaaaguauccauggagucuguccgugggaaccaaagccucuucacugaccuuguuguugacaaggacuuauuccacugugccuccuucaucgugagucaaggggucgggggugggaggggugucagugaagaauguaacaauggcaaccaagcacagggauuacggaucaacucaucuguuuccaaguacauauuauaagcauauugagaauaaauccaaugaccaaagaaaaauucuauuugucaaaacaacaacaacaaaaccagcacacaguagagaaagggagaaaugugacuuuuaacguuaaaauuccuuuuuaaaguucauagagaaaacuaguucaagguuaaccgugagucaccacuggugguaaacaggcauaccucaaagucuuuuaagaguaacaacuguagaaauugcccugagcgggaguccaaucuaucuuuagagcuggaugcaugggaauccuuguaaucuaguacuaccaaaaugcuuucuuuuuccauagcguuaagacccuguagcccugauaacacagugcccuguuaguguauaauuaccuggucaaauacaguguguaaacgagucaagacugcacuguguuuucuauauaaaucaagaugagauguuuagucacagcucuucuuauuaauguaucuuauacuugggucuuccaauuuguaaaauauaagaauccuugccaacuucccagaagagaaugaagggagcgaugaaaccaagaaaaagaaugagaucuccauagagaugcagaccagggagaggagaaagaggcugcagagacucuccggguuuucagacucucuucuguaauuuaggucccacagucuucauccaaugaggugauguuucucacuguccaaguaaaaggaccaacucaugaguucaggaggaggagcacggugcugaucaagacuaaagagagccuggucuuugcucagacugacaagcccaucuacaaaccaggacagauggguaugaugagauucacaaucaggagagcaucaaaaaggaaacuccucucucccugccugucucccacagccccugugaucuuuaauaguuuuuauugcccgccgauaggauuggucaagagcuagggcucaucaaaaauauuucuauuucagugagauuucguguugucucauuggacgaaaauuuccacccccuuaaugaauugguaaguguucuauuauuuacauaaaauuauuguuauuuguacaaacuagcuggaaccgguuuggauuguacaggaaggaggaguuggagagugaaggagugauuucucacuccucacacauugcaauagcccagggucuucacucaaaacauucucccaggucaaucgguagggaacacgaucugcugugaucuggcacucagcuguuuauccuacauuuaaacguacucuccgguuuccaacuaggaaaaauaagaaaauaaacagcggagaguggucugaggaucuaaguuuguuuuggcuuagagaugugaauguugcuaugaaagaaguuggggugcucaguuuauuccuuugugaggauucacaaaucuuccugccaccaugugggugacagaccaacucuccauucucagcaccacaucuccccaucuuacaaagacucuuuuaaccccaaaggcaagaggaaaaugcugugcccuuggcuucucugucucucacucacacaucaacucacacaaauucauguuagcuguuggcuuggaaaaauaccauuucuuacuacccaaauuguuacuacuugcccaacauguguaaacaagaccauggaaguaaacuugauguuucucucucucucucucucucucucucucucucucucucucucucucucucucucucucacacacacacacacacaccaaacccuauauaugaugccaaacauaucauauauagguauuuuuucuuuuuuuguccaccuuuuuagaaugaggacagacagacacauuguucuuuucuguacugcucuguucucagcaucuagaauggcacacaacauacagcuagauauguagucaauauuauauuuguaaauggauaaacuuuggcaguagagaugcuauucccauuccuucucacucuuagaagcauccaguaaugcauauaaacaagugaguucagggcuaguuacuugcagcuccguguguuuacuuuucagucugugaaguugcauagcaagaggaugugcuuggcugggaugccacaaguccuuggacaauauuagcaaacucuacuccuaacaauaguacacaauaaguaucuauuacccauggccuacuaaguucuuauuacuaccuauuaauugcuugaagugaguuaauuaaaacaaguuuuaaaaaauuuuauuuguagaauacauuuacacacacauauguauauauacauacacauauguauauauauauauacauauauauacacacauauguauauauauauacacacauauguauguauauguauauauauauaucgagagagagagagagagacagagagagacagagauacauauucuauauguguugaauuagcccauguaaacuagaauugagaauacuuucuuuucuuucagauuccucuacuguacauucaggugaguaacaccaauauucuacaguuagagaaaaagcaucuauuucagaggaaaccuucuuuguggacuacuuacaacaugccagaggagacuuuggggaaggggggagcucccagccuacccaggaauggauggcuggaacucaccugcccucugaacccuucucauuugcucucuuuauggguaacauggaaguuuccauagauuuuuuucauaaucucugauguucuuugcacuuuuaugaauauuauggcuauuuauuacaggauucaaaaaaaaaucgcauugcacaguggcagaauuuccgcuuagaggguggccucaaacagcuguccuucccccucuccucagagcccacucagggcuccuacaagguggugauacguacagaaucaggcaggaccgucgagcaccccuucucugugaaggaauuugguacggauugugugaacauuguuuuucauagcugagaccucuagagcucagagucagcacuuacuuagauucguucgguuuccuguggaugguuucaagcucagaguagaacuaauuacauaaaaguccaguggggcaugagugauuugugaauugauuucauauaguuagguuguuuguagcaaugcugaaugaccaaaauaaaauacuguuucauacuguuucaguagugagagugggaaggggaaagggaagaaaaaggaagugggguugggaaggagagagggggagggaaggggagagggggagggaaggggagagagagagagagagagagagagacucuuuaagguuauaaugaacugucauaguuccucaaucaaaauauuuacuugagaaugaagugaguguggauaaguugcagaguggaguuaccuuuacaaaauaucagaauaucauuagagagcuguugugaagaacuaggaaacacuaaagccuucagaucugaagagcagccacuaaccuccuuuacuguguguggcccacagugcuucccaaguuugaagucaaaguugcaguaccagagacaaucaccauccuggaggaagagaugaauguguccguguguggcaugugaguugacaagagcgaaagcaacucuuuggagcagauucaccguuugagauaguuugaaugauuucccaggagcaggggccacacggaaaauuuugaguguucccaacuauaggccauucuucuccuguuccuuuguuggguuuccuucuucuuuucauuuauauccuuaucaacauuucuauaacugucagugaaguggggaccauuuauagagaagcuaaguggcuuggauugacuuguaacaaguaagaaagcuacacauacaggcacaugcaugcacacguauauacaugugcacacacaugugugcauacacacauguauacacagagagacuugcacacaugcauacauguacacacaugcacaaauacacauguacauguacacacauucacacaaguguacugaaggaugcuggcuuucccuuagccauaagugauaguaauacucuaagaagggagguaaguaauacaugauaauagaggaauaucagucaguaacagccuugaccuugcagaccgaggguaaaaagagcagauuuggagucuaaauuaugcuuaugucaucggcagcugcaggccugucaccucccucucugcacaccauuuucaccgagagacugaagaugcucuuaggaucuuaggcucccauucuuagagaccuguaguggcaguaacaggacaggacccagaaagacuagugaugccugcacaucaugcaugugacacaccugcuaucagcugcucagagucauggccaccaaguccccugcaauggccaaucaguguccuugcaaacugauacagaagauacuucaaauagggaggaaagcaaaggcuguugaaaacaaaauggucacacauaacauuuaccccacaacacuguucucuucauaaaaaguuacaaacauauauauaaagauuucuacugaggaugccucaaguaauaguuugaauuuuuaaguaguuuugaaaacaucuguaguuucuauuguuucuuuucguguguauguugccauuacuuuucucuuaagagugugaaaucaugcauugucucucacguguggauacuaggucuuuucuuuucuuuucuuuucuuuucuuuucuuuucuuuccuuuccuuuccuuuccuuuccuuuccuuuccuuuccuuuccuuuccuuuccuuuccuuuccuuuccuuuccuuuccuucccuucccuucccuucccuucccuucccuucccuucccuucccuuuccuuuccuuuucuuuucuuuuuuuuuuaauuagguuuuuuccucauuuacauuuccaaaaguuccccauacccucccucccacuccccuacucacccacucccaccuuuuggcccugguguuccccuguagugaggcaugcucaugagugcauauuaagaggggggagagcaugcacauaugcugugaggcucaggucacaugagaaaggaaaggaaagagaacacgugugucaagaaaguggaagaggacuguaaggggaggugauacaggggagaaagggaacggugaggaguugggggggggggggagaauccaaagaugauguucuaaaauuugaugacacugaaugugugucauaauuuaaaauuuuuaaauaaaaaauuauauaaccuuuguuacaaaaacaccauuauuuagauuauacugaaaauuuaaauucaagaacugguuauggugguauauggcugcaaucucaacacaacggaagcugggguaggaggaggaucaguucaaggcuccucuaggcuauagaacuaucucaaaauaaauucaauuauaaauuuaaaaaaauuaaaaauaccagacaaaaggaaagugcagcaagcuccagcauguggaguggagguuuucugagucagaguucaucugccucugguggguaauaaguggccccccgcacagggcagaauggaacccugagaauggaugugcuguagcugaagaggacuuacagaagggagaaacagggguguccagugcuugcuuugagucauuuggcaauauucuaauaacagauacaccuaugggaagccuguuccaggacacgugacugugaacauuugcagaaaguacaguaauccuucuagcugcuuuggugaagaaucgcuggcuuucugugagaaauucagucaacagguaggcuuauugacagcaacguggugcuaaggcaggaggagaauuuuauaauaucucuaagaaauaaaaaauaaauaaaugacuuagcuaaaaaaaaaaaucauugcuugucuuuugcaaucgcccaauguauguguucuagaauaacagaaauugagccaugcaaagauuucccagguaucuguaaaaggagauaaggcaaaaaaaaaaaaaaaaaggugaucuuucaaaucaccuugaccgugaagagugucagcucuagucuccuucuagaagcaagaaccgauuacaaugccccaucuagaugccagggcaaugacccaggaagggccaucagauaggugaccaaucaccagugucugcuaugagaggugacccagcauuuggugaaaugcuaggucucaguugcagugagauuucccagaaccauuaguauauuucugaaucaaacagugucaggcagugagaaauugaaacuguccauuauacacaagauacuguugcaaaauuaucgguaguuagucccuaggcagugcauauuaugcccuaauauaauagaaaaugccagauuauuuuaucauucccccuaaauucuaccagauuaaccaacuccugaucuauagaguuugauaugcaccguuauuuucuccuuuauuagcuagauggccguggcugcuucucacagcuagugaaaaccaagucuuuccagcuaaagaggcaagaguaugagaugcagcuugaugugaaugccaagauccaagaagaaggaacagguuguguguugaggggugugggggcaguauaugacauagauuguugcuuggcccaaauuaugaacuguaaggaaggagaaaaugguauaagaaauucgccgacaucagccuucaacaaaagaaaaccuuuucuucuguuucagguguggaagaaaccgguaaagggcucacuaagaucacaagaacuauaacaaaacuaucauuugugaacguggauacacauuucagacaaggaauuccuuucguugggcagguggaguaucuuucaauucauuaggccaugugcuaucaaaacucacaucauagguauaaagucugcuaaaauuauaccugguuagccaaaggaaaaaaguauuguacacacacacacacacacacacacacacacacacacacaugccauaaccaaaugucuaugaucuaaccaaaaguuaaaguuaacaaaaaaugaauguauuugucuuaaaauuguauaugaagucuauaaaaucaccugaaagauuaucaaguugccuuugcaaugaccuaaugaccuuucuugaagaccugugacaacuuuccauugugguguuguuguuguuguuguuguuguuguuguuguuguuuuucuguuaguagauguuugaaugaacuuugugacucuacaagucagaagugaggacuguaucuaugccaguguguaacugcuguguauuacgguuucuaauguaaagguugcuucacuguggaggcuguagaagacaggccuagacuuaaauaaaauaagaguacauuguagaaggcucaguuaaauggcagaacauauccagaaacuaaaauccuaaaauuuccuaaaaucaaagugucauccauuuaaaaauucccagaaguuuuuccaacuuaacacugggaaauaacuucacuaucuacuccaagacugucucagcagaagacaaaagaaugaauuuguguacccauucuuggguuuguaugugcagcugacaucuucaugauagauuucauugauauuuaagacugcucauccauaucagccuggguuuucuuuucugcuacuaaauaaaugagaggauucaucucaucauuauacaccaugugcauaugauugaaauugcacauccaacuuuauaaauauguauuaugugucaauuacaauaaaaaauucaaaguagcauauaguaaaaaaaaaagucaccaacuucauaauauggacuggguuguuucauguauuuguuuguuuggcugaguucaguauuaucaacagguugguuuaaaaccugauauaaugcuggcugugccuccucagguuuaccuugucauaugggaggcacauuauaagucugacuacucuccagaaggcugaccaucuaggaugagaaacaacauuuacaagucaaucagugaagcaaauggcacccaugucagaacucugcuugcauacagaaugcuaugccauaauauuaggccaaaggaaauuaucuugucuaccaugagauaaaugucugcaucucaaauaaauuugacuacugaauuaaauuuucccucacuauauaauucuuauacaacucugugagucuuugcaaacuagaugucacaaggcuucuguggugucacuccuauguauuuuuguugcuuuauaucucuuuacacccuucuuuaaccuuccuagaguuaauauauguuuauuuagcaucugugcccuuuuaccacacuguagacuucugaugauauccacagugccugggacuguggcaugcaaugccuagggauagaccuuugcuuuuaaucuucaggugcuccugguggaugggagaggcaccccuauuccauaugaaaugaucuucauuggagcugaugaagcaaaccagaacauaaauacuaccacugauaagaauggccuggcacgguucuccaucaacacugaugacaucaugggcacgucccuaacugucagggugaguguagagagagguuauaguggaugaacaagucuuggaaacuaaauuggcaccuaaagagaugaaaucuccaaauugucuuguauggagagaaaacagccccauaacuuagagauaauuuaaggucaacuucuaauaguuuuaguaagaaaguaauauugugacuaaauaugggugcucuauuauauaaaaugguaaugcacuguggaaaauauuguaccaguuucucaaaaaaaaauaaaaacaacgaauguuuauauaaaauuuagcagccuuacucauauguaaauauuauuguucacucuacuguccaguuacaagaucauagcuaaugauaauguacuguauauuucaaaaaagcuagaaaaaaguauuuuaaauguuguuaccauaaaaauaauguuaucaaauaggaugcuuagucugauuaaaauauuaugaaauucagaauuacagaacacauucacucacacaccuaagagaggccuggcaaggacaucagguaguucucccacuuggcucuagccagugcuuuuuugcaaccauuuucucuaggcuacacaugaggcuauacuguuucauuuauucaucaaagccaguggaaacuaaucaccaaagacucgacugccuugugaagcaguuacuauguuuucucuccuugcugagguuccauagcuccaacaucuuucugcacuggcaaagcagcagaggcaucuucaaaccacguagccagcaagacacauggcccaaguuauucucuucugauuuacaaauaccaaacucaggauguuagguggggaaaagccacaaaccaugccuauauuuaagauaaagaaauagaauaugugccucucuuacuuguacuauagaggaaaagacuuguagcugcuagugaaggaggagguauaaauccauagaacauugugaggacaggggauccucacacaugaucuagcaaaguaacgcuguuuuucuaauuccuuaggccaaauacaaagauagcaaugucugcuauggauuuagaugguugacagaagagaacguagaggcuuggcacacugccaacgcugucuucucaccgagcagaagcuucgugcaccuggaaucccugcccuauaaacugcgcugugagcaaacccuggcgguccaggcucauuauauucuaaaugacgaggcugugcuggagcggaaggaguuggucuucuauuaucuggugagaagggaggucaccccaguacugccuacacauaaagcucucuggggguaaggggugaagaaacuaugcacaucaccacuuugacguccuuucaaacuuauucuucuuauguauguguguaucugugaauguuugccaugugugugaacaucugaccccgcuagagcuggaguuccagaugacugugagcugcccagcgugggugcuggaugucgaauuuggucuuuuagaggagcagaacugcucuuaacugcugagccguccgucccuccagccccaggcuucacucucuuguuuguuuuuagaguuugacuucuccugaggccaaucauuuccagcaguggcucaauaagccaagcacgcagaacagaacggaagacaguagaagaugucuguuggaauuuuuuuaauuuccuguuuugcagaugauggcaaagggaggcauuguucgggcagggacucacguucugccugugacgcagggacacagugaguacggcauuaucuccacagcucugcuccgugcugaccgccugaccucaggccacaucgggaugcuuccagaggggcucuuucugcaucuacucagagugaagaggaagccgggagggaugcaggcuuccuuugucauccuuuaucaaaugguuucuuuuguucuauuauauuuuacuuggguuacuucaaacauugauagggccacaaugauacgguagcuauuucacguuuuccagccagaaauauuugugcacucucuucucaacaugaaagacauuuuagaauuguguaaauggagaggaggaagaccuuggggugcuuucuacuuaccagguucugugauaaagucucucucucucucucucucucucuguguguguguguuuguguguuucucuuuuuaaguuaaugacaauuuacaaagguucuacugguuauuucuaccauggaaugggacucugcccuugaauaacaggauaauagacauuuaaagguuuccccccuucugacggguucuaaaaaccaacuuacuaagaaagcuaugaaugggcacuucuuuaucucuuggugcagcagacuuaagaauguuuaaagcaaacacuacaguguccacaggcaucaaggugggcuuccacgggaguguaagucuccucuuccagagaaaaggauagagccauguuucagggaggguaaacaggacacaaguguaaaugcaguauauuaaccucuuacugucaggccucacagccuccucccccuccccuaaugugaggauuaggagugauugauggugaagucgacaccuccacucccuuagauagcauuugaagcuagugucagccagcaaaagcucaaaagggaugaggcaacauauauacgauuuauauaggagagggauuuuguauaauugucuuccccagagucagaauucugcaagauagugaagcaucuguugugugcauuauguucacuaacagcagcagugauuggccaggcuaggugcccaaacaccuagccuguguaauaaaguaccucuuguuuucaagaaugugucuaacccgugguugccuccucucauccucccugcuccagagaaaggccauuucuccauccucaucucgauggagacagaccuggcuccuguagcucgacugguccuuuauaccauucugcccaauggagaagugguuggagauacuguuaaauaugagauugaaaagugccuggccaacaaggugggucuuucauagaguaaaaaucuagcacuuauaacgaguagucccugcuaucaccuauucucugauauguguguggacugaaggguuaagugggaaaguuccgcaaggucacugcagacucacaugacagaguuauugccucaguuccaaaguccucucuguaccauugacucuucacaucucccaaugccuuucccucucuguaugauugacucuucacaucucccaaugccuuucccucucuguaccauugacucuucacaucucccaaugccuuucccucucuguaugauugacucuucacaucucccaaugccuuucccucucuguaccauugacucuucacaucucccaaugccuuucccucucuguaccauugacucucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaugauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguacgauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaugauugacucuucacaucucccaaugccuuucccucucuguaugauugacucuucacaucucccaaugccuuucccucucuguaugauugacucuucacaucucccaaugccuuucccucucuguaugauugacucuucacauuucccaaugccuuucccucucuguaugauugacucuucacaucucccaaugccuuucccucucuguaccauugacucuucacaucucccaaugccuuucccucucuguaugauugacucuucacaucucccaaugccuuucccucucuguaccauugacucuucacaucucccaaugccuuucccucucuguaccauugacucuucacaucucccaaugccuuucccucucuguaugauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguacgauugacucuucacaucucccaaugccuuucccucucuguaccauugacucuucacaucucccaaugccuuucccucucuguaccuuugacucuucacaucucccaaugccuuucccucucuguaccauugacucuucacaucucccaaugccuuucccucucuguacgauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaccauugacucuucacaucucccaaugccuuucccucucuguaugauggaguguuugaagguacacagcaaguuuaaaggccacaagaagcccgaacaaaagggccuagaccuuuguuugcacuccauaaauccagaguuaaugagcacauuguacaucagagguaaaagacugaaacuuccaaauggccaguuugggaagcaucuuuagagaccaugacaguugucugacagaaucuugagagucaaggcaaaguucaagaggggaaaaggccucacucagguagcacaacaccaaccacuguaagaucuagcaaaauuguucugcaucaaaggugaguaagagacacauggcggggauucagauguugauuuuucuggccuuucucuccuaucugucagguggauuuggucuuccacccaaauaucggucuuccggccacacgugccuuccucagugucauggcuucuccucagucucucuguggccugcgagcuguggaccaaagcguacugcucacaaagccugaggccgaacucucugcaucccugguaagucccugucagccuuggagaugacaagcacgugagggacuugaagcaaggagaauugcuugaguaaugcaagaccuguugaaacuucagugacauugaggaaggggaaggagaaugaauaaaauauauuacaugaaauucucaaggcagagauaaaagcaugaaaaaaagcgacuauagucuccuguaggugaauaguuuugaacucugacagacacuuugcuuagugagaagaagaugcuugcccauggucuccugcaucccuccuuucaucucacacugcuagcuauggcaggugaaagaauuaugcacauguuugcuuggaaccaaccagaaaaucaauagucugaaaagguaaaaacccagugcaaauuaaccagagagacuuaggaugcaagcaucaauaucucgucccagaucagauggcugugcugaaccgcucagcuuagcagugcugggggagcaugaggcaggcuguaaauagggaugcaagaggggugugguucugccaaguaaacaggauuguuucugauuguagaaccagagagaucaugaucaauaugcuuaaauaaaagagggcaggguggcugaaacccguaacucuguaaaugcaaucauaauuguuuucaagcuaguuuuaacauguugggaagugaugcacuucaugagguaggucuggguggccuguuugccugcugugagacuacacagacccaauaguguuucagaugucugcuuucauaagaauggugccaacuaaaauaaggaacaucacaaagugaacauuauuacugaaaaaauaaaccauuguacaagggacauugagaaauaaaauacuugaaugacauaaugaaaacuuacaccauugcccauaacuacuuacaaguacauuccgauuguauuuugccaaagauucauucacauuuucauaaaacauacgaacaacuagaauauguuuuugcuacagaauuuauggaagcuuacaaaaagaaauaauauauuuuuacuuuuauaaaaaaaauguaaguauagggcuggcaaaaaagacucacugaaaaaaggagcuugcagucaauccgauaauuugaguucaauccccagagccaacaaggugaaagaacagaauuacuccaauaggcugacuucugacuuccacacauaguacaacacacacacacacacacacacacacacacacacacacacacacacacacacagagagagagagagagagagagagagagagagagagagagagagagagacagagagagagacagagagagagacagagagacagagacagagacagagagacagagacagauugauucuuaaaugggcagugugauggcacacauauuuaauuaaucacagcucucaggaggcagaggaaggaagaucucugaguuugaggccagccugaucuauagaacaaauucuggacagccaggacuacauagagagacccugucccaaacaagcaaacaaauaaacaagguuaaaaaagggaauagaaguuuaagaaaauauaacuucuuggucuauaaauuuuuauuuuauauuauuguguguauauuuaugcugugcauggauaugcauguacuacaguauagagugcauguagacguuagagaauaacuuucaagugucaacucacuccuugcacaguaggcuuggggaucgaacucagguugucaggcuuguauggcaaacauaccuggcugaaccgccuccuccaucuacagugcuugcucuucaagugguauuuuaauagaaauguuaaaaaauauauauauuuaaaggacauauuaaguacauuuauaauagcauaauaaggagaaaaacuucaauaaggagaaaaauagcauuuuuuguauguauaaugugauuuauauuugucagaacuuuaaauugaugccaacucuaaugguccugaaguagacagucugguaauuuuguaguggugaaggaggagccuucaggcaucuguaacaggacaugagucccucuccaacguuugucagucuguuacuaauaaagccacuucgccuggcagugugagugagugauucacagaacaugaacuuaacacccacuguguucucggggcuguacuaagcgcuaguuaugagcuauggaaagucggguaacuguguguaauugaaauggauaacuuauguuuuagagaaagacaaagcaggggaggaagguuguccgggaggagcuaaugaggggucucguguguggaucaccacagacgccaggcccugucuuuucaggccauagucacuuuccugugaaugcucaucugugcaucaguuggcacgugucuguuuuacuucucuccccuaguuggguuugaaagcaucaucucuaaaaccuuagaaguacuguuuccucgcauguggaggguguucacaguacuucucucugggacacguguccuuuauucuaugcagaauuggugaccaaguccaagguggugacagaacuauuuaucccuuuauuccuucuucccccaaacgucaaaucauccacagcacagcuccauuucucaauuauuagggucuuauuucacguuaguguugaguagauagugucugcuuccaaaugauacaaaccagugucaagacccucaguuaguuaagugagaagcaaauuagguuuugguguugcuguucuuggguuuuuuuucuccuuguuacuuaauaaaaagccacagagaaguuggcucuuauaugcuuuauguucccguagguuuaugaucugcuaccagugaaagaccucacuggcuucccuaagggugugaaucaacaggaagaagacacuaauggcugccuuaagcaaaaugacacuuacauuaauggaauccuguacuccccaguacagaauacaaaugaagaggacauguauggcuuccuaaagguagaccucuuaucucagagacaggucuaaaaguucuuaaaguacccuguguagaaaaguuauuuguuucaaaugcuuucuuaucacgauugaaacuaacaaaauaaaaggaccaaguggcuucuugaggucaccagcagaaagagaucugccuaacgcagcagaaucagguccauaaguuuuaaugguuaacaaaguuuucuuuuuauugaaagucauugcuuugugauauuuauacgcacugcguauaaaauuaucacuguccggugagcuuagggacaauguggcauaaugucccuguuucauaugcaaacauggaaagauuaauucagaugaaaggagguguguguggggugcacuaaucagguggucauuuccuuuguaggauaugggcuuaaagguauucaccaacuugaacauccguaaacccaaagucugugaacgccuuggagucaauaaaagugagugccuaaaacacugaacugagugaggcaggauuuuaaagauaaaaugugaucaaaaucaacccaaaccuugacucagcuauaauagggcugugacaauaaguucuuaacaaucaaggcucaaaucugauacuggcaccccuccaccaaguauacgucugcagagcacagaagaggguugugaacaguguccuaggagacgugcagauccagcacagacacaguguaaagaacggauggacucugagcagucagucagaaauucagccaccaagaacguauaucugccgauagacacaagggucugggaggaaaggaagguucccaggagucuaacugugaaaacagaguuagaagugcucacgaggcagggcugcauucucucaggcggggaaagaucucccuccguggcccugaacagcaguaaacaugcuucacuauuuucagugaucuaagcuauucuuugccaagucauaguaggcagccuggguuuauuauuauaguguuaauuaauguuuggaugugucaaauguggggggaaaggaaaaaucuaggaaaaucuucugugagaauccauauucuaugugaaauuuacuacagagaaucagauauuuuuauuuaugaauuacagaauuuaauccuuuguuaccaggaucuauaggaaaguuguuuaucaucugcccauguagcuccugccuguccaugugucuguugcuguacauuucccuaaaguagguggcuaucaaaaguuuaccagcacuuuacucauagaaagugacaguaugggacagccaacugauguucucacucaauauggaauacauagcuuuucuauccuugauuccuccguugcuauaaacuguuucucaaaaccacuaccauuuuuuuuucuaugcuaccauagaugagcaugucauugguaggcuagccuacugcccuccuccccacccaacacccuaggucucuccauugggcacaaugggcaguaguuucaagggauuccacaaagccaucucuccugcauacagcccaaggcuuucugccaugcuccuuccagucugugcuuggcauuuauuuccccuggcucaguucguucuaauaccucagaauucaguugaaaugucacuuccucagagaagccuuccuuguugccuguguguccuuuucuggcucccaucuuaacuucucgaucuuucugagguuguucuuugguaaaacaaugguucaugagcuuuaucuuuguagucauugccugucuucucucaccugcuauaguaccagcugcauaccaccuuguaagccaaggccacauggaugcuuuucuagagucuucagagucucccacagagacuacacgaagcuacuucccugagacguggaucugggacuuggugaucguggaguaaguuacuuauuuuuauauaagaugcagagauauagauguaucacaguuugaacauccacgaguguccccuuuuuaguguauauauuuagaauugcugagcgcagcauuucacugucacugggaaagcauuacuaagguugagcaacguagaagcccccuagguuaaauugacuucuaaguacuuauucuauuaugaaugggauuguugucuuuauugcuuuuccagauagcaugcuacuaguauaaaaaaugcaaacauacuuucauuuuugcauccaacagcaucacugaguucauuuauuaguucuaacaguucuuuagaguaacuuaugagauuuacuucauuugggaucagauaaucuguaaacagggaucaucuuagucguuucuaauuuggauacucuugacuucuuuuucuaguuuaauuauuuuuacagggcuuucuccuaaaggagauugguuuagcugcucacuuccuuuacuuuacaucacacccccugcagcucaacaggaguggcugaaauggaagugacagucccugacaccaucacugaauggaaggcuggggccuucugccuguccaaugacacuggguugggccucucuccugugaucgauuuccaagccuuccagcccuucuucguggaucucacaaugcccuacuccgugauccguggagaggccuucacgcucaaggccacugugcugaacuaccuccagacaugcauccggguagagacuuauuuccuuaauucagcacacaccaauuaaaacuuacagucguagaaauaccaagaaggaaauuuaaaaaagaauaaguaaacccacuucuugucuacuacaaaggaagaagcuaucauacauagauuuauauguuaggaaaguggauaucucuaagaaucaaccuacaaagaugaguuucuaacauugaucguaauccucuaaaguuaagucaccugugcaauagacagauuucuuacacaagugagcaucaccuugcccgucccauguuuuacaguuuguagauccaacuucuacauuccugcauauuuauuuuuucacacugcauucauuauacgucgcuucauuuaaaauguugcuugugugcaucccuccucggucaaaaccauaacuguuuauagaccuuguguaguaacugagccagggggugauaacucuucugggucccagaagagcugcuuacccaggcaacacuccauugucuuucuucugguuccagcccuugaaaggccaagcaccccuucaagugcugagguuuaccugugaggugcuaaugaauggagcauugcacuggggucuuauuugucuuguugauguuagguaacagaaaaucugaucuccaaguaggcuuccacugaaaccuggucuccuccuaucuuuaauccugcuucuugugugguuacagguugguguacagcuggaggccucuccugauuuccuagcuaccccagaggagaaggaacaaaagucucacugcaucuguaugaacgagcggcauaccauguccugggcggugauccccaagucauuaggugagcagcagaguccagaggcucagucgggcccuuauaagcagggcuucuucucccagguaaggacccccaggugguaggaucacuuuucuuugacuuccauuccagaauggcaagcacuaccagguuuacuggugcacaccugcaguucaguaguuagaaggcugagacaaggucacucaagaguucaaggccuugcccacauaaucaaagcugcaucccaaauaaaacaaaacaccagccacaucaaaaagaaacccuuucuuguaaguugagggcucaaggaagccucacuuccuuaccuccacuucuagugacacagaucucuaguggauguggcuuccauuucugcuccgguguuuuuaugaaucuauagccuuguaaauuccaaguuugcaagcuugcgggaagagggaauguauacaucucuucuaccuggcuuuucuuuuucuccuaggaaaugugaauuucacagugagugcagaggcacuggacucuaaggagcuguguaggaaugaggugccagugguuccugaacguggaaagaaagacacgaucaucaagucccugcugguugaaguaaguaaaucugccuaccugauaggaaacacugaggcacaagagcaagcucaguuaaggggcuaauuauuuuuacaauuucaacucuucaauguugaauaauguacagcccauauaagauucacaguaacaucucucugucgucuaucauuuaucuaucuaucuaucuaucuaucuaucuaucuaucuaucuaucuaucuaucuaucucaucuauuaucuucuauuaccuauuaucuaucaucucuauuaucuaucuaucaucuauguaucuaucaucugucauuuaucuacaucucucaucuaucucuauuaucuaucuaccaucuaucuucuaucuaucuaucuaucuaucuaucuaucuaucuaucuaucuaucuaucuaucucaucuauuaucuaucuucaauuaccuauuaucuaucaucucuauuauuuaucuaucaucuauguaucuaucaucugucauuuaucuacaucucucaucuaucucuauuaucuaucuaccaucuaucuucuaucuaucuaucuaccuaucuauaucuaucuaucuaucuaucuaucuaucuaucuaucuaucuaucuaucuaucuaucuaucuacuuaucuauugcuccccauacuucucuaucucuguccacucuugcuaauuaucuucauuaaucuucacucauuuucuuuucuaucaauccaucuuuuucauauacuugcaaugaauagaauuuauuuagauagugcaacaaauccuuuuuuucacugugugggacucugugguccccgaaucaacaacucccauauccugaaggucagugcaguucaucuuaacuucuuuuuucuucccuaaagccugaaggucuagagaaugaagugacauucaacaguuugcuuuguccaacagguaagccucaaccauuauaauuaaacucuccaacuaaggcuuuauaccauuuaaaguucaaagauuauuuguauguuccugugggaugaaaccuggagugucaucaauacaacagaguuagaaaguaguuccuaaggaggccagaguaugguagugaauaccuauacuuccugcacuuggaaugcugaugcagggggaaucaaagaaacaaagaagcaacauaucacaacaaaaugauguuucuuccuaaagacaaggcucuaacuccuaauucucucagcagcaauuuuugaagagacucuucuuuguucacuguauauuuuauucuucauugaaaauuaaucaucuguaucuguguggguucauuucuauggucucuauacuuuuaucguggucucucuguauauguuuuaauguaaauaucaugugauuuuaauuaugucuguuuugcaacauacuuagauacaauguaacaccuucaguucugaucuuuuugcuuuugauuaccuuuguuauuuuuuuguucccaauuuuguaguaguauuuuggggacucuuugccuccuuugcucccaaauaacuacagagcauuucuaugccagcucuagccuauucuagcuccugaauaacugauguagagaccugguauuuuuauuaaugagcugcuggcacuaugcuaggcaggugcugagcuauucugacccucuuaggcugauguuucccagcuacaugguccuuuaccuucaaucagucuuucccuggcauucuguguacuguggaagaaugggugaccaggaggagguggguugagucacccagaacagagcccuagagucuucuuccuccagcuaccuaggcuccugaagguggccagcuuucccugccugaugcuuacugaggugagcccugggagugggcuuuuccaagaggucuuuaguguuauuuauccuucuccuuacucccuacuguacccuacacuccauucuccacccaguuuaacccuuccuauucuauuauugccaguaccuuuuaugcuagugcagccuaucucuccucccuugaaagucccuccucacggccccuuagucauuuccugguaguuguagcuauuccaaaugaaacauacauuauggagauucaaagcucccacccacaggugagagaaaacaugugacauuugucuuucugaaucugaaugaccucgcucagagugauuauuuccaaauccaugcauuuuaccucagaaugucaucauuucauuuuaaauaguucaauaauauuccauguguaaacguacauuucauuaccccuucauuaguugauggauauccaugcuauuccauuuccuggguauugugacuagggcagcaaucaaccugguugagcaaguaucucuacaguaggacucuguggagucauuuauguauauacccgagugguacagcuggauccuguggaagaucuauuuuuacauuuuuugaggaacuuccacagugauuucuauagugguugaaccaauuuguguuucugcaaggaaggaauaaguauuaucccuucuccaauggaucucagcauuuguaauuauuuguguacuuuaagcauucagagugagguaagaugacaucucaauguagacuuccuguuguaaccauagaucaaugcaucucucaauccccaucagagaaguuucuauuugcaauagaugguguuugguacagagacccaaacugccccaaguacagagaaccagagaagauagaaugcucagcccuaaagggaacauacauuuuguaccuaccccccaaaaugccaucauugugcaagaguggacagaaaguauaagugccagggguggugaaugacuacagggaaacagugucauagcagagcaaagcagggccacuguaugcaugagcucacagcaauugcaacaguguacacaaacucuguaguccaugccagaccaaauuccagcauggaaaagggugcugguauagaaccccaacaccuaguuguuguacaaauggcagauuuuagccuuugggagagggaaagaccguuuuccuuaacaauguaaccccuggaacaucaaccacacucuaguggaagagcucacauccaagaauauuuggacagaacaaguugguauugaagggagaauaaaaaaacaucauuaggcauuaggaagauggauuuggggagacuuaaggguaugugaaugugauuaaaacauguaugaaacucauguauguaaagaacuaauuuuuaaaaagguagcaaauguuagcaaugugguuguuguuguuguuauauggggggaauuugagccaggaagauggaggacaauaaggaauaaagaaaaguuuagccaagaaaaucugagaaaaauauuccacuuguuaaucauagccuucaucucuuggccacacaaauauaauuuauaagcauugcuuccaccucauaaagaagaaugguguucuguuguccucuauggaguguucugcaaucaucuguuaggccaagugaguguuuuauucauuuucucccuggaugaucugucuauacuuugaagugcgguauugagguuccccuccauuauugcauuacaguuuauaucacuuuguauccuugaauauuugcuuugucuaugcacucugauuuggagguacaugcauuuucaaaacuguuauuuuuuucuccuagagaaugagucucuauaaaugucucuaaauuuucacauauuuuuauuuuacaugauagaagugccauuaucuccacguuuuguucccugagaaggugauucuguugcagugccacauaguuaggucucguuuuuauucauuuauucauucucaguccuuauauuggagacucuuauccuuucacaucugaggugguuauugacaggcaaggccuucuccacauguuaaccauuccugguuguguagaugauccauuucuuccauucucugugucuccuuuuguggacugauguuuuucuguaauguuguuuuuaauccuuuuuagauuugauuuguguuucuacucaccagacuuucucucuaguuaccauaauguuuauauauaggaucuuucuuauagcaacuugucuugagccaucuuugucugaauauguguaaucugugacauugcccuuggguuuucugugaguuggacuacaguaggcucccugggaagcaacucagaaugccaucuggggaggaugacucuuuuucuccuguucaaacuggacuuggggagaucucugucaaguguugugcuaacuggggaaagcagacaugaagugguuaaaauggcaccaucuuuaacucuucugguuuggguucucuccaguugugggcuaucccuuuaagacuuguuucuguguaaugaauuuccaaagauguucuagucccugaagaggugcuggcugagccuugcaugggauauucuggggcuuaauaguucccaucucaucacauccuuccuagucuugguuuuaguagaccaagcaccuccuguguuuaugcuuccauaaguauguauuuccagaaaguaugcucagcaucuuuaucuaccuccauugcuuacaaauguugucaagauuuuugauugaaaguauugugauccugucuugauucaucacaagaggaguugaacuuugcuauuguguguuuguuugaggcauuacuaugaaaugcugucaugucauuugaccauagauguuggacuauuuugucucuuuugaccugaguugaaugguauugguuauuuaaugagcacauuguguuuucuuucaccccgaccuaugguaucugacuucuuacauaacucaauauuaauuuuaugaggauaagaugauaaauaccacaauuccuucauuuuccucuuuauauauucuaccaggauuaaaauggcacauguauugauucagcaauuguuauuacuuuauuuuaugcaagccaaaauauuuucuuccaccuguuuauuuuuauuuuaucuuugcuuagaacauuuuucuugcaaaaugauugauauuaacuuugugaaaggccauauauggauaacuuuaugaaaggaaaguaacuauuauacuuuccuauuuuaucuuuuuauauaguaauuauuuucuuuuuagugagucagguacuauucauuugcucauuccuauuuuagaggucuccaauuaagauacagcauauucauaucugaaacaaauuauaugauauuguuguagaauuaggacuuuugagggagguuuucucuguuuauuuauacaaaugaauccugguugaauuuuccucuuucauggcuuuugagagagaagcugugagugggaaagcuaaauuggcucaucuuguccugcacacacaguguagaccauggugugacugccacagacccccccuccccucaccagcucuggacucuugcugacuuggaaauucuacuucauaucaaggaggucugggaugaaauuaugaaaaccuucaagucucaguaacuccuaagaucagaaagaaaagaaaugaauguuuaauuuuuuuuaaaggaacagcuuuucagaaguagcuucugcuuaagggacaauucuaguuucugggccaugaacaucucuaaagauccagugcagaguggccuuuccuguggcugaugugcuucuugcccuaggugcugagguaucggaacagauaucucugaaacugccaucagaugugguagaggaaucugcccgagcuucugucacaguuuugggugaguucauucccuagagaauuuggauguuaauuuuugauguauuuuuuuuguucauauauguguguguguguaugcauacauacacacauuuauauguaguuuguauuuauacagcgaacuuuuuauuuuauaauuuuuaauuuucuuaauuaaaauauaauuacaucauuuccucuuucccuuucuucccucuaaccccuccuauguguccccuugcacauuccuuuaaauuauuaccucuuuuuaaaaaauuguuuugacauuauagacacauucuuuuuuuaugguguaaaaucuuagauuaaaauuuauuuacaguuucacuuucaugagcuuacuugucauacaaccaauacuauaagaaagaaacuccaugaaaucugcaucauuuauuaugaagcacccuuacauucuggauucaaggagucaaaucaguagacaaacaagugcagacacauucuuaaauauauaggaauguaacuuccucuuucauauuguucaccuuucuauaaauauuuauuccaaacaaaaggcaacaacaacaacaaaaugugguaguacacaccuacaaucccaacauugaaugccugaugcaggaggauacauaguuuguggccagccuaggucgcagagcaaaaccuugucuugaauauauacacaaauucaucaaauuauaauuuuaacuucuuuucuuugaauuauuguuuccaacaauuuucaaauuccaaaaauuccaguguccugucuguacccuuugcaaaaguacucauuucuuaacauggcuaauuauuuauuuuggauauaaucuuaaaugucauuauuucccaucucucccauuuucuaggagauauauuggguucugcuaugcagaacacacaggaucuccuuaagaugcccuauggcuguggagaacagaacaugguucuguuugcuccuaauaucuauguccuggacuaucugaaugaaacagagcagcugacacaggagaucaagaccaaggccauuaccuaucucaauacgggugaguacugaucaaggggcugaagguugacaguacuguuucaguuggcuuguucaaugaggcugaguuauuuaucauuacuauugccuauuaucucaagaccauaauagaaaacacuaguauggguuacuucauagaaacuaucuccucuccaacuuccaagaacacauuaugaagcgagaacauauuuuagauguggacagaacaguuuucagcaguuacaagagaugucaagcauuuuaauaaucuuucugguugccauggguacucaaccugccauauuguuucucuaacuuccccucacagguuaccaaagacaauuaaacuacaagcaccgggauggcuccuacaguacuuuuggggauaaaccugguaggagucaugccaauaccugguaaggggaagcaaauggcuugaacucuuguuuguuuguuuguuuguuuguuucucuguauagcccuggauguccuggaauucacuuuguagaccaggcuggccuggaacccagaaaucgaccugccucugccucucgaggcuugaauucuuuacaugcaguacccuaguuaugucaauaacaacuaugucaagauauauguuauuggaauuagaaugaauuauauuaaaugaauguaccaacauuggagaauuaacaagcagacaauuugauauucagaaauauguuuguuaaacguguuccuaagucauccugggcauauuauagcaacacuuucuuuucuaaaaacaguuccccuagccaagaguuuuaaacugauagugagcauaucacaugacuucuagauaagccguaacagcuucaguuuuucuuaucuuucuuggaucauacuuaucuugagagaggaugaauucauuuagaggggaaagaauuaaggauagaaugaugcaaaaucuuauauuuacauuccuaagucaaagugaauguaagguuacugcauagaagaaauggacaugugaggauacugucaucuauacauagcaaaaaaccuuccaagaggagggugaagaaccaucccaugcugcuuuaucuucucaaugagccaagaaaaaagaagugugucagaaaccuguagcuucuuuauuauggcuaaagcaaauucuaguucuagcauccuucuccuguagaccaggguagaccuagaggguaucuccagugcaccaauuccaguuagauacuucuccagugucaggcagggacucuggaagcauuuucuugugaagaggcucuaaaaucauuguaacagcaaauauacgauuauucccacgucacucaggcucacagccuuuguacugaagaguuuugcucaggcucgaagauauaucuucaucgaugaaucacacaucacccaagcccucaccuggcucucccagcagcagaaggacaauggcugcuucaggagcuccgggucacugcucaacaaugccaugaaggugaguauuccagagcuaguuuuggcuuauccauuaugagaucugugaguacagagauuacaggguagaaauuauugacagagcuacuaaagaacaauaagaccuagacaucaccaagaaagagaagauagaguucauauuaauugugaugcauugcucgggaguggauauuuagaaaugagaaguuccacaacacagcagaauacaaauagcuaguuaauagaacucuuagaacuacugagauugcuuccucuugcccauucacagggaggaguagaagaugaagucacuuugucugccuacaucaccauugcucuccuggagaugucucuuccugucacuguagguaccaccuccuucccuaccaaaagaugauucugggugcaacaaaacucuggcuuguugccugagacuugagcuuccuaaacagcaugugucugcuuuccuuuuaugcagugcaaaugcuucucaaauccauuugcuccagcaaagaggaaagguuugcauuuuccgagggaggcaucuaugcuguuucucuccuauaaacaucuccagucucucaaggauccuaaagacauggcuaaugucaaauuagcaguuaguaguacauuauauuucuacuuuugagaauuucauaaauguauauaaucacauauagucguaucuacuccuuucuauuuccucccuccaacuccuccccauguccuuuucaacucaucccuucccaacuucaugccuucuuaugaaaaaauauaaccacaaaguccaguuagugcugcuaauauguuccuguguguggagccacccaugaggcucugaccagaggcugcacucuugaaaaauaauaauucucuccuccuccagaaacuaccaaaugccaugagagccaaaauauggggugggaucugaaaagcaccuaccccaucuaugcuagaauuuuggcuggcuugaucaugugccuucugcagguagccccagcuacuguaagcucaugaaugugguagccaugcuauauucagaagagagcauuucacaaggcuccuacccauccuguggcucuuacauucuuucugccucuucugugauauuuccugggccuugguuagaugcuucuucuucuaaguauaagaaugaauuggaaaacccucuuaucuccauguccucuaucugcucaccugggaaugucagccccuuucuucacauagcuguuuccuuucugcuuccuguucauagcauccuguuguccgaaaugcccucuuuugccuggacacagccuggaagucagcgaggagaggagccagcggcaaccaugucuacacuaaggcacuguuggccuaugcauuugcccuugcugguaaccaggacacgaagaaggagauacugaaaucacucgaugaggaggcgguaaaagaagguaagagcauuugaggucauucuacugccaacagccugugggcuauacugcagaauuuuucugcucugccuuuugugaucuguccuauaugcuacccacuauccaucaucuaguuauaucuaucuauuccauauagaauuuauuuuuaaaaucuaggacuuuaaaagugaaaucacacauuaaggaaaaaaaaaaaaaaaagaagcagcaucggguuuagcagcaagaagcucagccuugaagauuugcuccacaaugaacuauuugugugaagccaggcaagcuauccaguuacugaugguucuguucuuucaucaggaaacagggacacuguuugccccauaggguuguccauugagugaauaguaaaugugaagacuuagugaagucuguggcacaugaugaauguuauaagagcacuagcuguuagaccuacuacuuauaugucgcuuccuaaucuccacuugacccuuacuuggugacuucaugagaaacuucugauguuuuaccucauuacacaagucaaucauguugaucaaucuuuuuauuuucagguaauauuuuuucauauaucacgguuuauaugacaaguuaaagagacagaaaauacaaugcgcauauccaaugaaauugaacuugucuuucuucuuugauagugccauuaaauguucuuaaugcacugagaaauauuucagagaauguaauaagccuaaggaauaauuaggaaauuccugagucacucauucccaguggaagaaaauaaguauacccaaugcauuaaaaaaaaaacauguuucauuuaccccucuagagaugaacauuauuuuaaauacauuaucacaauuucuacuuauauguauauaugcaauauauaccuauguauuucuugcauauguauccauaaaugauauuuuuaauuuuguaaaguguacagcuuuacaugugcaguaucauauccauuaauauuucaguagcuuguuuuccuuuugauuuuuagguguaagauuaggcaaauaagccucccuagcaguagugcacugauuuucauucuucguuuucuauuuguuagacaaauucuugcuauguagccuaagcuagccucaaagucacaauucucccaccucaguacaaucccaaguacuggguuugcagcuauguggcacuguguuagacuucuugauuguugacauagcagguccacaguggaugcacagauaccugucccucuggucccucugugcauguaccagcuuauccaaguuagacuucuagaaguuuaaggauucacuguagaccagacucuuuuuuuccugaauauugccaaauugcucucaaagaaaaacuagcuuuccaugauaaucuuugucaguuucaguacuuaacagccaugccagcuacuuuaaagacaacaguauuuuuuuauuuuuuacaaucuaaugacuauaaacuuuuuaucauaucaugugcuuggugauauucacaugaaccuucuagggaaggguuuuacaagauaucuaauacauucugguuaagcucuagaucacaucugaagcacagaauacccacagccuaugagagaacuuucucccacuacacaacuguaguaacugucuucagucauaagugguuaaggagccugucacucuaccagcacuacccugccaugccuggauugaaaugucgaauucacauuuacaccaaaaggacuguuaucucuuuaagguuugaagaaugaccuuugaagagcaguucuuacuuuagcucugccuuggaugcuuucaaacaacgaagugcaaauauuucaucacucauaagcauucuuuuuuaaaauuagauauuuucuucauuuacauuucaaauguuaucccgaaaguccccuauacccucccccugcccugcuccccaauccacccacuccuguuuccuggcccuggcauuccccuguacuagggcauaugaucuucgcaagaccaagggccucuccucccauugaugaacaacuaggccauccucugcuacauaugcaacuagagaaacaguuuugugggguagugguuaguucauauuguuguuccuucuauaggguugccaaccccuuuagcuccuugauuacuuucucuagcuccuucuuuagggguccuguguuccauccaauagaugacugugagcauccacuucuguauuuuccaggcacuggcauagccucacaagagacagcuauaucaggguccugucagcaaaaucuugcuggcauauguaauagugucuggguuuggugguuguaugugggauggaucccugggugggccagucucuggaugguccuuucuucugucucagcuccaaacuuugucucugcauaagcaucccuuuucuaccuccagacaauucuguccacuggaccagagcucagaaacccagagugccagcagaucucugguaccaaccccaggcucccucggcugagguagagaugaccgcuuaugugcuccuggcuuaucuuaccacugagcugguuccaacccgagaggaccugacugcugcaaugcucauugugaaguggcucacaaagcagcagaauucccacgguggcuucuccuccacccaggucagugauugguuaaaacauuuuaucuuuaguuagugaaagggcugcugacuaaaaacacacaugagaaaaaaaaaacaaugaaggugacuuggaagauuauuaauauacagagauaauaagaggaaauugaaagaccgcuaaacagaaaucuuaaauuguggcaccccaccucagcccugcauuauuguggucuccucguuucaacaacaaaucuaugugcccacaguaauacuagggcaccagaaggaggaagaaaaaauuaccuacuguucuucuugaaggcgaagacucuuuuugagcugucaauagggacccuaacucaacauucucugcuuacagauguguccauuuguaggccuaugugguaacuagaugcuuuugauggucuccagacgccucuuacuacacaaaaauauguuuauccgcaacauaaugggaugucuuuccucaaccaaucucucaagaucaacucuauaguuauaugccuaaacaauucaucaguaugugcccaggaagagucuuuauuuugagagacaguagauauaagcauaugucuucuguaagugggacgaggguauaaagaaauacaaccuugucuaugucuauuguguuaaaaauauuauuauuuauauuuuuauaagauuauaaaaagauuucuuagaaaucuauuauuuaaauauugucuugcagcucagugucagugguuuugagaauaugcauagugauggggaggugagcacuggugguauuuugaugaaccaggagaggccagucagaauagccguauaucagggggauguuuauaaugagccccuuugcuuccuuuggagaaagccugacucugagcacaguuauaaaagaccuuggcuucuagucagcagagacgaguuugauuuggaaaggggaccagaccaagcucuggcuccuacuagcuuugauucuccacccaaaagcaccuccauagggccuaagcuccagacuucugggcaacugaucacguugugaucccugggugaguuaccccauuccucuuucaggacacgguaguggcucuccaugcuuuguccaaauacggagcagcuacuuucacaagagcgaagaaagcugcacaugugaccauccagucuucuggcgcauuuuauacaaaauuccaagugaacaacgacaaccaguuauuauuacagagagucacauugccaacugugccuggggauuacaccgcaaagguagcuggagaagggugugucuaccuccagguaagacuugggcagaggaggugguggugggagggcagggaucauccucccuauaaaaagucagaacucaggcaagccaauggacaaguuccagagaaagagaugagggaguugaggggaaucaccacgaaaagaguaaaacagacgccugucuuuaaugugccaccagacauccuugaaauauaguguucucccgagggagaaggaguuuccauuugcuuugguggugcagacucugccugggacuugugaggaucucaaagcucacaccaccuuccagaucucacucaauaucagguaagaccaauuuucaccaucuggguaaacaacuagucuuuuuaucuggggcuuaucacuaaacaaagcuguuggguagcaaauauuuagaucuguuuuaaaaauaagguauuguuuuaaguugguaaaaucguguuucucugcgauggagcuauguugccugcccucuaccuucagaaauuaauucccuugaauaauuacuuacuccugauaguaaauaaacuagcaauaccauucuuugucuacuacuugaauuccuccuauguaaugaaauccuuuaguaaucuugaucuuuauagaaaaaaaaaucuuggaaggcuuaaauaaaaggaaguaguugcuuuuccacuauaauucugcugccgauaaguaagucuaguccuguaugguauacuacuucuggaaaacagcacgcauguacauugagggagucaaguggcuacagaacucacaaacguacucagaaggccuuugugacuuagcuugcugcucuaccuaggaaauuguggugaucaagugagagucacaggaaacucagaacagguuagaguccucgaggacaugucacccaccaagcauccuuaagacacagaccugagaccacaggcuugaauucugcuucuagauccaguuucuguggauuuacucaguucuauacaaagucuaauacacaccaauuuuuucaggauccuuggaaagucuuaugcauacuucauagagcuauagaguauacaauauacagacauagaaaaagacuauuuacuaauuugggaaagccuaacucuuccuuuccugaaccuucaguuacauuggaagccguucugacuccaacauggcaauugcugaugugaagauggugucuggcuucauccccuugaaaccaacagugaaaaugguauguucaguauaagcucaggauggcacaguaauaugguauguucacuaagcccaggauaccacauuaaguugguauauucacuauaaacccaggauggcacauuaauaugauauguucacugaaagcccaggauaguccauuucauuuuauaucuuauuuauuaaaauacuauuucaauaaaucuucaagguuaugcccugucaaaauaaagugugaucgugcuuguguguguaucauucuuuagacaucauggcuacuggagaaacuuguaaacaguuuucuuuucuuuuaaguuaacuaaacuauaguuacaucauuuuccccauuccuuucuuuccuccaacucucccauguucccuucuuacucacucucaaauuuauagcuucuuuuucuuaauuaucauuacauauauauauauauauauauauauauauaugcaaacacauaaauauaaaauacaacuugcuaaguccauuucauauugcuuguauguauaugauucagaguugaccauucagugauggguaccccuuucuucagguaagucaacuuuacauguguguucauaugccauacuaauaguauaccagucauccaaauuaccuuucauuuuuacuuuuacuuuuuuuuauuuauaagggacuuuugaagaaauucgaccuucagaauauuuugauaauaaaauaaucucauuuuuccuggcuucuccaggagcuucauccauucauuaacauuugugaugccuccauuuucuucagcuugaaagaucugugcaugugagccggacggaagucagcaauaaccaugucuugauuuacuuggauaaggugagacuccuauguaaucauccucuaggaacuaacugggaagcaccugucuguguuugagaguucucaccuccgugcuagagucaugagaaucuaauaucacaguggcuguccucucuuuggaaauacaucaccugagccugugacuagacaugccccacuacacaccugggauaugaaugcuuccaggggcuuggaagauagucuccauaaugguuuucauuauaucaaccaguuagcuuagagaugcuaaauaaugcagggaagugaugacuaugauuaaucagucauuauaucaucgucuucaacaacuguauaagaggggaaaauaccaugaaucucagcuggcacuugggccaugugauaguaaaacagcaguccagccauggaccaauaagugaaaagauggguacaguagcagauuuauucaaacaucuauugauaggaaucuauugaaugaucucuguugacaaugcagcagugguuccccuuuuauagaauucuuugggucuguaucaguauuuuuacaagacgaaaacgcaaaacuguacuaaaccucugaaauuuaaaagaagauaucauaguaaaacugaaacuguguauauauuccuccccuugaacauagccaugagcugccguugauuaaggcaauaguucccaaccuguguucccuuugugugugggggauccauaucaguuauccuggauaucagauauuuauauuacaaucauaacaguaacaaaauuacaguuaaguagcaauaaaauaacaaggaacuauauuacugggucaaagcauuaagaaguuuucuaacccucgauuaaggcauauggacuuaccaagucauguuaaucauugaagagguaauuuuaggcaauuucccacuuacucuggggguuuucuauacuaugcugucagcaaauaaaaucccaaccuuguaaaaccacaauugauuucaauguaaaaaaaaaugucccaggaagucauuuagcuccuuuugauuuccaggugucaaaucagaugcugaccuuguucuucauggugcagcaagauauuccagugagagaccugaagccagccauagugaaagucuaugauuacuacgagaaaggugagcaagagcauccugaacaugggcauucaguuccccgugcaggaacucagaccuaggaacgugccaggcugccaagugacacuggcuccucaccacuuccucuugucuccuucagguuugacaccugcccccuuuaucuccuugcuucuguggaagaaagcacauuuuaaacccaucaaccagaaaaacaaaguaguugcagaguuaaauuuuuugucagauaagccagucauaggacaggaaugagauuuaagaauguacaacaaccgacugucaggagucuggggugaaauguggcucaccauugcuggaagguuguccaaggcaacaagcaguggauuagagaaaugaugugggcauuucugaugcaaaugcagaagcccauggugacaucacuugaugcauuuguuucuguuuucucauuuacucagaugaguuugcaguugcaaaauacagugcucccugcagugcagguaagcaguucacauucuuguuuuguuuuguuuuguuucguuucuguuuuuguuuuuugagacaggguuucucuguguagcccuggcuauccuggaacucacuuuguagaugaggcugaucuugaacucagaaauccaccuaccucugccucccuagugcugggauuaaaggcguguaccaccacugcccggcaguagcucacauucuuuuaaaggguaaccagaauuccucuagcuugugucccagauuuccuccuccauaaaauucuagguagaucuucuuaggaaucauuuugcuuggacuguguguuauuauagaagaguguaugcuuuggagaggugugaugccucuugaacccucagcgaguuugcugcacagcuuauugggucauuagcugcagugggucucagcuccuccugcauccauuggguugucuuggauaccaugcuguucaaacuuagaggaauauauaucguuugcucauggaaacccaagccuaucuuaauuuucucuucuuuccacuaccacagguuauggaaaugccugaagacacugugaauaagaaguguuucaccagagcccuguucuuaggacuucucaagaaaaagugguuuuuguauuuccagagauuugauaaauaaagcauucuuucauaucuauccaucaccauuccuucauua

SEQ ID NO: 3352 - RNA, 9017 nt, Mus musculus
agcguguuuuuuguuuuuuaauuauuguguuuuuguacaaaagugguauauuauuuuucauugaaaacacggguuaggaugcaaacaacaaagaagccuuuuuuaaaaauaacauuauuuuucuuguauagaaagaaacaaaauuuccacugccauugcaaggguauugagaaguaggaaugacuucauucauuuuucucuaaaguaacgaauggcccugccuuucccacaucuccuguguucagauuaacuguguuguuacuuaguggccuaggcguucacuauuauagcgagaucagcuugcaucugggcagauggccuaaacagaaagagagaacuaaaauccuuuucccauagauaagugggucagacacuucccugagccagcaggagagacaggugcagcaguguccccacccaaagcagagaccugcagagccuccauguccacuuccgcuuccauucccuuccuuuaugauuggggaaaguauaaaaagccaaacuacagaucugugagaaaagugcaacucagauuuacaaguaccaguagagggagaugaggaagaaaaggcuggccacugagacuaacuaccacaaggcaacacacagggucuguuuacuuuagaaaaggacuacuugauuaggcauuuggguuaccuauggauuuauaaaccauggcccaggguccaauucaaacuaucaagccacuuaaagaccuauacacaacgugaugguaccuuagaauucuguaguuggggaauuucacauuuuuuuucccuguccuaaucccacacaagggacaaucaggugacugauuccaggcucaaagcaaaugggaguauuuggguuacagccagguaagcacugcagaacaacuugaggcaaccaaagguacaaguaaucuuugcuuuuuaauuagaguauccaguguuucaacuuauaaaaauguuuacagccagggcucauggcuuucugccuauuuagcuguccuugcucuuccuggggugcaggagucugccccacaggcccuaugucugucugccuuccacucuacuugugcagaggagaaacaauaggaaggagcaaagagaggcagguuagggucaaaucaaaagccaacuggaaagcaagaauauuaagggcaaggugagagaugggagaccggcuugagaagucuggcugaguaugcuuugguuuggggacugaagagguggcuagacauuaaagugcaaucacauugguagcagaugaucaucccuuucuuccgacucuucacccagcuggucaucucccacuccacgauaugcugcaggcacauugcgggguuuggaucggcacacaaagucacaaccauccuggaagcaaaaagcaaaggaaagauaaucuugauuaucuauuucagagugaaacagaugauaugguuucaaacugacguucuccccaaagcccccuccccagagaacacccaaaauccaaggcuuagcccaaauuaacuuugcuacuuacagcuacuagguugccaagauccugccagaaggccagaugaggaaacugcuccauucccuuggcccccacuaccagucgcugguauaagaaacccccaaugauauagacagcaaccaaugaugcaaaucuagacaggaaaagaaauacuuaaaacuuauuuuaaccccgaaguggcaccacauaccucuaaaaguauugagagggccagggcuagauuuuauagucaauauuagcuguuuucuaaguagcagugagaagcuaaggcuagacuauacauucaucuuuagcuguuuccuaagcuauacucuaaacaaacagggcugguagcuccuuagaaaaacugcuuaggagugcugugucaaacaccuagaagagggggcaggaacuuaguaugugacucaaauagccauggaucacuauuauugggacuaaaccauuuuuuaagaagccaggucugaucagguacaucuuuaauaucagcucauggaagacagaaauucuucugaguuugaggccagcuauagcuacacauacauaagacugucuucaaaaauguuuuauauuuuucuuuacuacugucagggauugaacacaggaccucgugcauacugaucaaacacuuagccaccaagcuauacuccccagcuuaauuucuuugaacguguauagucauaucagugagucaucucuaauuuaguauaugucagcacacgcagcuacugagaggguacaaaguacucacaugacaaguaagaucgagcccacacugaggugugagaccucuggugaacaggccaggcugcuauccaucucaaagagguagaagcaauccuggacuuugccucguuccucagacacuggguuaaaauuagccugaugaugagaagaccaaacaauaauuacguaugccuucuuucaacuugcauccaacaaacaagacugccucugauaaaugcauaaagcccaaucauuugcagcuccuggucccaagcugucccaggacaccuuaccgcuagugugugccgauugcaggagaucaucaccacugcacggcgcugcucuuugccacagugguugucauauucaucacccccuuuauauaucagcaugauccaauuaccugaggagggacaagaacaauggagagcacuacggagagcagggaaagcagaggcaacaguggguagcaugaugguguggaauaagcuacuggaaccauuuuuaguuaaugauaauugauacgaucuguuuaucugaaugcuaaauuaaaaucuuucuuuuuuaaaagaugaguuuugcuauguagcucuggcuggccuccaacuugugaucuuccugccuuugccucccaaguuuugagaucacagacaugagccuccuuaccuggccuuaaaacuuguuucuuaagaaaacuuuuguucccuuguuuuaagagagcaaugaccagauauguaagauuaaccuuauucuuuucuauacuaaaggcaggcgagagacugcaaagacaguuucuaugcaagcuuuuaacacugaugugcauuuucucaacacaaugcaaaagaagaggggauuccacaagauugccaggcagcagggacucuaaguauuuauuuacuaugauuaacauucucuguaaaauacuguuugacugacaaccaaguuaaggauucuuucaacuuugcauaugagaaaacaagauuuuaagauuagugagcuggugucuuaaagccaucugugguggucugaauaagaguggccccauauauuugacugguuaagucacuauggcauggaacugucugaaaggauuguaaagauuaggggguguggccuuuuggaggaaguacgucacugggguggguuugagguuucaaaaacccaugcaaggcccagagucuuuccccaucuuuuuacccagaucaggacauagaacucugagcuacuucuccagcaccauguguaccuguguacugucaugcuccccuuuguggugauaaugcacuaaccucugaaaauguaagccuccaauuaaaugcuuucucuugaucauggugucuguuuauagcaagagaauagugacugaaacaccaucgcacuaggagagagucugggucaagaacuuguuuuauucuuuacauagucaauaucuacacuggauaauuuaucuguuaugggaagaaaucagaccacaggugcuccccuccagcauauacuuucaugacauuugaaaaauacagucguuaguacaacuaggcagaggguuuuuuccccccuuaaauagacuuacugguuugcacaaaaaaaguuaucuuaagauucaauagugguuaauuggaugagaaauggcaguggcugguauggaacugguugaguauuugggugacuggcagggacugcagacuguguaaaauucuggcuagagucaaucauucucagucagucauagucauauuuccuuuuccauccuuuucuucugucuuccuuuuuugugguauuaaggaucaaugucagaacuuugugcaugugggcaaaugcucuaccuugaacuguguguccaaucuuacauucucuuuaucaaaguuucgcacugucuucaagcacagaggugcccugagcagcucugaacugggcacugugagcuacagucuagaccaauuccauaaagcacggcauacagaaagcuggagaaggccaacucagacaggauuacuggagggcugacuugggauuagucagcaggaaauaucuuacuuccauugaagaugugagucucguugauucucccaaccacugucuccuugucauugcuuuuguugaucuggaccaggccugcuccagaggagugguugcuagcuucccggcauacucugaauauguagcuguaugugucugagcccuggcccacaguacucucaaaacuauacaagaaaaggaggaagagaaaaagaacaggauuacuaguuaccaugcucaggaaagcagucucccuccuccuaucaaaggcauaacaucauugaauuaugaguuauuuguggccccauagacuguccuacuuguugauaauaaguucaaacauaccauccaagacagcaauacccauucuagcuacauaaaaguguuagcuguuuccccacagcaaggguuugucuguuuucaugggauaguccuauguuuaaagaucauuuucauguuuaucugaagauucccugacacagaggaagacauacuuagacaugcauauguuuacaugugucuguuugagguuucuaaagucuuauaugaagccaucaaguaauguuccaauuucuacaagcugguguuuuagacccugucuuuagaaacugauacuuuucugugaaagagaagaaaaacauacauaguaucauggcugugaacuugguaucaaagaaggggauguauuacagccaaauaaaacuaagaguugcuaaaguucacauuagagccuguaccgcaccccuuccacauuaaaccuaaaguaaacucaugaaagagaaaagacccuuagacccuuagauaguuucuucccucucagguucuuuuuuuuuuuuuuuuaaagauuuauuuauuauauguaagcauacuguagcuguuuucagacacccuagaagagggcaucagaucucauuacagaugguugugagccaccaugugguugcugggauuugaacucaggaccuucggaagagcagucauugcucuuaaccgcugaggcaucucuccagccccccauuggguucuuuaccuuuuguuaaacaguggccguaaccucuccaggagagccaccucguucuuugacuccuuauccuucucuccuaccaggucacacgauuuuucuucuaucugccaggauucucucacagccacagccaggaguagcaacaauaacaguucaguccuccagcagccagagaaggggaacauucuuuuggaagaguguguugaaggugaaggcaggaucaggagagaaacaaaacagaucaaucacacaacugugcaaaaaauaauggcauuuugacucugcaaaaagcaugacugcuucaaaacaaacgggggcucaguguagagccaaaugccuuuaaucuccacacucagaggcagaugcagauggaccucugugaauuugaggccagcaagagauacuuggugagacaaccugucucaaaaaccucuaaaacccaaaacccagcgaaacaaaugggggagggggauguuaagaggaagaaaauauaagccagggugcacccaucuuugcauuguuacuguuugaugaauuuauguuguaguaucccauuuuucaaagucaaauacuaguuuauaaauaaagccuaagucaguggccuucccuggaacaucccaucaugguuuacacagauccuagcuugaaguuauuaugaaaaauguaaggaagagagagaagcuugacuuugcugggcccuaacauaucaguagggaacauccaacaaucuuucuucacauucacuggaagcauguggaaugugggugaagcagccauaguaccuuaacucaccucaauuacuuaugugccauuucucuggggaaaaaaaaaaaaaaaucacccaaucacagaagaaaacucacugggucaaaaggagugaccagaagucuuccuaaaucuaccucgccccuucaagucacaaaucuuaaggccagcuaaacuuucaguaagauggcugucuuuuuacacucuaaaguucugaguucacuuucuguuuguauuauucuaacaggcccauccaaacuauggcccauuggacacauauauccccugauaccugugaaugcagcccaacauauucguggaugacaauguucuauuucaauguugaaaagcuggcuaccuucauaguuaggccauagugacugaugcuugcacaaggcuucuacuaguaucuauuaguaacccuucaggccauugacauuguuuauuuuauaaugguuuuacucuuuuuuugacaguuaacucuuccagacauucuccacaagagagugaaagcucuaacccugugcucuaaauucauuucccuuucucccugaaagguacaucugaguuuccauuucccauaugcagggaggguaacacacuuacccauacucccccgccccccacaucaacucaccaauacaaacauuuacaaggcauuuauuuccacccaguaaucacacguagccaagaggucaaaggcacuccuaacucaucucagauaggacauuacagaacaugugcagcagagggacagccuucagccaggcacucucugaaaugcuaccagacauuaacuagucaauccucuccaaaccauguauuaaacuuaacggucucuguuucacaaguaaaaauuacaggacaaacagaacaaaugccacugacacagcuaauggaguaagauggauggcuccagagucaucuauccagaagggagccaacccagagcugccuuucuccuuuuuaaaacagaccaggaaguuggaaguuaacuguaacaaggagcccagguuuaagcucuccccuccccugagcucagcuauugcucaaccggucaccucaccuagagcuccucuguuaaccuacucggugccauuuucugcaaguucucucaggauuuaauuuaaaaaaaguaacauucugggcucugaggcgcuugcuccccaggacauauccuggagggaugcucucacagaaugaaugcugugcacucuggccuccaaguuauuuccucauuuguuaacuguugcugcuuucucuucccaaauuagggcaaagaauuucacaaaauugggacaggaugaaaaaauuaaaacaagccacgguaggcacuggaugaguggaacuguuugucauuugcuuaaacguucaaaaaguuaguagaagaauaacuuuacacuucucccagcuuaagauuugagucuaauuuugagcugcuucuccuugauucagugugguguauguuugaaaugcuaugccugcauuguguuaguuacacagccuagaaaagaugaggggucugacgcuuagaguugcucacugaguuacuuguccuaggcuacacaaauauuaaaucaaccuggaugacuuaaugccaugaaggcauuuguggucaaacuucugauaaauacaggcccaaauagagagcaggauaaaacugaaagcugggcaguuccuauuuagcaugguccaaagagauccccagagugcaagcacuuauaacucucagacgcuguaaaacaggaucuuaggcucuugagaauuccccuuucuuauucuauagagacagaucuaguggcaaugcugaaacauucucuauaggacgccgagugacuaaguuagggguugggaaacugcugaccucauucagcccugcacgcauuuuuccacucauggccguuuuccauuuucuaauggagggcuuuauuuucuuccuccugguucauugcagccaacacguuuaagaucagucucaacuggcagaaaggcccaauguuuaaagugccccaaggagguaguucugugcuucaaagucuccacagaaacacaagacacucuugucacucuuuuccacaccaugcuaacagaccuuccucgaacuucuuccaggagucuggaaauucucgccuucuaucuacucaaagucauaccuuacccccaaaugacgccaugacgccacuuuacucccacgauacaggucaaaauucucucuacaagaauccaguuaacacuucacacaugagcacuuuccuuuuccaaccuucaaaacaucucaaaucccucucugaucuuggaacuccucuuccucacuccuagaagucuggcguucuccguucucaugccuuuugccucaaguccucccuagggcucccuagcaggaucuccagccagaaccacggccaagcgagaguccugguccgcaccuccuucaguacagaggugugcgaggaccccagcccgcuuccuccacgcccccaacacucacgugucacgggaaaacagagcaaccgcggcucagaagcccccaagaaugugucucugagguuggaagacgcguccggagaucaggggugcgggggcgcagaccccagucccucgauuccucucugaagccagcgcuucccuaggcgccucaaugcgccccgcuccagaagccggaaacaggaagcagcgagagccugcugagcaacugcuccucccacuagacuccgcggcgugugaccgcagaaccuugguucccuggucucucuuuuggacgcugauuggucagcagccuaguucgcuguuccccggucccaucaacuccaaucacucggagauugucaagaucaguuucuucuuuucgggucgccuuucuaccaaugagguucgagcuccgccuccagggacucugggcgggcgcuccucauccacgcggggucaugcgccaggugucccaauaggucugaagacaguacgugagggcgaucuguggaacuacaaagag

SEQ ID NO: 3353 - RNA, 1316 nt, Mus musculus
ugagacgccaacauggccucucccagggaagucccguaugcuuccaauuuagggacagccuuguggugugggcccgagacuccagggcugcacagcuucuaguauccccauucucaucccgaugcaguccuuuagauaacugaagacgguggaaguaaggauuccccacgaaugacugaguaaaagcagcgucaggucaaccaagagugggcagaaagcagucagcccaggcgaagccuuuggaaugggagguuguagacugucacagccuuccgcucagugauggcaccgggaacuguggccuggaucacccugauccccaagaaucuaaguuaggucugcuggguguggggggagcagcagcgccuuggagaggacugaucugcaaaaggaaaaguagaggcguccgcacccgagaaaaggggugucacgauuauguggcugguggggugucacgauuauguggcucuuggcuugucaaaaaugggaacguagucaguguuuuuaagcaucaguguggacuuagggugaacaugcagugugcgugcgcuucguggauguguaguuuguucuccggggguggggcugggggaggaguuccugacacugagauuuuccaaaaaaaacgauucugacuuuucugcagacucuaucccaucgcuuacaugaaacuuacuggaaucaauucccacagccaggucucugggaaagacuuggaguccucugagagcccucugucugcgggcgauggcgauagcgaugccaacccagccuucggggcaauaccgccaucugcugacgaggcuaagaagaaaauacaggaaaacaagacucccauuaugaucugggagauugguaagaaauucagagccaaccagagaacucacucauacaaagaaaaggaccgccacggagaggagaagucagaaaggccaccggggaaguacggacaaagaguugugaucagagacugaacagauacgggauccaggcuucaaaggcucuuccuggagagauauucuggaaauguccugcaucuacgacacagaaccaaucugaaguggcagacucggucugagagcagagcugguuuucaggguccagggucccacagcuuaccucccugaguggcagugcugucgaguggaggguagcaacugccaucuccuggcuucuugacuuuggcaucuaguaaaguuuucaagugcauguccugaccauagagaccaacaaaugaugcgucaaugugcccaaugaggucuagcuagcucagccacaaauguauuaaaaauaaagauguuuaugcuuucuacaag

SEQ ID NO: 3354 - RNA, 1316 nt, Mus musculus
cuuguagaaagcauaaacaucuuuauuuuuaauacauuuguggcugagcuagcuagaccucauugggcacauugacgcaucauuuguuggucucuauggucaggacaugcacuugaaaacuuuacuagaugccaaagucaagaagccaggagauggcaguugcuacccuccacucgacagcacugccacucagggagguaagcugugggacccuggacccugaaaaccagcucugcucucagaccgagucugccacuucagauugguucugugucguagaugcaggacauuuccagaauaucucuccaggaagagccuuugaagccuggaucccguaucuguucagucucugaucacaacucuuuguccguacuuccccgguggccuuucugacuucuccucuccguggcgguccuuuucuuuguaugagugaguucucugguuggcucugaauuucuuaccaaucucccagaucauaaugggagucuuguuuuccuguauuuucuucuuagccucgucagcagauggcgguauugccccgaaggcuggguuggcaucgcuaucgccaucgcccgcagacagagggcucucagaggacuccaagucuuucccagagaccuggcugugggaauugauuccaguaaguuucauguaagcgaugggauagagucugcagaaaagucagaaucguuuuuuuuggaaaaucucagugucaggaacuccucccccagccccacccccggagaacaaacuacacauccacgaagcgcacgcacacugcauguucacccuaaguccacacugaugcuuaaaaacacugacuacguucccauuuuugacaagccaagagccacauaaucgugacaccccaccagccacauaaucgugacaccccuuuucucgggugcggacgccucuacuuuuccuuuugcagaucaguccucuccaaggcgcugcugcuccccccacacccagcagaccuaacuuagauucuuggggaucagggugauccaggccacaguucccggugccaucacugagcggaaggcugugacagucuacaaccucccauuccaaaggcuucgccugggcugacugcuuucugcccacucuugguugaccugacgcugcuuuuacucagucauucguggggaauccuuacuuccaccgucuucaguuaucuaaaggacugcaucgggaugagaauggggauacuagaagcugugcagcccuggagucucgggcccacaccacaaggcugucccuaaauuggaagcauacgggacuucccugggagaggccauguuggcgucuca

SEQ ID NO: 3355 - RNA, 554 nt, Mus musculus
augugcauagauguuugccuguaugucguguggguggccggugcagguagaagccuaaagaggaugcuggaaacccuagaacugggguuacagauggcugugaaccaccauugggaucccgugacuucaaccuggagccuuaggaagagcagucagugcucuuagccacugaggccagagucaucucuccagccccagguuucccuaaugugucugcaauaugcauuuaaucuauuuaucuauaucccagcauauuuaacucgggaggacggugcaugcuuaggguuuuuuuuuuccaagcuuuuuucucuaaucaguuuugcauacucgguaauugaguaaacugaauugcuucuuaauaguaagacuuugccucuuaguuagcuaaguucuagcauaacuguggacugcuuugggcgucuuggaugaaacagacacgguuauugugauuugaacugcaucuauaucuaggcuucaaucaauguaaauaauguguuuauauccagagaaccacagaaucaaaacaucacacuaacaaacauuuaaacuguuug

SEQ ID NO: 3356 - RNA, 10808 nt, Mus musculus
guaaaaugacaucaacucaacuuuauuucccaaacaauuuuguucccaaaagaccagagaggccaaugaccgaccaccuuuaacccaaugaguuuccuucagggaccagagagaagucucuguuguuuggguaauuagauaauccuucggcugccugaaagaacugcguuucuaagagaguucaccaaauugcagauuggcuuccaugggcuucuccuucucuacuuggagucaugacacacuguauuuauagacagcuugaucaagugguacuuucucuucgcacacaacaccagcuugauuuacugcuaaggaaauagugcaaaaaaagaugaguaaaagaaaaacuaucuucagucuucgacaaacgauuuucgcaauaggagaugggccuauuacgauugcaguuauuacagucacuggcaucacauagcauguacacacacgcgcgcgcgcgcgcgcacacacacacacacacacacacacacacacacacacacacacacaccccuuaauugccuuccacuuaaaacgccagacgccaagucagagacgaaaucucuucaauaagcuuuuuccucccuccuuacaaauuauucuggcgccaccuaguggccaaggugcaguuugcaguuuuacaacguggcguccaaacaggcacuuccgggacacgaagguaaucccugcaagguguguauccuuugucccauagaugugcagcuuuccuuuacccaacaaagccaguguaauaaagccauuugacuccaacaagugcuaucuuaauaagagaauuaucuuuaugcugggagugauggcacacaccuuuaaucccaacccuccagaggcagaggcagauggaucucugugaguuugaggacugccuggucuacauaaugaguuccaggucaagccagugcgacauccccacaagcaucccaaauggccugggugggagagcaugcaggucacgucaccagugcucucugcucuuucuccagucuggcugccacguggaauuguuguuccuacgcuacaucucagacugggaccuggacccgggccgguguuaccgcgucaccugguucaccuccuggagcccgugcuaugacugugcccggcacguggcugaguuucugagauggaacccuaaccucagccugaggauuuucaccgcgcgccucuacuucugugaagaccgcaaggcugagccugaggggcugcggagacugcaccgcgcugggguccagaucgggaucaugaccuucaaaggugagacuugcacacuggagagagcggucugaguugccacucagagugagugucagcggggaaacuggggguggggugcuacuuaaagaccuucaguucguccuggauaucaaaaguauuacuuuauuuuuugagguaggaucucgcuaucccaggcugaccuucaacuugcaauucuccgaccucugccuucugaguggcggaauuacaaguauacaucaaucucagaauuaucagaauuugagagauagaaguuggcagggcuacaggugcgcucaguggcagaacucugguccagcaugugcaaagcccugcauuccaccuuuagcagucaaauaauaaauugaggagggagaggaggaggauaguggucagagagaugguuccgugggggcccuugccuuuguaccuuaaguuuaaccccuaaaacacucugacuuucugaccuucaccuacacacacacacacacacacacacacacacacacacacaccuccuucuuauuuaucuauuuauuuuucuuuuaagacuauuuuuacugcuggaauacauuuguagaaaaucgugaaagaacuuucaaagccugggaagggcuacaugaaaauucuguccggcuaaccagacaacuucggcgcauccuuuugguaagucugccugucugucugccugucucucugucugucucugucucucugucugucucugucucucucucucucucucauacacacacacauacauacacucacacacacacacacacaccuggagccucuuaguuauuuguuuguauuaugcauuauuuuauacaaugauuacuucaaggcacuuacaacccaguuuucuuuucugcuuuacccaggacagagcuuccacuuagacgcuugccucuugccuccucuucgcucagucuucauaacucuuuccuuuugcuaaccuccccucaggugggguuccuuccagggcagaauucgccccuucuuuuuuuccugguccucaagcaauuuacuuuccucuggagccacccacuucguuuagacacuuuccuuuccagagaucaaauuuaaagcccuucacuccguuuauaucaucucucuuucuccacagcccuuguacgaagucgaugacuugcgagaugcauuucguauguugggauuuugaaagcaaccuccuggaaugucacacgugaugaaauuucucugaagagacuggauagaaaaacaacccuucaacuacauguuuuucuucuuaaguacucacuuuuauaaguguagggggaaauuauaugacuuuuuaaaaaauacuugagcugcacaggaccgccagagcaaugauguaacugagcuugcugugcaacaucgccaucuacuggggaacagcagaacuuccagacuuugggucgugaaugaugcucuuuuuuuucaacagcauggaaaagcauauggagacgaccacacaguuuguuacacccacccuguguuccuugauucauuugaauucucagggguaucagugacggauucuucuauucuuucccucuaaggcucacuuucagggguccuuuucugacaaggucacggggcuguccuacagucucugucugagcaaucacaagccauucucucaaaagcauuaauacucaggcacaugcuguauguuuucacuguccgucguguuuuucacauuuguaugugaaagggcuuggggugggauuugaagaaugcacgaucgccucugggugauuucaauaaaggaucuuaaaaugcagaugaggacuacgaagaaaucacucugaaaaugaguucacgccucaagaagcaaauccccuggaaacacagacucuuuuucauuuuuaaugucauuaguuuacucacagucuuaucaagaagaagaguucaaggguucaacccaauuuucagaucgcgucccuuaaacaucaguaauucuguuaaagggaucaaacauccuuauuucuuaacuaacuggugccuugcuguagagaaaggagcaaagcgcccagauccaaaguauauaguuaucauagccaggaaccgcuacucguuuuccauuacaaauggcaaauucuuccccgggcucuccucauagugccugagacggaccacggaggugaugaaccuccggauucucuggcccaacacgguggaagcucugcaagggcgcagagacagaaugcggcagaaauugcccccgagucccaacucuccuuuccuugcgaccuugggaacaagacuuaaaggagccugugacuuagaaacuucuaguaauggguaccugggagucguuugaguauggggcagugauuuauucucugugauggaugccaacacgguuaaacagaauuuuuaguuuuuauaugugugugaugcugcucccccaaauuguuaacuguguaagaggguggcaaaauagggaaaguggcauucaccuauaguuccagcauucaggaagcugaggcaggaggauuguaaauuugaggccagucugagcuguaaggugagacccuauuucaaacaacacagccagaauuggguucugguaaaucauacuuaacaagggaaaaaugcaagacgcaagaccguggcaaggaaaugacgcuuugcccaacgaaauguaggaaaccaacauagacucccaguuugucccucuuuaugucuggucucccuaacaacgaucuuugcuaaugagaaaaauauuagaaaaaaauaucccugugcaauuaucacccagucgccauuauaaugcaauuaaaaggcccacaagaaauccuguauacacgaccguuauuuauuguauguaaguugcugaggaagaggagaaaaaaauaaagaucauccauuccuuccugcaucuaucccuguuuuuuauguugcugcguggcaucuauucugaaauauuaaagugggugccugaaguuucauaaauuugaaacuuuagagauuacuauauaucugcacucgucauugugaucauccaaaaucguaaugauuauggcucggcagcugugcucuugauuuuuagcaacucccacccccacccccacccccacccccacccccaacccccacccugcgugcagcaaguucauccuggcuuauuuuaaaucaacugaauucgagauuaaaaugugaaaguuuuggagaugaacuacugaauaaaaugaugucgggaaaaagcauuuauauauuaaagucauacagaucacagggaagguggcgcauguauuuaacccccagcauuggaaagauggaggcaggaggcucucuguggguuugaggucagccugaucuagacagagugcuccgcagauagccacacagagagagccugccuuagagaaauaaauaccugaugaaauagaauugaauugagaguccagaaauuaacccacucagcuaugaccaacugauuucagauaaagguccaagguguacugagucagcaaacccugcuggggcaaucugacaucaggugcaaagagugcaguccacauggugacaccugccuguccccuacucgggaggcugagacaagaagaucaguaguaguugcaguaaaucuccacccaaauaugcccuggcaaugaaaacacaacucaauuaauaugaauacaugcugugcgccuagauugggcagaucuaccgcugcacuaccaucuucuccaucuaugagacccuuuagaacuugcgguuucuaagguuuggggguauaauuagccccagggcuauccacaacacuguccuaggcgcauuuccuaaacacgagcuuauucauaagcccagccagaggguucacauugcccacaacacacccuccuuuccuaccacauaaccaaagcccaaacucuagaacugguucuaacugggaauucucauggcaucccauagcauauacccccuucucugcagugagcaauauguccaguauuuccuggaaaccauugguacacaaaacucugagucaccaacacccgcugcucugucuacugaacuggcuuccaauguuaacuaauucauuugaguguguguauuagugugaguguguguuaguuacuuuugcuguuguugugauuaaaacaccaugaccaagggcaaccuaaggaagagagcguguguaucuuggcuuaugccacugagaacgaagccaucacugugggguggaggcauggcuucaagugucaggcaugacgugaggagcaggaagcugggagaucacaucuuuaacagcgagugccaagcagagagggaaacuggaaguuaaagcccacaagugaugugcucccucagccaggcugcacuuccugaacaccccaaaacagcgccaccuaccuagaaccgacuuugaauaucugagccuauggggacauuugucauucuaaccacuguugugcacuguuguugcacagugagccaucuugccagcucauauuccacaauuuguauuucauuuuaccaaugcucucucuguaguagugauaaugaugacuguucccuuuuuugguuuugcuucguuuugagauuucaguauuuuucucaaguuuuauuuuaagugauguuaauuacagcguuugaaggggaggagcuaauuccacucaaaauggaagacucuauaauguacccauuaaacugcuaaaaaaaaaauaauaauaauaaugguaagucuacaagaggagucaguuuagaccccuaguguugucagagugugaccacaaucaccugcccagaucagagccagagaacccggaagcuauuucauacucuggugcaauggggggggggggggggggagaaauuuuaaaaaaacaaaaaggaggaagaaaaacacacacacaacacaaggaagaauuaaguccugauugacugacuccaucuugcccacccucuccacccuaaaauggcacaaaagaaaauaccacaccuaaagacuacuuuugguguaaaacagguaacugaugggcuaggaugggaacaggguaugaugaucugucuaaaaaaauguuccuuucacgaagguguguacguacuucugagcagauaggaucgggacaccaggguucaaugcuugggaagucacaauuucaucuggggacuggauacagauuuacaaaggguccacacauucccagcuuccauuugcagccuggcaucucuagaggcuccuccccaagccccaacccacaccuacagcuagaaaggacccuuucuggaaugggguuucugcuguaccucugaaaugguaaacaccuuaaagcugagucauccuuagccuggagaggcauucaucaacucucgcauccccaacauacaauauuaaaaguccacuaaauugguagcuauguugcaaaauaguucaaaauuaacgauuuuacaauauucauuuaugcuugaaauucuaguccuaagccaagcuugugucugccagcauugauguucuugcguccaguagggcugacaaugucaguuugauaccugguuuuaggaucugaguguacccuaagccaaucaggcuggaguuguucacuuugccagaaaagcaggcaucaggguggaacugaaauuuggcugcuauuccaaagcgaguguuacuguuuucugcaguccaggcgagauugacagcagucuccaacuucuuguucgccuucugguaaauggaaccaccaaacucugucccgucguaugaagcugucuugcucugggucacucaggacuucgaggucucaaaauucaucugguagccagcuagccaacccucauagccaagcaccggauugagggcccagcgaugucaaaguccacgccacagcccaaguugaugugcucccucuuguacccugucaugauuuuuagcauuuucccccaaguuuugggugaaaaagaugaaucgaaggucagcuucaguccacaagcaagcuggucucccacggugaucucagugcccagggugcugucuguguuccacuucuccguaaauguuugcccauacucaguccaucuguccuugguuuccagacugccguucacucugguggucuccguguuggcagagccugagcugguaaauuccaaucuauucuuggacuucguuuucaaaucaaguuuuauuaagccaaagcgguagcccuuggugaagacaucccugauggauagaggcagcugcgaugggggguugcagcgaggaugcugggagcgcagcgaauaggcagagggcggggcagcucucacgauuguuucuuaagaagacuuccuuuaaaauuaauacuaauccacuaacuacucacucauucuuccaggauuuuacugaucaauugcuguauacgcauagcgccgcggucaucguuacacagacguguuaagcacacaaagacugcuuugaagaaggcugaaagaucucggggcuggagagagaacucugcaguuuacagagcuucuugguccuccagagaacccaauuucaguucccagcauccacaucacacagcucacaaccgccggaaacuccagcuccagaggguccaacaccccuguucuggccuccaggagcaccuacauacaugugucaugcaaacacacacacaaacacacaacacacacauacauacauaaauuaaaaauauauauaaauaaaucaauccuuuuuuuuuaaagcagucuuaaaaucuguggaccuagagaaguauuaucugaaauuuugaaaugggacccaaagaacgucuucucacaggaacuaauacuuacagucuuuugaagcauagguaaauguucaaucggugaugauaaaccuagagacugagacugcagccaggcugggagaggacuuguccagcaugcgcuaaguccagugcucagcccacggggccacacacagcuggguguggugguacaugccuaugaucccagugucuguaagauggagacacagggagcagaaguuucaaggucagaccuuaaaaaugccucggaugcuaaacacauuugccacagaagccugacaagcugaguucaauccuuggaacccuuuauuucauuuauuauuuacuuggugagaugugugcucugggauuaaagaccugcacccccacacccagccucggcccuuguuuuaacaagaggcuuuaucagccugaggcucaacacucguuacuuuuacuuccuuggaggauuacauuuucaugaugugcaacaguuucauauuuuguuugugcgugaccuuuaagacuuuugucuccaggcgugguggcacauaccuguaaacccaguacucgggagacuuagacagguuugggaguugccagccagccugggcuacaucacaagacccuuuggauucuccucucuguaugcaaacacuccccuccugucucuucugguccaugggucugcaugcagccccaguaaagagaaacaaaaaagagauacugaggcagcuucaaccguacccuggccuguuuucuaucucugacacuuaaugcugcaaugcaaagcuuccuggggauugcaccgugguugaguguacaagaguuguucugggucccgucccacauggcuaugaaauguugaaaguagcgucugccuuauucuuggcuccucaacucccgacaacacacugaagcagccuuccccaaaaaauuucuaauuccugcccugccucaaaaucugggaagccuaucgauccuguaaaaugggauucuaucuggaggaggcaacguuaccuaggaaaccuaacacacauuuagguagagaaugguuuacaaaguuaagugagacuuagggggagccaaaaaugagguagugaagagucccugggccaguugcugcucaagaccugucacccucucugggaggugugauaaccaggaugggacaggguuggcuguaaagagacaaccacccugggagggaaccuuaguggagucacaggccaucugggagauaggugaaaagucaggcaagcuguguccacaggaagaugcucucgucuucagagcgugaaaucuacucugcacaaauaacuaccuuugagugcuaaucaaaugugaucggccccugggguuuuaagacugucaugguccaugcaauuugcuuucuucuucuuuccaauuuaaaucucacagggugucacauauuaccagacacgagaucuaaauaggaaacugaagccaaagaagcagaagacggugauauacagaaagacuccauaaacgucccacaacgucuguauaaagagcaaaccgagaaagcacccgcagcggcuggcuucauaguucuuucccgguagccccuuuucuuccccaagguuucagugcucuguuuacucccaauggaaucuuuucacacaaagacaagauuucauaaaacagcaaugacagcuggguggggacgccuuuaaucccagcacuugggaagcaguggccaguggaucucugugaguucaaggccagccuggucuacagagugagcuccagggcuucauagagaaacucugucucaauaaacaaacaaacaaaaacccuaacaaacaaauacacaaacacacacacacacacaccccaaaguaaacauagcaaugacuuaggcagugaaggaagggugcucaggucccaggcugugucugaggauggcucacagcucagcuguuaacucauuuaauuacuuuuuaauuacuuaauuuauucaaguucccaggaaucugucuucagugcaggacuuagcacagucacucaggauucacuggggugggggugggggggggugauucugcuauaaauuuauuccaggagcugaggagcucagagguagagugcucacccuggagggggggcggggggagaugggcugcauucaguccccaacacaggagagaaagggggugggggacaggguggauaugguagacugugcuuguauugggagcccaggcagaaagauucugagagugaggccagauugggcuguauaguaagaccucgucucagacgaaauagaaaggaagggaaggacaacaaagaauaacaaaaauaaaggcagcucuuccugaagacgcaguguuuguaauucugagauuuuuccucucugucucucucucuuccuuuuauucuuucucguucuuuccuucuuccuuuuguucuuuuucuuccuuccuuucucucucucucucuuucucuuccuuccuucuuuccuucuuuccuuuauucugccucccaaauucuggguuuauagccuaugguaucacgccggguuuauauguuuuaaaaauagaacauagggcuuccugaaagcuaggcaaaugcucuacugacugagcuccaucuccagcccuggaaacuuauggaccucaauuugagacaccgucucaguccauuuugucagacucugguucucaggaugaucagggugaccacugagccuaggcaacaccuuuaguacugaagaccagauuagcacccuucuaacuauagagugaacacacuguaccuucugugggcgggucagcucuauccaccaaguccacacaccagugcaca

SEQ ID NO: 3357 - RNA, 752 nt, Mus musculus
gacaggguuucucguccuuuccucuggcggcagccaucaggugagccaagaugggugcauacaaguacauccaggagcuauggaggaagaagcaguccgacgugaugcgcuuucuucugaggguccgcugcuggcaauaccgccagcucucugcgcugcacagggcuccccgccccacccggccugauaaagcucgaagacugggguacaaggcuaagcaaggcuaugucauuuacaggauucguguccaccaugguggucguaaacgcccaguuccuaagggugcaacuuacggcaagccuguccaccaugguguuaaccagcugaaauuugcccgaagccuucagccuguugcugaggagagagcugggcgccauuguggggcuuugagaguccugaauuccuacuggguuggugaagauuccacauauacauuuuuugagguuauccucauugauccguuccauaaagcuaucagaagaaauccugacacccaguggaucaccaaaccaguccacaaacacagagaaaugcgugggcugacaucugcuggccgaaagagcgguggccuuggaaagggccacaaguuccaccacacuauuggugguucccgccgugcagccuggagaaggcgcaauacucuccagcuccaccguuaccgcuaauacacaugauauuuguaaaauucauauccaauaaacaauuuaggacagucaaaaaaaaaaaaaaaaaaaaaaagacaggguuucucu

SEQ ID NO: 3358 - RNA, 7147 nt, Mus musculus
cuaaagguaaaauuaguguuuuauuuuguuuaaacuaguccagcuggcaucgguucaucaugguacagucaaauauaaacaucuuucuacagauauuaacauagcaguuacucuugggggacuccaaggacaagcaagcaccuuaauaggugaaagcuuuuauuuuguugagacuuuaguuuuauuauuuuaucgagaugcugucuuacuauuuaaacauaguacagguuggccuugaacuuauugcauaucugagcuacccucaaacuccugguccuucugucucauccucgagaguagccaccauaucguuauacuuuguauauacuuuuaaaccucaccccucaaaaugacacaguguauaccaagacccacgcuucuaagaaaaaagacuagcaugggugggugggcguggguaaggguguucaagcacuuauucuugggaaggagagaguauaugcaccucacugucuccaaagccuagaguuaacacuaaaaaaaggacaaauucagaacuaagacaaauacacuaacacaccaaguuguaaauagagcucagaaguugaguuggugcccagcauguucuaaguccuagguuugcucuggcaccaauaaaaauagaaauagaaauaaacaauauauaugccagguguggugguaugccaccuuuggucccagcauucaggaggcaaagauaagugggcagaucucugaguucaaggccaggcuggucugcagagcuaguucaaagacaauuagagcuaugcagagaaacccugucuugauaaacaaaaagcaaauaauaauuaaaaaaauaaaccaggggcuggugagauggcucaguggauaagagcacccgacugcucuuccgaaggucaggaguucaaaucccagcaaccacaugguggcucacaaccauacguaacaagaucugacgcccucuucuggagugucugaagacagcuacaguguacuuacauauaaugaauaaauaaaucuuuaaaaaaaauaugaaaauauuuggaagaaggaaggaaccuggcuuugcccugacuuuaagcccagauguugcguaagucucauauuucaccugguggagucacagaguaguucaggaauaauuccaaggcuuguggggugcuaaaaugcgcauggcuuucccuaguggcuuccaaauucaccuccaaaucacuggcagagaaguuuugcugcaacuguacguaaggcugcagaaaguccuccccgaaguuauggagcggagcagcauuccaaggcuggccguuccaggacugagcgguccaggccuggcugcuccaaguuggguugguccaggucugguuguuccaaguuggguugguccaggucuggcugcuccaaguuggguugguccaagucuggcugccccacauggaaaggcuuccagaugcguucaccagauagcccuggggauagcugcaauggaugcugggauacuccacuggugcugagcccuucugaaagaggugauuaaugcaaugagugaaaaggggacucuaaagauguaaacugcagaaauacugaaaagauuagcauggccgcacaggccguuaaccccagcacuccugagacuaggcaggcagaucucugacugccagggcuacauagagagagccugccucaaagaaccaaagaucacaagaaagagugcguggaggaagagggaugggaaagggacaggacuaauggacauagauggaucaggaugacacugggaagcaaaggcagagccacugacugcucuuacaggaaaucugggauccauacccaacagccauaggucagccacacacacacacacacacacacacacggcacagacacauaaaauaagaugguaagauggagggggaaaaaggaaagcagagaaaacaucuuguuaccugaaucagaccauugcuagucuucaaccacugguuuuucugccaccgcuugcacuucauccuuugguuuugaaaccaggucuuaaccugcagagugacaggacauucgaacaagcuaagacauacagaaugcagacaggucuacagcccgaccuuaaacaugacagccaggccuguaaagugaaacucuuucuugaaaaagacaggugcugggggaaauggcucuucuguuaagagcacuggcugcucuuccagaggaccuggguucaauucucagcggccacauggcagcucacgacugucuguaacucuaguccaggagaucugauacucucacaaagacaaacacaugcaggcaaaacaccaaugaacuaaaggaauuuaaaaauaaacaaucuuaaaaaagaaaagaaaggaaaaaagccaggcacaccuuuauuuccagcacccaggagacagaggcaggugaaccucucccagccuggucuacagagaccagucagggcuacagugagacccugauuuggggaugggugugggaggugaaguagaagauaaaguaaccaaugaaacaaacugggaaauauauaaaucacauaauuggggcuggagagauggcucagcgguuaagagcacugacugcucuuccgaagguccugaguucaaaucccagcaaccacaugguggcucacaaccauccguaaugagaucugaugcccucuucugguguaucugaagacagcuauaguguacuuauacauaaucaaucaaucaaucaaucacauaauuaugauuuuaacaggcgcauaggauaggaggauaggauaguuagagagacguccagacguuaguucgauucauuagcaagucagucucauuguguuacauuacagcaacuucuaaggaccccaccugcuuauagcucagguucagaauggaggagaguucuugcaucugcuggaggcugagguacuucugcuucugaaaccuguccuugagugcacacagcugggccugagagaacacaguccgcaucuucugcuuccuggcaaggaccuuguucuccuccuccucagggcccuugucagccucaggacuugagagcuuuuguuugggacugguagaagaaucagggcugccuugaagaggcaggucuucagaggaagggcgaggagaggcuguuagaaauaaauagauaacuuguuaauaaauaagacauucucagccuggcauggugguacauaccuuuagucccagcacuugggacacucaagcaggcagauuauggguuuaaguccagucaguucacggggugggguggggguuauggcucagcgguuaagagcacugacugcucuuccgaagguccugaguucaaaucccagcaaccacaugguggcucacaaccauccguaaugagaucugaugcccucuucuggugugucugaagacagcuacaguguacuuacauauaauaaauaaauuuuaaaaaggccagucaguuuuacaaaguaaauuccaggauggccagggcuacacagagaaacccugaccaaaaaaacaaaaacaaaaccaaccaaacaaauaaaucauuuucccagauaauuaaauguuacauuuaauauauuuacuuacuuucuuucuuucuuucuuucuuucuuucuuucuuucuuucuuucuuuuuuuuuuuuuuuuuucuuuuuuuuugguuuuuucgagacaggguuucucuguauagcccuggcuguccuggagcucacuuuguagaccaggcuggccucgaacucagaaaugcgccugccucugccucccaagugcugggauuaaacgcccggcuauauuuacuuucaaagcaauuaucuucauagaucuaaguaacaagaaaaaccuaauuuuuggaaaguauucuuggaauacuuugucaccccuggguaacaccauuuugcauagaucucccuuuuauaguguuuuuuuuuuuuuuuuuuuuuuuuuuaagaauguuucuacuuagggggcuggagagauggcucagcgguuaagguuaagagugcagacugcucuuccgaagguccugaguucaauucccagcaaccacaugggauuaauuaauuaaaaaaaaaaaagaaugucucugcuaaauauuuauuuauuauuauauguaaguacacuguagcugucuucagacacaccagaagagggcaucagaucucauuacggaugguugugagccaccaugugguugcugggauuugaacucaggacuuugggaagggcagucagugcuuuuaccuguugagccaucucaccagcccuacauacaguguuuuuaaguuucauuaguuauuuaaauuauacaauuagacccugggaauccuauuuaaaaaaaaaaaaagacaacuaaccaaacaauacucaguucaauggcaggaugaagacagguuugaguuuguagucugcucuuuccaaucccuucucccugcucccucuucauuagaaccgugaccgcaucuacacuguaaaccucugauccugacaguggguagcacaaaucuaaagccccccugcuccaguagcugagaugggagaauuugagaucagcccgucucaacaaauagagacagacagacaagacagcacaagagcuuaggcagcagaggaucuagucuauguuugugguuuucuuuucuuucuaagggauagggucucagguagccaaggcuggccugcucucuggguccuaccucucuaccuucugaguggagguuuauccaaagacucagguuuggggggacuuuuaucucgccuagauuuuugcauggugcugggugaauagaauccuguugggaccuuucauacucuacuaccacugagucagcuauaucuauacauacauacauauauacauacauacauacauacauacauacacacacacacacacacacacacauuaacauuuagggaugaacuaauauuuaugaacaaaaaaugucaugacgaaauccauuauacugaauguuaucuaaggaaauuuccaggguuaaaucacuuguuguuaggaaugcacaguccugaguuuagacaccccccacccccaauuuuuuuuuaaagguauauuuuaaaaugaucccacuggggcuggugagauggcucaguggguaagagcauccaacggcucaguggguaagagcacccaacugcucuuccgaaggucuggaguucaaaucccagcaaccauaugguggcucacaaccaucuguaacaagaucugacgcccucuucuggagugucugaagacaacuacaguguacuuacauauaauaaauaaaucuuuaaaaaaauaaauaaauaaaaauaucccaccaucuuuucugcuaguacaagagcagccagucagaggguccaguuaauuauuaauuacuagaguaaaauuucgguuaaccaaauucguuucucuuauccuugacccucuagcucuucgguuagcuuuuuuguuuuuuuccagggccuucagcaagagacaagugcuccuccaccaagcuuugccccaacauuuccuagauccagcagcagguagaagacaccuccuacacugaagacaucugugcuccacgcugauggcaaugcugagguuagccugcagucuagcaaauaaguagacagcccugaaagcagcuucuaaauggaaaauuaugccaucugcuggcacuaggggcacgcacuacaaacacacaugcucuacacacaugcucuaaaaacacacaucacuuacaaaggcuauccccacccguucauuccuaacccagcacuuuucccaccuccaaaaucaaaaauugagggaggcagaggcagaggcaggcggauuucugaguuugaggccagccuggucuacaaagugaguuccaggacagccagggcuacacagagaaacccugucucgaaaaaacaaaaaaaaacaaacaaaaaaaaaaucaaaaauugaacccauaaaucagaaaaaucaagaugacagacauuaacuuaaaagcucagaaaaaaggggacacacacuuccuagcgcuccacacacccaagcaccgcugcacacacccgagcaucacugcacacacccgagcaucgcugcacacacccgagcaucacaacacgcaccugagcaccguggcacacacagccuagcagccucuugguucuaccauuuacaagccugaguacugggcugacucuguacagacaaugagcuucagaccuuggcuccagaugcuagcuauaagaaugaaugacuuaaacuguguacacuuguuugggguuuggaaggagcacugagcucacaaacccagaacugcuaagugacauccauauucccaaagguugagagaaaugcuaacugcuucugcuggagaaaacggccauuugggcaaauugcaaacuaacuguauaaccucaccaaaaaaauggggugcucauuccaagcuaggauguuaggucucccugcuacugaagacaccacucacugcccccgaacauauuccaaagagcccaaauauuuagguucucaaauacacacaagagccuuauauugcuccguccugugucccggaucucuauuucagacuagaaggccaacguaucaccggucaaacucagagggguuuccagaagagugauaaggacacccgcuuauguuaaugacuacuacgguucauaaagaagcaauaacccuucagcccguuuuuucuacucuuacccuaauuuacuggguucuucggggacugaauuccuuaccagccucugugcagagcaucucaguagcagacccuuguaagcaagaauaguucucgggaugaaaaacugcaggcauugaugaggcguucccagaauucgaugcuuccucagaacuaggcaaacuguggggaccaggaagacccacacucaugucagugugauggcgagggaagggauuucugaaaagguuuuaggcaacaaccaaaaaacucagugucuagaaggaaagaucauagaaagaagaguuaaaugucuaaugcaaaauuaucaagaagucagaaggaagugagccgcagccuucccacagaaagagcaagacaccaaccaaaucagccuaucugaaggccaacggcucaaggcgauagauuuaaaggguagguccugcuccuccccccucaagccuccuacccuacccacccccuauucucccaggcacccaggcggca

SEQ ID NO: 3359 - RNA, 73834 nt, Mus musculus
cuugugacaugacacauacauucagaaguuuuauuucaaaacagaaacuacaguaacauuaauagaaaguauguaugaagauauucacaagauggccauuggcaaauguaaaaacuccacuggaggaacugaagaggugaaguuagaggagucgccuuucccagcaaagccccuuuccauagcaaucugaguuuuuaaaucccaacuggccacagggaguggagaguugaauacugaaaccgagcacugagauauggcucuaccacucuaugcaaggguuugccuaaagggucugaaauguguaagcaccgagggugacagugggauccagugaccuguggaaaaggggugagguccaucaggguugucuccauuuauggaaguggaggaggggacaguugggaaggugucugugaccuauggcagaagggaaucuuggugauaucaacauaccaauaugccauguuucuuaacucccuuuaaauaaagccacccuuggcccacaacugggucuucaggagccacagcccugaccucacaccuuuccauugcgccuccuagcuguagugagguagagccuuccaaccucagaccucaaggaagcaccucucuccaacagggacagggaacccaauggguggcaucuaauccugggugcaagcuccaccuagcagaggcagugcugcuucuguacacaggguugaguucuaauagucgaucaauaaaaagcuacaggagccaagggaccagggacuucaugcccagagcaaagugacaaugcacagacauuugugcccucaugcguggaccacacugcacauucagucacugucucuaauguguguagcagagccaaggccccuugggcauguagcacaauagcacaggaaccuggaaacaagggcagccugagacuguaacagacauaggcuagcaugccacaacucuagagcaacaaauguacucccucaaaacaagucauuaauagucauccagcgaaaauccucucccagagcugagguaacaaaauccaaguuagcuaugaaucccuuuaaaccaaaaugaaacaaaccaacaccuaaaaucucuuaaaaaaaaacuaaguugaagaaacuaaugccucucaacaacuacugucuuugugucucauccacacggcucgcucgcucgcccgcccguuugguaaugggcuugaccaucagaaaagaaaaagcgagcucacaggacagagaggguguugguccagggaaaggagaggcuugcggugaccccucccuugucuggacuccaugcaacauaaaaauccaucaauaucacuaacuacaaagaccacuuuaguaacaagccuagauuuuaguaacacuacauaaaaacuauaaucuuaaaagaaaaggcccacagaaagccaugagccuuuuaguacaggcacucgcucuucugagaaauaacaagggauagugucccuucaucuacaaaggaagugacucacaggccaccaguaacauccauccucccuguuguaaccucucuccagcaccaaacuuucuuuccuccugaaccucucuuuaaacaccucccuccaaccucaauuucguuacugucucauuauuugguaaaauuacaauuaaaaaaauaaauauuuaugcaauucaaccugaagauaaaauaaauaaaacucaaguuacuuugcugugcagagcuguaucaagugaggagggggucuuuuguucaaucccccagggcccuccacacuggguaugaagaucuguuuccuggcaaacuaaggugguggugggggcggugcugcacccuacuccuacucccuaguuguccuaguuagcggguuuuagaaccuaaggggagcugcggccccuucccucccaauauaaagguaggcuuccuuggucuuuccugauuacaagggaaguaucccccaaaucaaacacuuaaaagccauuggcgaucuggucaaccccagcauugggugcagcugaguuuucauggaguguguggggugagaauagcagcacucagaagcaguccugguucauccugaugaggucuccccacuuaaggggagguggcuuuccacaguggagggaggugaaggaggugcucccggcucaggcguugccaggggucuccuugaccggcugcaugcuguucaacuccacaccggcagggccuuuuccagagugcgccugccccucgaaggcccgggcaauguccucgaaaguccugccuuuggucuccgggacuuugaagaaggugaagauuaggaagaagaugaggaaggcagcgaagaugauaaaaacguaggcuccuaaguaggccuaggagacaggagaaagaagacugcucauugcuggucgacuguuucauacaaauguaccaauguaaguguucauaaaugugaggggagccucacauuucuaucugacuagccuuaagcuacaagucuuccacagcaucauuggucaguugacuuacgaugcuauuacguaucucugcaagucauaugccauucuuuuuuuucuagucacaaaaauuagcugcuuccaaagacuuccuguggcuuuguuucugguuuuugagacagggccucacuuuuuagcucuggcugcccuugaacucaagagauucauuugccucugcuuccugagugccaggauuaaaggcaaaugucggcgcuggagagaugucucagggguuaacauaacuggcuugcucuuccagaggaccuaggcucuguuaaucccugcauccauaaggcagaucacucauaauggucuguaacccagcuaagcaagugguacaagacauacacaggcaaaacacauaauaaucauuaaaaaaaaaaugugugucaccacuucugguccuuccagggauuuuugauaauaagauauuugagccaugagccgggcgugguggugcaugcuuuuaaugccagcacucgggaggcagaggcaggugaauuucugaguuugaggccagccuggucuacaaagugaguuccaggacagccagggcuauacagagaaacccugucucgaaaaacaaaaacaaaaaaaaaaaaaaaaaaaaaaaagcaacaauguuucaaauacagauguguagaaagacucaugggaauagggaaugguuuauauaacaaaucagcuccacgucuuuuucuaacaggaaauccugaagaccaccuacccuuuaggagcacucggcucucaguacugacugaaaugaugauuucaauauuggucggauaaguuugggugcuugguacuguccuucuguuccuaccccaucucagguccucaaaaauguccaguuuucccucuuaauguuuuguuuugauacagggucucaauuguagcccaggcuggccaacccucuuuccacagcuucccaagugcuaggauugcagccgugagccccaugcuggcccauccuguuuucuugacaaggaagcaguaagugugauuuaagcgcuuagcacaaucauuuccccuaaggugaaucuuaauaauguguuggagucagucggcugguuugugagaggccauguuuaauuuugaauuuacuuacugcagcugaggggaagagcauuccgaccagaaaguuggagguccaguuacaacagccagccaccgcaauggcagcugggcgggggcccuggcugaagagcucagccacaauaaaccagggaauggggccagguccaaucucaaagaaggcuacguagaucaagauagccacaauacagacaaagcucauggcuucauagucauccugcaagagaaagcaagcaagcaaaguccguuuaaaugcaugguaugacauaggauccauuuucagagcugcugucuaaagcugcagucacuccgcuugugaguaaaaagccuagcguuucugaauccaagcuacaggccucacccuucucacucuguaccaagaccauggcaacaucuguaaaguggaacuaccgcagagugauuucuuuuuuuuuuuuuuuugguuuuucgagacaggguuucucuguauaguccuggcuguccuggagcuuacuuuguagaccaggcuggccucgaacucagaaauccaccugccucugccucccgagugcugggauuaaaggcgugcgccaccacgcccggcuggcagagugauuucugucacagccaaugucuggccuuaauuuccuagaugacugcuaggaauuaaauuagauauggcuugcaagauggcucagccgauaaaggugauugucaccaagccugaggacacugaucaggugccccagacucacaugguacaaagcagcuggaagauuaggaauucaaggcuacccuaggcuacauaaauccuuaccuuagaacugaauuugacaauaugucuuacaaucgacauuucaugcagugcaaugauacccacguaccuguacuuuuggaaaucucaaauuugacuuuauugaugaccuugaaggucaauaccccagcccccacagcagagaguaaacuacagccucacccacccaguacauuccuccacucaaagagugcucaccuuuaguaacagcgaaaucgucaugaaaacggagcaaacagccaugccucccaggccuaucauaugcaggguucuccucccugcccucuccaccaggaacagcuggaaggcaaggaagacacugcugauucuguguacagggcgcugcugccuuacccugucuugucuccaggcacaccuagucuguccacacugccccuuucccacccguuccacagcuucugagugacugaagauggcuuaguaugcucaucauccacuauuauuucucccaggggaaagcaauaaaaugguuuuaacuagaugugagaaguugaaagacagguuauguuugaacacuucaagaaagaauucuuguuucucucauccccaugccucaauccgaacuacucaacuuacagaaacuacagugaagauaguauugaccacgccugcuccaaucguggcauagaucgguuccuggacacccgcguccuugaagauuccuguugaguaauagaacaccuggaaagggacagaagagcaucacugguugcucccaggaaugagcccuggcauccuuggccagcacucggccucugcacccucuaccucccaugguuccccuguuuccuucuaaggcucagccccacuauuuaguuaacuuucuucuuuuggugguggggugagguuggugggaguagggguauaacaaguguuacuuuguagucucugccucuccagugcaaggauuauaagaagguaucugucaccaaggguacccagcuccaucacuuucuuuaaaaaaauuuuuuuuucuauucauuucauguauaugaguacacuguagcugucuucagacacagcagaagagggcaucagauuccauuacagaugguugugagccaccaugugguugcugggcauugaacucaggaccucuggaagagcagucagugcucuuaaccgcugagccaucucuccaccucucucucucucucucucucucucuuucuuucuuucuuucuuucuuucuuucuaaagauuuauuuauuuauuauauguaaguacacuguagcugucuucagacacuccagaagagggcaucagaucucuuuacggaugguuuugagccaccaugugguugcugggauuugaacucaggaccuuuggaagagcagucaguguucuuacccgcugagccaucucaccagccccaccucucacuuucuuaugucuacuuugcuaauuagacauuuaagucucucucucuuguuucacuaccuagcccaagauggccuuuaguuucuaauccuccugucuuacccuuccuaguuaagauuaaagaugugugucaccacuggcaccuuugccuuuagguccuuuuaaaaauuauuaugcagcugggagugguggugcacgccuuuaaucccagcacuugggaggcagaggcaggcggauuucugaguucgaggccagccuggucuacaaagugaguuccaggacagccagggcuauacagagaaacccugucuggaaaaaccaaaaacaaccaaccaaacaaaaauuauuaugcauagcaugguggcacacaccuuuaaucccaacacccaugaggcagaggcaagagauccugugaguucaagccagacuggucuauagagugagaccccaucucaaacaccagcacaaaagagaaaggaaggaggaaaaaccaucauauacugacaacccugaggcucaauaacaaaacacguguggcgugaccccgacuuuaacccugcaaggcaagaagcaggaugagggaaacaucacuucucacaguuggugaaguaauuucuaagcaugcugcacacuagauuucccucuucguuguugcuguuuuuguuuguuuguuuuuguuuuauuuuuuucgagacaggguuucucuguuguagcccuggcuguccugguacucacucauguugcugcuuuugagacaaggccccucuauguaguccugguuuuccuacaacucacucuguagaccuuccccauucugggauuaaaggagagagucgccaugcccagcuggcuuuaccuuuuaagaaacaaguaaguccaggccacuuuccuaagagacucaggaaaauaccgcccugcagguuugggcuagaguauacccaggccaaacugaucacugaguaaagugggagguuaguccaauaaugaguucagugagaugggacggggcagcuugcaccaugcaccucaguugucugcgguguuuugggugcucuuuugcaggacuggggugaggcagccaggagcucuguguggugcgcauucccgaggcuacgugcaaccaugcuuucacgcccaucccagcucugcaguccucaggcccugaucagcauuauccuuuuuacucuaguaauauauggcuauacuaucauuucaaaucaggagaccugaguggggucugucaaaauuccuugggagagugcagguaagaaggaguccugcaggaagcuuuucaaacuaacagauucaaaccccccacccccacccccaccccuuuuccuuggagagggucucauguagccaagacugguccucaacucaauauauauuugagagugaucuugaaucccucaucugccugccccuaccucccgagugccgagugcugggauugcagccauggggccccaccagauuuaccaaagggcuucaugugcacuaggagagcacccugccaacuuaucuacaucuuuuuuuuaaagcccuggcuggccucaaauuugggugcuccucuugucuugagcugacauuacagauauggaccucaauacuucuggcuuuuucuauugccuuggggcuugucccauugcuguugcuacugcugccauuacuacuccugcugcugaccucacauuccugggcacuagugaaugacccuccuguuccagcgucuggagguagcuacauucuacagacaugugacaaccugccgacaagagcgagcgacuucgggagacuauugcugggcgugggcaucuccgggcggggcccacggcagacagauacucacagcauugaucccagagagcugcugagacagcuggaggacaauggagaugagaagcggcuggacguaguugggugaccugaagagcuccagcacagucaccugcuucuccugugacauccgaacacucucauccuucaucuccuggaucuccuggaccacguccgaggugccccacaagcgcugcaggacuggggaaagaggcaaaaagaauacagauacugccuaugucccccaaccccugccacaaaacuguuuccugccaggcagcagcaggcaccuaaaacauccauccaucuuuacuagucuuccuacuucauucucagguccugacucagacagcagggucagaacacggucaaaagaaugaccaagggcucagcggauaagagcacugacugcuuuuccaaagguccugaguucaaaucccagcaaccacaugguggcucacaauuacccauaaugagaucugaugcccucuucugguguauuugaagacagcuaugguguacuucuauauaauaauaaauaaaucuuaggaaaaaaaagauguguaccuacaagaaaauuaaaaaaaaaaaauccacauccuggauuguuccugggugugauuuugugccuccgaugcaaacauuuacauucaauuuaugcuuauucuuguuggaugucagaacacagcuauagaacccacucuggucagugugcccugcaucuggacauggccuccugccucgcuuucaugcuuucccagauaucaucuauaguacgcaccaggcaauuguguuuaaguuggucuguccugaggaagcucugagaaagggcugugcuguuagguuaauauuuaguaugcucucacugguguucauuuacauguucaucugaacucaaacgaccuucuuugucacauccguguauauaagguacacacacugaaaaugaaguaagguugugcacagcaauagacuauaggucuuucagguccgcagaucccuggucucccagacacagagcugcccgggucagcaaaaguccacaaucagaaaacucuuccugcacauggagauccaggcaaggggggcgacaagaaacacacccaauguccucacccuuaaccacgcacagaaccacgcuccugaggcgacaagcaagcagcacuuacucucuguagcuuggucuuccuccuuuuuguuaaugagcaagaaucuuggacucucagggcaaaauggaagggcugcgcuuugcaggauagcuggaaugaugguuaagccaaggagcccaggccacaguucuucagagcccagaauaaaguccaaaccaaagaucuuagaugcagacaaagagaaauguuuaaccucaauuguauuucuaugccauaauugcaccauuaaaaaaaaaaaucacguauccuuuuaccauaaauaggaaagagaaaacaaauuguuucuauuucuuucugggcccugccuguaucauuagguaccguaugaacuacaguaauaucugaaacauguacauauaaauacacaauugaacacaugccagaucuagauagagugcuucacguaugucaguucauucauggcgcacagagcuagcuagcguccauuauuauuauaauacauaaaacuguaaggguaccugagcuaccagaaucccaacaacgaugcccagcugguuuagugugccaaaugcaccccgaagggcagugggagacaccucuccaauguacauaggcacaaagcccgugcacaggccacagaaaaugccaaugaguaagcggcccaggaucagcauuucaacagacuccgcuaucuuggcgaaucccauaaggcagcccgcaaugauggccagcaaguugacuagaagcauagaguugcgucugcaagguuaaagacaaagugguuaguaacgcgcgcgcgagagagauccccugucugucucuccucauccuuuugcucuucugaagccuccguagaugucaaucucuuuccuuuuugcugcugugggcuuguggacuugagggacccuccucaccacuucgcuauaccuuaggguuucuuuuuauucuguacuguguuuguguuugaguguccaggugccagugugccacagggcacauguggaguucagaggacaaccuuuguggcuggcuggaguugguucucuuuccacuuuuauguggaucccgaggacuuacacaccucaggucaucggcuucaugacacaggcuucuccguacugagcuaccgugccagccccauuuuaucacauuucauuacagaacucauacugcaaagacggucggauauuuaggacaauuuuuuuuaauccuuuccugaauccucaaaaggucugugucaaguaguuaagggcuaguuaguacuaaucaguacugaaacuggugugacuaaugcuuuauaagcuaagcuggcagcagagccacugacacagcugagacagaagagacuagcccugagaaccuucaguggcugaggggccuugggauucuggcgguaaaaggucccgcugugcagcccagguuagccccaaaccugcuuggccuccugagcaccaccaugcccagcggaccugugagauucuuugcucaaauagacuaauaaacuauaaagggagcugggaaaaugucgacacauaguucccaugcccuagggacccacuuaauugucucagaguacgagguaucccugggacuccugagugugcagccaagaugcacaaauaccauuaagaggggaaaaaaauuuaaaacucuuaaguuaaaauuuaaaaaguuacgacaaguuguggucccagcacucccgaggcagaggcagauugaucucugaguucaaggccagccuggucuaaggacagccauggcuacaaaaaaccuugucuuaacaaaaacaaaaccccccaaaaaacaaaacaaacaaaugaaaacaaacaaacaaacaaacaaacaaaaaacccaaaacaccucuuuuuccauucucuucuuuagugagguucuuugucuaaagggaaaaagucacuggagucugagucaugagacaccauuaaaaauaccaaaauagugggcuggagagauggcucggugguuaagagcacugacugcucuuucagagguccuccugaguucaguucucagcaaucacauggugacucacaaccaacuguaauggggucugaugcccucuucugcugugucuuaagacagcugcaguguacucauaaaguaaauaaauuuaaaaacauaaaaacaaaauaacagauaagcauuauccaauaauagguuugcuuuacuaauuaccaugauuucaauuuacaugucuagaauauauaaauuuaacuuuuuaagauaacgaaguuuuucacuuuaauuguguuugcguguggcaagauguauauuccacagagagcaugugcuauauuguuuguggaggucaucagaguucaacucauguagguagguucuuuccuucuaccuguggauuccaggcuggccccaacccauaauccccgugccugagucucuggggugcuagcauuguguguuugcgcugucuugcccggcugaguaucuuaugugacuuugacuccauuaccagucaucucuggaagcauaugacccuuaagacaugguacuauaucaaucaaugucucuuuggggagggaaaucaaguuauuuagccaucauuuacauuuuccacauggcaagggcugcagaaaguauuuauuuauuuauuuuuuaaaaggcgugcgccaccacgcccagcuaagauuuauuuauuuuuauuauauguaaguacacuguagcugucuucagacacuccagaagagggagucagaucucauuacggaugguugugagccaccaugugguugcugggauuugaacuucagaccuucggaagagcagucgagugcucuuacccacugagccaucucaccagcccgaaaauauuuauuuuauaaaauaaugaaaagacuuccaagaagucuccaaaaauuucagaaacaaaaauaacuucuggcuggaugucauggcacccaggaagcagaggcaggcggcuggaccuccgaguuugauagaggccagccuggucuacacaguuagccagugacugccuuggggguggggugggagggagaagcaaccuuuguccuuaaaagaaguuuaaggaacuccguugcugaccucacucuagcaaaauuaaaccagccugggagcuaaaaugggaacuuccgagagcaaggucucacaucgcagcucucuaggcagguggacuagcuuuccccaaggauaacccaacacguucccacacagcauuaucccccugacccgaugugcucugcugucuuucggguaaccagugcaggcagacuccuggcccagugucugcucaguaccugccaaagcgguugacaaagaguccaacagaaaaagagccaaucaugccaccaacagagaagauggccacacauaaggaccagagggcagucagcagucccucacuugguaggucuucuaaccgcucuuccaaaguguaguuaagaaaguccuuuaggaucugcacgaaaaaaugcacagugugaggacagaccauuaaaucucgaugagaguaguaggcaaauccuaggguggcuuccuuagaggccaggaucaggagggaggaaaggcacgugcuuugaaaagggcaucacccuaaacguccaguagguggcagcacagauguucaaaggggcaccccacccagucacgacuucccacguucuuaggaaucccuaaagaauaauauaggaaaaggaucacaacucggugagggggcagagccugaggagcaaagagcuugccuuagcuucuuccacagugugcuagcccucccccaccuuagccaggcaucuuaaagucccaguccuacuuaaaacucaguuugcaaucccuuuucauuucggcacacucacugucucaggugcauugaugacuccaguguuguagccaaacuggaaagagccgaucguggcaacagucacggcgaacaccagagauggggucaccuggagagcaagcagacaaggggaaaugcuuacacacuuugaccagugacauucuuucccuucccaaggaugccugcuuggaguccaucuuaaggcauuucuccugccuuugcuuagaaugccaggauuucaggcgcauuuggagagaaagaccuaaaaaggaauuuaagucaauucucuuggccucaucuacauagcuaguaccaggccagccaggcuacacagugagacccugucucaaaaaacaaaaacaaaaaaaaaaaaaaaccgaaaagcaaaaacaagaccauuucaccagccggacuaggguggugaacaacuguaauccuagaacccuaggauccugaguucaaaguccgccugaacuaaauuucucaaaaagaaaaggcaaccaaaaacgucaccagauagacacagguaucugacugcccuagggaacggugaaugcaggguuguggaauacuaucggugaguucauggcuaguccaggcuuacagugagaucuugucucaaaacauaaaacauaacagacccaaaccccucaaagcauagagggcagaaccagacuccauguggguccaccacgccucacagacuguagaggccagaacaggagcaggaaggagcagccacaccagcaugguagauggcaggugacccccuucuccccccgcaccaccccccccccgacccccaagcaccggaacuaaccgugugaauuccuuuuucuccucucccaccaccuguuucucucucaucuccucuuccucucuuugagaggaggucccacgcucuguacuccaagcuaaccucaagucagcuccucacuucuccugcuucagccucucagguuuggagucacaggugcgaggugcuaugcucagauuuuuauuuuucuuaucucuagacuacccaacccaccagcaacauccugggcccucuugagagucuuccuguucucuaaauaugguaccauucuccgcccagcuggccagagccucugcucauuuuaaacacauuauuaggagccauuuuuagcaaggggggaucaggcagacaucuccucaccuugcugggaaaucacucaagcaggcagggacaucucaaaacuggagucugaggccgaccuauuuggccugcuacaaccucuucaccuguccuuaaguuccucuuaaggucacucccgguggcaggcugggagcgucuagcagcgagcugaccuucccggcagccucccagucucucggugguuaagugcugucccuuccaggcgaaggcccuuuccuuguuguaaaacccucuuuacagacauccccucuuuuauccugauuuuuuuuucacggucucuuaauuuacuuaauuuccaaguuaaucuucguggaaaugcccuuuuccuuacaaauacugccuuccucccuccgcccacacuaacuccgauacauccugcacucacaaccauaguaaggacaacuggacuucccuccccacaguaccgggaacccaaggaccgauagcgggaugcugaacagcaaacccaagccaaccccacguccucucaaggucuaagccuuucccaagccuuccagcuggcuccgagacccccgcggccaaguccuacccucuucgcucucaucacagcuaccucaaacacacccgagaggcaaacagcuucugaggugacuuucacgugcuaagaagguguccgagaggauccucgucagguaggagaugccuagaacgcuaacacuaguaucgaauugcuugcuggagcugauaagaaaaggccuccguccggauggcucggugacuuaggagaaaccggagcacggcgauccgcaccacgaccuaccuccgugaggaccccaaacaagcaaauaaaaacaaccagcucuuaccuucguuguccccauggucccaaccuaguucucaagucuuaagguagaucuagagguauccagccaauguucucggcagcaaguguuccucggguccuacagaagccgcucucagaaggcuuaaggacuaucaccgaaagcaucacagcccgaagcccagccuaccuauuuauaaucucugcaagggguggagccuucaaccucccaccccccaauccuuaaccugugaccccaggaauucagugaccucuuaucugaucuucaccgcuccacccccagccccuguccuuugcaaucaaccaccaucacccacccccuccugcuuuuuaccacauccuccucgugguucuuuuuuuuuuccccucaaagcgcuuccaaauuccuuccccuuuucaagagccgacagccuuuuuguuucacagaaaaaaauacuaaaacaaaguuuggagggcgggcaaauuugaaggcagucgggauggaaucagucuaaacgcagaguagagucagugcugcuuuuaguugaaagucauccaaggagcaggaagcagagaauugauaaugcguuuucauuauaggcuggguguacucgccuugaaggagggaaaggcgaggcaguccaagaaaacgcauccaggugugaaggcagccuucuugacuugaggcuccaagaaggaucaagugaaguacacagccccaauuccucaccacagcauacgccaccccacccauugugaauucugccucucucagcucuguuuugagauuaacagcaucuagaaacacaacaaauaucuaauucaacuuacagauuuuugcugagugcauagcucucaagcgggaagaaaaaauuaagagcugggguggaggugucucgcagugguauagcacuugccgcggcucuagguuaaacccccagaacaaucagucuaggguaacugauucucauauaagaaacguuugcuaacauacuauuaccuagggauugugugucucucgaaagacaaacuugagacaaguacuucacuaccacacugaaagaaaccuaaaaaguuggguacgcgaaaggagagcuuacagagaggccugcgauggccugcaggaggcaggcacauuucaggugagcuccagagugaagcagcugagcacgugauaaacgugugacacugaggcucuaggcucugacucccggugcgggggagggaaggcgaccccuccccugaagagugauuugguauaggcucgaggaaggaaaggcaucuucagucccuagcuuucugggcagagaucuagacugauggacugaacugaagcaaaccuggucccuuucuccuuaaaggagggucuuugccaaaucggaugcuugcugagaaaacugagguggagugaaccggaccgcgcaagaaaaucauccccgagguugcacccccuugcucucgucauuuuucuuuccuagaagcacugagucggaagcgccguuuaauuaccacagcaacugaaucuagcagcuaaagaaauaguaaagcccaaaggccagugccugccaguagaaagagaauccaagccacuuggugcaacauuccauuuuccuguagccacauuagaaauaaugaagguugucaagauggcuuagcagguaaaggcacuugcugccaagucuggagaccugaguuucauccccacgacccacacauggugucaggagaaaaccaaguccacaaaguuguccucuuuuuguuguuuuguuuuguuuuguuuuggaaacaggguuucucuguguggcccuggcuauacucgaacuugcuuuguagaccagguucccuuccagccuuccaggugcuguacaacacuuggugcacagacauacacguaggcaaaacacccauaaugcauaaaauauaaagguguuuuucuuuuuuucuuuuccuuuucuuuuuuucuuuaaggcacucgggaggguggaagugggcuagugaucugggaaagacagaugcuccaaagccuaagauuagcucugaaacagagaaaauuaugcuugcagcaauguauguuuuuuaaagauuacagcuggaauuuagcugaauucccaagaaucuaaaaagugcuaaacaaauugagacaaaugcucuucaaagcagaagcucgucugaugcuuaagccacaaggccucaugcuacugugggcuuagcagcagaguccaagacagacaguccucaucucgagcaacacagaccagcugcugacuagcuguuagagauugccugggguccucagugcacugugggagugcaugugaaggguucccuggggaacucgguacauuguaggaauuccugugccggguucccugggguccucagugcucugugggagugguugccaauugaccgaaaaguccaagucccagugagggugaccaaccuugagggacaaagcacucaacagccucauggcugagaugcaguaacaacaccuaucuacuacguguccuuagauugcuugagaguucuucuaucuuugcuggauaucaaagagggagaagcacgaaggggacuuuaguaaaaguacccaguugggagcuaagagcaaaguaggugugcuuaggagagagggaacaagaacaauagccugggauaccaguucccaaugcacacaccugcacaauuggagccccaaucuggucuccugcuguuagccuguugagguuugcuagugugacaacuaagcagaaggacaagggauccuacaaaagagcacucaagauuuuaaacucagcacagugcccccggccugggaaaacgcaagcagagccaguuguaaggacugcccagaccccgugcuuuacauuucuaucaguccccacaaacagcaaccugcaugguuucgugugucugauuuuaaucuuucccuaccaggugagguguccccauaauucacuuugaaucugaaaacacgguuuaaaaaaaaaaaaaagaagcagcagcagcagcccuggggugaagaaaggaaaaaucugagaaaugccgcuucuccuguugacacugccuuuaaaccauucauuacugcugccgguccugaaaaccggauuccagcccccagcuucucaucacuguggcagaucuugcguaucccaaagucuccaggaacaaauuccaaaguaguguugacccuaaguuaaaauucaaagcacagcaaucuacucacagaucuucaguggugccuccuuaauaagcccuggguucaaagcaccuuugacuacaggcgcgugggccacaguuuaaaacauuccagcagcgcuaacaacagcaacaacaacaacaaaaccuaacgcacacacguuaauuuuauuauauuauauuuaucccaucugacaugucccaaguucucuguuucacuucacucucuucuucucuuugcagugcaggggauucagucuggggcugaccauaccagucucaggccucaaaguucucauauuaacaucuaaccaacauaaaugacuaauaaucuauuuugauauuuuugcaccaggccuucagaauccaaugugcaucuuacuuacagugugccucugauggaagagucaauuuuuggguauugaggugaaauauccuuuuucuuuuuuucuuuuuucuuucuuuuuuguuuuuguuuucgagacaggguuucucuauguacccuuggcuguccuggaacuaacucuguagaccaggcuggccucgaacucagaaaucugccuguuucugccucccaagagccgggauuaaaggugugcgccaccacugcccagcgaaauaucguuuuucuuuucauuucuucccccccacucccauacauugguuacugaacauagguccuuuugaauauccugagcuguauuuucagccugaaauccucuuuuaaaaugaaacuguaguuuugaacucagugaccugaguucgagcacacacaaacacaccacccacgugagugugucaccccauagguaaauaauucacugugauugucauacuaggagaaaccuauagagaacaccaaaaccaaucaagagugcccuggaguucugcacauuuugcuacuguaugccauggauggauaaguguguucuccaaagauuccugugcuagaauccagguccagcacagccaugcuaaagggaaguaaaaccuuuaaguuguaaggccucagcgcgcacacacauacacacacaucauucauggaucagagaauaacuuuugggagccuguucucuucccuuucuucuaugugaccccaggaauugaacucuguuaccagacuuggaagcaagugacuuauucucugagccauuucacaagccccuaaaccucuuuucaggcucuuaacagucaggcaggcauaugcuuucaauccuggcucuggguggauuaaggaucaagaauuccaggcuagccgggcaugguggccuuuaaucccagcacuugggaggcagaggcaggcagauuucugaguucgaggccagccuggucuacaaagugagcuccaggacagccagggcuauacagagaaacccggucucgaaaaaaccaaaagaaaaaaaaaaagaauuccaggccacucaaguauuuuauuacagcaacagaaaauggacggauccuguuaaaucguguucucaucaucucugugucacauuuucaagcggaaauccaauuccaggccugcagaacuccguggucaauaguccuuaaugugcaagcuugaugaccugccuccccguccuagaaccccaccaccccaaaugcuggagauggcucugcaauaagagugcuugcugcucuugcagcaagacugcaguucuaguccaguacacauaugagguggcucacagcugccuguaaguagagcuccagagcaucccauaguuucugguuucagcaggcacccauguaugcacagccaggcagacacagauaaacacauacauaaaacuaaaucuaaaaauaaaaagccaaacgcaacaguucaugucugcaauccuagcacuccuaaagugagaugggaaguggagaaggggaggaagcucaagagacaagguagccccaaguguauagagcagcaaaagcaaaggagacccugccuugacaggauggagaagagaaaucucuccugaagucauccucugguguccauaugcauaccuacgcucacauauacgauaauaauaacaaauuaaaacagaacaaaaccaagcuccagccaagugugguggcucacuggauccccaagagcuuggaugcagaggacaaaaacccagagaugaacaguaggaugaaguaaggagguaagacaccgagcuguccucacugggucaccaucccgaugcccacuggcacuugcugaauacaggguuugagaaaggaagugagccagguggugguggcacaugccuuuaaucccagcacuugggaggcagaggucggcagauuucugaguuugaggccagccuggucuacaagagugaguuccaggacagccagggcuauacagagaaaucuucucgaaaaaacaaaaaaagaaaaaagauagagugaaggcaguuuuauggcauuuuauagauuugguaaaacacuuugguuuaauuucuuuauaauacaugauuuuguuuuuuugguuuuuuuuuuuuuguuuuuuguuuuuguuuuuuuuuugagacacguucucacuguguaacucagauuggccuggcacucucaguguagaccagguugacccugauccugaucugccugccucugcuucugccaccgugcccugcagaaauuguuugcuguaccuguacuuaucauuucaucuuuuccuguacuuaagcugcccacugggcugguucuggaaaggaucgcacaggccacaucggccagaguguuuaacucaggaacgagaaguucuaauaugcugacgagaugggcaguguuucuggguuuuuauuacgcacguuccuggugguaaugacugguugacuggcuggacacucauuaaagcaguaggguugacacgugacuauauggauagaccuuuugcaaugaaaaugguugugauuugaaaacaguuuuaaaguuuguaagaggggcuggagagauagcucagcaauuaagagcacugacugcucuucuagagguccugaguucaauuccuagcaacuacaugguggcuuacaaccauuguaauaagaucugauacccuccucuucuguuguguaugaagacagcaguguacucauauaaauaaaauaaauaaaucuuaaaguuuguaagaaucuggcauaugaaaagcuuugauggcuguugaauuccuagcagauuggugugauuggugcuacagauagcaaaucuccucucucucucucucucucucucucucucucucucacacacacacacacacacacacacacacacacacacacauacacacacacacacacacacacaaugcaagcuggccucgaacucacuauguaacuggguuuauuuugaaccucuuguuucuacuucccaguucaggaauuacagguguguaccaccacauccguugauguuucuccuuguaguaggacuuuaaauuugccagcugaggucuuuuuguuguuaucuugguauuucaacucagcaucucacuguguagcucuggcuguccuggaacucacucuguagacuagauuagacuagauagacucagagaucugccugcuucugccucccagugcuaugaucagagguguacacuacugccaccguuaccgccgucgccaucaccaucugccuuauaaauaccuuuuaaaaagaucaauuuuguuagugaccucccaaaagacagauaguauauuuuaaacugaucuucuaucagaccagagaugguuuagcagucaagagcacauuauucuugcagaggaucuggguuugguucccagcaccuauauaguggcuuagaaccauauguagacauuuaugugguacauauauauaccugaaguaaaaacccauguacauaaaauaaguaaacuuaaaauugucauuccggcuuaucaaaaagagugaggcacuugcacuaggguucugccucagagcauggacuuagcauguguuuagccguagguaugaucccuggcucuuuuuuuaaaaauggaaagaagaaagaaagaaagaaagaaagaaagaaagaaagaaagaaagaaagaaagaaagaaagaaagaaagaaagaaaagaaagagggagcuggugagaugguucagugguuaagagcaccgauugcucuuccgaagguccuuaguucaaaucccagcaaccacaugguggcucacaaccauccguaacgagaucugaugcccuuuucuggaaugacugaagacagcuacuuauuuauaauaauaaauaaaucuuaaaaaaaaaagaaagaaagaaagagcaaggaaggaagaaaggaaggaaggaaggaaggaaggaaggaaggaaggaaggaaggaaggaaggaaggaagacaaggaaaaagacaagggaaacaaguggguuagggaagaaaaaagucuggucuggucaguggauacuaauacauuccuauguauauaugaguacacuguagcugucuucagacacaccagaggagggugugggaucccauuacagauggaucugagccaccaagugguugcugggaauugaacucaggucuucuagaagagcaaucaauguucuuaaucacugagccaucucucuagccccuaauacauucuuccuuauagaagugacugcuucaaagauaugaucuccccuuguacuagcaucuuuuuaacuuuuuuugagacuguuuugccuacagacugaucucugauuuacaaaauuucugcacaggcauguuucacacugcacauggacaauuuuuuuugggaucucuuuucuccuuccaccuugcuuuugagaaagggucucuccuaauuucaucggcugcauuguauacuugagcuccugggugaauuuuccucucucugccuccuaucuggcuggagaagugcugggauuacagccaccacacucugcuuuuucuuuucuucgagacagaguuucucuguauagcccuggcuguccuggaacucacucuguaggcaaggcuggccucgaacucagagaucugccugccuccucugccucccgagugcugggauuaaaggugugugccaccaccgcccagcaacacacucugccuuuuuaagugaaugaaagcaguccucacguuugcaagaaaagggcuuuuauuguugaaccuucuugccaccccaaaaccgaucuuugaagcauuaccuaagcagacaauaaacuugcuuauugucauuucuuuaucuuuaggcaaguuccccuuucccccaugcccucuacgcccgaaugcccagguuggccuggaacucaugauguaacacaagguggccuugaacuggucauaaugcuuuugcuuagccuccagcauguuggaauuacaauugugaguuaucaugcuuggauaacucuuauguggggcccuggauuaaagccaugcacacuaggcaagcauucuauggaccgaaguacaccucuagccccucuuucacauuuuauacacacacacacacacacacacacauaugcuugcacacgugcgcguacacacucauucauaggcgaggguguguguacuauauauacacauguaauauauaaaaccggcuuugaacucuugauccuuccacugccaccucccuacuucuguaauuacuaggccuauuuguuuauuuguuuauuuguuuauuuuuuugaacuugcuauguagccaagggaccuugagcugauccuccuguccugauguccuguguacugggauuauaggugcaucccaccacgcucucaguguauuugaugcuggagagcagucacacuggagcuucgugaugccaggcagucgugcucacagcucaggcacauccuuaguccucauugacugaauuuuuuccauauguacuaauaggaguuggguguguggaggucagaggacacuaugugagucuguucccucccuucaccaugcaagaccagaucuucagucucgguagcaaaugucccuguccaccgagccauuuguucuuggacuauggcugcauuuuaauaguugucaggauuaacugguuccaucacacugcugccugacuauaacaugccaaagucagcucuagccucaauaucuccggagagaaagauagacugcaggugccuucaaucccagcagcuggaaugcagaggcagguggaucucuaugaguuuaaggccagccuggucuacagagugaauuccuggacauccagggcuacacagagaagaaacacugucucaaaagaggagagagagagagagagagagagagagagaagauuacacagacaaagagagaccugggagaaacaaaggaugggugggcauguguuaucaaaaugcaaaugcaaaauuccgguuacuuuaaagaacaguucauuaacgguuuaaucccuuucccuauuggucccuuucucacugugcuccgagcuccaggaaguuaguagcaggagaaaccauuggguuggcuaucuaaaaacuuacucaauuuucguuuuuaagauuuuaaaugaagugaauguguguguuuguaccuacgaaugugagugcagacguucacugagucuccuggaacuuaaguuccaugugguggagagccaccuaacauccuggagagccacccaacauccuggagagccaccuaacauccugggaacucaacaguccucuguaagacagugcaucaacuaaacuguggaacccaagcgcaucuauuauuuaucuaucuauuuauuuaaugucuaugaguacacuguagcugucuucagcuacaccagaagagggcauuggaucccauuacagaugguugugagcaccaugugguugcugggauuugaacucaggaccucugaagagcagucagugcucuuaaccacuaagccaucucuccagcccgugcaucuauuuuuuuuuaagacagggguuuugcuaucuaguccuagauagcauguaauuuacuauguauaucagauccgguuuggccuugaagccauccuccuguuuuguacugcugagauuacagguguuugcugacaaaaauggcuucuccuaaacuuaguaucuuuuuaaaaucuuuauucaauuuuauuuauuuaauuacuucuuaugcgugugcauguaggcccuggagacuggacucaggcuuaggcauggcagcagaugcccuagagucaguauuuauacuaaagguuaucaugcccaucuccauagcguuacuagaagauuaagacaaugcaaguuaaaaacaaaugaacagguauuuggucaaacaucacucuggcuguuucugugacauuauauggaaugagauuugauuuaaaucaguggcuuugaacagaacagauuguucuccacaauggaaaacucgaccaggcuugaagagaaccagagacuggucuuucuggagcaaaaaggcuuguaucugccaaccuggacauggguuuuuuugcuggguuuccagccugcccacgcacuguuuacacagcagaugugccagccccuagaacucacagaaucuacuggucagucuagagaaugagaagcuaguuccaagaaguagggugaggauuuaguaaaggccuauaugaaucugugaguucaagaacagccaggccuacacagggaaacccuaucucaaaaacaaaacaacaacaaauccuacaaaugggcaaugggagaaauaagaaauucugugguaauacuggaaaagccaagauugccuugaagagacuguggguaagaauaugaauguuuaaggugacucuggggcuggagugaugauucaguggguaagggcucuuguagcugacccugauggccugagucuaacuccugggacauacauggugagagacaagggacuccgauagccuaguucaagccccacacauacaaacacagauaaauguaguaguaguaguaauaauaauauauacacauauuuaauauuuuugucuauuuuuaaaaagaugguccugccagauucuuagguggaaacacuuuacuagauauggacagaaaagugaucuuuguuuuaaaaaggagaaacaaacaaacaaaccugucuaaauauggcugaagagauuucuuuuuuuucucuuccguuuuuucuuuucuuuuuuuucuuggcuaaguuuuguuuucauuaaucauauuaauuauaauauuccagggcaaacugaagaauuuggcaguccaguuggucccccagagauucacaggcagguagagcaccugggcucaguagcuuguggcuguguucgucuugcagguuacccacccucuacaucaugccagaucuuggggaugggggugggaauccucuaggugcuugggggauuucagucuucuuuccuuaucgggcucucuugugacuuucuuccuugucacucucuagaaacaauuccugguauauuggcagacacuguaaccucaguacuugggaggugugcaggaggaguuuuaguuuaaggccagcuggacacaaguauuaagacccuaucccaaaauuuuuugaaaaguuuuuuuuuuuuuagauuuauuuauuuauuuuauguaaguacaccguagcugucuucagacaucccagaagagggcaccaggucucauuacaggugguugugagccaccaugugguuacuggggauuugaacucaggaccuuuggaagggcagucaaugcgcuuacccacugaaccaucucaccagccugaaaaguuguuuuuuguuuuuuguuuuuuuuuuuuaaguuuauaggugcauucauagaccugauaagccauuaauuuagcagaauccacaaguaaaaugggccacuuuaccggggccuagcaaacacagaaguggaugaucacagucagcuauuggaugggucacacggccccuaauggaggagcuagagaaauuacccaaggagcuaaagggaacugcaacccuauagguggaacaacaauaugaacuaaccaguaccugggagcucuugucuuuagcugcauauguaucaaaagauggccuagucggccaucacugcaaagagaggcccauuggacuugcaaacuuuauaugccccaguacaggggaacgccagggccaaaaagggggaguggguggguaggggauuggggggguggguaugggggaccuuuggggauagcauugaaaauguaaacgaggaaaauaccuaauaaaaaaaaaaagggccacuuuaugccagaaggaauagagacggaacaagaugaugaccgccaaugugagaaccaaagcuagccuguugauuaugucuucauuccucuaaacgaguucguuugacccaacugcuugauugguuguaggcaggaaauauguuggguuaugcuugccccugguuggacuugauggaaaauaugguggcccugugguuuuguguuuuaugccucuguaaaacaugacuccuggccauuuccugggaaccugagaauggagcuggccggaguccaucauccuggucaguauuuaauuaaagcuugcuucaaauuuggcucauaaugguggaguugguuuuucucuggaccaugucaagauuaacaucaaaugucuggaauuuuauagaaugggacaauaacacccaaggacagaaaguauccuucaggaccagacaaagaugaucgccaaagugauguacgaccagucuuagcaugcccaccacaggcccagcugggcacgcagguccacggggcaaugcugucuccucacgugcagugggccagcugcuguccaggacaacagcagggaugcggccaucacagagagccgagaguucuucuucuguuuuguuugucguuguuguuugaaagugccugggauugagcccaggacucauccauacgucaaaucaucuaccaccaagcuacaucccagccucagaggucaucugacccuuaagucuaacaguacauuacuuuuuugccucuaucaucaaaagcacaggcaacugaauaaaauauauaaacaaugaaacgccaucaaccucagcaacacuuccguaucaacaggcaaaaucagcagcauaaaccagaguuuucaaaauggaagaaaauaguuguaagucauauaucuaauaaaugguuaaaaauccagaauagaagcugcaaaguuguggugaaugcucucugugaguucaaggccagccugaucuacagaacaaguuccaggacagcaagggcuacccagagaaacccuaccucaaaagccaaaaaacuaaaaauccaauagccugauuuccaagggaggcucauccuacccucacccccccccccaaaaaaaaagaaagaaaaaggaaaagaacccugguaacuuuaaauguuuuccauucacacacacacacacacacacacacacacacacacacacacaaaagugugaucaaguuagacauguuagccaaaacuagaaucccuugggagauggaagcaggaguucaaagacagccugagagacauuccaaguucaaggccaguuugacugucaaaaaaaaaaaaaaaaaaaaccccaaaaaaaaaaccccccaaaaaaaaaaccaaaacaaaaccaggaaguugggggauggugcuggagcacgcugaggcacuuaagcucuuacagaacuuugacagcucacaacagucuguaacuguaguuccagaggaucugacacuuucuucuggcuuccagaagcaccaggcuugcacaccgagcacacacacacacacacacacacacacacacacacacacacacacacaccaaacacucauaaacugcuggccaugguggggcccgucuuugaucccagaacucuggaugaacuuaaaguggucaguuuguuucacuagucaacuuuguaccacugacaaauagucuaaaauaaucaagcugugagggagaaauugucauuuuaacucaagugagaagaaaaggaguucaagguucaagaccauccugggcuaccugagacccauuuuuccucaaaaacaaaacaagaacaacaacaacaaaaaaauuaagugaauuuucauggguuuuggcuguaggagcuugguuggcccucauaucuuuggacccaagggacagugauacacuauggcuagcaacauauggcaguuaccauauauguauaucgaugcagggucuuauucuguagcccaugcugaccuucaaacucaccgagcugcuccuuuuaggccucucagugcugggauuauagggauagaccacuaugcucagcgugggcccagcuucaucaacugugggucacaguccaacacaguguuguauaagugaguuguguaaguuuugugaaaauuuuggcaaugauaaaaauuucugaauauccaaugaguuaaaucaaaaucaaacccacgguguaaugacucugagcacacucuaccacugcaucgagguuugcuugugaucuuuugauuuuccagacacggucuuauguauuguagcccaggguuuucccaaugugagcacguugccccacgccugccacuacagcacugaaugccaacaaacucacccggaaacaucucagcucugagaccacuauguuacaccagugaaggguuuuuuacauacaaaguugucccaucuuauaaaugugggucuaauuacagaaacccaagacuuuuaaugcuuuuucugccuucauuacuuagcacauaucaagucaagucuuuggguuggacuaaguuagaauauuugauuuuaaaaucugacauuaaaggggccaggaguauagcucagccaauccuauucccaaggcuuugcguuugauccccagcaccacacaaacccggagaagugcuuaggacccauaaucccaacaugaagguauaagggcggugaguguguguguguguguguguguggggguggggggcaggaucaaucagaggcuagccugggcuauaagcgucucuguuucaaaaauaaguaaaaauaggggcuggugagauggcucagugguuaagagcaccgacugcucuuccaaaggucccgaguucaaaucccagcaaccacaugguggcucacaaccauccguaacgaaaucugaugcccucuucucgagugucugaagacagcuacaguguacuuauaauaaauaaaugaaucuuaaaaaaaaaauccgguucacacuuugagucagugucuuuaaaaaaaaaaaaaaguaaaaauaagcuggguggugguggacaggccuuugaucccagcaacagggaggcagaggcaggcauaucacugaguucaaggccaaccuggucuacaaaguaguucuagaacaacuaggacaauagagaaaccuugccucacaaucacucauaaaagaaccaggauuugaacucagaucuucacacuugcacagcaaguguccuuagucagagagauccacauucccucccuccaguccgggaaccucugcuuccuucuuugaaggucaaacggaacauugugaaucucagccuuggugcagagcagggucuauaccacuugcuguagaggcugcugaagcaaauacucaguucuuuuuauggcugaagugcaucguaguacauccguguaccucaguuuacccauuugccuacauaaggacauccugguugccuccaaucuuagaaauuaugaaugaauugcuaugagcaucugugaacauguuuuuguguauaauugguuaauuaguauuugagacgggcucucugacaaggcuggccuccagcucccaggauaguucaaggucaaccuugaucugauccucaaucuccaacuuccgagagcauguuggguuucuacucuaagucagacuuggggcuccuuuaugcauuagccuucuuuucuuuuuuuucuuuuuaacauguguuaguauuugccugugcuauguguaugccugguucccaggaggucagaagaggguguccagucccuugguguuacagauggcuuuguguugugaccugggagcugggaaucagaaagagucaucuggaagagcaaccagugcucuuaccugcugagcuaucucuucaucaggaccccucaaacuccuuuuuuuagguuuuggaaaugaagucuuacuacacagcucgggcugguuuggaacucugugaagaacaggguggccuagaacucagauaguucagcuuggauuaaagguggucaccauggggccuagccccucagcuguguuuugcaugcaaauugcauaguuaggccaauaaggaccaugcacuauuauuugugggauguaaggaugaguguuugaauucugcguguguagccagccuguccuacuguuccugguaugaaugccuuugcuucucuauauuguugucugguggcgauggcauuaucaccagagcauuucugcugccuuggcuacgggaaaacagcucacgcugacucauacccacccuuucaaauaacauaaccacaugccggucuguggccacucuucaaugagaugugucauaauugaagggcuguguccuuugagcaaguuuccucccuaauuuuggugguagagccuaacuucucagaaagaagggaaaaaacccaaaaaaccaaaacaaaaaaacaaaaaaagccccaaacaaacaaacaaacaaacaauccaaaaacaaacaaacaaacaaacaaacaaacagcaaaccacucaaugcucugaggcaccauuacuaacauggauggaauugggaauucuaugaugggcuaggcuacuacacaaacugccagaaaguaaaugaaaugcuuuacuugagaauagucucagaggggagaaggucacaguuucaaaugaagcuuagaggggcugcugagaacugcaggaauccagagaaggcccucucccugaguccacagggaccacaguggagacuugcagucauugucugucucugccggaaucucaaagaaggagcccugagcaaaccagauguuccagcuaauuccuuccucggguggggacacucggagaaaccauccuguccucauccguccccagcacucuggacacaaugaccccuuugaauuuguggccaguaaauauaaauauauauauuuauuaaaaaaacccaaauuugacauauggggguagaggcacaugcauuuaaucccagaauuuggggagcagaagcagguggaugucugugagugaggccagccuggucuccaggacagcuagggcuacacaaagaaaccuuggcacucuguguagagcaggcuggccucaaacucagagaucuacucugcuucuugagugcauaaaggcauaugccaccacacccagauuuuauucauauauguauuuuccaugucaucuuuugacauggguauuccagacaaaguucauagggucuacacaugucagaaugcuugccuagcaagcuugaggccuuguauuugaucuaagguacugauaacacacuggguuagagagauggcucagcuguuaagaguaaguacuauucuagcugagaaugugaguuagauucccagcaccuacuuuagauagcucacaaacauauguuaacuccaacuucagggauccaaaggcccugguguccuccaacaauucaccucaccuauacacacagaaaaauaacucuuuagccaggcacagugauguaacccuuuaaucccagcauuugggagaaggcagguggauuucugaguucaaggccaguuuggucugcauaguaaauucagggauaaucagaguuacauaugagagacccugucucaaaaaaaccaaacaaauuucuuaaaauaauaauaauaauaguaacugggcuggugagauggcucagcaguuaagagcacugacucacugacugcucuuccaaagguccugaguucaaaucccagcaaccacaugguggcucacaaccauccguaacaagaucugauguccucuucuggagugucuguagacaguuacaguguacuuacauauaauaauaaauaaauaaaucuuuaaaaaauaauaauaguaacuaauaauaagcaguagcagcagcagcagcacauaggaacaagucagcuugaaaggauuuagaauuuuaucucagucguucgagugaguacuauuuuaucucagugagugaguacuauuuuaguguucuccuuuggcugcucaguagggugagcugugaagcagcaggggcaagcuucucuuaagcuaaaugacuguguuuuucucaccaaaaccuuccacaacguaugcauugugcauugaacaaguuugauuugggcaugguggcacaugccuuuaaucuagcagaggaagucuuaucucucuauaauucagagacaacgugaucuacauaguaaguuccaggccagccaagacuccaaagugagaguuugcuucaaaaaccaaacaaacacaaaacccucccccaauuuuuuuuuuguagauugugugccauauaauacggcagccacggugcuaggaaucacugucugaucucaugcauuccuacugaagauacucuuacaagugccaugaacuuuguguugcagaucagacuguuuaauggauacaucuuucucacaagugacccaagccuccaauggaaccagccaguuacagaaauauuuggaggaggcgggcucagaaaccaaaguaucucuucucucuucccagcaagcuaagccccgccugcugacgucucacuuucuuuuuggggggugggcugcguaaugcagacgugcgaagaggaccguucagcugguccucugaaucuccggagcgaccugcuacaucacucaguccugucucucccuuauucuacuccccuccuguggaauuuguuuucuuguuauguugccgagagaugcaaccaucagcucccgguuguccugguuuucuucauccuguuucucugacuuuuuuuuuuuuuuuuuuugacacaaaucugcaaaaucucauggguguguaacaagauauccugagcauuuaauggaaugguuuauaugcagacuuauagaaugacuguggaaugauuuuggaaauguguguaaaaagaaauguguguaauagucccugccuuuugguggauccuacaauucuuuuuuuguuguuguuguuuguuuuuguuuuuuucgagacaggguuucucuguuuagcccuggcuguccuacaauucuuuaaauguucaaaugcagaaaaauucuuuugccuacaagcacauuuuaaauuagcuuucagguaugguuguuguuuuuuuguuuuuguuuuucucccuaguaaugggcuugaaaaagcagggucuugaacauaacuggggaaucucccacagcaagguaucuccuaagaucuuuuuucauugauguuuuugugcguguuugagacagggucucauguaacccuggcuagccuggaacccccagagauccacaggaccaacaccacccugaccaaccuuuuuuaauuuuuaauuuuuuuuaagacaaggucucaaguaguucaggaugaccuugaacucacuauguagccaaggcuaccccaggcucaugacaacauuguaauucucccagcucagccuccugaaagcugggauuacagaagugcaucaccaggccagacuuccuauugucauuuauuuuugaaauggggucccacuguguuccuuaggcagguuuugaacugcuauucugccuaagucuccucauagcugggauuacaggccagcuggaggauaacuuuuaaaucuaauguuaucacaauuauaccuaaguggcugcuucaaucuaguuuuuccuuguuaguguuuuuauugagacaggucuggaaucauuuagaccaggcuggccucgaacuuguagaucugccugucucugccucccaagcgcagggauuaaagauuugagcaccaguguuuucuuuacaaaguucauaggaaagaaauggucuauuaaaucccaugcccugaccaauggcucucuauuuagaccuuaccuugauacuuucuggucaacacccuuucauaugaaggcuuguuguguuuguuuguuuuuaauaagguucucauauugcccagaguggccuagaacuagacaaguaguuaaggacggccuugaacuccuuucugauccuccuaguucuaccucccuggcaaggggauuacaggcaugagcaccacacccaguuuaaugaguucuauuuacuaacagacaacaacacaucacagcaggagagaccuguuuuagcuaggguuguuugugcuguaauaaaacaccaggaccaagccgggagugguggcacacgccuuuaaucccagaggcagguggauuucugaguuugaggccagccuggucuacaaagugaguuccaggacagggaggguuauacagagaaacccugucucgaaaagccaaaacaaaacccaacaaacaaacaaacaaacaacaaaaaaacccaaaaacaccaggaccagagcacauggagaaaagaggucucuguggcccauuuccaccucagcgcugaagucacauuugaacacucguaguuaucagcuauccaggucucucucaccgugacauuaucuguguauauaacguaguuuggucaugcucacucacuauuacccucucuagaccccucccacucccacaggaagcaucuuccaaggcuagggaucuggaggcugcagauaaacagcugauaccgaguuccaggaaaggagccaccccccugguacucagugagggcccuauucccaggcuguuuggagagccucucaggucagaggagauggagaggccacagagagaggccagugaggcaacaaggcucuugggacacugugguccacaaacccuaaaacacuuacauaaucugacccuuugcaguaaaaguuaccaacucccgaguuuuacuguagaugaggcaaaugaaaugggaccuuaaagcugugagaucacagucauuggcugggaucagaagaaggaaggaggcacugucugugguagcagaggcuggagacaaagaacaugccucugagcggggaaacucugaggacuuccugugaaugaaaaaaugguccagccaagacugacaaccgaccguacucaacaggaaagucuuucucagucucagucucucucucaauaucuuucauuucauguaacaggaauccacgggagugccaccgugagagugcccuacuuaagggcacugggccuagaggcugguuuuccagguucccccggggccugcaggcagcuuuagauuuuacuggagaguaagcacugagaggaagucacuuugaguauacugcugucauccaugucauuagugagggaaaaacugggacuggaggagagguggcugaagauuaguugaugaauuguccuuagguuuucuuuacacccaccuuagucauuuuuugugaacaccuccuuccccccgcgcgcgcgcuuaaaagguagcaaacagucugcauagacccaaccaaagaccaauguagggagauaacuguugagcaugggccaaggccaacagacucagcagggaguuccucauuuucucauggguaauauucccuuuucaggcuggagaagugagggucagagacugaagcacuuagguuaaacaucccagcucaagauguguuuaaaggauaacaugcuuagauuuucuaaugccaauuuacaacacaucagauuaugucccgcgacugguguuaugaagaacaugucuauccaaaguccuaaaaugucauuaaggguuaaaugcaugcaagcagcguucacgugcuuccuugguuuggggcacagagaaagguagaguacggcggauguuaggacggcgaggcaggcaccagaaagcccuuauuucuacuuucuucugcuuauuucgaccccgacgcacgccuaaauagcaaguagcacaaaauguauagcccuaaugugcagggcuguucuuuuccgucggucgucgaucgugccacaguggcgcaguucgcugcggauggugcagggugacccaacgcucugcgcaugcucacacacaucugauccuucccaggcccacccuuuccuucuuccugguggucugcagcccacccuaccuuuuacuucuaaauucacccuccgccuuucccaguccguuucuuucuuuuuaauacccccacccccgccuccucccgacaagucaaccaaaaacgucaagggaacgugaggaccaagggaaggagcggaacacugcaggaugcgcgaaugagucagcgagcuggggaggcagauccaagcgacucagggaccgcgggggcugccgggcgccgugccaauacgcacgucccuucugccgggcggggucggccagcgcccaccggauggggcugagaaagugcaguugucaggaauccgaggcaucucuguggagcagcagguuacgccagagucugccucgagggcgagggcgaaugccccaccugcgcccggcagucuccccaccuguccaucuauuuugccgcaggccauucggcuucgucgugcagcacaccaggucgcucacguuucccacgcugccugcuucuuuuuauuucagucagcuuuacauauacuacgcgugcaaaagcguucacccauuccagcuguucggguagaugacuaauuuuugaugccugcagucuccugucuccgugccaccccacugcaaucaucagagugcaaauuuacucuuagaacauucuccugcagcaugcucucacugagguuacccggucauuguucgguggcauucgagcgacuguaggcuuuuguaacggacccagcaggaggagauaaucugggagagacaccagcuccuccccuuagcuaucaaccuauucaaacaauggaccaaagaauuaaaauuuccccaggacucccaagcguuugaggguggagguggggugcagauccccuggugaggaggguuaagggacgguggugggggugggguggggguuaggacggggcacuuugccuaccgggaaagauuucacagggaucugacaacuuuaucauacccuuauuuccuggccuuuguuucaucacuucuguaaaauuuacaccuguuacagaaauggcggagaaaaacuaggcaucauucucuguuuuggacaagucguacauaaauccaauuuuccuucaauuuugcuuccuuauaucuuuuaaaauguaucaggaagcuggucggauugacacaaacauuuaaucccagcacucuggagaagaggcaggaggaucagugaguuagaggucaacuaggucuauguggugaauugcaggauauccaaagcuacaucuugagacccugccuugaaaaauuagaacaaggaaaaaaagaaccagguuuaagauguaaaugucuuccugugacauuuuucucaguuacuuuuucauauauuagcagauaggagguauuucuuauggaccguacacaguuaaaauggggaacgaguuaaacuuauuuuucaucucugcgcaguauuuggaugcuccccccccccagcccccaccaagacaacuggauucacugacuaauccuuucugagagguaauuguuuucucucucucucucucucucucucuuucuuucuuucucuuuuucuuuuuuccuuccugaggaaagcugcagggaaaagaagcacuuaaagacucaauugcagcugaguagaaagccaggugggacugaaaggaauuuuccgaagaauugggggguggggguggggcacagacauuaaaggcucuguuuuaaaaaccaggcacuccaagucucauggugugguuguaaaagcgacuggaaggcugccuuugggcagacaggaugugaauuccugcaauagacucauaaaagaaaauguaaacucggaccauugagccuaaugaaagaugggagcugagaacaguagauuuguccucccacagaggguguggugugugucugguguggugugucugguguguguguguguguguguguguguguguguguguguguguguguguguguuuaggaaaaacaaucuaagagaaggacacaaagaugacucguaggaagggcauuucaagauuugccuaucaacaccugggaagcagagacaggaguguucaaagcuguagguucaaggucagccuggucugcacgugaguaucaggcagggcagccauaguuuuacaguaagacagacagacagagaggaggacaacaacaugcuacccuuguugcaauguuguugcaaagcaccaggcccuuuuccugaaccugugacaaaggguuuuuacuuccucuugcugacccauuacucaacagguggagauagcucaacaccuuucuaaggagggacaguuacagccucuccuuagaaggccagucacagaaguccuuuuuuuuuuauugguuauuuuauuuauuuacauuucuuuuuuuuuuuaagauuuauuuauuuauuauauguaaguacacuguagcugucuucagacacaccagaagagggcaucagaucucauuacgggugguugugagccaccaugugguugcugggauuugaacuccugaccuucagaagagcagucgggugcucuuacccacugagccaucucaccagcccuuauuuacauuucaaauguuaucccccuuccagguucuccccagcaaauccccauuccucccacccccacccccagaagucuuuaauaguccuggagcuguucuguuggaauaaaacuuucaggacagguacuuugcuggugguuacugaacuacacaugcaccgauggagguaaauaugcacuauugcaaguuguacagcuggauggauggaucaagacauggauucuagaacauugcaacaccccaccuccccuuccugugccagguccagacuauaguuuaucgauccuagcauccuacucauggauauaccuaaguguauucauucuuccauagacauacacauuauuaucauuauuauugaucugugcaguacugggaauugaacacagagacguguaugcuguguaagcacauuagggagugauccucucagccuccaggguagacacugcugggccuuuugaacaacauauauauuuucuggucaccuguaaaauguuuucuccuuaaguaagaucgcuaaauugcuccccccccccccccccccagacaggguuucucuaugcagcccuggcuguccuggaacuuucucuauagaccaagcugggcucaaacucagagguccaacugccucugucuccugagaaaggcgugcaucaccaccaccuggcgaaaucacuauucuuuguuaauaaauaaugucuuuuuccuucuccucuuugacugcuuugcagcacuggggaucaaacccaagcauccacauguuaggcaagcaguuuacuacugagcuacucucccagaccgaauaauaaauccugaacagaaauaagcaaacuacagauuauauguaugcacuguucuguuuuguuuuguuuuuuugucagucuuacuguguagcccgagcuggccuguaacucacagcagucugccuaccucugccuccagaguacuggauuaaagucaugcaccuagugugcaccacacacacacacacacacacacacacacacacacacacacacagcacagcacaaacagcccuugcuuagcugguucucucucucucucccucucucucucucucucucucucucucucucucucucucucucucucucucucucucucucccucccuuccucccucccuuccuuccuuccuuuuuuaauguaugugccugugugaguuuuguguaccaugcagcugcccgaggaggccagaagaaaguauccgggaauuagacgcgcucuucagugcugagccuuuucucugccuugugccaauggccaggccacccaaccaucugcuuugugcaggacuaugcuauuuuaguacuaaaagucacugggcaaaacuggacaguuggucacucuacacagggacagugaccaaagaggugcaaggcuuacauauaaaaacccaaagggaagcugguggugcgugccuguaaugccaguacugucucuugaaggugaggggcauggguuugaagccagccuaguuacaagguuagacuuugucucaaaccaaaccaaccaagcaaacaccccugaaaaccugauugugugcaugagacucauugauuaauccacacauuuaugcucugcacgaauuguuaguaugcauagagacagggggcaucucaccugcugcuacucaaauccugcuuuagggagccaauuagaaaggcaaacucaagcauuccauucuucagacuucagaaucaaauucaguggaauucggugguuugugacaggcaaauuuaccagguuggcauaaaggagcgggaaauggagcccaagucugaggacaaacgacuuagcgacuuucccuuacagacgugcagcccuuguguggcuuuaaagagcucucuaggcagaagccaggcacaguggugcauacuuuaugucccaguggagacaggcagaucuaugaguuccagacuaaccuggucuacacaguuccaggacagccugggcuacacaagagagacccugucugggaaaacuaaaaucagacaaagaagcucucagccaaguacuccucccacaugaagcagaucuuacucuugguaaaaaagcuuuugcucuaauuaaaaucucuuucugguccuaagcgggaguggagaucuuccugguugcuuggcuuccgucuucacugccugcuuccugguugcuuggcaaugcuuccaucuucacugccugcuuuggcuucuuuuucuguagugcuugagaauuaaauccaguuuuuauuuuuuuccuuuucuaaggucauuucaaauguaccucaugaauugcuuaaauugugguugucuaaaaccauuagagaaaaaaaaaauguaucaaaaggaaaaccucacaaaacuuaagagaggaucauuuacuuuaagguauaucagaaaugguucacaagauaaauggcgcuugccgccaagccuaacgauaccaguucgauccuuggggccccacaugguggaaggagagacccagacuccugcaagccuucacacucauaccauaugcgugcuacauacaggcuuacacacacaauaaauuacguauaugccuuaaaaaaaaaauagaaaaagaacaaccacccgagaaacugagaaagaaacaggacuuguugaaugaguuuuugagcagggccuguccccuggguuguguguaauauggauguaaucaacagacuuaguuuuaacuccguuccaggacucaauccaaacugucgucuccagaccagcuucucuugcucaucuuuucuagcccacucuucuucccaugcccccuucucuucuccagagaggaguugccauggagauagugaugucacaguaagccagcugacagagaaaaccagaagccaaauggggaagacugcagagaguaaaagacccuggcagcaauggucugugacacggaugagaguaagacucagaagugacgagaugucacaacaaauuaacuuacacaacuggauagagacgcugcccacagugagaacacagcagcauaauggagaugaaggccgacugggccaggaguguaugggagaugaucaggacuuugaccaccagacacagaggacgcugcuggacccugcagaaagcagcucaagauagaugcaggcuaaaaagucaguuccuaggaaguguguauccacgccccauaccugagcucugcccguuuccaaggaaagggcaacuugugauuagggccuggguuucauuucuguacccuccuccaucucccuuugcuggccucuggccuuuugacacauacauaaggaaaccucccuaaaacaaaggcuaagaauacuucccuuaggcacacccuuguaucuuuuguuguuuuauuugagauggaggaaucacuauguaggcugguuuggaauucccuauauagacuaggaugaccuugaauucacagugauccagcugccucugccuccugaggugggauaacaagggggacaggacccacgccuuucaugcaugcugggcaagcccuccaacccuugauuguucucccuucaauguauaaaucucagagccuucacaguggucuuucuuggcuccccucacccuuggccagguaguacauccugaccucugucacauucuuucccacggcucuguuuccugagcccugcucauacccagcuccagucaguguugcuuauuccagcucuacacucaggugcagaaugaaguacaauuuucuugcuuuccuccuccucuucaugccaaucgcacacuucauacuccugcucugucugauaugagucacuucacaugccguguuuugccccauuuaaaaucucuccuguuugugugagucggagaccagcuuggucuacagagcuuguuccagaaugauguguguggagagagagagagagagagacagagacagagacagagagacagagagagacagagagaggagagaagagagagcccguaaauucgcguacuggaaugcagcccagggccucugcgcaugcucagugugucuuaccgcugagcuacacgcaccuaccuaaugcuuuuacuguuugccuucccauugcuuccuugacccuaacccugaaccccaagucauuuuuuuuuucacuucguauucuauacauuauuucuguaagaagacucucugaauagaaaccaggcuguuugcuacaaacgagcaucucucucucucucucucucucuuuuuuuuuuguuuuguuuuuuucgagacaggguuucucuguauagcccuggcuguccuggaacucacucuguagaccaggcuggccucgaacucagaaauccgccugccucugccucccgagugcugggauuaaaggcgugugccaccacgcccagccccaaacgagcaucucuuauuucuacuuuuagaacaaaaauaagguugagagucagcaaaccaggcuucccuggggccuugacauugacuugcuaugcugcagacuaugcugaacaaaaagaaccaacaagcaaauaacccgccucagcucuacccagcgugugaguucacaacugaagguauagaacuccgacuaugcucugcagucugacagucuugcagagauacucuuuauacaaauaguaaucuaugccugaaguguaagcccuggcaaggcaggagagaaauuguacauuucaaacugggcagugguggcacacaccuccaauuccagcacucaggaagcagaggcagguagaucucugggaguuccagagcuagccuggucuccagagugaguuccaagacccucagggcuacacagaggaagccuugucuugaauaaccaaaauacaauaauuaauaauaaauaaaauuuguuuuucuauguacauuucaacuacuaaauagguacucacuuauucuuugaaacacauacuuggaacuuccacauugguggaagcuuucucugguucauguacauguacaguacuuauagacauaauaaaaaauauuugaaugaacaaaagauucucuguguacuggcugguuuugugcgucaacuugacacaagcuggaguuaacacagaaaggagcuuuaggugaggaaaugccugcaugagauccaguuguaaggcauuuucucaauuagugaucaagggggaagggcccauuuugaguggugccaugacuaguagucuuggguuuuauaagggaacaagcugagcaagccaggggaagcaagccaguaagaaacaucccuccauggccucugcaucagcuucgacuuccugaccugcuugaguuccuguccugacuucuuuuagugaugaacagcaauguggaaauguaagcugaauaaauccuuuccuccccaacuugcuucuuggucaugagguuugugcaggaaauugaagcccugacuaagacacucuggcuauaagguuaaagauacugaggaaagacuccuacuuucucacccccgccacccauuauauuuuggguaggaacauaguuggaauuuggaaaauugaaagcauuugaccaggccuaccuaguuuucugaguaacacuguaaagaauuuucaucuuguucacccuuuuaaucuccaccagggccuggcuguuccagguaccuagaucauagcuauuuucuugucuccuggugacucuuugauccugacaucugcagucaauaccaagcaacccagcagccccagggaaaggcggacacauuccucaccuuggaggacgugugugcucuugggagcagcauucuuccaggucucucaggcucuaccucugcgccacgaggagcagguggugacaucugcccccucuaucucaccaaugacuaaccugguccacaucagugacugagccacauucuaaaacagccucgugccuugcuuuacuggggcucucaaagauaaggacagagcuccaggcuuaaguuguguuuacccgguauuaagagagagacaaaagaaaaggagcauuauuuaccuucuuaagaaaaccaccuuuccacaggaaggaaugaggaaagcacagaaaagcagcgacaggccaggaaggguaaugagauaacuaaguggcagcuuaguuugccuuuaauacaaugcugccaugugacaauaaugacccacacuuaaugacacagcacuguugauauucuaaaaagucagaggacaagaauugaaaaaggacauuuuggcccuuucuuuuuccucucucuuucuucucucuccaucuuuccauuuucuuccucuuucgcucucgagcucucucuacucccucuuucuuccuccaccuuucccuucuugccaauagacuuuauauuuaaaagaagaaggagaaggaggaaaagaaugaagaagaaggagaaggagaaggagaaggagaaggagaaggagaaggagaaggaaagaagaagaagaagaagaagaagaagaagaagaagaagaagaagaagaagaagaagaagaaagaagaagaagaagaagaagaggaagcagcagcagcagcagcagcaauggagacuugagauccucuugguucaguuuaccaaaugcuguuacuaugcccaacauugaaaacuugaaguggaaaaaguaauaccucacuuguuuucccaauacagucuagaaagauuacuaauggacgguuggauacaccaaaggggaagaggaguaaguaguaggaaggagaaugacuguauuagucuuaaguagaauuauuuaugaagcuuaaagcauaacaaacugcuuccuauagaguuaaugacaucagggggacacuggagaccaguauuccacaugaugugccgcugaugguuugggcuggauaauuaugcacaguguuuuaaguauagccuccccucacuggaauccuucugguuuucuuccuaggagugcuguguauuagacccagggccucagcaaugcuagggaggugcucuaccacugagcuacccaccccucuauccauuguauuuaaacauucuucagcauacucaggacaagauuauccugagaaauugccaaaugcccuggugggaaaaaauaaaaaacaacacuggcuugauuauaucuugaaaaccucuaauauaauaccagguagagggcuggagagauggcucaguguuaggagcacuggcugcucuuccagagguccugaguucaaaucccagcaaccacaugguggcucacaaccaucaguaacaagaucugacucccucuucuggagugucugaagacagcuacaguguacuuacauauauuaauaaauaaaucuuuaaaaaaaaaaaaaaaagaacuaaaauccagggcuggagagauggcucagcaguuaagagcacugacuacucuuacaggggugcugaguucaauuccccgcauccacaugguggcucacaaccaucuguaauggaaucugaugcccucuugugacaccaucaguguauuaaaauaaaaaaaucuuaaaaaaaaaucuuuaaaaaaaaaaacaaaaaaaccacccucauuaaaaaauauauuuauucuagcuuggucuacagaggaaguuucaggacagucaggaccacaaagagagacucagccucacaaaaccaauauuacacacacacaucccuauauauaguguacucauuugugcuuguguaaaugguaugugcaguaugcacauacagguaccugaggaggucauagggaaccggaccccuggaauuggaguuacaggugguuguaagcucuccagucugagugcuggaaacuaaacucagguacuuuacaauaacaacaacugcuuuuaaccuuucaaaacacugaaccagcgcuccagccucaagaaaacucauuguuaacaagguuuagaaaaaaaaagagagccuggcuugaugaugugacuaccuuuaaucccagcauuugagaugcagggcagacagaugcuugugaguuuaaaaacagucucugcuauauagaaagugccaggcuagcuaggauugcauacagagaucuggcuuuuuguuuuuguuuuuguuuuguuuuuuaaagcuucuuacuaggguucaaguuuuaccaaauuuaauccuuuggucccuuucuuuauaaauuaugagaaaauacacauacaagucaaaccauuaauaacagagucacagcuuaaauugauugguuuuugaacccaagaacagaugagaggagauagccuaagcuacagaaagggaaccugacacagugaugagaacaggagaaacaggcaaaucauaaagggcccaaauguccaaagacugggccaauagaaggaaacaguuguggcccuaaccaagucuuuccugacuuucgaacuaccuggagauguguuacaagaauaggacugcugagauggcucagcagguaaaagcucuugcuugcaagccugcugauaugagcucaauccccgggaguguggcgacuucagcacacauacauguucacacacaauguggcgaaaagaaguucuaacaucuucuucccucuugucacucaagucugagcucaauugaccguguaucugauguugucccucucuccaugacuuggcaaauuaccuuguuuuaauuuuucauacuucuuuaacauuguacaauuuuauuaaauaagaaaacuguauuuuuuuuuuaacucacauugugagucagagaaaagcuacagugaugaaagacaucagagauguggcaagaagaaagaaagaaagaaaggaaagaaagaaagaaauaaagagagaaagaaagaaagaaagaaagaaagaaagaaagaaagaaagaaagaaagaaaggaagaaaagaaaaggcuaguguuggaucaacugaagcucuagaauccauuaagucaguacauaccaucacaagacgcuugcuuucuuucuuguuuuuuucuuaugcgugaagugcuuuaccugccugucugugcaacacaugcacgcagcgccaaggaagccagaagagggugcuggauccccugggacuggaguuacagaugguagugaaccugcaugugagugcuggaauugaaccuggguccucuaaagagcagccagagcucuuacccaccgagcuuucuucccagcccucugguuugcuucacagugaguucuucccacccacgucaucuucugccuggauuuuccccuacgcauuuccuacuucaguauucuaugcuuauuaucucagaacucaggaugagguccuguucaugauucccaguucugcauugcguuucucaaucuuagaucaucuuuccuuggcugucaaugaaguguuuuuuuuuuuucucccaaaugcuacuuauuuguaucgucuuucuccuuccuucucugaagccaacugggaaaauguugucccacaucacuaaaggugaaggcaaaaggguagccauugaaagagguauauuuccuuaccacuggagucucuugguccaccucacagcccuaacaggacagcuuaggcuacagcccggucaccugagggucucagaggggugaagccugaugccaggagacuguaauuggacuccugucccaaagugcccugacccuuccuucuuuccuucucucucucucuuuaaaaaaauuuuuuucagacaggguuucuuuuuuuaacaguccaggcuguucuggaacucacuauguagacuaggcugacucgaaaucagacauuggccugccucugcccugagugcugugauuaaagccaugugccacgacuaccccugugucuauacuucuucccacuagguuucuguccuucagggugagcuaugcucuggcuuuccaauucuccuucucccauucuguuccagcaccuuucagagcaucuaggagucugcagagauccagcuucuacaugcaaauuacaugcccauuauuacuaauauuaaucaauaagacauugaccuuugcuguaguuaaaauucuuucauuguuguccuccuaugauaauguccuuguaugaaggguucucagaaaaaggggacauuccacaccugggaggaagcaagggaaccacaaaagaggaggaggagggcacugguccuugcuccuuauauuucaagcuugacaagcugagggcuuucccagaggcaaagcugguuucugacaauggagccaggcccgcagcuucucuggaaaggaccccguaagggaaccagcucacucuaaaguccaaacacuauuuucuucuuaucuucuagugagagauaacaaggccaacaacagcauuccaagcuuaucuucauuacaaucagcagcucugugguuagcagcaauuaagggaugagaguggcccucugcccucuccgcucccugccuuaggcuacccaggugcuaguuagggucuuaaucauuuccaaagggaacaggcuuuuugccuacagguucaagcauccccuaccccauuccauugcaaucuuuguguuuguuuuugguuaucuaucuaucuaucuaacuaucuaucuaucuaucuaucuaucuaucuaucuaucuauuuuuuuucugacacagggucucugaacucauucuguagaccaaguugucccgagacugacagaaaccacuugcucugccuccugagugcuggaauuaaaggugugugccaccacuaccacugcucagaucauuucaaucuuccugaggauauuucuguagcaaaagaugucaaugaucaaugacccucucaaugagaauucgguccaucacuuacacuuccugagccucugaacuucuuugcuuucauuuggugucuuucuuuuuauuuucucaagggcugaucauuuguuugcuauucuuguuuuugauuggacucagaaguagaaacugucaccaagggcagccuauguauuuuaaaagcacacaugcacacaugcacacacacacacacacacaucuguuaugagaacaaggcaggggcugaagagagggcucagugccaacugcccuuucagaggaccaguuuccguucucagcauccucaucagggagacucagucaucacuucauuugcuggguauccaacacccucuucuggaugcuacaggcacucucauguguacauaaaauaaauauguauucacacauacaauaaaaaaauacauugauuguuuuuuugaugaaggugauguuuguuuugccugaaaagucaauaaaaauugacacugccgggcuggagagguggcucagccuuuaagagaacuggcuauucuuccagagguccugaguucaagugucagcaaccacuugguggcucacaaucauuuguaaugagaucugauguccuccucugguguguccaaggagaaccacaacguacucacuuccauaaaauaaauuuuuuuuuuuuaagauuuauuuauuacuauaucuaaguacacuguagcugucuucagaugcaccagaagagggcaucagaucucauuacaggugguugugagccaccaugugguugcugggauuugaacucaggaccuucggaagagcagucggugcucuuaaccacugagccaucucuccagcccccauaaaauaaaccuaaaaaaaaaaaaaugacacuacccaguucuaguuaaaauauuucaaaaugcauaguuggauaaaaauaaauauguaaugccuuuuuagaagauaucugcuaagauuuagauauucagccagaugugguggugcaggccucuaaggcaguacuugggaggcagaggcaggugaucucagaguuccaggccagcuugaccucuaaucccaggccccuggaggcagagacaggagaaucuuagagcaaguagugagcucuggguucagccaggcacccuaccuaaguaaauaagguaaaaaacaaucgagaaauaccccuuuugccaauuucucaccuguacacacaggcgcaugccccccccccagggcacacacauguguacggcacacauauguacacauauacccgcacacauuccaacauacaugaacuccuauacccgcacaccacacacacauauucaugacaaaaaaaugacucugauuuucaccacaauucccauaaauuauagccguaauacacacagguacaaagaugaucgccacagcauaaugucacagagaaagucuggaaacacucucaaugcagggggauuuguuuuaaaagcguucuauuucaccgugagcuucuucaccuccuuuuguuucucuauauuuacacaauggcguuuuuuaguuccuugggcuugccaggcucuuggggacuagaguguccuuuauguuuccuccgcccagaaagccccuucuuuccuguggcuagcauauucuuuuuaaaagccagcuguaaugugaguguagaaaaaggcucccuguccauuuguguuguuaggaggucucuguuaauuugauauuaagcgauuacugucuccuucaauaccauguauugugucuguuagaaagcagucucccacaauggacagccaugcacagaacacuauggacccauuaaggcaaugacuguaaccauauaaugacuuacaaguauguugagcucauguuucuucacuguguauugucuuaaauguauaagaacagauaggacacaagacaucaaccagaaggcugaaaaucuauucucuguauauauugacaaugucaauuguguaguauaauagacuaauacuccauggugaccagugagcucuggguuuaucuagggucccugcgucaauauaugagguaaaaaauauuugaaggacacccccuuugucaaccugugaccuacacaugcacgcucacacaugugcccacguaccugcacacuugcaguuagaaaggugaugcaucuuccugucuaggugcucuacugagcacuggaggaaccuaaagaggcuauaaaggacucgcacaugccccacaggaggccuaugguuagaccuaccacagagcuaacaguagggggaggaagggaugucaagcucacaggguuaguguuccuaagaguugaaaagaacaagaaugcaggaauguaugaguugugccuuauaggguguucucaggccaaaaaaaaaaaaaaaaaaguacacaacagucaggugugguggcacaggcuuguaaucccuagcacuugagagguaaaggcaggaggaucaagaguucaagacaggaggcuggagagauggcucagugguuaagagcaguuaagagacugcucuuucagaauuccugaguuuaauucccagcaaccaucuguaaugggaucugaugcccucuuauggugugucugaagagagcaaugguauaugcauauacauaaaaucaaucaaucaaucaaucaaucaaucaaccaaucaaucuuaaaaaaaaaauaguucaagacaaguuugaggucagccuaggcuacacaagacccauaucaaaaaagagaagagaugggcuggugcguaaaugugcucuccauccugucugacaacccgaguucugucccuggagcccauaugguggaaggagacagaaccagacuaaaacauauuccaagcugggaaaaccagucacacaggucagagagagagcagggguaguuuguguuaccagauuagauagacuugcauaaggaggggaauuaagaccaacuauauuauuuccuuuguuuguuuguuuauugggccuucugcagagaggucagaggacagcuuguucucuucugccaugcucuuagcauuccaacucagguuguaggguuuagcagcaaguguccuuaccugcugagccaucuugacagcccucuguucuuuucacuauaaaacuaaggaugcuuguuuuuucuuuacauaggagaucuaucagauguauaaacgaaguugaagacagaauagggguacagacucugugaguaugaauacagccaagcugaacacaagugagacccauacuccagcauggcagaggcuaaggaaaggcacagcccaucaagaguuuggcugugagugacagaguguuucaagagcagcauuucaaguaggcacacugcaaaaacccugcaggcucagcgguagugacucugacaaaggggugcgguggggcaggcugggguggaagaaaacagcuuucugggucucaggggcuucugggucacaagaguuugcaggacucgacaggauggugagcuuugugauccagcagcaaaggaggcugagagauaaggggagauuuaucacaaaucgauaaccaagcuagcggaggcaggucaagcauuuggacuuugucugcugacuaagaugccuggcagguuaacacagcaaaaguguguccagacuuggacuauagaaagaucacuaguaaagccuggggucacaggcucuuaagcagcagaugaggccagcaaggguuagagugaacaucaagccaggauaggcuauauugcaagacauagucucaaaaaaaaaaaaagauaaaaauaaaagaaaaauuaugggcuacaugauagaaaccaccaaggagaugcuuauuauaagaugaugacgauagacuuaaauauuugacaggaaacucagaauaucagcucucaaaaucuuuaaaaaguauaucuuagugaugggcauaguagugcaugccuuaagcacucucaagaaagaggcaggaagaucuaucucugugaagguacccuggucuacauacugaauuccugaccagcuaaggguauauagggagacccugccucaaaaaagaaaacaaaaugcaaaucuguuuucaaguaagcuuuccugagaaauucacaugauuucauuuuccucucauuuuccucgggagagauggaaaacaaaaggcacaggcacagccaugacaagaguaggagaaacagagaaccugccauugggguauuuagucaguagacauuuauccaucagcuacuauauaaaggacuuucuugauccuguucacuguggaauuaaagagcaagacagagaaagagcacuggagacagagauaucacacacauucuuaaagcuacugcuacguuucuaaaaugugcugccugcucauggugacaccguggcagagggcugcuguccuuccuguaggaacaaacauuuggaaaacauuucagcagaucugcuggcuggauuguuccauaucgcugcuccacucgugcugaccuuuaucucagccagguuggagccacagauaacaccuuaagagagauuuggaaagccuguguacucaaagcaggguguccagggcagggcauaggcaagcagaggggaaagcaguaggaccauauggaacguagccagggaaggaaaugaacuaguaauauucacagagcacuaagugauugugguuuaguuacacaauaguucccuccaguuccagcaacuggcuacauggggcagcuuugaaugccaaaagaauuugcuguaugaagugcaagcucuauucccaacugcaugaccuuggccaagcuguccuuaauguugacauccauaaagugauggaagugauugcauugauggggagaucaaacacuacacguuaaagugcacaguguaaaguacggaguuguuacugcucugaaucucaagaaguauaggaaaccugaggucaggaaauagcauauccuaccagcagacuuuccucaagacauuucuccuuggaucuagcucgggaaaucaauggggcaauauuugacuaguaaggagacgugccacuuugaggagaaccccuuugacuuucagcccagauacuaggcaauccaucuuuaugcucuucugcagauauuuaugucaacuuccguuuuuauuugcuugcuuucuuucucuuucuuucuuucuuucuuucuuucuuucuuuccuucuuucuuuuucugagacaggguuucucuguguagcccuggcuguccuggaacucacuuuguaaaccaggcuaaccuugaacucagaaaucugccugccucugcuucccaauugcugggauuaaaggcacaagcuuauuauuguucaucuuaugugaaugaaugcugugccuauguguaugucugugcacuacauguauuccuggugccuguaagccagaagaggguuucggaucccagaaguuaaagauguuuguaagaugcugggaauugaaccuggguccucugaaagagcaacaagugcuccuaaucacuagcucuuauuauacaauuuuuaaaaauucauguuauuuuaaaguguguguguguguguguauguguauguguugcacacgcaugugugcaucuuagugcaggugccugcagaggccagaagcagguaugagaucgcugggagcugaaauuauaggcauuugugagaccucugaaguggguacugggaacuggacccagguccucuggaggagcagcgagugcucuuaaguacaugucuacagcccaguccauugcuuucuuccuuaaaauugguuuucuuucuuuuuuuuagauuuuuuauuagauauuuucuuuauuuacauuucaaaugcuagcccgaaaguucccuauaccccgcccccccccaauauugguuuucuucucuuuuucuuuucuuuuuuuuuuuuuuuuuuugguuuuucgagacaggguuucucuguauagcccuggcuguucugagacucacuuuguagaccaggcuagccugaaacucagaaauccgccugccucugccuccugucucugugcugggauuaaaggcgugugccaccacgcccagcugauuauugguuuucuuaagaaagugccugguagcugguggugguagugcaugccuuuagccccugcacucccgaggcaggagcaggagaccgugccuggcuuacuccagucucacuuccuuucacuacuuugcuuacuugggaaaaggagaguuuuaucucugagccacuguaggaagggcauuauggcaacugguguugucacaguagcaaagugacagcgcuuguuuuagucacugcuacucacucugucuucccagcacuggugacaucaccaccugugugacaucaccaccugugugacaucaccaccugugugacaucaccaccugugugacaucaccaccugugagacaucaccaccugugugacaucaccaccugugagauaugcaauccagauguggcgaaucagacucuugacaggguaaggccaagacaccugcaacaagucuuacaagcgacucucacgcaugcuaaagcuuuaggaagaucaccuggcagagagguuccugucugggucaaacuuaagaugguugaggacuggagagaugggucaggaguuaaagguacucgcuguggaagcaugccaaccugaauuugauucccagaacccacaugaaguugggaguggagaacagauuccauaaagccguccucuaaccaccacaggugccuggggccuguacacacagauacauauacgcaauauaaacaaacuaacagucaaaguaagaugguuagcauggaaacauauguuaacauggguauuugagauaaaaauggaagucagcuuuucucagaaguuuaauuuggcuaaaaggcuugcccaggaacaaaggcuuuguguuuguuuauagcuuuguaaacuggaauguaccaucucuaguucagguugguuuuuuguuuuuuuguuuuguuuuuuuuucuuuuucaagacaggguuucucuguguagcccuggcuguccuggaacucacucuguagaccaagcuggccuggaacucagaaaccggccugccucugccucccaagagcagggauuaaaggcgugcgccaccacugcccaacuuauuccaagguuuuaaaucucuaaauccucuacaauggcuuuuaaguauaacaguuuaguuuggaaaguuuuaauccuaggcuuugaagcuucuuugcacaagaggucuuccuagaccaccccgcccccaacuacucagagaagcaccuuuuccuacuuugcaugaaggcacugcacccccuucuggccuugggggcaacaugcauggaugugguacagagacauccacacagucaaaauauccauacauuuaaacauaaaggaaacagaugcuaaguuuaaaaugugugugugugugugugugugugugugugugugugugugugugugugugguggcaggugguggugguagcaguucuagaaaacuaagagaacugagagcagaagucucccaucucaaagaucgccucuuccuccuuugucuucaguaacgcccaguaggugcuccccaucugcacugcaaccugcaagucucucgcuuucuuuccauuuggggccuccuuuuuagcuuuuuuuuucuaaacacacauaaugcauccaaacaauuuauuuaagcaucuguugcgguuuggauaugaagugccuccccccucuuccuccccacacccaaggcucacgugguaaaagguuugguugagaguuaaaaggccuucugggaagaaccaugcaggaccugacuaauccacagcucaguggauucauagcucgauagugauauggaucacgugggguggggcccagccgcaggcauuccuuagaagaauaucuaaucccuggaucugucuucucucugcaccacucuaccaugagaggagcugccucucgccaccuuaggcuuccggcuagccaccucaucgagccuuggccuccagacaauggaaccaagugauaauggacugaaauccuggaacugugagagaagaaaucccucccugcuuaaguuuucucagauacuuugcaaugacaaaggaguggcuaaauccugcauguguggugugagcucagccucaaccccuggcuccgcucugagagauauuguguuuaacaaucucggaagggugaaccuccuacugagucguuugcuggcccucaucugcaagccaccgagucagcagaaccauccaagagauccucccuuagugauuuugucaugggcaccugaccucagaggcgccugcgcucugagauccuucuccuucccgccucuggucuggucuauguugaagucaaucaggugaaccuaauuuucagugacccaccaccucugguuuccuugucuuuaagcccccaacucaacacacaagugucagaggccaaagaccuccgcuuucuaauguuaaagcccacgcccuucccauaacccuccuuccuccgcucccaggccacuaucucuccuuccauuccuuuuaucauccguucccuaaauagccucaaauggcuucucggcuucccaggguuugucuucuaggccuaauuaaaaacaguucacaaggcaccugccucaccucucuuaguugaaugccuggcuaaaaaagcaguaagaacuuggaacuacagggaucuacacugccaccuggugccaacugucaaaauagguuggcauccuagcaacagacccuggaggcagauacaccaacgcacuggucgugggcagaauaggagcgcucuuucuucaaaccaguauuuucucugccugcaauuaucuuaucuuaacaagauuuuauuuuauuuuuaccuaccagaauucuuuaauuucuuccuuucacuggggacugaaucuagagacucguccgugcuaagcaagggcuuagcauacauccccagaucucccacucuuuuuucucucugcuaaaucuccaagaucucuuuuuccuuuugacuaaacuaaccuauuauuuuauugaaaauaauaaaauagaagcaaaagaaaugaucuaucuucaguaauaaaucuaauuccuguucuauguacacucucaguuucuugucaaacagauacagggucagcuacuccagcuaagccacgccuuuucuagauagccggaccucuuucuuauuuuuucacccaacaauccugucuggaaagugacuccuuucuggaauacaaaguuacuuuucuaaugaguucauauucuaaguccucauauucuaaguccgucucauuugagagcuacggaacucaggagaguggacauuugugugguagugagagcuggacagggauuguacagccugugagaucaaguggggugcugagcguuaugacgcauuaaagaaucccuaagccgggugugguggcacacgccuuuaaucccagcacucgggaggcagaggcagguggauuucagaguucgaggccagccuggucuauagagugaguuccaagacagccagggcuacacagagaaacucugucuugaaaacaacaacaacaaaccccccccaaaaacaaaaacaacaacaaaaaaucccuaaaauacacaguuccuuccugaggaucaaagcaagaauucuccuucuccucugacccucucucuguuccuuuuuauuugucuaauuaguuuucagugccaggaauggagcuuaagcuuuccaggagcuggacaauugcuccaccaccaaggcuuugaagaacggcuccauuucccucagucagccucugucacggucaccgacacacuccaucuugacagggucaccaacacacuccaccuuaacagacccaaucaugguuaacagacccaaucauggccacucacaacacauuucucugcuuagcuguguuuugcuuuguuuugugacagggucugaaguagcccaggcuagccucauauuugcuguauagcuaaggaugaccuugaacuucggaucuuucugccuccaccuuuccaagugcugggauuacuggugugcuacuguugcgccacaaagcauuugugaaccccaaaagaccaccaaggugcuauuuccgauauaaucacauuaaggucucuauauuaccaacucaaguuuggacuuacucaccacuggcccacaggaugguuuuuggugaggcagcuccaaacucucaccgagacaagauuuuacagaagauggaaguaaaugagggccuagcuuggcaaucaucuaacugcacaacuauuguaaaccgacaggugggugcucugaagcaagaccguauacaaucacaaaccugucuguaagcacaucugaaacaaucagacuaauuuuugauuaauugcugcuaggaaguagcuagggaguaacuccggccaaggacaagcuucgggguccuuccugguacgugggugcagcuaagggccaagaucucaggcuuuuuuccccuguauuacaauggaggcucguuccaagauggaguagguuuggccacucacuaccaccguugguuucuguggugcuggaaauaaaagauaggacuaucaccuggguuacacgucccgcucucugauuuguuuguuuauuguuguuuguuugagacaggguuucucuguguagccuuccuuggcuguccuggaaaucgcucuguagaccaggcuguccuugaacucaaagaaaucugcacaucucugccuccugagugcugggaugaaggaaggcaagugccaccacgcucagcucugauuaguuuuuaagcuacaucuucccagccuuccuuagcuccacacacacauuuaaccuaccaggaagccaggaaggccuuuuaauuucucugcuuggauuuuauuuugggguguggggacaaggugucauaguagcccaagauaaccuggaacuuacucugcaccccaggcuggcuucaaaugcauggugauccuucugccucugccuccuguguacugagaucgcaggcguugcguccggguucacuuggcuuuagagccaucacccuagguuucuacaccgucuuacugugguuucucagcauugcuaaauacuagcaguccucaaaacucaguacucaaaccuuucucuucugucccagcucccuggaguucccaauagggaucucagauuugggccuuacacuuggguuguuggccugggugucuaucaggagucagaugggaaagugcucugggacccugcccuguuguacucuaucugguccuuucuccaauuuucccacuagggaugguugcccccaauagaggaaucagucuaucuucuggauaaccuuugcaccucuggacaguucauuagccucuuuuuuuuuaaaaaaacauuuauuuauuuauuuaauguaaguacacgguagcugcccucagauacuccagaagagggcaucagauuucguuacggaugguugcgagccaccaugugguugcugggauuugaacucgggaccuucggaagagcagucggcgcucuuaaccacugagccaucucgccagccccagaacuagaaauguguagcguuuguuuguuuguuuguuuguuuuuguuuuuuguuuuucgagacaggguuucucuguauagcccaggcuguccuggaacucacuuuguagaccaggcuggccuugaacucagaaauccaccugccucugccucccaggauuaaaggcguguaccaccacgcccauuccugugggaucuuaccacuuccgauaguccagucacucuggcacaagucacuuucacgauaacccgugguuccuagaauagaacucuucucugucuccuuguuugccuucacaugaucuaaucucuagacaacagccagagugaccccuuagaaacaugcaugugaccucauuuuucccauugucaacacuccuccauggacuaucauauuagaucgaaacuuuaguuagcuauguuaucaucuuggugggcugcaggcccucugucaucuggcucaggguccuuccauuucccauagcucuccuccucggcucagcacagucaccuccuugcuuggugucuguuucuuuagcccagggccucacauaugccaagcaagcauuuacuacugagccaauccuaguccuccuuagacuuugggucugacacagggccucacaugugcaggacaugagaacgccuaagaaggaaaugaagucaaaauaacaauauagaaaaugggaugaaagaaggggacggaguuugcucauucugauacuguguccgguuggggaaaaaaaaaaaaaccucuucaggaagaaugugggcagaaauggauucuccagggcauccagugaucucuucuggacucugaggggaccuguauacacacgacauauauggauauguacacauacaccuacauaaaaugaaucuuagauaaaacauggcuccacugagaugcagcuaacacgccauacaauuacagaugugauuccagcacuggggagagguagaggcagaaggaucagaaguucaaagucaucucagcuauuuguagaguuugaggacaguaugagaugcaugaaaccuuaccuucaaacaaaauaaagcaauaagggaagagcaggcccaugagauggcucacugggaagagcaggcccaugagauggcucccugggaagagcaggcccaugagauggcucacugggaagagcaggcccaugagauggcucacugggaagagcaggcccaugagauggcucacugggaagagcaggcccaugagaugggucacugggaagagcaggcccaugagauggcucacugggaagagcaggcccaugagauggcucacugggaagagcaggcccaugagauggcucccugggaagagcaggcccaugagauggcucccugggaagagcaggcccaugagauggcucacugggaagagcaggcccaugagauggcucacugggaagagcaggcccaugagauggcucacugggaagagcaggcccaugagauggcucacugggaagagcaggcccaugagauggcucacugggaagagcaggcccaugagauggcucacugggaagagcaggcccaugagauggcucacugggaagagcaggcccaugagauggcucccuggguuaaagcacuugcuugcugugcugcgugccagcugagcuccaucccugggagcccgggguaggagagaacagauuuccauagcuguccucaggccuccacuaaugugccauggcacaggcgccuaugcacacaauuaaauucacaaaauaugagugaauauuaacccaaaaccaaauagugggucugauuuaugcauacaugauuuaugcaagcgacguuucugagugacucuaccuucaugcuguugaccgacauauaaguuauauauauauaaauuauaaggaauuauagaggauugagagcaagaauuuuugaaccuuuuuauuuuuaauuuuucuaaauuaauauuucuuuaugauuacauauaauaaauaaguaaaaucuuuaagauagagggaacuggugagagggcucagcaguuaagaacacugacugcucuucuggagguccugaguucaaauuccagcaaccacaugguggcucacaaccaccuguaaugagaucugaagacugcuacaguguacuuacauauaauaaauaaauaaaaucuuuaaaaaauuucuuuaugaaccaaaauccaauugguggauuucagguuuuuucccucccuuuucucucucuuuuuuuuaauguuuuauguuauuuauugauucucccuccaaagagggguguuucaguucaacaaaaccagcccagcacuagcagaaggcagccccgagcucaucacaguucagcugcugugauccacaguuguauugaacauaaaacgagacgucccgugccauggcuuguggcgacagcaaagggcacuuccaaaaacagccgucccauggggagggacgacaaacuugacaacacagaagggagcguuugugaagccaggagcuugagcugggugugcaggagacuagcuggcuuuaggcagccauggucaccugccucugcacugaagugcucccuggcuggagagagccugccuggcaugcuagccaugaacuguacccaagugacuuguacacaggcagcccccugguucaaggcugccugcagaauugggagacaauguuucagccacaagagaccugauggcccacucccaucuacccaagauccaggcccccagauagagucauguggguaguccuuagggucccugccucaggcuccuuaaacuggaccauagcccaguaguagguuguaaaacuagguucagagcucacaaacagccugccacaaaacaaacaagggaucuaacaucucugcaaacuuuacuucugcaacauggacacaagccacaccauacggggaagcacuucccuugggcucacugucaacaccagaccagccagugcccgggcuguuuccuguugcaccaugauuugugucccgcauccccuggggaagcugguaccaugggcuuacuaugcuguuugggacagugacccagagaccuguggccucuuccaaugagaggaaugggaggaccccagaaugcucugucagcaugagucugcucuccgugcaaggaaggcuuugguccugaugccacccuaggucccacucacugagagggaucccugacugugcuuuuaggagccaguggucauccccaggcccuuaauccugggucuguggggaaccuacauaugcugguccucaauggggucugcugcuagacuccaggugugagcgcuugccaguggccaacaccccagggugaucuccuggcucggggaagguccucuugugguugcgcccguugggcccgccucggugcugcuugcacagguccccguugaggauguccuggauguguugcacgaucagguugauggccaccauauuaucaacuccucgagggaugaucacgucagcguacuucuuagucggcaggcagaacuccucaaaggcugguuucacaaaggcgguauacugagucaggaucuguuccaggucccuuccucguugcacaucccggagaacucuucgagacagccuaacaucagagucuguguccacaaagaggcgcagguggaacaugucccggaucucccggguguagaauaccaagaugcccucgaacagaaccacaucagcuggguagaccacaguggucucugguaaccuugagugggucacaaaaucauagguagggaccucgacaguuuugccuucaacaauguuuuucagggucuugugcaucagaucauuaucaaaagcaucuggguggucaaaauuguacugucccuucaaagccuuggccuucugcucggccgucagaaccuuguagaagcaauccuggcucaggaugaccaacuugcgcugccggcgguccacuucguucugucccagcagcuccaugaucuucucacacacuguugacuugccacuagcggugccgcccccccccccccccccccccccgccgaagccauauccggagcaacggacauacauucaccgacucugcccgcucccgccgggacauagucccucccuuuucucuugauucaucuugaacucuugaguuuuugcccuuuaugcuaggaugauauuggacaugauuucaacuaguauugggcauuguuaaaauggucuugucaaaaguaaaaccagggcaagugagauaaccgugucaccagcauuagcuacucuguggguucuucuuucuuucacccuucuccacccuuucaaccccuaacuuuagauagaagagaaaaaaaaaaaggagagaaaggaaagggggugacuuuauuauuagauuauuuccugcugauuaggacuguugaguuucuuggggcaaguuugaucuucacugucaggauaucuaauuuuuuuauuguuuccucuuugugcaccacuauguaauaaaccucaaucaacaacaacaaacagcaacuaaccaccaaucaauaacccacccuaacuaccaacucaacaaccaacuccccacugucuuuggguccuagcaucuauauaccuucugaaaagucccgagaauuccaaaugucacauaacugaagaaaguguuugccucuggcaaaaucacaccccugcuagaggacugggcaaaucacauucagccgcugugaacaaccugaagcagccccaugucccauaccugggaucaaagugaauacauacucauaauauuucucucccuuccuuccuuccuuccuuccuuccuuccuuccuuccuuccuuccuuccuuccuuccuccucccucccucccuccaucccucccuucuuuucuuuuuuaaaaaaaauguauuuauuuacaaauacaguguucucccugcauguauacugguguaccagaagagggcacuagaucucauuacagaugguugugagccaccauguguucgcugggaauugaacucaggaccucuggaagagucguacucuuaaccucugcaccaucucuccagccccuauuucuguguuuuucaaagacaccaaaauuccuaaauacucacuacagcucaucugauaaagaugccuguuacuaaaccuguuuuuaauuacuagcaauaucaccaauaaaacuuaauuuuuaccaaauuuuagaggacuuuuuuuguuuacaucuauauugcuauaaacuuaauagauauguacuuccuuuagaauaaaacaagaauuaggggcuggagagauggcucagcuguuaagagcacugaccgcucuuccagagguccugaguucaauuuccagcaaccacaugguggcucacaaacaucuguaauggggagcagguguccucuucuggugugucugaagacacaaacaucuguauuggggagcugguguccuccucuggugugucugaagacagugacaguguacucacauacaugaaaucaaucaaucaaucuuaaaaaaagaagaggcugaaaaacaaaaacaaaacccccccaagaauugggaggacacgguggcacauacuagucaucucaacauuguggacugaggcaggaagauagaaauuugaggccaaccugagcuauauaauauccugucauaaacaaacauaaaugauguaugauacccuuauauaauaagggugguauagucaagaagccuacaaauaagaaagcguagcauaugcuuucuuuaucuuucugagaccagguagcauaagcuagccuuggacuugcuuguuacccaugguaaccuacaauuuuugaaauggaaaacagaguaaccccuugucucaaauaguaaggcucagcuauucaauaaacagggugagguugagccaugcccaugaucugcaguagggagagcuggguggggaguuggggugggcaggguccagagcagccaugcuuuugguuggugaagaaaacaaacacguuaaaaagggaacucauucggaaaguucauggcacugccuuccuggccugucugcccuaguacagcuaguggucauugaacacccacucuuuucuguggcacugccugaccaguaaacaaagcacuccucccccuggcaccaaugccaacuugcuguagaacccagacuuaaucaucacccugugcccugccagcucuucuggaucucacuggcacagacaaacccgguuucucucgccaggggaauugauguacuguuuguaucauaaauuccaggcacugauuuuuccuccagcccuuggcuucucaguuucugugacuagauuuaguuucugccucucaaauccuguaagugagcccugucugaucauccaggagcacucgcuguaggguaaauuccccuggcucugugcagcgcagcuguuucuuccagcuugaggcauuccuuucuggaaggagagagggggcugcaagcuugccaagaggaggccaaggaagcucccugagguagguuaagcaacugcuggcagggguuggggugaggguagaggguggugagcugagugagggaccugccugcaaguuguggagggaacuccaacgaugaaucucacccaccccuaugagcuucuuuugaugacgaagcugcugccuuugagucacccguaggcagauaagucauucccuauccauauucugguuaaguuacaguuggaucagauugaaucaauucuuuggucugucaucaguacccuaccuggggugaauaaauagguguccaugucuaccuaagaaaagucauacaauauauuuaauagaggcauaguaggaaaaaaaagaucacuuaucucacuucuguaguuuauguacuuaugugacugagauuggccccuaugcaaggacaacaugcaaaugugugaagaaccaaaauaugauauaaaaaaugauauaaaaauaaaagggagacuuggagggacagagaaagacaaaggauaaggggaggagggaauauuaccaaaugauuuaagaacaguacauacaccuauggaaauacauauauuacaaauaguauaugcuagcaaugauacaaaaagaauggcugacugauuuucucaguuugaaaagcacgccaaaggagacaauguuucucuaaggccaaccauuaaagucaaaacaagauacaaggggaaaaaaaugcucaguagagugccacaaggcuucaaugccagcacucaggaggcagaggcauggggaucucugcgaguuugaggccagccugguuuacagagugaacuccaggacagccagggcuaaggagaaaacccugucuacaaacaaacaaacaaacaaacauaccagcaaauucccagagaacagcuuuaugcaaaguccuucccagaaauaaccauguguucccugccuuuagguaacaugcaccaaccaucagagggugucugcccuccccuaacccauuccaaaaggcugagccucacguauuaccuuccguggacauuuuaucacggugcuuugcaaguaacaugccuaaguugcacaccagagaggcuccugaaagaaugguggugguuguacgcauucauaauucauagauucuccacugcuuuucauaucuauggcaccaugguucuguucaagauuuccucauaaacacagugugcaacccuuaacaagaguuacagaugcuguuacagugcugagcucgaguauuuuaucauucuuguuacuuugaauaacgcacacugaaacuacgaagugggccagcaaaguggcucagaagguagagggaccugccacuacaccagaugacuccuccuccagccucugcccaggcaccuugguacccaaacauggguguguacacacacgaacacacacaauaauguaauuuuuaaaaguaaaaacacugugaauggcaaauguaaugguggggugauugcccaguauuaagaagcccuguguucagcugcuagcacuccuuccuauaagcaggccuaguggccuaggccuggauguggaggcuggaggaccagaaaaaguucaaggucaaucuugacugcauagaaacuuuggggcguaucuuggacacccaagacucugccuuagauagacagacagacagacagacagaaagaaagaaagaaagaaagaaagaaagaaagaaaggaaggaaggaaggaagaaaggcuggagaugcuggcauacaccguuaaucccagcaucugagaggcagaggcaguuguggguuggaggccagccuggucuauauagggaaguucuaggcuagccauggcuacauagagagaccuugacccccaaaaucucaaaaaaaaugugggaacauguuaagccuguugacugaagcagugaugggcucuccugucaucauuuauauguuuuuaauuaucaagacaaaaggcguucacgaaggugguaaauauggagauuaucaacaguagcacaacaauuugauaccagucugacauuaaucuuaauacucacauuauguuugcugcucuccaucucucuauuguagcaagacuugauccuucuucaaauuucucuucaaggcacagcuuccuguaaauugcaauuggucauuaguuauuuaguuauucauucuaucuaauuaaguuuccugaaagaagagcucgugaguuaucuccuagacaaaugggcacugugacaccggaggugaguuuucauacauucuaaugauacauuagaauaacuugggcuggagagauggcucuguggguaagaacacugccuguucuuccagagguucaauucccagcaacuacaugguggcucacaaccaucuguaaugggaucuggcgcccucuucuggugugucugaagacagcuacaguguacucauacauaaaauaaauaaaucuuaaaaaaaaaaaaaauuucugggaaccuuguucaaucgccagagauuguggaggggcuaacaagugaaggguacuggaugaaggaaagaaaaagaugguuaaauaugcuaaaaaaaacaaacaaacaaaaaaaacaaaacaaaaaaaaccucuagauuuugagccauuacaugucaccaacuggcaguuucuccaucugcaaaauggacaggaagugagcuaggugaccuugcuggcaccaauucugccauuuucuucuuuuuuuuaugguuuauguuacuuuuuauguagauuagagucuugccuuuauguaugcauguuuacgguauagaugcucagugcccagggaggucacaagaaagugcaaaggugucagauccagaaccggaauuaccauggaugguugugagccaccauggggugcugggaacugaacuuagguccucugcaagagcagccagugcuccaaccacugagccgucucucuaccaucacaaauucuguaauuuaauacagcuuauucaucauguaagaauuacaguauuugaagaguuacaacugaagaccucagaauacuuagagauuuggcuaugcuuugauacgaccaauagucugugauuggcaucucucccuugagaagcccauacucacucuuaagugcaucuuuuuuucucuuaacccuacugcuuaaaaguuauauugaaaucuuuuaaaaaucaaacaaacccagcucugcuucaauagccucuuuucuuguauagaugccucuacaguauagaauaauccuauaguauucuaccacauggcuguaauauguuauuuauccauucacuuuuuuuaaaagauuuauuuauuauauguaaguacacuguagcugucuucagacauucuagaagagggagucagauaucguuaaggaugguugugagccaccaugugguuguugggauuugaacucaggaccucuggaagaacaagucagugcucuuaaccgcugagccaucuuuccagcccccuccauucacuuuuuguugaugaacauuuguguugcuucuaguuuucaacgauugcaaauaaauuuaacuaugaacaacaacagguuuaaaguaucugaaauagccagugucacacuccuuuaauccugccacugagaagggugaguucgaggucagccaggucuacauagagaauuucaggacagccaggacuacacagugagacucuguaucuaaaaugacaaaacaggacauuggaaagcaucugccucuuuucacucucacccucguucagaccauuucagugaguagcaacagucagacaucaugguucugcuuagggggcugucaacaucaccaugucugcuuucucuacccuccuucuccugacauggacagguugccuugaaggcuagcugagaugaaguaaguaaaaauacuagcuuggggggcuggagagauggcucagugguuaagggcaccaacugcuccuccagagguccugaguucaagucccagcaaccacaugguggcucacaaccauccguaaugcucucuggugcaucugaagagaguaauaguggugcacuucuaugcaugaaagaaagaaagaaagaaagaaagaaagaaagaaagaaagaaagaaagaaagaaagaaagaguaggcuggagagauggcucagcggguaagaacacugacuacucuuuugaagguccugaguucaaauuucagcaaccacaugguggcucacaaccaucuguaaugagaucugaugcccucuucuggagugucugaagacagcuacaguguacuuacauauaauaaauaaaucuuuuuuaaaaauuaaaaaaauaaauaauaaauaaaucuuuaaaaauauauacuaucuugguuggagacuuuggccacaccaucuuacccucucauacuucuucuucuuccuuccuuugcugaaccagugugcauggcuaguuaaacaaccugucuggcuucagcuucccagguccugggacugagggcauaggcugccagucugugacaaagaucucuuugccuuuucuagucuuuugaucccuuccucaucucuuucuccugagaacucccucuuaccuucugugucacucuuauuuuggaaaaacaaaauaaacacagaacagcuccacggggcccuuccacuucaaauaaauauguuuuucuuuaaaagugagguucuggggcuggagagauggcucagugguuaagagcacugacugcucuuccggagguccuguguucaaaucccagcaaccacaugguggcucacaaccaucuauaacaaaaccugauuccuucuucuggugucugaagacagcuacaguguacuuacauacaauaaaucuuuuuuuaaaaaaaaaagugagguucuggcacuggcaagauaguucagcgggugagguugcuugcugcuaagccuaacaaccugaauucgaucucuggaacccaacaaauccuacaaauuacagggagaccacacacacacacacacacacacacacacacacacacacacacacacacacacggguggggguggguaauauagcugagcaggggaacacuaaccuagcauguggucaguccccaguagucgugaaaaaaaaaaaaaaaaaaaaaaaaaaacuaaagugauuaacucacagaauagcucuuuaugcuuauguauuaaaccgggagaaacuaagaccauuuugcccaguagccuuucauccuuucucaaacacuuagggaguaagucacuuacugaauuacccacaaauuugcuaagaaaaaaaauaucccucuggcuuaagacccuagcagacaucuuucauggcuaacacaauuccuuccucuccgcggaccaguucccucuguuuggauucacucuggguucacucucaguaguuccucucagacaaaccacuuucucuaccccgcacuuggcagaacacacaguucuguccugauuccuucacccguuacauuucccuugagaagauguacaggccuguaauuuuaggugcucuggaggcuuauguaagaggaucuacaguuccaguccagucggaguuacccgggguaguucaaggccggagagagccccugucucaaaaaguaacaagggaggggauguagcucagugguguagcuccuuccuggcuugaccgagucgauaguuuccguccucacuuacaaagacuuccccggcuaccaucuacucauuugucuaggaugugagguccgggagggcgggucuuuuggccaugugcuuggccgagggcccuggguuccuguuaggaugcucagugaacaccaacaggggcgauuccgaaccacccuccacccaccucggcuucccgccucucacccaccauccccgcagcugcccggugccgagcuccgcccaaccgcccgcuucgcagcccgg

SEQ ID NO: 3360 - RNA, 73834 nt, Mus musculus
ccgggcugcgaagcgggcgguugggcggagcucggcaccgggcagcugcggggauggugggugagaggcgggaagccgagguggguggagggugguucggaaucgccccuguugguguucacugagcauccuaacaggaacccagggcccucggccaagcacauggccaaaagacccgcccucccggaccucacauccuagacaaaugaguagaugguagccggggaagucuuuguaagugaggacggaaacuaucgacucggucaagccaggaaggagcuacaccacugagcuacauccccucccuuguuacuuuuugagacaggggcucucuccggccuugaacuaccccggguaacuccgacuggacuggaacuguagauccucuuacauaagccuccagagcaccuaaaauuacaggccuguacaucuucucaagggaaauguaacgggugaaggaaucaggacagaacuguguguucugccaagugcgggguagagaaagugguuugucugagaggaacuacugagagugaacccagagugaauccaaacagagggaacugguccgcggagaggaaggaauuguguuagccaugaaagaugucugcuagggucuuaagccagagggauauuuuuuuucuuagcaaauuuguggguaauucaguaagugacuuacucccuaaguguuugagaaaggaugaaaggcuacugggcaaaauggucuuaguuucucccgguuuaauacauaagcauaaagagcuauucugugaguuaaucacuuuaguuuuuuuuuuuuuuuuuuuuuuuuuuucacgacuacuggggacugaccacaugcuagguuaguguuccccugcucagcuauauuacccacccccacccguguguguguguguguguguguguguguguguguguguguguguguguguguggucucccuguaauuuguaggauuuguuggguuccagagaucgaauucagguuguuaggcuuagcagcaagcaaccucacccgcugaacuaucuugccagugccagaaccucacuuuuuuuuuuaaaaaaagauuuauuguauguaaguacacuguagcugucuucagacaccagaagaaggaaucagguuuuguuauagaugguugugagccaccaugugguugcugggauuugaacacaggaccuccggaagagcagucagugcucuuaaccacugagccaucucuccagccccagaaccucacuuuuaaagaaaaacauauuuauuugaaguggaagggccccguggagcuguucuguguuuauuuuguuuuuccaaaauaagagugacacagaagguaagagggaguucucaggagaaagagaugaggaagggaucaaaagacuagaaaaggcaaagagaucuuugucacagacuggcagccuaugcccucagucccaggaccugggaagcugaagccagacagguuguuuaacuagccaugcacacugguucagcaaaggaaggaagaagaagaaguaugagaggguaagaugguguggccaaagucuccaaccaagauaguauauauuuuuaaagauuuauuuauuauuuauuuuuuuaauuuuuaaaaaagauuuauuuauuauauguaaguacacuguagcugucuucagacacuccagaagagggcaucagaucucauuacagaugguugugagccaccaugugguugcugaaauuugaacucaggaccuucaaaagaguagucaguguucuuacccgcugagccaucucuccagccuacucuuucuuucuuucuuucuuucuuucuuucuuucuuucuuucuuucuuucuuucuuucuuucaugcauagaagugcaccacuauuacucucuucagaugcaccagagagcauuacggaugguugugagccaccaugugguugcugggacuugaacucaggaccucuggaggagcaguuggugcccuuaaccacugagccaucucuccagccccccaagcuaguauuuuuacuuacuucaucucagcuagccuucaaggcaaccuguccaugucaggagaaggaggguagagaaagcagacauggugauguugacagcccccuaagcagaaccaugaugucugacuguugcuacucacugaaauggucugaacgagggugagagugaaaagaggcagaugcuuuccaauguccuguuuugucauuuuagauacagagucucacuguguaguccuggcuguccugaaauucucuauguagaccuggcugaccucgaacucacccuucucaguggcaggauuaaaggagugugacacuggcuauuucagauacuuuaaaccuguuguuguucauaguuaaauuuauuugcaaucguugaaaacuagaagcaacacaaauguucaucaacaaaaagugaauggagggggcuggaaagauggcucagcgguuaagagcacugacuuguucuuccagagguccugaguucaaaucccaacaaccacaugguggcucacaaccauccuuaacgauaucugacucccucuucuagaaugucugaagacagcuacaguguacuuacauauaauaaauaaaucuuuuaaaaaaagugaauggauaaauaacauauuacagccaugugguagaauacuauaggauuauucuauacuguagaggcaucuauacaagaaaagaggcuauugaagcagagcuggguuuguuugauuuuuaaaagauuucaauauaacuuuuaagcaguaggguuaagagaaaaaaagaugcacuuaagagugaguaugggcuucucaagggagagaugccaaucacagacuauuggucguaucaaagcauagccaaaucucuaaguauucugaggucuucaguuguaacucuucaaauacuguaauucuuacaugaugaauaagcuguauuaaauuacagaauuugugaugguagagagacggcucagugguuggagcacuggcugcucuugcagaggaccuaaguucaguucccagcaccccaugguggcucacaaccauccaugguaauuccgguucuggaucugacaccuuugcacuuucuugugaccucccugggcacugagcaucuauaccguaaacaugcauacauaaaggcaagacucuaaucuacauaaaaaguaacauaaaccauaaaaaaaagaagaaaauggcagaauuggugccagcaaggucaccuagcucacuuccuguccauuuugcagauggagaaacugccaguuggugacauguaauggcucaaaaucuagagguuuuuuuuguuuuguuuuuuuuguuuguuuguuuuuuuuagcauauuuaaccaucuuuuucuuuccuucauccaguacccuucacuuguuagccccuccacaaucucuggcgauugaacaagguucccagaaauuuuuuuuuuuuuuaagauuuauuuauuuuauguaugaguacacuguagcugucuucagacacaccagaagagggcgccagaucccauuacagaugguugugagccaccauguaguugcugggaauugaaccucuggaagaacaggcaguguucuuacccacagagccaucucuccagcccaaguuauucuaauguaucauuagaauguaugaaaacucaccuccggugucacagugcccauuugucuaggagauaacucacgagcucuucuuucaggaaacuuaauuagauagaaugaauaacuaaauaacuaaugaccaauugcaauuuacaggaagcugugccuugaagagaaauuugaagaaggaucaagucuugcuacaauagagagauggagagcagcaaacauaaugugaguauuaagauuaaugucagacugguaucaaauuguugugcuacuguugauaaucuccauauuuaccaccuucgugaacgccuuuugucuugauaauuaaaaacauauaaaugaugacaggagagcccaucacugcuucagucaacaggcuuaacauguucccacauuuuuuuugagauuuugggggucaaggucucucuauguagccauggcuagccuagaacuucccuauauagaccaggcuggccuccaacccacaacugccucugccucucagaugcugggauuaacgguguaugccagcaucuccagccuuucuuccuuccuuccuuccuuucuuucuuucuuucuuucuuucuuucuuucuuucugucugucugucugucugucuaucuaaggcagagucuuggguguccaagauacgccccaaaguuucuaugcagucaagauugaccuugaacuuuuucugguccuccagccuccacauccaggccuaggccacuaggccugcuuauaggaaggagugcuagcagcugaacacagggcuucuuaauacugggcaaucaccccaccauuacauuugccauucacaguguuuuuacuuuuaaaaauuacauuauuguguguguucguguguguacacacccauguuuggguaccaaggugccugggcagaggcuggaggaggagucaucugguguaguggcaggucccucuaccuucugagccacuuugcuggcccacuucguaguuucagugugcguuauucaaaguaacaagaaugauaaaauacucgagcucagcacuguaacagcaucuguaacucuuguuaaggguugcacacuguguuuaugaggaaaucuugaacagaaccauggugccauagauaugaaaagcaguggagaaucuaugaauuaugaaugcguacaaccaccaccauucuuucaggagccucucuggugugcaacuuaggcauguuacuugcaaagcaccgugauaaaauguccacggaagguaauacgugaggcucagccuuuuggaauggguuaggggagggcagacacccucugaugguuggugcauguuaccuaaaggcagggaacacaugguuauuucugggaaggacuuugcauaaagcuguucucugggaauuugcugguauguuuguuuguuuguuuguuuguagacaggguuuucuccuuagcccuggcuguccuggaguucacucuguaaaccaggcuggccucaaacucgcagagauccccaugccucugccuccugagugcuggcauugaagccuuguggcacucuacugagcauuuuuuuccccuuguaucuuguuuugacuuuaaugguuggccuuagagaaacauugucuccuuuggcgugcuuuucaaacugagaaaaucagucagccauucuuuuuguaucauugcuagcauauacuauuuguaauauauguauuuccauagguguauguacuguucuuaaaucauuugguaauauucccuccuccccuuauccuuugucuuucucugucccuccaagucucccuuuuauuuuuauaucauuuuuuauaucauauuuugguucuucacacauuugcauguuguccuugcauaggggccaaucucagucacauaaguacauaaacuacagaagugagauaagugaucuuuuuuuuccuacuaugccucuauuaaauauauuguaugacuuuucuuagguagacauggacaccuauuuauucaccccagguaggguacugaugacagaccaaagaauugauucaaucugauccaacuguaacuuaaccagaauauggauagggaaugacuuaucugccuacgggugacucaaaggcagcagcuucgucaucaaaagaagcucauaggggugggugagauucaucguuggaguucccuccacaacuugcaggcaggucccucacucagcucaccacccucuacccucaccccaaccccugccagcaguugcuuaaccuaccucagggagcuuccuuggccuccucuuggcaagcuugcagcccccucucuccuuccagaaaggaaugccucaagcuggaagaaacagcugcgcugcacagagccaggggaauuuacccuacagcgagugcuccuggaugaucagacagggcucacuuacaggauuugagaggcagaaacuaaaucuagucacagaaacugagaagccaagggcuggaggaaaaaucagugccuggaauuuaugauacaaacaguacaucaauuccccuggcgagagaaaccggguuugucugugccagugagauccagaagagcuggcagggcacagggugaugauuaagucuggguucuacagcaaguuggcauuggugccagggggaggagugcuuuguuuacuggucaggcagugccacagaaaagaguggguguucaaugaccacuagcuguacuagggcagacaggccaggaaggcagugccaugaacuuuccgaaugaguucccuuuuuaacguguuuguuuucuucaccaaccaaaagcauggcugcucuggacccugcccaccccaacuccccacccagcucucccuacugcagaucaugggcauggcucaaccucacccuguuuauugaauagcugagccuuacuauuugagacaagggguuacucuguuuuccauuucaaaaauuguagguuaccauggguaacaagcaaguccaaggcuagcuuaugcuaccuggucucagaaagauaaagaaagcauaugcuacgcuuucuuauuuguaggcuucuugacuauaccacccuuauuauauaaggguaucauacaucauuuauguuuguuuaugacaggauauuauauagcucagguuggccucaaauuucuaucuuccugccucaguccacaauguugagaugacuaguaugugccaccguguccucccaauucuuggggggguuuuguuuuuguuuuucagccucuucuuuuuuuaagauugauugauugauuucauguaugugaguacacugucacugucuucagacacaccagaggaggacaccagcuccccaauacagauguuugugucuucagacacaccagaagaggacaccugcuccccauuacagauguuugugagccaccaugugguugcuggaaauugaacucaggaccucuggaagagcggucagugcucuuaacagcugagccaucucuccagccccuaauucuuguuuuauucuaaaggaaguacauaucuauuaaguuuauagcaauauagauguaaacaaaaaaaguccucuaaaauuugguaaaaauuaaguuuuauuggugauauugcuaguaauuaaaaacagguuuaguaacaggcaucuuuaucagaugagcuguagugaguauuuaggaauuuuggugucuuugaaaaacacagaaauaggggcuggagagauggugcagagguuaagaguacgacucuuccagagguccugaguucaauucccagcgaacacaugguggcucacaaccaucuguaaugagaucuagugcccucuucugguacaccaguauacaugcagggagaacacuguauuuguaaauaaauacauuuuuuuuaaaaaagaaaagaagggagggauggagggagggagggaggaggaaggaaggaaggaaggaaggaaggaaggaaggaaggaaggaaggaaggaaggaagggagagaaauauuaugaguauguauucacuuugaucccagguaugggacauggggcugcuucagguuguucacagcggcugaaugugauuugcccaguccucuagcaggggugugauuuugccagaggcaaacacuuucuucaguuaugugacauuuggaauucucgggacuuuucagaagguauauagaugcuaggacccaaagacaguggggaguugguuguugaguugguaguuaggguggguuauugauuggugguuaguugcuguuuguuguuguugauugagguuuauuacauaguggugcacaaagaggaaacaauaaaaaaauuagauauccugacagugaagaucaaacuugccccaagaaacucaacaguccuaaucagcaggaaauaaucuaauaauaaagucacccccuuuccuuucucuccuuuuuuuuuuucucuucuaucuaaaguuagggguugaaaggguggagaagggugaaagaaagaagaacccacagaguagcuaaugcuggugacacgguuaucucacuugcccugguuuuacuuuugacaagaccauuuuaacaaugcccaauacuaguugaaaucauguccaauaucauccuagcauaaagggcaaaaacucaagaguucaagaugaaucaagagaaaagggagggacuaugucccggcgggagcgggcagagucggugaauguauguccguugcuccggauauggcuucggcgggggggggggggggggggggggcggcaccgcuaguggcaagucaacagugugugagaagaucauggagcugcugggacagaacgaaguggaccgccggcagcgcaaguuggucauccugagccaggauugcuucuacaagguucugacggccgagcagaaggccaaggcuuugaagggacaguacaauuuugaccacccagaugcuuuugauaaugaucugaugcacaagacccugaaaaacauuguugaaggcaaaacugucgaggucccuaccuaugauuuugugacccacucaagguuaccagagaccacuguggucuacccagcugaugugguucuguucgagggcaucuugguauucuacacccgggagauccgggacauguuccaccugcgccucuuuguggacacagacucugauguuaggcugucucgaagaguucuccgggaugugcaacgaggaagggaccuggaacagauccugacucaguauaccgccuuugugaaaccagccuuugaggaguucugccugccgacuaagaaguacgcugacgugaucaucccucgaggaguugauaauaugguggccaucaaccugaucgugcaacacauccaggacauccucaacggggaccugugcaagcagcaccgaggcgggcccaacgggcgcaaccacaagaggaccuuccccgagccaggagaucacccugggguguuggccacuggcaagcgcucacaccuggagucuagcagcagaccccauugaggaccagcauauguagguuccccacagacccaggauuaagggccuggggaugaccacuggcuccuaaaagcacagucagggaucccucucagugagugggaccuaggguggcaucaggaccaaagccuuccuugcacggagagcagacucaugcugacagagcauucugggguccucccauuccucucauuggaagaggccacaggucucugggucacugucccaaacagcauaguaagcccaugguaccagcuuccccaggggaugcgggacacaaaucauggugcaacaggaaacagcccgggcacuggcuggucugguguugacagugagcccaagggaagugcuuccccguaugguguggcuuguguccauguugcagaaguaaaguuugcagagauguuagaucccuuguuuguuuuguggcaggcuguuugugagcucugaaccuaguuuuacaaccuacuacugggcuaugguccaguuuaaggagccugaggcagggacccuaaggacuacccacaugacucuaucugggggccuggaucuuggguagaugggagugggccaucaggucucuuguggcugaaacauugucucccaauucugcaggcagccuugaaccagggggcugccuguguacaagucacuuggguacaguucauggcuagcaugccaggcaggcucucuccagccagggagcacuucagugcagaggcaggugaccauggcugccuaaagccagcuagucuccugcacacccagcucaagcuccuggcuucacaaacgcucccuucuguguugucaaguuugucgucccuccccaugggacggcuguuuuuggaagugcccuuugcugucgccacaagccauggcacgggacgucucguuuuauguucaauacaacuguggaucacagcagcugaacugugaugagcucggggcugccuucugcuagugcugggcugguuuuguugaacugaaacaccccucuuuggagggagaaucaauaaauaacauaaaacauuaaaaaaaagagagagaaaagggagggaaaaaaccugaaauccaccaauuggauuuugguucauaaagaaauuuuuuaaagauuuuauuuauuuauuauauguaaguacacuguagcagucuucagaucucauuacaggugguugugagccaccaugugguugcuggaauuugaacucaggaccuccagaagagcagucaguguucuuaacugcugagcccucucaccaguucccucuaucuuaaagauuuuacuuauuuauuauauguaaucauaaagaaauauuaauuuagaaaaauuaaaaauaaaaagguucaaaaauucuugcucucaauccucuauaauuccuuauaauuuauauauauauaacuuauaugucggucaacagcaugaagguagagucacucagaaacgucgcuugcauaaaucauguaugcauaaaucagacccacuauuugguuuuggguuaauauucacucauauuuugugaauuuaauugugugcauaggcgccugugccauggcacauuaguggaggccugaggacagcuauggaaaucuguucucuccuaccccgggcucccagggauggagcucagcuggcacgcagcacagcaagcaagugcuuuaacccagggagccaucucaugggccugcucuucccagugagccaucucaugggccugcucuucccagugagccaucucaugggccugcucuucccagugagccaucucaugggccugcucuucccagugagccaucucaugggccugcucuucccagugagccaucucaugggccugcucuucccagugagccaucucaugggccugcucuucccagugagccaucucaugggccugcucuucccagggagccaucucaugggccugcucuucccagggagccaucucaugggccugcucuucccagugagccaucucaugggccugcucuucccagugagccaucucaugggccugcucuucccagugacccaucucaugggccugcucuucccagugagccaucucaugggccugcucuucccagugagccaucucaugggccugcucuucccagugagccaucucaugggccugcucuucccagggagccaucucaugggccugcucuucccagugagccaucucaugggccugcucuucccuuauugcuuuauuuuguuugaagguaagguuucaugcaucucauacuguccucaaacucuacaaauagcugagaugacuuugaacuucugauccuucugccucuaccucuccccagugcuggaaucacaucuguaauuguauggcguguuagcugcaucucaguggagccauguuuuaucuaagauucauuuuauguagguguauguguacauauccauauaugucguguguauacagguccccucagaguccagaagagaucacuggaugcccuggagaauccauuucugcccacauucuuccugaagagguuuuuuuuuuuuuccccaaccggacacaguaucagaaugagcaaacuccguccccuucuuucaucccauuuucuauauuguuauuuugacuucauuuccuucuuaggcguucucauguccugcacaugugaggcccugugucagacccaaagucuaaggaggacuaggauuggcucaguaguaaaugcuugcuuggcauaugugaggcccugggcuaaagaaacagacaccaagcaaggaggugacugugcugagccgaggaggagagcuaugggaaauggaaggacccugagccagaugacagagggccugcagcccaccaagaugauaacauagcuaacuaaaguuucgaucuaauaugauaguccauggaggaguguugacaaugggaaaaaugaggucacaugcauguuucuaaggggucacucuggcuguugucuagagauuagaucaugugaaggcaaacaaggagacagagaagaguucuauucuaggaaccacggguuaucgugaaagugacuugugccagagugacuggacuaucggaagugguaagaucccacaggaaugggcguggugguacacgccuuuaauccugggaggcagaggcagguggauuucugaguucaaggccagccuggucuacaaagugaguuccaggacagccugggcuauacagagaaacccugucucgaaaaacaaaaaacaaaaacaaacaaacaaacaaacaaacgcuacacauuucuaguucuggggcuggcgagauggcucagugguuaagagcgccgacugcucuuccgaaggucccgaguucaaaucccagcaaccacaugguggcucgcaaccauccguaacgaaaucugaugcccucuucuggaguaucugagggcagcuaccguguacuuacauuaaauaaauaaauaaauguuuuuuuaaaaaaaaagaggcuaaugaacuguccagaggugcaaagguuauccagaagauagacugauuccucuauugggggcaaccaucccuagugggaaaauuggagaaaggaccagauagaguacaacagggcagggucccagagcacuuucccaucugacuccugauagacacccaggccaacaacccaaguguaaggcccaaaucugagaucccuauugggaacuccagggagcugggacagaagagaaagguuugaguacugaguuuugaggacugcuaguauuuagcaaugcugagaaaccacaguaagacgguguagaaaccuagggugauggcucuaaagccaagugaacccggacgcaacgccugcgaucucaguacacaggaggcagaggcagaaggaucaccaugcauuugaagccagccuggggugcagaguaaguuccagguuaucuugggcuacuaugacaccuuguccccacaccccaaaauaaaauccaagcagagaaauuaaaaggccuuccuggcuuccugguagguuaaauguguguguggagcuaaggaaggcugggaagauguagcuuaaaaacuaaucagagcugagcgugguggcacuugccuuccuucaucccagcacucaggaggcagagaugugcagauuucuuugaguucaaggacagccuggucuacagagcgauuuccaggacagccaaggaaggcuacacagagaaacccugucucaaacaaacaacaauaaacaaacaaaucagagagcgggacguguaacccaggugauaguccuaucuuuuauuuccagcaccacagaaaccaacggugguagugaguggccaaaccuacuccaucuuggaacgagccuccauuguaauacaggggaaaaaagccugagaucuuggcccuuagcugcacccacguaccaggaaggaccccgaagcuuguccuuggccggaguuacucccuagcuacuuccuagcagcaauuaaucaaaaauuagucugauuguuucagaugugcuuacagacagguuugugauuguauacggucuugcuucagagcacccaccugucgguuuacaauaguugugcaguuagaugauugccaagcuaggcccucauuuacuuccaucuucuguaaaaucuugucucggugagaguuuggagcugccucaccaaaaaccauccugugggccaguggugaguaaguccaaacuugaguugguaauauagagaccuuaaugugauuauaucggaaauagcaccuugguggucuuuugggguucacaaaugcuuuguggcgcaacaguagcacaccaguaaucccagcacuuggaaagguggaggcagaaagauccgaaguucaaggucauccuuagcuauacagcaaauaugaggcuagccugggcuacuucagacccugucacaaaacaaagcaaaacacagcuaagcagagaaauguguugugaguggccaugauugggucuguuaaccaugauugggucuguuaagguggaguguguuggugacccugucaagauggagugugucggugaccgugacagaggcugacugagggaaauggagccguucuucaaagccuuggugguggagcaauuguccagcuccuggaaagcuuaagcuccauuccuggcacugaaaacuaauuagacaaauaaaaaggaacagagagagggucagaggagaaggagaauucuugcuuugauccucaggaaggaacuguguauuuuagggauuuuuuguuguuguuuuuguuuuugggggggguuuguuguuguuguuuucaagacagaguuucucuguguagcccuggcugucuuggaacucacucuauagaccaggcuggccucgaacucugaaauccaccugccucugccucccgagugcugggauuaaaggcgugugccaccacacccggcuuagggauucuuuaaugcgucauaacgcucagcaccccacuugaucucacaggcuguacaaucccuguccagcucucacuaccacacaaauguccacucuccugaguuccguagcucucaaaugagacggacuuagaauaugaggacuuagaauaugaacucauuagaaaaguaacuuuguauuccagaaaggagucacuuuccagacaggauuguugggugaaaaaauaagaaagagguccggcuaucuagaaaaggcguggcuuagcuggaguagcugacccuguaucuguuugacaagaaacugagaguguacauagaacaggaauuagauuuauuacugaagauagaucauuucuuuugcuucuauuuuauuauuuucaauaaaauaauagguuaguuuagucaaaaggaaaaagagaucuuggagauuuagcagagagaaaaaagagugggagaucuggggauguaugcuaagcccuugcuuagcacggacgagucucuagauucaguccccagugaaaggaagaaauuaaagaauucugguagguaaaaauaaaauaaaaucuuguuaagauaagauaauugcaggcagagaaaauacugguuugaagaaagagcgcuccuauucugcccacgaccagugcguugguguaucugccuccagggucuguugcuaggaugccaaccuauuuugacaguuggcaccagguggcaguguagaucccuguaguuccaaguucuuacugcuuuuuuagccaggcauucaacuaagagaggugaggcaggugccuugugaacuguuuuuaauuaggccuagaagacaaacccugggaagccgagaagccauuugaggcuauuuagggaacggaugauaaaaggaauggaaggagagauaguggccugggagcggaggaaggaggguuaugggaagggcgugggcuuuaacauuagaaagcggaggucuuuggccucugacacuuguguguugaguugggggcuuaaagacaaggaaaccagagguggugggucacugaaaauuagguucaccugauugacuucaacauagaccagaccagaggcgggaaggagaaggaucucagagcgcaggcgccucugaggucaggugcccaugacaaaaucacuaagggaggaucucuuggaugguucugcugacucgguggcuugcagaugagggccagcaaacgacucaguaggagguucacccuuccgagauuguuaaacacaauaucucucagagcggagccagggguugaggcugagcucacaccacacaugcaggauuuagccacuccuuugucauugcaaaguaucugagaaaacuuaagcagggagggauuucuucucucacaguuccaggauuucaguccauuaucacuugguuccauugucuggaggccaaggcucgaugagguggcuagccggaagccuaagguggcgagaggcagcuccucucaugguagaguggugcagagagaagacagauccagggauuagauauucuucuaaggaaugccugcggcugggccccaccccacgugauccauaucacuaucgagcuaugaauccacugagcuguggauuagucagguccugcaugguucuucccagaaggccuuuuaacucucaaccaaaccuuuuaccacgugagccuuggguguggggaggaagaggggggaggcacuucauauccaaaccgcaacagaugcuuaaauaaauuguuuggaugcauuauguguguuuagaaaaaaaaagcuaaaaaggaggccccaaauggaaagaaagcgagagacuugcagguugcagugcagauggggagcaccuacugggcguuacugaagacaaaggaggaagaggcgaucuuugagaugggagacuucugcucucaguucucuuaguuuucuagaacugcuaccaccaccaccugccaccacacacacacacacacacacacacacacacacacacacacacacacacauuuuaaacuuagcaucuguuuccuuuauguuuaaauguauggauauuuugacuguguggaugucucuguaccacauccaugcauguugcccccaaggccagaagggggugcagugccuucaugcaaaguaggaaaaggugcuucucugaguaguugggggcgggguggucuaggaagaccucuugugcaaagaagcuucaaagccuaggauuaaaacuuuccaaacuaaacuguuauacuuaaaagccauuguagaggauuuagagauuuaaaaccuuggaauaaguugggcagugguggcgcacgccuuuaaucccugcucuugggaggcagaggcaggccgguuucugaguuccaggccagcuuggucuacagagugaguuccaggacagccagggcuacacagagaaacccugucuugaaaaagaaaaaaaaacaaaacaaaaaaacaaaaaaccaaccugaacuagagaugguacauuccaguuuacaaagcuauaaacaaacacaaagccuuuguuccugggcaagccuuuuagccaaauuaaacuucugagaaaagcugacuuccauuuuuaucucaaauacccauguuaacauauguuuccaugcuaaccaucuuacuuugacuguuaguuuguuuauauugcguauauguaucuguguguacaggccccaggcaccuguggugguuagaggacggcuuuauggaaucuguucuccacucccaacuucauguggguucugggaaucaaauucagguuggcaugcuuccacagcgaguaccuuuaacuccugacccaucucuccaguccucaaccaucuuaaguuugacccagacaggaaccucucugccaggugaucuuccuaaagcuuuagcaugcgugagagucgcuuguaagacuuguugcaggugucuuggccuuacccugucaagagucugauucgccacaucuggauugcauaucucacagguggugaugucacacagguggugaugucucacagguggugaugucacacagguggugaugucacacagguggugaugucacacagguggugaugucacacagguggugaugucaccagugcugggaagacagagugaguagcagugacuaaaacaagcgcugucacuuugcuacugugacaacaccaguugccauaaugcccuuccuacaguggcucagagauaaaacucuccuuuucccaaguaagcaaaguagugaaaggaagugagacuggaguaagccaggcacggucuccugcuccugccucgggagugcaggggcuaaaggcaugcacuaccaccaccagcuaccaggcacuuucuuaagaaaaccaauaaucagcugggcgugguggcacacgccuuuaaucccagcacagagacaggaggcagaggcaggcggauuucugaguuucaggcuagccuggucuacaaagugagucucagaacagccagggcuauacagagaaacccugucucgaaaaaccaaaaaaaaaaaaaaaaaaagaaaagaaaaagagaagaaaaccaauauugggggggggcgggguauagggaacuuucgggcuagcauuugaaauguaaauaaagaaaauaucuaauaaaaaaucuaaaaaaaagaaagaaaaccaauuuuaaggaagaaagcaauggacugggcuguagacauguacuuaagagcacucgcugcuccuccagaggaccuggguccaguucccaguacccacuucagaggucucacaaaugccuauaauuucagcucccagcgaucucauaccugcuucuggccucugcaggcaccugcacuaagaugcacacaugcgugugcaacacauacacauacacacacacacacacacuuuaaaauaacaugaauuuuuaaaaauuguauaauaagagcuagugauuaggagcacuuguugcucuuucagaggacccagguucaauucccagcaucuuacaaacaucuuuaacuucugggauccgaaacccucuucuggcuuacaggcaccaggaauacauguagugcacagacauacacauaggcacagcauucauucacauaagaugaacaauaauaagcuugugccuuuaaucccagcaauugggaagcagaggcaggcagauuucugaguucaagguuagccugguuuacaaagugaguuccaggacagccagggcuacacagagaaacccugucucagaaaaagaaagaaggaaagaaagaaagaaagaaagaaagaaagaaagagaaagaaagcaagcaaauaaaaacggaaguugacauaaauaucugcagaagagcauaaagauggauugccuaguaucugggcugaaagucaaagggguucuccucaaaguggcacgucuccuuacuagucaaauauugccccauugauuucccgagcuagauccaaggagaaaugucuugaggaaagucugcugguaggauaugcuauuuccugaccucagguuuccuauacuucuugagauucagagcaguaacaacuccguacuuuacacugugcacuuuaacguguaguguuugaucuccccaucaaugcaaucacuuccaucacuuuauggaugucaacauuaaggacagcuuggccaaggucaugcaguugggaauagagcuugcacuucauacagcaaauucuuuuggcauucaaagcugccccauguagccaguugcuggaacuggagggaacuauuguguaacuaaaccacaaucacuuagugcucugugaauauuacuaguucauuuccuucccuggcuacguuccauaugguccuacugcuuuccccucugcuugccuaugcccugcccuggacacccugcuuugaguacacaggcuuuccaaaucucucuuaagguguuaucuguggcuccaaccuggcugagauaaaggucagcacgaguggagcagcgauauggaacaauccagccagcagaucugcugaaauguuuuccaaauguuuguuccuacaggaaggacagcagcccucugccacggugucaccaugagcaggcagcacauuuuagaaacguagcaguagcuuuaagaaugugugugauaucucugucuccagugcucuuucucugucuugcucuuuaauuccacagugaacaggaucaagaaaguccuuuauauaguagcugauggauaaaugucuacugacuaaauaccccaauggcagguucucuguuucuccuacucuugucauggcugugccugugccuuuuguuuuccaucucucccgaggaaaaugagaggaaaaugaaaucaugugaauuucucaggaaagcuuacuugaaaacagauuugcauuuuguuuucuuuuuugaggcagggucucccuauauacccuuagcuggucaggaauucaguauguagaccaggguaccuucacagagauagaucuuccugccucuuucuugagagugcuuaaggcaugcacuacuaugcccaucacuaagauauacuuuuuaaagauuuugagagcugauauucugaguuuccugucaaauauuuaagucuaucgucaucaucuuauaauaagcaucuccuuggugguuucuaucauguagcccauaauuuuucuuuuauuuuuaucuuuuuuuuuuuuugagacuaugucuugcaauauagccuauccuggcuugauguucacucuaacccuugcuggccucaucugcugcuuaagagccugugaccccaggcuuuacuagugaucuuucuauaguccaagucuggacacacuuuugcuguguuaaccugccaggcaucuuagucagcagacaaaguccaaaugcuugaccugccuccgcuagcuugguuaucgauuugugauaaaucuccccuuaucucucagccuccuuugcugcuggaucacaaagcucaccauccugucgaguccugcaaacucuugugacccagaagccccugagacccagaaagcuguuuucuuccaccccagccugccccaccgcaccccuuugucagagucacuaccgcugagccugcaggguuuuugcagugugccuacuugaaaugcugcucuugaaacacucugucacucacagccaaacucuugaugggcugugccuuuccuuagccucugccaugcuggaguaugggucucacuuguguucagcuuggcuguauucauacucacagagucuguaccccuauucugucuucaacuucguuuauacaucugauagaucuccuauguaaagaaaaaacaagcauccuuaguuuuauagugaaaagaacagagggcugucaagauggcucagcagguaaggacacuugcugcuaaacccuacaaccugaguuggaaugcuaagagcauggcagaagagaacaagcuguccucugaccucucugcagaaggcccaauaaacaaacaaacaaaggaaauaauauaguuggucuuaauuccccuccuuaugcaagucuaucuaaucugguaacacaaacuaccccugcucucucucugaccugugugacugguuuucccagcuuggaauauguuuuagucugguucugucuccuuccaccauaugggcuccagggacagaacucggguugucagacaggauggagagcacauuuacgcaccagcccaucucuucucuuuuuugauaugggucuuguguagccuaggcugaccucaaacuugucuugaacuauuuuuuuuuuaagauugauugguugauugauugauugauugauugauugauuuuauguauaugcauauaccauugcucucuucagacacaccauaagagggcaucagaucccauuacagaugguugcugggaauuaaacucaggaauucugaaagagcagucucuuaacugcucuuaaccacugagccaucucuccagccuccugucuugaacucuugauccuccugccuuuaccucucaagugcuagggauuacaagccugugccaccacaccugacuguuguguacuuuuuuuuuuuuuuuuuuggccugagaacacccuauaaggcacaacucauacauuccugcauucuuguucuuuucaacucuuaggaacacuaacccugugagcuugacaucccuuccucccccuacuguuagcucugugguaggucuaaccauaggccuccuguggggcaugugcgaguccuuuauagccucuuuagguuccuccagugcucaguagagcaccuagacaggaagaugcaucaccuuucuaacugcaagugugcagguacgugggcacaugugugagcgugcauguguaggucacagguugacaaaggggguguccuucaaauauuuuuuaccucauauauugacgcagggacccuagauaaacccagagcucacuggucaccauggaguauuagucuauuauacuacacaauugacauugucaauauauacagagaauagauuuucagccuucugguugaugucuuguguccuaucuguucuuauacauuuaagacaauacacagugaagaaacaugagcucaacauacuuguaagucauuauaugguuacagucauugccuuaauggguccauaguguucugugcauggcuguccauugugggagacugcuuucuaacagacacaauacaugguauugaaggagacaguaaucgcuuaauaucaaauuaacagagaccuccuaacaacacaaauggacagggagccuuuuucuacacucacauuacagcuggcuuuuaaaaagaauaugcuagccacaggaaagaaggggcuuucugggcggaggaaacauaaaggacacucuaguccccaagagccuggcaagcccaaggaacuaaaaaacgccauuguguaaauauagagaaacaaaaggaggugaagaagcucacggugaaauagaacgcuuuuaaaacaaaucccccugcauugagaguguuuccagacuuucucugugacauuaugcuguggcgaucaucuuuguaccuguguguauuacggcuauaauuuaugggaauuguggugaaaaucagagucauuuuuuugucaugaauauguguguguggugugcggguauaggaguucauguauguuggaaugugugcggguauauguguacauaugugugccguacacaugugugugcccuggggggggggcaugcgccuguguguacaggugagaaauuggcaaaagggguauuucucgauuguuuuuuaccuuauuuacuuagguagggugccuggcugaacccagagcucacuacuugcucuaagauucuccugucucugccuccaggggccugggauuagaggucaagcuggccuggaacucugagaucaccugccucugccucccaaguacugccuuagaggccugcaccaccacaucuggcugaauaucuaaaucuuagcagauaucuucuaaaaaggcauuacauauuuauuuuuauccaacuaugcauuuugaaauauuuuaacuagaacuggguagugucauuuuuuuuuuuuuagguuuauuuuaugggggcuggagagauggcucagugguuaagagcaccgacugcucuuccgaagguccugaguucaaaucccagcaaccacaugguggcucacaaccaccuguaaugagaucugaugcccucuucuggugcaucugaagacagcuacaguguacuuagauauaguaauaaauaaaucuuaaaaaaaaaaaauuuauuuuauggaagugaguacguugugguucuccuuggacacaccagaggaggacaucagaucucauuacaaaugauugugagccaccaagugguugcugacacuugaacucaggaccucuggaagaauagccaguucucuuaaaggcugagccaccucuccagcccggcagugucaauuuuuauugacuuuucaggcaaaacaaacaucaccuucaucaaaaaaacaaucaauguauuuuuuuauuguaugugugaauacauauuuauuuuauguacacaugagagugccuguagcauccagaagaggguguuggauacccagcaaaugaagugaugacugagucucccugaugaggaugcugagaacggaaacugguccucugaaagggcaguuggcacugagcccucucuucagccccugccuuguucucauaacagaugugugugugugugugugugcaugugugcaugugugcuuuuaaaauacauaggcugcccuuggugacaguuucuacuucugaguccaaucaaaaacaagaauagcaaacaaaugaucagcccuugagaaaauaaaaagaaagacaccaaaugaaagcaaagaaguucagaggcucaggaaguguaagugauggaccgaauucucauugagagggucauugaucauugacaucuuuugcuacagaaauauccucaggaagauugaaaugaucugagcagugguagugguggcacacaccuuuaauuccagcacucaggaggcagagcaagugguuucugucagucucgggacaacuuggucuacagaaugaguucagagacccugugucagaaaaaaaauagauagauagauagauagauagauagauagauagauaguuagauagauagauagauaaccaaaaacaaacacaaagauugcaauggaaugggguaggggaugcuugaaccuguaggcaaaaagccuguucccuuuggaaaugauuaagacccuaacuagcaccuggguagccuaaggcagggagcggagagggcagagggccacucucaucccuuaauugcugcuaaccacagagcugcugauuguaaugaagauaagcuuggaaugcuguuguuggccuuguuaucucucacuagaagauaagaagaaaauaguguuuggacuuuagagugagcugguucccuuacgggguccuuuccagagaagcugcgggccuggcuccauugucagaaaccagcuuugccucugggaaagcccucagcuugucaagcuugaaauauaaggagcaaggaccagugcccuccuccuccucuuuugugguucccuugcuuccucccagguguggaauguccccuuuuucugagaacccuucauacaaggacauuaucauaggaggacaacaaugaaagaauuuuaacuacagcaaaggucaaugucuuauugauuaauauuaguaauaaugggcauguaauuugcauguagaagcuggaucucugcagacuccuagaugcucugaaaggugcuggaacagaaugggagaaggagaauuggaaagccagagcauagcucacccugaaggacagaaaccuagugggaagaaguauagacacagggguagucguggcacauggcuuuaaucacagcacucagggcagaggcaggccaaugucugauuucgagucagccuagucuacauagugaguuccagaacagccuggacuguuaaaaaaagaaacccugucugaaaaaaauuuuuuuaaagagagagagagaaggaaagaaggaagggucagggcacuuugggacaggaguccaauuacagucuccuggcaucaggcuucaccccucugagacccucaggugaccgggcuguagccuaagcuguccuguuagggcugugagguggaccaagagacuccagugguaaggaaauauaccucuuucaauggcuacccuuuugccuucaccuuuagugaugugggacaacauuuucccaguuggcuucagagaaggaaggagaaagacgauacaaauaaguagcauuugggagaaaaaaaaaaaacacuucauugacagccaaggaaagaugaucuaagauugagaaacgcaaugcagaacugggaaucaugaacaggaccucauccugaguucugagauaauaagcauagaauacugaaguaggaaaugcguaggggaaaauccaggcagaagaugacgugggugggaagaacucacugugaagcaaaccagagggcugggaagaaagcucgguggguaagagcucuggcugcucuuuagaggacccagguucaauuccagcacucacaugcagguucacuaccaucuguaacuccagucccaggggauccagcacccucuucuggcuuccuuggcgcugcgugcauguguugcacagacaggcagguaaagcacuucacgcauaagaaaaaaacaagaaagaaagcaagcgucuugugaugguauguacugacuuaauggauucuagagcuucaguugauccaacacuagccuuuucuuuucuuccuuucuuucuuucuuucuuucuuucuuucuuucuuucuuucuuucuuucuuucucucuuuauuucuuucuuucuuuccuuucuuucuuucuuucuucuugccacaucucugaugucuuucaucacuguagcuuuucucugacucacaaugugaguuaaaaaaaaaauacaguuuucuuauuuaauaaaauuguacaauguuaaagaaguaugaaaaauuaaaacaagguaauuugccaagucauggagagagggacaacaucagauacacggucaauugagcucagacuugagugacaagagggaagaagauguuagaacuucuuuucgccacauugugugugaacauguaugugugcugaagucgccacacucccggggauugagcucauaucagcaggcuugcaagcaagagcuuuuaccugcugagccaucucagcaguccuauucuuguaacacaucuccagguaguucgaaagucaggaaagacuugguuagggccacaacuguuuccuucuauuggcccagucuuuggacauuugggcccuuuaugauuugccuguuucuccuguucucaucacugugucagguucccuuucuguagcuuaggcuaucuccucucaucuguucuuggguucaaaaaccaaucaauuuaagcugugacucuguuauuaaugguuugacuuguauguguauuuucucauaauuuauaaagaaagggaccaaaggauuaaauuugguaaaacuugaacccuaguaagaagcuuuaaaaaacaaaacaaaaacaaaaacaaaaagccagaucucuguaugcaauccuagcuagccuggcacuuucuauauagcagagacuguuuuuaaacucacaagcaucugucugcccugcaucucaaaugcugggauuaaagguagucacaucaucaagccaggcucucuuuuuuuuucuaaaccuuguuaacaaugaguuuucuugaggcuggagcgcugguucaguguuuugaaagguuaaaagcaguuguuguuauuguaaaguaccugaguuuaguuuccagcacucagacuggagagcuuacaaccaccuguaacuccaauuccagggguccgguucccuaugaccuccucagguaccuguaugugcauacugcacauaccauuuacacaagcacaaaugaguacacuauauauagggauguguguguguaauauugguuuugugaggcugagucucucuuugugguccugacuguccugaaacuuccucuguagaccaagcuagaauaaauauauuuuuuaaugagggugguuuuuuuguuuuuuuuuuuaaagauuuuuuuuuaagauuuuuuuauuuuaauacacugauggugucacaagagggcaucagauuccauuacagaugguugugagccaccauguggaugcggggaauugaacucagcaccccuguaagaguagucagugcucuuaacugcugagccaucucuccagcccuggauuuuaguucuuuuuuuuuuuuuuuuaaagauuuauuuauuaauauauguaaguacacuguagcugucuucagacacuccagaagagggagucagaucuuguuacugaugguugugagccaccaugugguugcugggauuugaacucaggaccucuggaagagcagccagugcuccuaacacugagccaucucuccagcccucuaccugguauuauauuagagguuuucaagauauaaucaagccaguguuguuuuuuauuuuuucccaccagggcauuuggcaauuucucaggauaaucuuguccugaguaugcugaagaauguuuaaauacaauggauagagggguggguagcucagugguagagcaccucccuagcauugcugaggcccugggucuaauacacagcacuccuaggaagaaaaccagaaggauuccagugaggggaggcuauacuuaaaacacugugcauaauuauccagcccaaaccaucagcggcacaucauguggaauacuggucuccagugucccccugaugucauuaacucuauaggaagcaguuuguuaugcuuuaagcuucauaaauaauucuacuuaagacuaauacagucauucuccuuccuacuacuuacuccucuuccccuuugguguauccaaccguccauuaguaaucuuucuagacuguauugggaaaacaagugagguauuacuuuuuccacuucaaguuuucaauguugggcauaguaacagcauuugguaaacugaaccaagaggaucucaagucuccauugcugcugcugcugcugcugcuuccucuucuucuucuucuucuucuuucuucuucuucuucuucuucuucuucuucuucuucuucuucuucuucuucuucuucuucuuuccuucuccuucuccuucuccuucuccuucuccuucuccuucuccuucuucuucauucuuuuccuccuucuccuucuucuuuuaaauauaaagucuauuggcaagaagggaaagguggaggaagaaagagggaguagagagagcucgagagcgaaagaggaagaaaauggaaagauggagagagaagaaagagagaggaaaaagaaagggccaaaauguccuuuuucaauucuuguccucugacuuuuuagaauaucaacagugcugugucauuaagugugggucauuauugucacauggcagcauuguauuaaaggcaaacuaagcugccacuuaguuaucucauuacccuuccuggccugucgcugcuuuucugugcuuuccucauuccuuccuguggaaaggugguuuucuuaagaagguaaauaaugcuccuuuucuuuugucucucucuuaauaccggguaaacacaacuuaagccuggagcucuguccuuaucuuugagagccccaguaaagcaaggcacgaggcuguuuuagaauguggcucagucacugauguggaccagguuagucauuggugagauagagggggcagaugucaccaccugcuccucguggcgcagagguagagccugagagaccuggaagaaugcugcucccaagagcacacacguccuccaaggugaggaauguguccgccuuucccuggggcugcuggguugcuugguauugacugcagaugucaggaucaaagagucaccaggagacaagaaaauagcuaugaucuagguaccuggaacagccaggcccugguggagauuaaaagggugaacaagaugaaaauucuuuacaguguuacucagaaaacuagguaggccuggucaaaugcuuucaauuuuccaaauuccaacuauguuccuacccaaaauauaauggguggcgggggugagaaaguaggagucuuuccucaguaucuuuaaccuuauagccagagugucuuagucagggcuucaauuuccugcacaaaccucaugaccaagaagcaaguuggggaggaaaggauuuauucagcuuacauuuccacauugcuguucaucacuaaaagaagucaggacaggaacucaagcaggucaggaagucgaagcugaugcagaggccauggagggauguuucuuacuggcuugcuuccccuggcuugcucagcuuguucccuuauaaaacccaagacuacuagucauggcaccacucaaaaugggcccuucccccuugaucacuaauugagaaaaugccuuacaacuggaucucaugcaggcauuuccucaccuaaagcuccuuucuguguuaacuccagcuugugucaaguugacgcacaaaaccagccaguacacagagaaucuuuuguucauucaaauauuuuuuauuaugucuauaaguacuguacauguacaugaaccagagaaagcuuccaccaauguggaaguuccaaguauguguuucaaagaauaagugaguaccuauuuaguaguugaaauguacauagaaaaacaaauuuuauuuauuauuaauuauuguauuuugguuauucaagacaaggcuuccucuguguagcccugagggucuuggaacucacucuggagaccaggcuagcucuggaacucccagagaucuaccugccucugcuuccugagugcuggaauuggaggugugugccaccacugcccaguuugaaauguacaauuucucuccugccuugccagggcuuacacuucaggcauagauuacuauuuguauaaagaguaucucugcaagacugucagacugcagagcauagucggaguucuauaccuucaguugugaacucacacgcuggguagagcugaggcggguuauuugcuuguugguucuuuuuguucagcauagucugcagcauagcaagucaaugucaaggccccagggaagccugguuugcugacucucaaccuuauuuuuguucuaaaaguagaaauaagagaugcucguuuggggcugggcgugguggcacacgccuuuaaucccagcacucgggaggcagaggcaggcggauuucugaguucgaggccagccuggucuacagagugaguuccaggacagccagggcuauacagagaaacccugucucgaaaaaaacaaaacaaaaaaaaaagagagagagagagagagagagaugcucguuuguagcaaacagccugguuucuauucagagagucuucuuacagaaauaauguauagaauacgaagugaaaaaaaaaaugacuugggguucaggguuagggucaaggaagcaaugggaaggcaaacaguaaaagcauuagguaggugcguguagcucagcgguaagacacacugagcaugcgcagaggcccugggcugcauuccaguacgcgaauuuacgggcucucucuucucuccucucucugucucucucugucucucugucucugucucugucucucucucucucucucuccacacacaucauucuggaacaagcucuguagaccaagcuggucuccgacucacacaaacaggagagauuuuaaauggggcaaaacacggcaugugaagugacucauaucagacagagcaggaguaugaagugugcgauuggcaugaagaggaggaggaaagcaagaaaauuguacuucauucugcaccugaguguagagcuggaauaagcaacacugacuggagcuggguaugagcagggcucaggaaacagagccgugggaaagaaugugacagaggucaggauguacuaccuggccaagggugaggggagccaagaaagaccacugugaaggcucugagauuuauacauugaagggagaacaaucaaggguuggagggcuugcccagcaugcaugaaaggcguggguccugucccccuuguuaucccaccucaggaggcagaggcagcuggaucacugugaauucaaggucauccuagucuauauagggaauuccaaaccagccuacauagugauuccuccaucucaaauaaaacaacaaaagauacaagggugugccuaagggaaguauucuuagccuuuguuuuagggagguuuccuuauguaugugucaaaaggccagaggccagcaaagggagauggaggaggguacagaaaugaaacccaggcccuaaucacaaguugcccuuuccuuggaaacgggcagagcucagguauggggcguggauacacacuuccuaggaacugacuuuuuagccugcaucuaucuugagcugcuuucugcaggguccagcagcguccucugugucugguggucaaaguccugaucaucucccauacacuccuggcccagucggccuucaucuccauuaugcugcuguguucucacugugggcagcgucucuauccaguuguguaaguuaauuuguugugacaucucgucacuucugagucuuacucucauccgugucacagaccauugcugccagggucuuuuacucucugcagucuuccccauuuggcuucugguuuucucugucagcuggcuuacugugacaucacuaucuccauggcaacuccucucuggagaagagaagggggcaugggaagaagagugggcuagaaaagaugagcaagagaagcuggucuggagacgacaguuuggauugaguccuggaacggaguuaaaacuaagucuguugauuacauccauauuacacacaacccaggggacaggcccugcucaaaaacucauucaacaaguccuguuucuuucucaguuucucgggugguuguucuuuuucuauuuuuuuuuuaaggcauauacguaauuuauuguguguguaagccuguauguagcacgcauaugguaugagugugaaggcuugcaggagucugggucucuccuuccaccauguggggccccaaggaucgaacugguaucguuaggcuuggcggcaagcgccauuuaucuugugaaccauuucugauauaccuuaaaguaaaugauccucucuuaaguuuugugagguuuuccuuuugauacauuuuuuuuuucucuaaugguuuuagacaaccacaauuuaagcaauucaugagguacauuugaaaugaccuuagaaaaggaaaaaaauaaaaacuggauuuaauucucaagcacuacagaaaaagaagccaaagcaggcagugaagauggaagcauugccaagcaaccaggaagcaggcagugaagacggaagccaagcaaccaggaagaucuccacucccgcuuaggaccagaaagagauuuuaauuagagcaaaagcuuuuuuaccaagaguaagaucugcuucaugugggaggaguacuuggcugagagcuucuuugucugauuuuaguuuucccagacagggucucucuuguguagcccaggcuguccuggaacuguguagaccagguuagucuggaacucauagaucugccugucuccacugggacauaaaguaugcaccacugugccuggcuucugccuagagagcucuuuaaagccacacaagggcugcacgucuguaagggaaagucgcuaagucguuuguccucagacuugggcuccauuucccgcuccuuuaugccaaccugguaaauuugccugucacaaaccaccgaauuccacugaauuugauucugaagucugaagaauggaaugcuugaguuugccuuucuaauuggcucccuaaagcaggauuugaguagcagcaggugagaugcccccugucucuaugcauacuaacaauucgugcagagcauaaauguguggauuaaucaaugagucucaugcacacaaucagguuuucagggguguuugcuugguugguuugguuugagacaaagucuaaccuuguaacuaggcuggcuucaaacccaugccccucaccuucaagagacaguacuggcauuacaggcacgcaccaccagcuucccuuuggguuuuuauauguaagccuugcaccucuuuggucacugucccuguguagagugaccaacuguccaguuuugcccagugacuuuuaguacuaaaauagcauaguccugcacaaagcagaugguuggguggccuggccauuggcacaaggcagagaaaaggcucagcacugaagagcgcgucuaauucccggauacuuucuucuggccuccucgggcagcugcaugguacacaaaacucacacaggcacauacauuaaaaaaggaaggaaggaagggagggaggaagggagggagagagagagagagagagagagagagagagagagagagagagagagagagagagagagagggagagagagagagaaccagcuaagcaagggcuguuugugcugugcuguguguguguguguguguguguguguguguguguguguguguggugcacacuaggugcaugacuuuaauccaguacucuggaggcagagguaggcagacugcugugaguuacaggccagcucgggcuacacaguaagacugacaaaaaaacaaaacaaaacagaacagugcauacauauaaucuguaguuugcuuauuucuguucaggauuuauuauucggucugggagaguagcucaguaguaaacugcuugccuaacauguggaugcuuggguuugauccccagugcugcaaagcagucaaagaggagaaggaaaaagacauuauuuauuaacaaagaauagugauuucgccaggugguggugaugcacgccuuucucaggagacagaggcaguuggaccucugaguuugagcccagcuuggucuauagagaaaguuccaggacagccagggcugcauagagaaacccugucuggggggggggggggggggagcaauuuagcgaucuuacuuaaggagaaaacauuuuacaggugaccagaaaauauauauguuguucaaaaggcccagcagugucuacccuggaggcugagaggaucacucccuaaugugcuuacacagcauacacgucucuguguucaauucccaguacugcacagaucaauaauaaugauaauaauguguaugucuauggaagaaugaauacacuuagguauauccaugaguaggaugcuaggaucgauaaacuauagucuggaccuggcacaggaaggggaggugggguguugcaauguucuagaauccaugucuugauccauccauccagcuguacaacuugcaauagugcauauuuaccuccaucggugcauguguaguucaguaaccaccagcaaaguaccuguccugaaaguuuuauuccaacagaacagcuccaggacuauuaaagacuucugggggugggggugggaggaauggggauuugcuggggagaaccuggaagggggauaacauuugaaauguaaauaagggcuggugagauggcucaguggguaagagcacccgacugcucuucugaaggucaggaguucaaaucccagcaaccacaugguggcucacaaccacccguaaugagaucugaugcccucuucuggugugucugaagacagcuacaguguacuuacauauaauaaauaaauaaaucuuaaaaaaaaaaagaaauguaaauaaauaaaauaaccaauaaaaaaaaaaggacuucugugacuggccuucuaaggagaggcuguaacugucccuccuuagaaagguguugagcuaucuccaccuguugaguaaugggucagcaagaggaaguaaaaacccuuugucacagguucaggaaaagggccuggugcuuugcaacaacauugcaacaaggguagcauguuguuguccuccucucugucugucugucuuacuguaaaacuauggcugcccugccugauacucacgugcagaccaggcugaccuugaaccuacagcuuugaacacuccugucucugcuucccagguguugauaggcaaaucuugaaaugcccuuccuacgagucaucuuuguguccuucucuuagauuguuuuuccuaaacacacacacacacacacacacacacacacacacacacacacacacacacaccagacacaccacaccagacacacaccacacccucugugggaggacaaaucuacuguucucagcucccaucuuucauuaggcucaaugguccgaguuuacauuuucuuuuaugagucuauugcaggaauucacauccugucugcccaaaggcagccuuccagucgcuuuuacaaccacaccaugagacuuggagugccugguuuuuaaaacagagccuuuaaugucugugccccacccccaccccccaauucuucggaaaauuccuuucagucccaccuggcuuucuacucagcugcaauugagucuuuaagugcuucuuuucccugcagcuuuccucaggaaggaaaaaagaaaaagagaaagaaagaaagagagagagagagagagagagagaaaacaauuaccucucagaaaggauuagucagugaauccaguugucuuggugggggcuggggggggggagcauccaaauacugcgcagagaugaaaaauaaguuuaacucguuccccauuuuaacuguguacgguccauaagaaauaccuccuaucugcuaauauaugaaaaaguaacugagaaaaaugucacaggaagacauuuacaucuuaaaccugguucuuuuuuuccuuguucuaauuuuucaaggcagggucucaagauguagcuuuggauauccugcaauucaccacauagaccuaguugaccucuaacucacugauccuccugccucuucuccagagugcugggauuaaauguuugugucaauccgaccagcuuccugauacauuuuaaaagauauaaggaagcaaaauugaaggaaaauuggauuuauguacgacuuguccaaaacagagaaugaugccuaguuuuucuccgccauuucuguaacagguguaaauuuuacagaagugaugaaacaaaggccaggaaauaaggguaugauaaaguugucagaucccugugaaaucuuucccgguaggcaaagugccccguccuaacccccaccccacccccaccaccgucccuuaacccuccucaccaggggaucugcaccccaccuccacccucaaacgcuugggaguccuggggaaauuuuaauucuuugguccauuguuugaauagguugauagcuaaggggaggagcuggugucucucccagauuaucuccuccugcuggguccguuacaaaagccuacagucgcucgaaugccaccgaacaaugaccggguaaccucagugagagcaugcugcaggagaauguucuaagaguaaauuugcacucugaugauugcagugggguggcacggagacaggagacugcaggcaucaaaaauuagucaucuacccgaacagcuggaaugggugaacgcuuuugcacgcguaguauauguaaagcugacugaaauaaaaagaagcaggcagcgugggaaacgugagcgaccuggugugcugcacgacgaagccgaauggccugcggcaaaauagauggacagguggggagacugccgggcgcagguggggcauucgcccucgcccucgaggcagacucuggcguaaccugcugcuccacagagaugccucggauuccugacaacugcacuuucucagccccauccggugggcgcuggccgaccccgcccggcagaagggacgugcguauuggcacggcgcccggcagcccccgcggucccugagucgcuuggaucugccuccccagcucgcugacucauucgcgcauccugcaguguuccgcuccuucccuugguccucacguucccuugacguuuuugguugacuugucgggaggaggcggggguggggguauuaaaaagaaagaaacggacugggaaaggcggagggugaauuuagaaguaaaagguagggugggcugcagaccaccaggaagaaggaaagggugggccugggaaggaucagaugugugugagcaugcgcagagcguugggucacccugcaccauccgcagcgaacugcgccacuguggcacgaucgacgaccgacggaaaagaacagcccugcacauuagggcuauacauuuugugcuacuugcuauuuaggcgugcgucggggucgaaauaagcagaagaaaguagaaauaagggcuuucuggugccugccucgccguccuaacauccgccguacucuaccuuucucugugccccaaaccaaggaagcacgugaacgcugcuugcaugcauuuaacccuuaaugacauuuuaggacuuuggauagacauguucuucauaacaccagucgcgggacauaaucugauguguuguaaauuggcauuagaaaaucuaagcauguuauccuuuaaacacaucuugagcugggauguuuaaccuaagugcuucagucucugacccucacuucuccagccugaaaagggaauauuacccaugagaaaaugaggaacucccugcugagucuguuggccuuggcccaugcucaacaguuaucucccuacauuggucuuugguugggucuaugcagacuguuugcuaccuuuuaagcgcgcgcgcggggggaaggagguguucacaaaaaaugacuaagguggguguaaagaaaaccuaaggacaauucaucaacuaaucuucagccaccucuccuccagucccaguuuuucccucacuaaugacauggaugacagcaguauacucaaagugacuuccucucagugcuuacucuccaguaaaaucuaaagcugccugcaggccccgggggaaccuggaaaaccagccucuaggcccagugcccuuaaguagggcacucucacgguggcacucccguggauuccuguuacaugaaaugaaagauauugagagagagacugagacugagaaagacuuuccuguugaguacggucgguugucagucuuggcuggaccauuuuuucauucacaggaaguccucagaguuuccccgcucagaggcauguucuuugucuccagccucugcuaccacagacagugccuccuuccuucuucugaucccagccaaugacugugaucucacagcuuuaaggucccauuucauuugccucaucuacaguaaaacucgggaguugguaacuuuuacugcaaagggucagauuauguaaguguuuuaggguuuguggaccacagugucccaagagccuuguugccucacuggccucucucuguggccucuccaucuccucugaccugagaggcucuccaaacagccugggaauagggcccucacugaguaccagggggguggcuccuuuccuggaacucgguaucagcuguuuaucugcagccuccagaucccuagccuuggaagaugcuuccugugggagugggaggggucuagagaggguaauagugagugagcaugaccaaacuacguuauauacacagauaaugucacggugagagagaccuggauagcugauaacuacgaguguucaaaugugacuucagcgcugagguggaaaugggccacagagaccucuuuucuccaugugcucugguccugguguuuuuggguuuuuuuguuguuuguuuguuuguuuguuggguuuuguuuuggcuuuucgagacaggguuucucuguauaacccucccuguccuggaacucacuuuguagaccaggcuggccucaaacucagaaauccaccugccucugggauuaaaggcgugugccaccacucccggcuugguccugguguuuuauuacagcacaaacaacccuagcuaaaacaggucucuccugcugugauguguuguugucuguuaguaaauagaacucauuaaacuggguguggugcucaugccuguaauccccuugccagggagguagaacuaggaggaucagaaaggaguucaaggccguccuuaacuacuugucuaguucuaggccacucugggcaauaugagaaccuuauuaaaaacaaacaaacacaacaagccuucauaugaaaggguguugaccagaaaguaucaagguaaggucuaaauagagagccauuggucagggcaugggauuuaauagaccauuucuuuccuaugaacuuuguaaagaaaacacuggugcucaaaucuuuaaucccugcgcuugggaggcagagacaggcagaucuacaaguucgaggccagccuggucuaaaugauuccagaccugucucaauaaaaacacuaacaaggaaaaacuagauugaagcagccacuuagguauaauugugauaacauuagauuuaaaaguuauccuccagcuggccuguaaucccagcuaugaggagacuuaggcagaauagcaguucaaaaccugccuaaggaacacagugggaccccauuucaaaaauaaaugacaauaggaagucuggccuggugaugcacuucuguaaucccagcuuucaggaggcugagcugggagaauuacaauguugucaugagccugggguagccuuggcuacauagugaguucaaggucauccugaacuacuugagaccuugucuuaaaaaaaauuaaaaauuaaaaaagguuggucagggugguguugguccuguggaucucuggggguuccaggcuagccaggguuacaugagacccugucucaaacacgcacaaaaacaucaaugaaaaaagaucuuaggagauaccuugcugugggagauuccccaguuauguucaagacccugcuuuuucaagcccauuacuagggagaaaaacaaaaacaaaaaaacaacaaccauaccugaaagcuaauuuaaaaugugcuuguaggcaaaagaauuuuucugcauuugaacauuuaaagaauuguaggacagccagggcuaaacagagaaacccugucucgaaaaaaacaaaaacaaacaacaacaacaaaaaaagaauuguaggauccaccaaaaggcagggacuauuacacacauuucuuuuuacacacauuuccaaaaucauuccacagucauucuauaagucugcauauaaaccauuccauuaaaugcucaggauaucuuguuacacacccaugagauuuugcagauuugugucaaaaaaaaaaaaaaaaaaagucagagaaacaggaugaagaaaaccaggacaaccgggagcugaugguugcaucucucggcaacauaacaagaaaacaaauuccacaggaggggaguagaauaagggagagacaggacugagugauguagcaggucgcuccggagauucagaggaccagcugaacgguccucuucgcacgucugcauuacgcagcccaccccccaaaaagaaagugagacgucagcaggcggggcuuagcuugcugggaagagagaagagauacuuugguuucugagcccgccuccuccaaauauuucuguaacuggcugguuccauuggaggcuugggucacuugugagaaagauguauccauuaaacagucugaucugcaacacaaaguucauggcacuuguaagaguaucuucaguaggaaugcaugagaucagacagugauuccuagcaccguggcugccguauuauauggcacacaaucuacaaaaaaaaaauugggggaggguuuuguguuuguuugguuuuugaagcaaacucucacuuuggagucuuggcuggccuggaacuuacuauguagaucacguugucucugaauuauagagagauaagacuuccucugcuagauuaaaggcaugugccaccaugcccaaaucaaacuuguucaaugcacaaugcauacguuguggaagguuuuggugagaaaaacacagucauuuagcuuaagagaagcuugccccugcugcuucacagcucacccuacugagcagccaaaggagaacacuaaaauaguacucacucacugagauaaaauaguacucacucgaacgacugagauaaaauucuaaauccuuucaagcugacuuguuccuaugugcugcugcugcugcuacugcuuauuauuaguuacuauuauuauuuuuuaaagauuuauuuauuuauuauuauauguaaguacacuguaacugucuacagacacuccagaagaggacaucagaucuuguuacggaugguugugagccaccaugugguugcugggauuugaacucaggaccuuuggaagagcagucagugagucagugcucuuaacugcugagccaucucaccagcccaguuacuauuauuauuauuauuuuaagaaauuuguuugguuuuuuugagacagggucucucauauguaacucugauuaucccugaauuuacuaugcagaccaaacuggccuugaacucagaaauccaccugccuucucccaaaugcugggauuaaaggguuacaucacugugccuggcuaaagaguuauuuuucuguguguauaggugaggugaauuguuggaggacaccagggccuuuggaucccugaaguuggaguuaacauauguuugugagcuaucuaaaguaggugcugggaaucuaacucacauucucagcuagaauaguacuuacucuuaacagcugagccaucucucuaacccaguguguuaucaguaccuuagaucaaauacaaggccucaagcuugcuaggcaagcauucugacauguguagacccuaugaacuuugucuggaauacccaugucaaaagaugacauggaaaauacauauaugaauaaaaucugggugugguggcauaugccuuuaugcacucaagaagcagaguagaucucugaguuugaggccagccugcucuacacagagugccaagguuucuuuguguagcccuagcuguccuggagaccaggcuggccucacucacagacauccaccugcuucugcuccccaaauucugggauuaaaugcaugugccucuacccccauaugucaaauuuggguuuuuuuaauaaauauauauauuuauauuuacuggccacaaauucaaaggggucauuguguccagagugcuggggacggaugaggacaggaugguuucuccgaguguccccacccgaggaaggaauuagcuggaacaucugguuugcucagggcuccuucuuugagauuccggcagagacagacaaugacugcaagucuccacuguggucccuguggacucagggagagggccuucucuggauuccugcaguucucagcagccccucuaagcuucauuugaaacugugaccuucuccccucugagacuauucucaaguaaagcauuucauuuacuuucuggcaguuuguguaguagccuagcccaucauagaauucccaauuccauccauguuaguaauggugccucagagcauugagugguuugcuguuuguuuguuuguuuguuuguuuguuuuuggauuguuuguuuguuuguuuguuuggggcuuuuuuuguuuuuuuguuuugguuuuuuggguuuuuucccuucuuucugagaaguuaggcucuaccaccaaaauuagggaggaaacuugcucaaaggacacagcccuucaauuaugacacaucucauugaagaguggccacagaccggcaugugguuauguuauuugaaaggguggguaugagucagcgugagcuguuuucccguagccaaggcagcagaaaugcucuggugauaaugccaucgccaccagacaacaauauagagaagcaaaggcauucauaccaggaacaguaggacaggcuggcuacacacgcagaauucaaacacucauccuuacaucccacaaauaauagugcaugguccuuauuggccuaacuaugcaauuugcaugcaaaacacagcugaggggcuaggccccauggugaccaccuuuaauccaagcugaacuaucugaguucuaggccacccuguucuucacagaguuccaaaccagcccgagcuguguaguaagacuucauuuccaaaaccuaaaaaaaggaguuugagggguccugaugaagagauagcucagcagguaagagcacugguugcucuuccagaugacucuuucugauucccagcucccaggucacaacacaaagccaucuguaacaccaagggacuggacacccucuucugaccuccugggaaccaggcauacacauagcacaggcaaauacuaacacauguuaaaaagaaaaaaaagaaaagaaggcuaaugcauaaaggagccccaagucugacuuagaguagaaacccaacaugcucucggaaguuggagauugaggaucagaucaagguugaccuugaacuauccugggagcuggaggccagccuugucagagagcccgucucaaauacuaauuaaccaauuauacacaaaaacauguucacagaugcucauagcaauucauucauaauuucuaagauuggaggcaaccaggauguccuuauguaggcaaauggguaaacugagguacacggauguacuacgaugcacuucagccauaaaaagaacugaguauuugcuucagcagccucuacagcaagugguauagacccugcucugcaccaaggcugagauucacaauguuccguuugaccuucaaagaaggaagcagagguucccggacuggagggagggaauguggaucucucugacuaaggacacuugcugugcaagugugaagaucugaguucaaauccugguucuuuuaugagugauugugaggcaagguuucucuauuguccuaguuguucuagaacuacuuuguagaccagguuggccuugaacucagugauaugccugccucugccucccuguugcugggaucaaaggccuguccaccaccacccagcuuauuuuuacuuuuuuuuuuuuuuaaagacacugacucaaagugugaaccggauuuuuuuuuuaagauucauuuauuuauuauaaguacacuguagcugucuucagacacucgagaagagggcaucagauuucguuacggaugguugugagccaccaugugguugcugggauuugaacucgggaccuuuggaagagcagucggugcucuuaaccacugagccaucucaccagccccuauuuuuacuuauuuuugaaacagagacgcuuauagcccaggcuagccucugauugauccugccccccacccccacacacacacacacacacacacucaccgcccuuauaccuucauguugggauuauggguccuaagcacuucuccggguuuguguggugcuggggaucaaacgcaaagccuugggaauaggauuggcugagcuauacuccuggccccuuuaaugucagauuuuaaaaucaaauauucuaacuuaguccaacccaaagacuugacuugauaugugcuaaguaaugaaggcagaaaaagcauuaaaagucuuggguuucuguaauuagacccacauuuauaagaugggacaacuuuguauguaaaaaacccuucacugguguaacauaguggucucagagcugagauguuuccgggugaguuuguuggcauucagugcuguaguggcaggcguggggcaacgugcucacauugggaaaacccugggcuacaauacauaagaccgugucuggaaaaucaaaagaucacaagcaaaccucgaugcagugguagagugugcucagagucauuacaccguggguuugauuuugauuuaacucauuggauauucagaaauuuuuaucauugccaaaauuuucacaaaacuuacacaacucacuuauacaacacuguguuggacugugacccacaguugaugaagcugggcccacgcugagcauaguggucuaucccuauaaucccagcacugagaggccuaaaaggagcagcucggugaguuugaaggucagcaugggcuacagaauaagacccugcaucgauauacauauaugguaacugccauauguugcuagccauaguguaucacugucccuuggguccaaagauaugagggccaaccaagcuccuacagccaaaacccaugaaaauucacuuaauuuuuuuguuguuguuguucuuguuuuguuuuugaggaaaaaugggucucagguagcccaggauggucuugaaccuugaacuccuuuucuucucacuugaguuaaaaugacaauuucucccucacagcuugauuauuuuagacuauuugucagugguacaaaguugacuagugaaacaaacugaccacuuuaaguucauccagaguucugggaucaaagacgggccccaccauggccagcaguuuaugaguguuuggugugugugugugugugugugugugugugugugugugugugugugugugcucggugugcaagccuggugcuucuggaagccagaagaaagugucagauccucuggaacuacaguuacagacuguugugagcugucaaaguucuguaagagcuuaagugccucagcgugcuccagcaccaucccccaacuuccugguuuuguuuugguuuuuuuuuugggggguuuuuuuuuugggguuuuuuuuuuuuuuuuuuuugacagucaaacuggccuugaacuuggaaugucucucaggcugucuuugaacuccugcuuccaucucccaagggauucuaguuuuggcuaacaugucuaacuugaucacacuuuugugugugugugugugugugugugugugugugugugugugugaauggaaaacauuuaaaguuaccaggguucuuuuccuuuuucuuucuuuuuuuuugggggggggggugaggguaggaugagccucccuuggaaaucaggcuauuggauuuuuaguuuuuuggcuuuugagguaggguuucucuggguagcccuugcuguccuggaacuuguucuguagaucaggcuggccuugaacucacagagagcauucaccacaacuuugcagcuucuauucuggauuuuuaaccauuuauuagauauaugacuuacaacuauuuucuuccauuuugaaaacucugguuuaugcugcugauuuugccuguugauacggaaguguugcugagguugauggcguuucauuguuuauauauuuuauucaguugccugugcuuuugaugauagaggcaaaaaaguaauguacuguuagacuuaagggucagaugaccucugaggcugggauguagcuuggugguagaugauuugacguauggaugaguccugggcucaaucccaggcacuuucaaacaacaacgacaaacaaaacagaagaagaacucucggcucucugugauggccgcaucccugcuguuguccuggacagcagcuggcccacugcacgugaggagacagcauugccccguggaccugcgugcccagcugggccuguggugggcaugcuaagacuggucguacaucacuuuggcgaucaucuuugucugguccugaaggauacuuucuguccuuggguguuauugucccauucuauaaaauuccagacauuugauguuaaucuugacaugguccagagaaaaaccaacuccaccauuaugagccaaauuugaagcaagcuuuaauuaaauacugaccaggaugauggacuccggccagcuccauucucagguucccaggaaauggccaggagucauguuuuacagaggcauaaaacacaaaaccacagggccaccauauuuuccaucaaguccaaccaggggcaagcauaacccaacauauuuccugccuacaaccaaucaagcaguugggucaaacgaacucguuuagaggaaugaagacauaaucaacaggcuagcuuugguucucacauuggcggucaucaucuuguuccgucucuauuccuucuggcauaaaguggcccuuuuuuuuuuuauuagguauuuuccucguuuacauuuucaaugcuauccccaaaggucccccauacccacccccccaauccccuacccacccacucccccuuuuuggcccuggcguuccccuguacuggggcauauaaaguuugcaaguccaaugggccucucuuugcagugauggccgacuaggccaucuuuugauacauaugcagcuaaagacaagagcucccagguacugguuaguucauauuguuguuccaccuauaggguugcaguucccuuuagcuccuuggguaauuucucuagcuccuccauuaggggccgugugacccauccaauagcugacugugaucauccacuucuguguuugcuaggccccgguaaaguggcccauuuuacuuguggauucugcuaaauuaauggcuuaucaggucuaugaaugcaccuauaaacuuaaaaaaaaaaaacaaaaaacaaaaaacaacuuuucaggcuggugagaugguucaguggguaagcgcauugacugcccuuccaaagguccugaguucaaauccccaguaaccacaugguggcucacaaccaccuguaaugagaccuggugcccucuucugggaugucugaagacagcuacgguguacuuacauaaaauaaauaaauaaaucuaaaaaaaaaaaaacuuuucaaaaaauuuugggauagggucuuaauacuuguguccagcuggccuuaaacuaaaacuccuccugcacaccucccaaguacugagguuacagugucugccaauauaccaggaauuguuucuagagagugacaaggaagaaagucacaagagagcccgauaaggaaagaagacugaaaucccccaagcaccuagaggauucccacccccauccccaagaucuggcaugauguagaggguggguaaccugcaagacgaacacagccacaagcuacugagcccaggugcucuaccugccugugaaucucugggggaccaacuggacugccaaauucuucaguuugcccuggaauauuauaauuaauaugauuaaugaaaacaaaacuuagccaagaaaaaaaagaaaagaaaaaacggaagagaaaaaaaagaaaucucuucagccauauuuagacagguuuguuuguuuguuucuccuuuuuaaaacaaagaucacuuuucuguccauaucuaguaaaguguuuccaccuaagaaucuggcaggaccaucuuuuuaaaaauagacaaaaauauuaaauauguguauauauuauuauuacuacuacuacuacauuuaucuguguuuguauguguggggcuugaacuaggcuaucggagucccuugucucucaccauguaugucccaggaguuagacucaggccaucagggucagcuacaagagcccuuacccacugaaucaucacuccagccccagagucaccuuaaacauucauauucuuacccacagucucuucaaggcaaucuuggcuuuuccaguauuaccacagaauuucuuauuucucccauugcccauuuguaggauuuguuguuguuuuguuuuugagauaggguuucccuguguaggccuggcuguucuugaacucacagauucauauaggccuuuacuaaauccucacccuacuucuuggaacuagcuucucauucucuagacugaccaguagauucugugaguucuaggggcuggcacaucugcuguguaaacagugcgugggcaggcuggaaacccagcaaaaaaacccauguccagguuggcagauacaagccuuuuugcuccagaaagaccagucucugguucucuucaagccuggucgaguuuuccauuguggagaacaaucuguucuguucaaagccacugauuuaaaucaaaucucauuccauauaaugucacagaaacagccagagugauguuugaccaaauaccuguucauuuguuuuuaacuugcauugucuuaaucuucuaguaacgcuauggagaugggcaugauaaccuuuaguauaaauacugacucuagggcaucugcugccaugccuaagccugaguccagucuccagggccuacaugcacacgcauaagaaguaauuaaauaaauaaaauugaauaaagauuuuaaaaagauacuaaguuuaggagaagccauuuuugucagcaaacaccuguaaucucagcaguacaaaacaggaggauggcuucaaggccaaaccggaucugauauacauaguaaauuacaugcuaucuaggacuagauagcaaaaccccugucuuaaaaaaaaauagaugcacgggcuggagagauggcuuagugguuaagagcacugacugcucuucagagguccugaguucaaaucccagcaaccacauggugcucacaaccaucuguaaugggauccaaugcccucuucugguguagcugaagacagcuacaguguacucauagacauuaaauaaauagauagauaaauaauagaugcgcuuggguuccacaguuuaguugaugcacugucuuacagaggacuguugaguucccaggauguuagguggcucuccaggauguuggguggcucuccaggauguuagguggcucuccaccacauggaacuuaaguuccaggagacucagugaacgucugcacucacauucguagguacaaacacacacauucacuucauuuaaaaucuuaaaaacgaaaauugaguaaguuuuuagauagccaacccaaugguuucuccugcuacuaacuuccuggagcucggagcacagugagaaagggaccaauagggaaagggauuaaaccguuaaugaacuguucuuuaaaguaaccggaauuuugcauuugcauuuugauaacacaugcccacccauccuuuguuucucccaggucucucuuugucuguguaaucuucucucucucucucucucucucucucucuccucuuuugagacaguguuucuucucuguguagcccuggauguccaggaauucacucuguagaccaggcuggccuuaaacucauagagauccaccugccucugcauuccagcugcugggauugaaggcaccugcagucuaucuuucucuccggagauauugaggcuagagcugacuuuggcauguuauagucaggcagcagugugauggaaccaguuaauccugacaacuauuaaaaugcagccauaguccaagaacaaauggcucgguggacagggacauuugcuaccgagacugaagaucuggucuugcauggugaagggagggaacagacucacauaguguccucugaccuccacacacccaacuccuauuaguacauauggaaaaaauucagucaaugaggacuaaggaugugccugagcugugagcacgacugccuggcaucacgaagcuccagugugacugcucuccagcaucaaauacacugagagcguggugggaugcaccuauaaucccaguacacaggacaucaggacaggaggaucagcucaaggucccuuggcuacauagcaaguucaaaaaaauaaacaaauaaacaaauaaacaaauaggccuaguaauuacagaaguagggagguggcaguggaaggaucaagaguucaaagccgguuuuauauauuacauguguauauauaguacacacacccucgccuaugaaugaguguguacgcgcacgugugcaagcauauguguguguguguguguguguguguauaaaaugugaaagaggggcuagagguguacuucgguccauagaaugcuugccuagugugcauggcuuuaauccagggccccacauaagaguuauccaagcaugauaacucacaauuguaauuccaacaugcuggaggcuaagcaaaagcauuaugaccaguucaaggccaccuuguguuacaucaugaguuccaggccaaccugggcauucgggcguagagggcaugggggaaaggggaacuugccuaaagauaaagaaaugacaauaagcaaguuuauugucugcuuagguaaugcuucaaagaucgguuuugggguggcaagaagguucaacaauaaaagcccuuuucuugcaaacgugaggacugcuuucauucacuuaaaaaggcagaguguguugcugggcggugguggcacacaccuuuaaucccagcacucgggaggcagaggaggcaggcagaucucugaguucgaggccagccuugccuacagagugaguuccaggacagccagggcuauacagagaaacucugucucgaagaaaagaaaaagcagagugugguggcuguaaucccagcacuucuccagccagauaggaggcagagagaggaaaauucacccaggagcucaaguauacaaugcagccgaugaaauuaggagagacccuuucucaaaagcaagguggaaggagaaaagagaucccaaaaaaaauuguccaugugcagugugaaacaugccugugcagaaauuuuguaaaucagagaucagucuguaggcaaaacagucucaaaaaaaguuaaaaagaugcuaguacaaggggagaucauaucuuugaagcagucacuucuauaaggaagaauguauuaggggcuagagagauggcucagugauuaagaacauugauugcucuucuagaagaccugaguucaauucccagcaaccacuugguggcucagauccaucuguaaugggaucccacacccuccucuggugugucugaagacagcuacaguguacucauauauacauaggaauguauuaguauccacugaccagaccagacuuuuuucuucccuaacccacuuguuucccuugucuuuuuccuugucuuccuuccuuccuuccuuccuuccuuccuuccuuccuuccuuccuuccuuccuuccuuucuuccuuccuugcucuuucuuucuuucuuuuuuuuuuaagauuuauuuauuauuauaaauaaguagcugucuucagucauuccagaaaagggcaucagaucucguuacggaugguugugagccaccaugugguugcugggauuugaacuaaggaccuucggaagagcaaucggugcucuuaaccacugaaccaucucaccagcucccucuuucuuuucuuucuuucuuucuuucuuucuuucuuucuuucuuucuuucuuucuuucuuucuuucuuucuuucuuucuucuuuccauuuuuaaaaaaagagccagggaucauaccuacggcuaaacacaugcuaaguccaugcucugaggcagaacccuagugcaagugccucacucuuuuugauaagccggaaugacaauuuuaaguuuacuuauuuuauguacauggguuuuuacuucagguauauauauguaccacauaaaugucuacauaugguucuaagccacuauauaggugcugggaaccaaacccagauccucugcaagaauaaugugcucuugacugcuaaaccaucucuggucugauagaagaucaguuuaaaauauacuaucugucuuuugggaggucacuaacaaaauugaucuuuuuaaaagguauuuauaaggcagauggugauggcgacggcgguaacgguggcaguaguguacaccucugaucauagcacugggaggcagaagcaggcagaucucugagucuaucuagucuaaucuagucuacagagugaguuccaggacagccagagcuacacagugagaugcugaguugaaauaccaagauaacaacaaaaagaccucagcuggcaaauuuaaaguccuacuacaaggagaaacaucaacggauguggugguacacaccuguaauuccugaacugggaaguagaaacaagagguucaaaauaaacccaguuacauagugaguucgaggccagcuugcauuguguguguguguguguguguguaugugugugugugugugugugugugugugugugugugugugagagagagagagagagagagagagagagagagaggagauuugcuaucuguagcaccaaucacaccaaucugcuaggaauucaacagccaucaaagcuuuucauaugccagauucuuacaaacuuuaagauuuauuuauuuuauuuauaugaguacacugcugucuucauacacaacagaagaggaggguaucagaucuuauuacaaugguuguaagccaccauguaguugcuaggaauugaacucaggaccucuagaagagcagucagugcucuuaauugcugagcuaucucuccagccccucuuacaaacuuuaaaacuguuuucaaaucacaaccauuuucauugcaaaaggucuauccauauagucacgugucaacccuacugcuuuaaugaguguccagccagucaaccagucauuaccaccaggaacgugcguaauaaaaacccagaaacacugcccaucucgucagcauauuagaacuucucguuccugaguuaaacacucuggccgauguggccugugcgauccuuuccagaaccagcccagugggcagcuuaaguacaggaaaagaugaaaugauaaguacagguacagcaaacaauuucugcagggcacgguggcagaagcagaggcaggcagaucaggaucagggucaaccuggucuacacugagagugccaggccaaucugaguuacacagugagaacgugucucaaaaaaaaaacaaaaacaaaaaacaaaaaaaaaaaaaccaaaaaaacaaaaucauguauuauaaagaaauuaaaccaaaguguuuuaccaaaucuauaaaaugccauaaaacugccuucacucuaucuuuuuucuuuuuuuguuuuuucgagaagauuucucuguauagcccuggcuguccuggaacucacucuuguagaccaggcuggccucaaacucagaaaucugccgaccucugccucccaagugcugggauuaaaggcaugugccaccaccaccuggcucacuuccuuucucaaacccuguauucagcaagugccagugggcaucgggauggugacccagugaggacagcucggugucuuaccuccuuacuucauccuacuguucaucucuggguuuuuguccucugcauccaagcucuuggggauccagugagccaccacacuuggcuggagcuugguuuuguucuguuuuaauuuguuauuauuaucguauaugugagcguagguaugcauauggacaccagaggaugacuucaggagagauuucucuucuccauccugucaaggcagggucuccuuugcuuuugcugcucuauacacuuggggcuaccuugucucuugagcuuccuccccuucuccacuucccaucucacuuuaggagugcuaggauugcagacaugaacuguugcguuuggcuuuuuauuuuuagauuuaguuuuauguauguguuuaucugugucugccuggcugugcauacaugggugccugcugaaaccagaaacuaugggaugcucuggagcucuacuuacaggcagcugugagccaccucauauguguacuggacuagaacugcagucuugcugcaagagcagcaagcacucuuauugcagagccaucuccagcauuugggguggugggguucuaggacggggaggcaggucaucaagcuugcacauuaaggacuauugaccacggaguucugcaggccuggaauuggauuuccgcuugaaaaugugacacagagaugaugagaacacgauuuaacaggauccguccauuuucuguugcuguaauaaaauacuugaguggccuggaauucuuuuuuuuuuucuuuugguuuuuucgagaccggguuucucuguauagcccuggcuguccuggagcucacuuuguagaccaggcuggccucgaacucagaaaucugccugccucugccucccaagugcugggauuaaaggccaccaugcccggcuagccuggaauucuugauccuuaauccacccagagccaggauugaaagcauaugccugccugacuguuaagagccugaaaagagguuuaggggcuugugaaauggcucagagaauaagucacuugcuuccaagucugguaacagaguucaauuccuggggucacauagaagaaagggaagagaacaggcucccaaaaguuauucucugauccaugaaugauguguguguaugugugugcgcgcugaggccuuacaacuuaaagguuuuacuucccuuuagcauggcugugcuggaccuggauucuagcacaggaaucuuuggagaacacacuuauccauccauggcauacaguagcaaaaugugcagaacuccagggcacucuugauugguuuugguguucucuauagguuucuccuaguaugacaaucacagugaauuauuuaccuauggggugacacacucacgugggugguguguuugugugugcucgaacucaggucacugaguucaaaacuacaguuucauuuuaaaagaggauuucaggcugaaaauacagcucaggauauucaaaaggaccuauguucaguaaccaauguaugggagugggggggaagaaaugaaaagaaaaacgauauuucgcugggcagugguggcgcacaccuuuaaucccggcucuugggaggcagaaacaggcagauuucugaguucgaggccagccuggucuacagaguuaguuccaggacagccaaggguacauagagaaacccugucucgaaaacaaaaacaaaaaagaaagaaaaaagaaaaaaagaaaaaggauauuucaccucaauacccaaaaauugacucuuccaucagaggcacacuguaaguaagaugcacauuggauucugaaggccuggugcaaaaauaucaaaauagauuauuagucauuuauguugguuagauguuaauaugagaacuuugaggccugagacugguauggucagccccagacugaauccccugcacugcaaagagaagaagagagugaagugaaacagagaacuugggacaugucagaugggauaaauauaauauaauaaaauuaacgugugugcguuagguuuuguuguuguuguugcuguuguuagcgcugcuggaauguuuuaaacuguggcccacgcgccuguagucaaaggugcuuugaacccagggcuuauuaaggaggcaccacugaagaucugugaguagauugcugugcuuugaauuuuaacuuagggucaacacuacuuuggaauuuguuccuggagacuuugggauacgcaagaucugccacagugaugagaagcugggggcuggaauccgguuuucaggaccggcagcaguaaugaaugguuuaaaggcagugucaacaggagaagcggcauuucucagauuuuuccuuucuucaccccagggcugcugcugcugcuucuuuuuuuuuuuuuuaaaccguguuuucagauucaaagugaauuauggggacaccucaccugguagggaaagauuaaaaucagacacacgaaaccaugcagguugcuguuuguggggacugauagaaauguaaagcacggggucugggcaguccuuacaacuggcucugcuugcguuuucccaggccgggggcacugugcugaguuuaaaaucuugagugcucuuuuguaggaucccuuguccuucugcuuaguugucacacuagcaaaccucaacaggcuaacagcaggagaccagauuggggcuccaauugugcaggugugugcauugggaacugguaucccaggcuauuguucuuguucccucucuccuaagcacaccuacuuugcucuuagcucccaacuggguacuuuuacuaaaguccccuucgugcuucucccucuuugauauccagcaaagauagaagaacucucaagcaaucuaaggacacguaguagauagguguuguuacugcaucucagccaugaggcuguugagugcuuugucccucaagguuggucacccucacugggacuuggacuuuucggucaauuggcaaccacucccacagagcacugaggaccccagggaacccggcacaggaauuccuacaauguaccgaguuccccagggaacccuucacaugcacucccacagugcacugaggaccccaggcaaucucuaacagcuagucagcagcuggucuguguugcucgagaugaggacugucugucuuggacucugcugcuaagcccacaguagcaugaggccuuguggcuuaagcaucagacgagcuucugcuuugaagagcauuugucucaauuuguuuagcacuuuuuagauucuugggaauucagcuaaauuccagcuguaaucuuuaaaaaacauacauugcugcaagcauaauuuucucuguuucagagcuaaucuuaggcuuuggagcaucugucuuucccagaucacuagcccacuuccacccucccgagugccuuaaagaaaaaaagaaaaggaaaagaaaaaaagaaaaacaccuuuauauuuuaugcauuauggguguuuugccuacguguaugucugugcaccaaguguuguacagcaccuggaaggcuggaagggaaccuggucuacaaagcaaguucgaguauagccagggccacacagagaaacccuguuuccaaaacaaaacaaaacaaaacaacaaaaagaggacaacuuuguggacuugguuuucuccugacaccaugugugggucguggggaugaaacucaggucuccagacuuggcagcaagugccuuuaccugcuaagccaucuugacaaccuucauuauuucuaauguggcuacaggaaaauggaauguugcaccaaguggcuuggauucucuuucuacuggcaggcacuggccuuugggcuuuacuauuucuuuagcugcuagauucaguugcugugguaauuaaacggcgcuuccgacucagugcuucuaggaaagaaaaaugacgagagcaagggggugcaaccucggggaugauuuucuugcgcgguccgguucacuccaccucaguuuucucagcaagcauccgauuuggcaaagacccuccuuuaaggagaaagggaccagguuugcuucaguucaguccaucagucuagaucucugcccagaaagcuagggacugaagaugccuuuccuuccucgagccuauaccaaaucacucuucaggggaggggucgccuucccucccccgcaccgggagucagagccuagagccucagugucacacguuuaucacgugcucagcugcuucacucuggagcucaccugaaaugugccugccuccugcaggccaucgcaggccucucuguaagcucuccuuucgcguacccaacuuuuuagguuucuuucagugugguagugaaguacuugucucaaguuugucuuucgagagacacacaaucccuagguaauaguauguuagcaaacguuucuuauaugagaaucaguuacccuagacugauuguucuggggguuuaaccuagagccgcggcaagugcuauaccacugcgagacaccuccaccccagcucuuaauuuuuucuucccgcuugagagcuaugcacucagcaaaaaucuguaaguugaauuagauauuuguuguguuucuagaugcuguuaaucucaaaacagagcugagagaggcagaauucacaaugggugggguggcguaugcuguggugaggaauuggggcuguguacuucacuugauccuucuuggagccucaagucaagaaggcugccuucacaccuggaugcguuuucuuggacugccucgccuuucccuccuucaaggcgaguacacccagccuauaaugaaaacgcauuaucaauucucugcuuccugcuccuuggaugacuuucaacuaaaagcagcacugacucuacucugcguuuagacugauuccaucccgacugccuucaaauuugcccgcccuccaaacuuuguuuuaguauuuuuuucugugaaacaaaaaggcugucggcucuugaaaaggggaaggaauuuggaagcgcuuugaggggaaaaaaaaaagaaccacgaggaggaugugguaaaaagcaggagggggugggugauggugguugauugcaaaggacaggggcuggggguggagcggugaagaucagauaagaggucacugaauuccuggggucacagguuaaggauuggggggugggagguugaaggcuccaccccuugcagagauuauaaauagguaggcugggcuucgggcugugaugcuuucggugauaguccuuaagccuucugagagcggcuucuguaggacccgaggaacacuugcugccgagaacauuggcuggauaccucuagaucuaccuuaagacuugagaacuagguugggaccauggggacaacgaagguaagagcugguuguuuuuauuugcuuguuugggguccucacggagguaggucguggugcggaucgccgugcuccgguuucuccuaagucaccgagccauccggacggaggccuuuucuuaucagcuccagcaagcaauucgauacuaguguuagcguucuaggcaucuccuaccugacgaggauccucucggacaccuucuuagcacgugaaagucaccucagaagcuguuugccucucggguguguuugagguagcugugaugagagcgaagaggguaggacuuggccgcgggggucucggagccagcuggaaggcuugggaaaggcuuagaccuugagaggacgugggguuggcuuggguuugcuguucagcaucccgcuaucgguccuuggguucccgguacuguggggagggaaguccaguuguccuuacuaugguugugagugcaggauguaucggaguuagugugggcggagggaggaaggcaguauuuguaaggaaaagggcauuuccacgaagauuaacuuggaaauuaaguaaauuaagagaccgugaaaaaaaaaucaggauaaaagaggggaugucuguaaagaggguuuuacaacaaggaaagggccuucgccuggaagggacagcacuuaaccaccgagagacugggaggcugccgggaaggucagcucgcugcuagacgcucccagccugccaccgggagugaccuuaagaggaacuuaaggacaggugaagagguuguagcaggccaaauaggucggccucagacuccaguuuugagaugucccugccugcuugagugauuucccagcaaggugaggagaugucugccugauccccccuugcuaaaaauggcuccuaauaauguguuuaaaaugagcagaggcucuggccagcugggcggagaaugguaccauauuuagagaacaggaagacucucaagagggcccaggauguugcugguggguuggguagucuagagauaagaaaaauaaaaaucugagcauagcaccucgcaccugugacuccaaaccugagaggcugaagcaggagaagugaggagcugacuugagguuagcuuggaguacagagcgugggaccuccucucaaagagaggaagaggagaugagagagaaacagguggugggagaggagaaaaaggaauucacacgguuaguuccggugcuugggggucgggggggggguggugcggggggagaagggggucaccugccaucuaccaugcugguguggcugcuccuuccugcuccuguucuggccucuacagucugugaggcgugguggacccacauggagucugguucugcccucuaugcuuugagggguuugggucuguuauguuuuauguuuugagacaagaucucacuguaagccuggacuagccaugaacucaccgauaguauuccacaacccugcauucaccguucccuagggcagucagauaccugugucuaucuggugacguuuuugguugccuuuucuuuuugagaaauuuaguucaggcggacuuugaacucaggauccuaggguucuaggauuacaguuguucaccacccuaguccggcuggugaaauggucuuguuuuugcuuuucgguuuuuuuuuuuuuuuguuuuuguuuuuugagacagggucucacuguguagccuggcuggccugguacuagcuauguagaugaggccaagagaauugacuuaaauuccuuuuuaggucuuucucuccaaaugcgccugaaauccuggcauucuaagcaaaggcaggagaaaugccuuaagauggacuccaagcaggcauccuugggaagggaaagaaugucacuggucaaaguguguaagcauuuccccuugucugcuugcucuccaggugaccccaucucugguguucgccgugacuguugccacgaucggcucuuuccaguuuggcuacaacacuggagucaucaaugcaccugagacagugagugugccgaaaugaaaagggauugcaaacugaguuuuaaguaggacugggacuuuaagaugccuggcuaaggugggggagggcuagcacacuguggaagaagcuaaggcaagcucuuugcuccucaggcucugcccccucaccgaguugugauccuuuuccuauauuauucuuuagggauuccuaagaacgugggaagucgugacuggguggggugccccuuugaacaucugugcugccaccuacuggacguuuagggugaugcccuuuucaaagcacgugccuuuccucccuccugauccuggccucuaaggaagccacccuaggauuugccuacuacucucaucgagauuuaauggucuguccucacacugugcauuuuuucgugcagauccuaaaggacuuucuuaacuacacuuuggaagagcgguuagaagaccuaccaagugagggacugcugacugcccucugguccuuauguguggccaucuucucuguugguggcaugauuggcucuuuuucuguuggacucuuugucaaccgcuuuggcagguacugagcagacacugggccaggagucugccugcacugguuacccgaaagacagcagagcacaucgggucagggggauaaugcugugugggaacguguuggguuauccuuggggaaagcuaguccaccugccuagagagcugcgaugugagaccuugcucucggaaguucccauuuuagcucccaggcugguuuaauuuugcuagagugaggucagcaacggaguuccuuaaacuucuuuuaaggacaaagguugcuucucccucccaccccacccccaaggcagucacuggcuaacuguguagaccaggcuggccucuaucaaacucggagguccagccgccugccucugcuuccugggugccaugacauccagccagaaguuauuuuuguuucugaaauuuuuggagacuucuuggaagucuuuucauuauuuuauaaaauaaauauuuucgggcuggugagauggcucaguggguaagagcacucgacugcucuuccgaaggucugaaguucaaaucccagcaaccacaugguggcucacaaccauccguaaugagaucugacucccucuucuggagugucugaagacagcuacaguguacuuacauauaauaaaaauaaauaaaucuuagcugggcgugguggcgcacgccuuuuaaaaaauaaauaaauaaauacuuucugcagcccuugccauguggaaaauguaaaugauggcuaaauaacuugauuucccuccccaaagagacauugauugauauaguaccaugucuuaagggucauaugcuuccagagaugacugguaauggagucaaagucacauaagauacucagccgggcaagacagcgcaaacacacaaugcuagcaccccagagacucaggcacggggauuauggguuggggccagccuggaauccacagguagaaggaaagaaccuaccuacaugaguugaacucugaugaccuccacaaacaauauagcacaugcucucuguggaauauacaucuugccacacgcaaacacaauuaaagugaaaaacuucguuaucuuaaaaaguuaaauuuauauauucuagacauguaaauugaaaucaugguaauuaguaaagcaaaccuauuauuggauaaugcuuaucuguuauuuuguuuuuauguuuuuaaauuuauuuacuuuaugaguacacugcagcugucuuaagacacagcagaagagggcaucagaccccauuacaguugguugugagucaccaugugauugcugagaacugaacucaggaggaccucugaaagagcagucagugcucuuaaccaccgagccaucucuccagcccacuauuuugguauuuuuaauggugucucaugacucagacuccagugacuuuuucccuuuagacaaagaaccucacuaaagaagagaauggaaaaagagguguuuuggguuuuuuguuuguuuguuuguuuguuuguuuucauuuguuuguuuuguuuuuugggggguuuuguuuuuguuaagacaagguuuuuuguagccauggcuguccuuagaccaggcuggccuugaacucagagaucaaucugccucugccucgggagugcugggaccacaacuugucguaacuuuuuaaauuuuaacuuaagaguuuuaaauuuuuuuccccucuuaaugguauuugugcaucuuggcugcacacucaggagucccagggauaccucguacucugagacaauuaagugggucccuagggcaugggaacuaugugucgacauuuucccagcucccuuuauaguuuauuagucuauuugagcaaagaaucucacagguccgcugggcaugguggugcucaggaggccaagcagguuuggggcuaaccugggcugcacagcgggaccuuuuaccgccagaaucccaaggccccucagccacugaagguucucagggcuagucucuucugucucagcugugucaguggcucugcugccagcuuagcuuauaaagcauuagucacaccaguuucaguacugauuaguacuaacuagcccuuaacuacuugacacagaccuuuugaggauucaggaaaggauuaaaaaaaauuguccuaaauauccgaccgucuuugcaguaugaguucuguaaugaaaugugauaaaauggggcuggcacgguagcucaguacggagaagccugugucaugaagccgaugaccugagguguguaaguccucgggauccacauaaaaguggaaagagaaccaacuccagccagccacaaagguuguccucugaacuccacaugugcccuguggcacacuggcaccuggacacucaaacacaaacacaguacagaauaaaaagaaacccuaagguauagcgaaguggugaggagggucccucaaguccacaagcccacagcagcaaaaaggaaagagauugacaucuacggaggcuucagaagagcaaaaggaugaggagagacagacaggggaucucucucgcgcgcgcguuacuaaccacuuugucuuuaaccuugcagacgcaacucuaugcuucuagucaacuugcuggccaucauugcgggcugccuuaugggauucgccaagauagcggagucuguugaaaugcugauccugggccgcuuacucauuggcauuuucuguggccugugcacgggcuuugugccuauguacauuggagaggugucucccacugcccuucggggugcauuuggcacacuaaaccagcugggcaucguuguugggauucugguagcucagguacccuuacaguuuuauguauuauaauaauaauggacgcuagcuagcucugugcgccaugaaugaacugacauacgugaagcacucuaucuagaucuggcauguguucaauuguguauuuauauguacauguuucagauauuacuguaguucauacgguaccuaaugauacaggcagggcccagaaagaaauagaaacaauuuguuuucucuuuccuauuuaugguaaaaggauacgugauuuuuuuuuuuaauggugcaauuauggcauagaaauacaauugagguuaaacauuucucuuugucugcaucuaagaucuuugguuuggacuuuauucugggcucugaagaacuguggccugggcuccuuggcuuaaccaucauuccagcuauccugcaaagcgcagcccuuccauuuugcccugagaguccaagauucuugcucauuaacaaaaaggaggaagaccaagcuacagagaguaagugcugcuugcuugucgccucaggagcgugguucugugcgugguuaagggugaggacauuggguguguuucuugucgccccccuugccuggaucuccaugugcaggaagaguuuucugauuguggacuuuugcugacccgggcagcucugugucugggagaccagggaucugcggaccugaaagaccuauagucuauugcugugcacaaccuuacuucauuuucaguguguguaccuuauauacacggaugugacaaagaaggucguuugaguucagaugaacauguaaaugaacaccagugagagcauacuaaauauuaaccuaacagcacagcccuuucucagagcuuccucaggacagaccaacuuaaacacaauugccuggugcguacuauagaugauaucugggaaagcaugaaagcgaggcaggaggccauguccagaugcagggcacacugaccagaguggguucuauagcuguguucugacauccaacaagaauaagcauaaauugaauguaaauguuugcaucggaggcacaaaaucacacccaggaacaauccaggauguggauuuuuuuuuuuuaauuuucuuguagguacacaucuuuuuuuuccuaagauuuauuuauuauuauauagaaguacaccauagcugucuucaaauacaccagaagagggcaucagaucucauuauggguaauugugagccaccaugugguugcugggauuugaacucaggaccuuuggaaaagcagucagugcucuuauccgcugagcccuuggucauucuuuugaccguguucugacccugcugucugagucaggaccugagaaugaaguaggaagacuaguaaagauggauggauguuuuaggugccugcugcugccuggcaggaaacaguuuuguggcagggguugggggacauaggcaguaucuguauucuuuuugccucuuuccccaguccugcagcgcuuguggggcaccucggacgugguccaggagauccaggagaugaaggaugagaguguucggaugucacaggagaagcaggugacugugcuggagcucuucaggucacccaacuacguccagccgcuucucaucuccauuguccuccagcugucucagcagcucucugggaucaaugcugugaguaucugucugccgugggccccgcccggagaugcccacgcccagcaauagucucccgaagucgcucgcucuugucggcagguugucacaugucuguagaauguagcuaccuccagacgcuggaacaggagggucauucacuagugcccaggaaugugaggucagcagcaggaguaguaauggcagcaguagcaacagcaaugggacaagccccaaggcaauagaaaaagccagaaguauugagguccauaucuguaaugucagcucaagacaagaggagcacccaaauuugaggccagccagggcuuuaaaaaaaagauguagauaaguuggcagggugcucuccuagugcacaugaagcccuuugguaaaucugguggggccccauggcugcaaucccagcacucggcacucgggagguaggggcaggcagaugagggauucaagaucacucucaaauauauauugaguugaggaccagucuuggcuacaugagacccucuccaaggaaaaggggugggggugggggugggggguuugaaucuguuaguuugaaaagcuuccugcaggacuccuucuuaccugcacucucccaaggaauuuugacagaccccacucaggucuccugauuugaaaugauaguauagccauauauuacuagaguaaaaaggauaaugcugaucagggccugaggacugcagagcugggaugggcgugaaagcaugguugcacguagccucgggaaugcgcaccacacagagcuccuggcugccucaccccaguccugcaaaagagcacccaaaacaccgcagacaacugaggugcauggugcaagcugccccgucccaucucacugaacucauuauuggacuaaccucccacuuuacucagugaucaguuuggccuggguauacucuagcccaaaccugcagggcgguauuuuccugagucucuuaggaaaguggccuggacuuacuuguuucuuaaaagguaaagccagcugggcauggcgacucucuccuuuaaucccagaauggggaaggucuacagagugaguuguaggaaaaccaggacuacauagaggggccuugucucaaaagcagcaacaugagugaguaccaggacagccagggcuacaacagagaaacccugucucgaaaaaaauaaaacaaaaacaaacaaacaaaaacagcaacaacgaagagggaaaucuagugugcagcaugcuuagaaauuacuucaccaacugugagaagugauguuucccucauccugcuucuugccuugcaggguuaaagucggggucacgccacacguguuuuguuauugagccucaggguugucaguauaugaugguuuuuccuccuuccuuucucuuuugugcugguguuugagauggggucucacucuauagaccagucuggcuugaacucacaggaucucuugccucugccucauggguguugggauuaaaggugugugccaccaugcuaugcauaauaauuuuuguuugguugguuguuuuugguuuuuccagacaggguuucucuguauagcccuggcuguccuggaacucacuuuguagaccaggcuggccucgaacucagaaauccgccugccucugccucccaagugcugggauuaaaggcgugcaccaccacucccagcugcauaauaauuuuuaaaaggaccuaaaggcaaaggugccaguggugacacacaucuuuaaucuuaacuaggaaggguaagacaggaggauuagaaacuaaaggccaucuugggcuagguagugaaacaagagagagagacuuaaaugucuaauuagcaaaguagacauaagaaagugagagguggggcuggugagauggcucagcggguaagaacacugacugcucuuccaaagguccugaguucaaaucccagcaaccacaugguggcucaaaaccauccguaaagagaucugaugcccucuucuggagugucugaagacagcuacaguguacuuacauauaauaaauaaauaaaucuuuagaaagaaagaaagaaagaaagaaagaaagagagagagagagagagagagagagguggagagauggcucagcgguuaagagcacugacugcucuuccagagguccugaguucaaugcccagcaaccacaugguggcucacaaccaucuguaauggaaucugaugcccucuucugcugugucugaagacagcuacaguguacucauauacaugaaaugaauagaaaaaaaaauuuuuuuaaagaaagugauggagcuggguacccuuggugacagauaccuucuuauaauccuugcacuggagaggcagagacuacaaaguaacacuuguuauaccccuacucccaccaaccucaccccaccaccaaaagaagaaaguuaacuaaauaguggggcugagccuuagaaggaaacaggggaaccaugggagguagagggugcagaggccgagugcuggccaaggaugccagggcucauuccugggagcaaccagugaugcucuucugucccuuuccagguguucuauuacucaacaggaaucuucaaggacgcggguguccaggaaccgaucuaugccacgauuggagcaggcguggucaauacuaucuucacuguaguuucuguaaguugaguaguucggauugaggcauggggaugagagaaacaagaauucuuucuugaaguguucaaacauaaccugucuuucaacuucucacaucuaguuaaaaccauuuuauugcuuuccccugggagaaauaauaguggaugaugagcauacuaagccaucuucagucacucagaagcuguggaacgggugggaaaggggcaguguggacagacuaggugugccuggagacaagacaggguaaggcagcagcgcccuguacacagaaucagcagugucuuccuugccuuccagcuguuccugguggagagggcagggaggagaacccugcauaugauaggccugggaggcauggcuguuugcuccguuuucaugacgauuucgcuguuacuaaaggugagcacucuuugaguggaggaauguacugggugggugaggcuguaguuuacucucugcugugggggcugggguauugaccuucaaggucaucaauaaagucaaauuugagauuuccaaaaguacagguacguggguaucauugcacugcaugaaaugucgauuguaagacauauugucaaauucaguucuaagguaaggauuuauguagccuaggguagccuugaauuccuaaucuuccagcugcuuuguaccaugugagucuggggcaccugaucaguguccucaggcuuggugacaaucaccuuuaucggcugagccaucuugcaagccauaucuaauuuaauuccuagcagucaucuaggaaauuaaggccagacauuggcugugacagaaaucacucugccagccgggcgugguggcgcacgccuuuaaucccagcacucgggaggcagaggcagguggauuucugaguucgaggccagccuggucuacaaaguaagcuccaggacagccaggacuauacagagaaacccugucucgaaaaaccaaaaaaaaaaaaaaaagaaaucacucugcgguaguuccacuuuacagauguugccauggucuugguacagagugagaagggugaggccuguagcuuggauucagaaacgcuaggcuuuuuacucacaagcggagugacugcagcuuuagacagcagcucugaaaauggauccuaugucauaccaugcauuuaaacggacuuugcuugcuugcuuucucuugcaggaugacuaugaagccaugagcuuugucuguauuguggcuaucuugaucuacguagccuucuuugagauuggaccuggccccauucccugguuuauuguggcugagcucuucagccagggcccccgcccagcugccauugcgguggcuggcuguuguaacuggaccuccaacuuucuggucggaaugcucuuccccucagcugcaguaaguaaauucaaaauuaaacauggccucucacaaaccagccgacugacuccaacacauuauuaagauucaccuuaggggaaaugauugugcuaagcgcuuaaaucacacuuacugcuuccuugucaagaaaacaggaugggccagcauggggcucacggcugcaauccuagcacuugggaagcuguggaaagaggguuggccagccugggcuacaauugagacccuguaucaaaacaaaacauuaagagggaaaacuggacauuuuugaggaccugagaugggguaggaacagaaggacaguaccaagcacccaaacuuauccgaccaauauugaaaucaucauuucagucaguacugagagccgagugcuccuaaaggguagguggucuucaggauuuccuguuagaaaaagacguggagcugauuuguuauauaaaccauucccuauucccaugagucuuucuacacaucuguauuugaaacauuguugcuuuuuuuuuuuuuuuuuuuuuuuuguuuuuguuuuucgagacaggguuucucuguauagcccuggcuguccuggaacucacuuuguagaccaggcuggccucaaacucagaaauucaccugccucugccucccgagugcuggcauuaaaagcaugcaccaccacgcccggcucauggcucaaauaucuuauuaucaaaaaucccuggaaggaccagaaguggugacacacauuuuuuuuuuaaugauuauuauguguuuugccuguguaugucuuguaccacuugcuuagcuggguuacagaccauuaugagugaucugccuuauggaugcagggauuaacagagccuagguccucuggaagagcaagccaguuauguuaaccccugagacaucucuccagcgccgacauuugccuuuaauccuggcacucaggaagcagaggcaaaugaaucucuugaguucaagggcagccagagcuaaaaagugaggcccugucucaaaaaccagaaacaaagccacaggaagucuuuggaagcagcuaauuuuugugacuagaaaaaaaagaauggcauaugacuugcagagauacguaauagcaucguaagucaacugaccaaugaugcuguggaagacuuguagcuuaaggcuagucagauagaaaugugaggcuccccucacauuuaugaacacuuacauugguacauuuguaugaaacagucgaccagcaaugagcagucuucuuucuccugucuccuaggccuacuuaggagccuacguuuuuaucaucuucgcugccuuccucaucuucuuccuaaucuucaccuucuucaaagucccggagaccaaaggcaggacuuucgaggacauugcccgggccuucgaggggcaggcgcacucuggaaaaggcccugccgguguggaguugaacagcaugcagccggucaaggagaccccuggcaacgccugagccgggagcaccuccuucaccucccuccacuguggaaagccaccuccccuuaaguggggagaccucaucaggaugaaccaggacugcuucugagugcugcuauucucaccccacacacuccaugaaaacucagcugcacccaaugcugggguugaccagaucgccaauggcuuuuaaguguuugauuugggggauacuucccuuguaaucaggaaagaccaaggaagccuaccuuuauauugggagggaaggggccgcagcuccccuuagguucuaaaacccgcuaacuaggacaacuagggaguaggaguagggugcagcaccgcccccaccaccaccuuaguuugccaggaaacagaucuucauacccaguguggagggcccugggggauugaacaaaagacccccuccucacuugauacagcucugcacagcaaaguaacuugaguuuuauuuauuuuaucuucagguugaauugcauaaauauuuauuuuuuuaauuguaauuuuaccaaauaaugagacaguaacgaaauugagguuggagggagguguuuaaagagagguucaggaggaaagaaaguuuggugcuggagagagguuacaacagggaggauggauguuacugguggccugugagucacuuccuuuguagaugaagggacacuaucccuuguuauuucucagaagagcgagugccuguacuaaaaggcucauggcuuucugugggccuuuucuuuuaagauuauaguuuuuauguaguguuacuaaaaucuaggcuuguuacuaaaguggucuuuguaguuagugauauugauggauuuuuauguugcauggaguccagacaagggaggggucaccgcaagccucuccuuucccuggaccaacacccucucuguccugugagcucgcuuuuucuuuucugauggucaagcccauuaccaaacgggcgggcgagcgagcgagccguguggaugagacacaaagacaguaguuguugagaggcauuaguuucuucaacuuaguuuuuuuuuaagagauuuuagguguugguuuguuucauuuugguuuaaagggauucauagcuaacuuggauuuuguuaccucagcucugggagaggauuuucgcuggaugacuauuaaugacuuguuuugagggaguacauuuguugcucuagaguuguggcaugcuagccuaugucuguuacagucucaggcugcccuuguuuccagguuccugugcuauugugcuacaugcccaaggggccuuggcucugcuacacacauuagagacagugacugaaugugcagugugguccacgcaugagggcacaaaugucugugcauugucacuuugcucugggcaugaagucccuggucccuuggcuccuguagcuuuuuauugaucgacuauuagaacucaacccuguguacagaagcagcacugccucugcuagguggagcuugcacccaggauuagaugccacccauuggguucccugucccuguuggagagaggugcuuccuugaggucugagguuggaaggcucuaccucacuacagcuaggaggcgcaauggaaaggugugaggucagggcuguggcuccugaagacccaguugugggccaaggguggcuuuauuuaaagggaguuaagaaacauggcauauugguauguugauaucaccaagauucccuucugccauaggucacagacaccuucccaacuguccccuccuccacuuccauaaauggagacaacccugauggaccucaccccuuuuccacaggucacuggaucccacugucacccucggugcuuacacauuucagacccuuuaggcaaacccuugcauagagugguagagccauaucucagugcucgguuucaguauucaacucuccacucccuguggccaguugggauuuaaaaacucagauugcuauggaaaggggcuuugcugggaaaggcgacuccucuaacuucaccucuucaguuccuccaguggaguuuuuacauuugccaauggccaucuugugaauaucuucauacauacuuucuauuaauguuacuguaguuucuguuuugaaauaaaacuucugaauguaugugucaugucacaag

SEQ ID NO: 3361 - RNA, 804 nt, Mus musculus
ugacucacaggccaccaguaacauccauccucccuguuguaaccucucuccagcaccaaacuuucuuuccuccugaaccucucuuuaaacaccucccuccaaccucaauuucguuacugucucauuauuugguaaaauuacaauuaaaaaaauaaauauuuaugcaauucaaccugaagauaaaauaaauaaaacucaaguuacuuugcugugcagagcuguaucaagugaggagggggucuuuuguucaaucccccagggcccuccacacuggguaugaagaucuguuuccuggcaaacuaaggugguggugggggcggugcugcacccuacuccuacucccuaguuguccuaguuagcggguuuuagaaccuaaggggagcugcggccccuucccucccaauauaaagguaggcuuccuuggucuuuccugauuacaagggaaguaucccccaaaucaaacacuuaaaagccauuggcgaucuggucaaccccagcauugggugcagcugaguuuucauggaguguguggggugagaauagcagcacucagaagcaguccugguucauccugaugaggucuccccacuuaaggggagguggcuuuccacaguggagggaggugaaggaggugcucccggcucaggcguugccaggggucuccuugaccggcugcaugcuguucaacuccacaccggcagggccuuuuccagagugcgccugccccucgaaggcccgggcaauguccucgaaaguccugccuuuggucuccgggacuuugaagaaggugaagauuaggaagaa

SEQ ID NO: 3362 - RNA, 804 nt, Mus musculus
uucuuccuaaucuucaccuucuucaaagucccggagaccaaaggcaggacuuucgaggacauugcccgggccuucgaggggcaggcgcacucuggaaaaggcccugccgguguggaguugaacagcaugcagccggucaaggagaccccuggcaacgccugagccgggagcaccuccuucaccucccuccacuguggaaagccaccuccccuuaaguggggagaccucaucaggaugaaccaggacugcuucugagugcugcuauucucaccccacacacuccaugaaaacucagcugcacccaaugcugggguugaccagaucgccaauggcuuuuaaguguuugauuugggggauacuucccuuguaaucaggaaagaccaaggaagccuaccuuuauauugggagggaaggggccgcagcuccccuuagguucuaaaacccgcuaacuaggacaacuagggaguaggaguagggugcagcaccgcccccaccaccaccuuaguuugccaggaaacagaucuucauacccaguguggagggcccugggggauugaacaaaagacccccuccucacuugauacagcucugcacagcaaaguaacuugaguuuuauuuauuuuaucuucagguugaauugcauaaauauuuauuuuuuuaauuguaauuuuaccaaauaaugagacaguaacgaaauugagguuggagggagguguuuaaagagagguucaggaggaaagaaaguuuggugcuggagagagguuacaacagggaggauggauguuacugguggccugugaguca

SEQ ID NO: 3363 - RNA, 1394 nt, Mus musculus
gcgcccccggcugccggcccagcguccggggcugggagcgcagcgcgggcuccgagauagacccgcgagccacugcaaaggcggcugagacggggcccgcggggccaucccgggugggcgccggggcaccagacuggauccgagauagacccggacgcuggcagcacagacuguacaaaguuguaacuuccccggugcccggacgccuagcgucaaggcauuuccaaaaagggggggggggcaugccucuccuuuguccugacugguggaguugagcaugggcugggcccuggacugagcgaggguuggccaccuggguaguccaucaaaggaugaugcggugaaggguggccauuuggggaggaaguaaagauuauuuugguaccuccucccccaguuagugauuggcggagguuugccgugauguaaaacagggcauaaaaauguccguaaagguaccgggccuauuggccggucucucagggaggaauucuaggguggaccgugaagagccagccgacgcugguuuuguaggggaggaccaaauggguugacacccggaaaugaguuaggaagggaacucagggaaagcgagggaaaccggcucaccuacuuugcccucacaaaggucauuuccugcaugggaucgauaguuuccuguuuacuuacuccucgggagggagcgcguacacuggcuuccuggaauauacccgauauucacacuuaacuuuugagcccaggcuucccuuuuagucacgguaccaacgggaaugaaugaaauggugaaaaggaaacgcaagggauuuaucuccacguagagaacggaaauggaguggggcuggagguugucuuucaugcacgcaagaagacaaaacuaggcguguuggcguacaccugugaugugaggugaaggcaggaugaggauguucagaaguucaaagucauccucgacuacguagagagaagcaagucuggauuaaauuugacgaugggggaggggcguauugaugguugaaagugaaaagaacucaaaauaaacuagcuuggugacucaccccuuuaauccuguaguuugggaggcuugcaggcuaauuucugaauuugaggcaagccugcucaaacacagcgagauccaggacagcccaauuagacucaaaaaaaaaaaaaucugaacugaaacucuucugcauaggcaggcacuucacucucuugugucugggacaggcagugcauacacagaagaagacaaaguaugaggggaaagauauuauuuuuaaagaugcccuuguaugucuuaugaacccuccccacuuuuuaaauucucacuuaaccacuuguguuauaaaaauaauuacauguguucauuaauucauaauuaaauuuugaaaagaagg

SEQ ID NO: 3364 - RNA, 25455 nt, Mus musculus
agcggagcugagccgagcccgagccgagccccgacgcgcuccguccgccugccggcuccuggcugccccgaccggucggagccucagagguggcagcgcggggagccccacgcuccgggaagcgcggcggacgggggacgugacccgggaggcgcugccgcccggcagcgggugacgggagcccggaccgcggccuccgggacccugcuguccaggccggccggccaggcgggcgggagccggagugcgaggaccccacccucgggacacccugugccgggaccugcucccucucccuugggagggaggacccucccuacuccccggacagccagaagagaucgccgcagggcacgcggcugucccucccacgguggcuccagcggagacccccagaagucgggaaggguagugagaccugaaggacccggagugagaccucccucacgccucagcgcacuccagacaguuugggacuuuugaggcagagagaaagggagccaugccuguggaguaggcaccccgcaucccacccgggacucaccgcggagaggcguccugauacgcacaagccaggacccuccagggaaccgccaggaauugguuccaguuugcuggagaguagaagaccucgccccucaacuuccgugcaccuagacaguggaccggggcagagccccuccacucagaucuccaacugacagaaagagcccucagccccugaaagauccaguuuggggggggagggggauucccccaaaggggaggagacaacuccuggcugggagaggcuccuccccuccucccuaggguagcaggcaggggguggggggugugccaucuuccccagguagguccucccucucccccuccuccuccuucgacuccucuuccucaggggacucaguucccugcuccagccugggaggcuccgccaggcacuggaagagucacugaggaugccaccugucaccugccucugaagaggggaaucccugcaaccucaaacuucuguaccaggugguuuccuccagcggcggggggagccuuggagacagguuagugcuuuccguucuguagucuuuagacaccaggagguguggggagcggaaaugguggagcuuaggguucauucgaagggaagaagaaagaccccugggaaaugucuuccgauggaacuuuugcacuggaacccacauguugcuucagagacucugagaaauggccuuuuaagauuuuggaguccaaaggguugggucauuugcagccccuagagaaguugaugcuuuggacugagaacagacaacaggugcguuuucaggacgccaugguguuaguaacucaggacacagcacagucagaaucccacagcacuguccaucuuugggucuuguccucuggugacuggaccugcaguaaaugaccugcagucgugggggcauuuuauggauuguauuguaucguccagggcaugccuaagucaguuuaauauucaacagacgucuucuuuccagucuauuacaaugacugcuugccugacuggcgacagguccccgcccacucugucuuggauaccaggagggaggccccuuuugacaacccuacuucaggcuggauaucugccucucuguguaaaauccaaagggaaaugcgaaugcacauguccuggaaugagaaggaacugucagggcaaugcaccuuggugggcuggagucuuccuagauaccaaaucugccuuaguccccucauguguccugccauucgcuggaaaaaucagcugaauggaggaagagaagaaggugcuuccuagcuuccuuccacccgucccucuaucuucaugagcuguccaccagggaggucugaccucugaggaguuuauuuuagaguuuccuccaggaaaacaccuacuggucucaucaucucucuucuugcuuuuucguuuaguucugggucccaggaaccuuguguugaaaauuuucuucaaaaucaaaaaucuuuagaaagagcaggagaaaacgugcuaagaaaucuuccugguugagccagaguggcauuuguagcagagcucugauuuuucacccgaggucacuagcucgagaccugcacuuccugucuggugguuggaccaugccucgucuucuguguggagcuuccuccccuuagguuuucagucucugccucccuauacgggccauggguggcuugccuguguuauccaagucuuugccuguccacuagauccuuggaagauaccugucguggugaugcgccgaaacaggacugugguccacagguucaauggcuggccuguagaaugauguacauguuccccagugggaaugacuguggcuugcugucuggguuuugaguauguacauggagaagacuauccuggcgguuuuuuuagacugugcuuugaucccuuagaaucauuucuggcaggccuggagaagcaggagacucucugccaaaaccaagaagagaugagcgugcagacaaccaguugggagaaagccuagcuuucccccucacccaccagggggaauucccgugacccccuccugaagucaccccaagcugcuuggcaggccuuucccagguuggaccuguuuucuuccaggacugguaggaaaguuucaucgugggugccuccagucuuaaaagaugacgguccuguccuuaacuuccaggucuagaaccgccucucccacuuuugaaagaggugugccagccguggcaguggucuguuccuuacaaagcacuuuaucagaugcuagagugcagcuucugaggggcacagugugggcuguggugucgcugcuccaggcagacugcuccauucagcuggcucugcugggacaaguuccguaacucucaugccucucaguagucagugaggggcugcuugcauuaacugugcuuuggaguguauuguuuucuagggacgguaucuuaugacugcaccaaaauccccugaaagacaggugacuauuuuccccuuuucuacguccucugaggcuucccgaucgcagucaguacugggcggaugaacucaagggaaauguuugaaauucugacguucugacagccacugcaggcuuguuucagacucggcaauaugaucaccgcaugucugaugcugucucugcgaucugcuauaauuuucuuuuugacguucucuucuuuucuugaaagauuuauuucucuugcauuuuauguauauaugaguauuuucucugugcauaggcacaccagaagagggcaucagaucucaugggacuaagguuacagauggaugugagccgccaugugggugcugggaauugaauucaagucuucuggaagagcagccagugucccuaacugcugagccaucucucugggaccuauucucuuuccauugaaacauuuugguguugggcagugaacugugggcugcaccugcaccuuacacacacugagccauacauacagaugacugauagucuuuuuucuucauucaaaaacaaagguauacuuacuaagugcuuuaaacauacuaaaaauauuagcuaagccucacagcucuuguaggaacaguuaaccuucauuuaaaagaauucuaagcuggguggugguggcauacucuuuuaauccuagcacuuggaggcaaaagcagguggaucucugaggucagggccagccuggucuacauaguggguugcaggacaucuguguagccagggcuacauagagaaacccugucucaaaaccaacaacaacaacaacaauuuuuuuuuuuuaaaaacuuuuuagauuguuuuugugugugaguaauagugucucacuauauagccauggcuggccuuagcucaggcuggcucaaacucauggcagucuuccugcuuuagccucccagagugcuaccagaacaaacuugugucacuauagcuaacuuguuagaauuuuuauuuuauuuuuacagagauagaaauuaagauaccgagaagcuaaaaugacuccucuaugagagcugaguugaaagccaggcagccuggccgaucaugagggaggcuguuaguuuuggcaugaugugccgcucaggagguucacuccuggguaccagacuuggguaccauguggagaacaguuacuagcuguucggguaacaugggcaguaaacagugcagguucucgaggaucucacaggucccgucccauuggcugcucaugccgcaagaagacuguguuuggcucuguuuuguuugcugccuucccacagcacuguagucgucauuagcugucccguggaugugauggagucugcccuuuggcugccuuucccagauucuguguguuuccuuccagcuugcagagaagaauguggccugacucagguucugcccaggccaguggcacgaggcccaccuggagagagaggucuggguaacuagguuggcuggcccgagaaauggaacuaccucuuguuugcuuuucuaauaauagcccugggcauuagccuugugccauuauuuuggggaucguggaaugcguggcagcuacgagcucauuagcuucauuccugucccuccagggacgaagcuuugguaggggcuaugacuucaucucuuuuacuggagggggaaacugaggcaucaagacuucaccggggagcaagggauagcuaagggcauguaaugagucagaucugggguugggaauaggagagaggaagcucagucaaucgccacugcccucuacgaacggggaagugaggagguaaggacgugggccaggccaaggagugcugagagaccaggaggaccaggcucugugaacucuguaggguuuaugcuggaauguauucugagcacugagguuugcauuuggagggcugcccucuuggggaaggaauaguggagaaagguuagugucucucagugucauguggggcaagggugcaggacagcuagcaagaggcagguguguguguguguguguguguguuucccuuuuagaaaugccuggugguuggcacaugucaaaugggccucuacacacuucaaauccacccccacaguucagguuagggucaagaguauuucagaggcaauaacugaaauuuucuggcucgaaagaugaggugcccugggguucuuuccugggagauaauggagcuuaagggacugaugucucuugacccaguuaucugggaagcugaugcaggaggauugcuugagcccagaaguuugagaccagcacggacaguguagacucauuacgcgcgcgcacacacacacacacacacacacacacacacacacacacacacacagagcuggggagggcaguggcugacugacuagggaacaggguaacacaucuuuccaggcuucuuccuggaaugaccccaguccuuaggaauuugcuuauuggcauaucacuguugaucuuaaagaacccaccuauggaacagacggacgcugcuugcgugcucccugccguaguccagaggccaggguguuuugacacagcaaaaagcuagaagguguguguguggcuuccuggaaagaugacgugucccuauuguuucccaaguuuccauguucaugguuugggcaagguggugacauuagguuggaaaggauggcucuggugagagagcuauggcugaaugggugggcuugcuugguaccaguuacagacauggcauggccccuuuguuuuucuaugcccaaacaacucuugagguguaguuaaggcucuugcuuccuagacccuugaggcaaggaagauguuuccugcagcuuuguagguguguugcugguugggagcacugggccagguacaugugagcacagguugauuucaagggugggaccuggucaggaggggagugaaugagaauucugggcuguagggaaugggcaagcgucuguguggaaacuacacuuuaggaugagaaagugaacgccugaaagguaugucacaguguguguguguguguguguguggggggcguuaagagagacgcuagggguccuguuugagacaaguguuggggcuugccaagugcgugagucugcauccuugcaagugucuggucugguguggucuggucaugggucuuuuggcuagggauuggcagacaggguacuuauucaccggcaugcuaaguucugaggggggcagucuuggcucgugcagaguacugcccuggugggacugagcaagaaaugcucgcuggaaucuggcggcugugcaggcacaaaccuguuacacugcaagggcuuaagggguuugccggcuucagcuccgaggaagugccaaauggcuacuugggugcgggggcggcggcggggcgggggggggggguuccuguucgccucacuagaccccgccgcaauacagauacugucacucuccuccacuaacuugucacaccuccccgguggugagagccuaggcaguuugguuggcggcagggcuggcaaacaucaggcgugggcggaaucgaagcucuaggaguuugcauggaggugcaggcagccugcgugccuggcugggaaggaaggagggaggagaagggcggggaaggggagccagcucuuagccuuacggaggcuauuuuuagccaggcuaucugauuguuaccggugugcacacagcugggugucucccuggcucgguaaagcccagcaggccugggaggugggagggccuuguugaugacuucuuccuggugcuggugucugugggcuggagcgugcuagcgggagcuuuaaaggugugagggcagcgguguacuuaggagcugucucuucugugugacuuugugcucuguugguaauguaugccguguauauguugugaucucugugugcgugccauuguccacgcgucagucuuguaccuugcugaugcugguugucaucauuuguuuguuuacuguggugcuggugacugaauccagggacucaggcaaguacacuaugccgagucacauuaaguguuuugccugcauguaugugugugcauguauguauguauguguaucgugugugugugugauuuuacuuuuuauuugagacagggucucacuaaauugcccaggcugccuaugaccucauuguguagcccaggcaaaccuugaaauugugauccugcugccucagccucuggagucuuugagauuacagacuugugcuuccagaccuggucacuuguuagaaucugcacuugggcuauguuuaauuugcuuuauguuaggcaugugugugauagcugagugcucauguuuaguaugaaacagcuuuaagagugucagugugugcuucauuagugcauacucauguuuauuccgucuuuccaugugcuauugcuguguacuuguggaugcuauauauaaacauacaagugucauguaauuggagaauagacacuggcuaauuuuaccugcuaagugggguugauuuuuuaaaaauuacucuuauauugaguuuaaaaauauuguguugcagccgggcaugguggcgcacgccuuuaaucccagcacucgggaggcagaggcagaggcagguggauuucugaguucgaggccagacuggucuacaaagugaauuccaggacagccagggcuacacagagaaacccugucuccaaaaaaaaaaaaaaguguugacagguuauaaaaagaauugagggaauaauucauuuuuugugggauuugcuaucugauccuucgugaagggagagacuacauaaucauacucuccauuaagaaacacucuggcaguggugcuugucuuuaaucccaguacuugggaggcagagacaggcagaucucugugagguugaggccagccuggucuacagagcaaguuccaggacagccagggcuacacagagaaaccaugucuagaauuaaaaauaaauaaaugaauaaagaacacucgaucaucuggcggaugguugguacuugcacuuggucaucucaggagaggguuacuaaaugggaauuuaaauggaaagaggcugcuugcccuccacauuagaaguggaguuaacagggcuggugagauggcacaguucaaaucucagcaaccacauggugguucacaaccagccguaaugagaucugacgccuccuuugugugucugaagacagcugcaguguacuuacauauacuaauaaauacaucuguuuaagaaguggaguuaacagaggcgauucaucugccuuccuacuuuugucuuucucugcagaacccagaaguacgauggccuccgaccuggagaguagccucaccuccauagacuggcugccacagcugacucucagagccacuauugagaagcuugggagcgcuucucaggcugggccuccagggggcgcccggaagugcuccccaggcucgcccacagaucccaacgccacccucagcaaagaugaggcagcgguccaccaagauggcaagccacgguacagcuaugccacccucaucaccuacgccaucaacuccuccccagcuaagaagaugacucucagugagauuuaccgcuggaucugcgacaacuuccccuauuacaagaacgcuggcaucgguuggaaggugggacuguuucugugagcugggcucauaccuagccuuuagcaaccucugcuuuuguuucuuccuauaaccuagucugguucacucugacuugucucagggauacguaaacucaagaucccuuaucuucuaccucugcuucuacuuacuuuagaguucaucagcuucaaaagcuuuaucagggccuuuaaucccagcacucgggaggcagaggcagucggauuucugaguucgaggccagccuggucuacagcgugaguuccaggacagccagggcuacacagagaaacccugucucaaaaaaaaaaaaaaaaaaaaaaaaaagcuuuaucauggaaacacuagugaugccaagcaugaaauauagugaaguggcaggaugcuguuguuaccacacgcucucauugucugguuccccgaaauggcagucuuugauuucaugucuuucuugccacucugcucuguucaagucauugagcaagcaaagguaugacuccuacuuugguaggaaacucaucaaauucuauagcuuccuuucagauagucauugucuucugaagcauuguauacuaagaaacaaagaauaauuaggaucuuuaccaguagcugguucacuagcagguaaugaggcuguuagauggagaccaugggcgucuucuuugaagaggaggaagaagguucauauuaaacuauauauauauauauauauauuuagccagguguagugacacacaccuuuaaccccagcacuuuggaaguauaggcagguggaucucugaguucaaggccagucuggucuacauagcaaguuccaacucagccagagcuauaaagugagacccucccccaaccaaaacaaacaaacaaaaaaacauccccccccaaaccaaaacacacaaaccacaaagaucugucugucuggcagacauugucuauuuugugacagugucauguguggcucaggcuggccuggccgggaacucacgauauggcugaagcugaccuugaacuacugauucuccugucuugaccucccuaugcuuaggauggcagguaugcauugccaagccaggcuucauuguaaucauuuggaacagucacucauuugccaacuguugaguaggaauggggauuaaaugugguuuucucacuccguaaaucaccagcugacuuucaaaccagaugaugaacugaggcuguugaaagcuuucagucuuccggugguaaauugugccccucuaggcuacagcucucugcgcacugacacaugcgcacugcggcuuucccuuuccccagaugucguucugaguguuacugagaaaaugaagguugucugugcuuuuguuucacuccugagguuucuuuuguuuuagccuuuguuguauucauuuacgugucuugccuguuagugaggguggaagaaugccauaagguugugugccccaagcccgugugguggucagaagacagacaacuucggguguaggucuuugcuuucuaccuuguuugagacagggucucuaauguuguuaacuacuguguauauauagcaggcccguuggccugugagcuucugggcacugucuugugucugccgcccauuugcuguaggacaacagcagaguucccugugcuuaacacuggcaugacggaccaugccuuuauguaggugccggagguuuaacuuauucuucacgcucagugagcugucucgcuguagaauacgcaugaguuuuugccuuguuuaauguauguaaacaguguaaaauacugcucuucugcuuuuguugauaugcauguuuaggaugugugugcaagcgugagugcauacauaccacauguggcuguggaaguuaagaggucagccuaggguaugcuguucgucuucuagcagguuugaggcggggccagacuggcuagggugaucuuccagggauucuuaugccuaccucauaucuaauccuaaaaacucugggauuacagguguggucagcuacaucucacgaucggugucaaacucuauccacugaaccaucucccuagcuccuacuuaaaauucauuaugguuauuguguguauguaugccugguguguuugugugugugugugcaccacaaugugcauguggaggugaagugauaacuccauaggguugauucuuucccuuccaucuauguggguuucagggguugagcucagguaccccaggcuugugcggcaagcacuaugcaccccugaaucaucucaugagcucaucagcagccuucccccacuguacccaaucucaccauguagcucugguuguccugacucacuguguaaaacagaauggccucaacucaaacucacagagauucacuggccucuucuuccugggagcugggauuauuaaaggcaugcacuacacacagcuuauuuagagaaauggucuuuuuaugcaguacuggcugcccuugaacucacugugauauagaccaggggggcuuccaacuuguggccacucuccuguuucuguuuccuaagugcugagccuacaggugugggguaccaugucuggcuauuuuuauugcuguuauuguuuauuuuuugagacaggguuuuaccaugugacucuggcuauccuggaacuugcuauuaucaggcuaaccucaaauucagagcuccuucuggcuugaggcauuuauauaugcguugucaauuuggcaggaaggcugaaagcuguaaaguuaacuuuucacgaucaccuggucaccgucaccucugacuucggugguuuucuccccucaccccucugcucucugugcagcccucccucccgcaguacaggcugaggugcugcaaugggcccuggaacuauguucuucugugucccuuuggggaacacuggggcauacccaaugcucagaccuaacuugcuucuuuguuuccccagaauuccauucgacacaaccuuucccuuaacaaguguuuccggaaggugcccagaccucgggaugacccugggaaggugagucgcugcugcaggaaucaaagggaggaggaaggagaggugacacucagaguccgguggcugugcugaugaccagggaggaaaccauguuagcuuuagaagcaucguuguguuuuccucagaggaagagcauggcugccaagcugcugggucuuuccuagagugggagacuaaggaagacuaugaaaucuuuuuguuuuaauaggaauguuuaugauggaguugucuuugagauucuuucucucucucccucccucccucccucccucccucccucccucccucccucccucccucccucccucccucucuuucuuucuuucuuucuuucuuucuuucuuucuuucuuucuuucuucucacuauguagaccuggcugaccuggaacuuuauauguagaccaggcuaaccccaacucauagauucaaguggugggauuaaagacauacaucaguauaggugugguauuacacaucuuuaaucccagcacucaggaggcagagacaaguggauuugugugacuaugaggccaguguggucuucauaaagaguuccaggauagccagggccuuagagagagacucugucucaaaaaauuaaaaaaaaaaacaaaacuaaacaaauagcaaaggcauguccuuaugcccagccuuuuaauuuuuuaaagauagagucucacacucuguagcccaggcuggcgggacccccuuucuuuugagaagcacuuguuucuacauguaaaauguuggcuuaguuaguuuuguuuuguuuuguuuuugagacagguuuuacuguguagcccagacuggccucagacuugucauucuccugccuuagucccuccugagugcuggauuacugguguguaccaacaucgccaguuugcucgcuaaccuuucggaagcuuuucuguguggucucaggccugaccuuaacgggagaagggagagguucuucccauuugacagaugcuaacgcuuaaggcacuuuugccucaggucguaggggaagggaccagguuuucuggccuuucucagcucucugacauagucucugacauuagucuucugccccuuuggaacguuugaagcuaguguuuggacugcucugugaccuccgagggcagauuuacuccucgcuagcacucagcucccuugggauuccgucaggaggucuagccuggcgucuucucucuccccuccuucccuuuccuuuuucucuuuucucuugcuugaucuuccuuccuuccuccucucuucuauucugucuuggggaauccaacaccaugcuaggcaaacacucugccacugagcuacauucccgagccccaccccauuuucagcaugacugcuauuagaggcucuuuccaacaggaacuuuauagguaaugcuucucuuucccgugggguuggguuccccuuccagggcuccuauuggacaauugacaccugcccugacauuucccggaagagaagacacccuccagaugaugacguaagugcucucuucuuugggagagcucuuucuuggauuuuagucauuucugugacuaaaugcggguuagcaccagcaagguggagccacaagcuggcucgugggugggugccucacccugcauacagcuuuucucuucuuucacaauucucagcuaucccaagacuccccagagcaggaagccagcaaaagcccccggggagguguuccagggaguggagaagccucacucucucacgaggggacuccucagaugucacuucagagccccuccuccguggccaacuacagccagguaggaagcugagaugacaagcauaggguaauuggacggaugguucaguggguuuggauaucacgccguucacuugcauauugaguaccuugucaugugcuaggcagauagauugggaaagaaggaaaaagcaaaggaggaaaacccagccagaaggaaggaggugcagagaggcauggaggugcacuagggaagggcuuguagaaaagaaauggagagugauguagaagccagguucaagauggccaaugagagcgggaagagccggugaugcugugccauuggccagcuggagacggugaagaggacagaccugacugacccugguggguuaugcugcuuagaaggcuuaggucaccguucuuaccugucuuugcagggcccagggucuguggaugguggagcaguggcagcaggggccccaggccaggagagcacagagggcgccccuccccucuacaacaccaaccaugacuucaaauucuccuacucagagaucaacuuucaggaccuaagcugguccuuccgcaaccucuacaaguccaugcuggagcgguccuccuccucccagcacggugagucugcagugggacaggcggggacauccuuguuuuuuuuuuuuuuuuuuuuucuuuccucuuuuucuuugacacagggucccucuuuguagcuuuggcuggucuggaacuugcuagguagaucaggcuggcuuugaacguaaagagaucugcaugucucccccuucugguugcugggacugaaaguuucuuauacugucaagugguaauguucucuucucucccuauuuucugucuuuuguuuuuuuuugagauuacauucucucucucucucucucucucucucucccccccccucucucucucucucucucucucucucuguguguguguguguguguguagucuuuaaaaaauguuacaaugcgcaagucccagggaacaaacuugcauuggguuuggcagcagaugcacuuaccugaacaugccaucuugccagcucccaauuucucguuuuaauauaugaaacuggucagaggacuaaacuauuugguacagacagcugacucagaggcacacuaggguauuaucuucagaaaacgaaucagaggacaauccaaaggcagcgauuucccucacauccuccaccccaguccugggauuugacccaggggcuguguguguuagagugcucuaccacugggcuacaccucuaguccagggguaaugaguucccagcugugagcgagucauucagaguaugaccacuaggggacaguaguggcacccucuccccaagaauccuuaugcuuuauaauaagaacaacuuaauuuucucuuucaguuaguuaguuaguuaguuaguuagggugagagagaauuacagauaucccaggcuggcuuugcgcuugcuauguagccaaggaugacuuugaaugauccuugucuggugccgacugcuggaauuacagcugugcuccgucacaucugguuuaguacuggggauggaaccagggcucauacagugggagcaagugcucagcuacgacuaaggcugccaacugaaccucaccuccagcuccuacugcucuauccugucuuauuuuuuccuuuuugagucagggucuugcuguguagcauuaucuguccugaaccucacuaaguagaccagccuggccuugaacucagagcaaugccugucucugccuccugagugcugggauuaaagcuacuauauuuuuuauuuguuaguuuuuauuauaaaacauugcaaacagaugagaaacaaccccuggccuccgucacucaccuuuauuuugcucagcuuauuugaccugccacugaacuugguuccaaguggaaacaguugagcgaauuucccaggccucaugccauucucuacaaaugcaguuucaggaagcaucacagugaugagagccucuccuguagcuuuccaccacaccaucaccauaccuaacacaguuaauagacagugcuuucccaacagcagccaauaucugccccauuggcaaacuuccacaguuacugagaaugacuuaaaguccucauuggguggcuuucugagagauggugugccucagcccucugcaaugaucacaucuguguacuauucuaguuugcuuucuguugcugugguaacagccaugaccgagugauccuggagaggaaagaggggcaggaacugaucagaggccaugggguaggcugcuugccaccuuauuccucauggcugugcagccuacucuguuuucuugaguuucaugguuucuccauguaguccuggcuguccuggaacuuacuauguagaucaggguggccuugagcucauagagaucugccugucuucaccuccugagugcugggauuaaagauguaugccaccauggugagcuucagccugcuuucuuaaccaccugcccaggguugacacuucccacaguggucuggguccucccauaucaaucaucaaucaagaaaaugucgucccccaccccaucuacugcccagugugauggaugcauuuucucaauugaacaauugauguuccgucuuucuagaugacccuaacuuguguuaaguugacaaaaaacuaaccacacaaacauaccauacacauguaugcuugcgcgcgcgcgcgcacacacacacacacacacacacuuucacagaggcacacaauuuugcauguguguuugcauguuuguguguguguguguguccguccaauugucugugugaauguguagauaugcuugccuuuggaggccugaggucaguucaaauguuuucuucagccgcccuccaccuuaugcaggguugcucaguugaauccagaacuugcccauuaggcauguccagcuagucaccuugcucuagaguccccuuaucucugcgcccugggcucugggauuccaggugggcugcacaccuaccuagcgcuuacaugaacgcuggggaucugaacucugguucucacaaucucauagcaagcacuuuacccuucuuuccagccccaguucauguagacguugugguggggcugagaguucacgugauggccuuguggccuccuugguaguccuuuguaggcagcgugggcuagccagagugaugagggauacagggccucagucacauuaacucuucucucugaggucuaucaucccaacugagagaaaaccugaacacugauuuggucuguuacaaguuccucccucucccccccuucugcucccuccuccucccaggccucuucugccauccuccucuccuguuucagucuuucucuuuuccuuucuucuuaacaaggucucuguagcccaugcuggccuccaauuuagagauccuccuguuucugccuccugagugcugggccugaaugauccucccaccuuggacuccugaauguuaggaguguggacacugggcucuguggccagcaauuacuuuuucuuuuuucuauaaccuaagggaucgaucucaagagugcagccuaagguguuaccauuugcuugggagauuaauacagcucauauugcuaauugauuggagggaggggaccuggagagagugccagaaacaaagucagaaauuagacugugugaggugaggacauuguggacauuuacucagguuucuagcgacagccagcuccaggcuuguccgacauuuugacauuacagcauaaugucacucucagaguucauacaugagaacugugugauuaaguuacagaaaacaaauguaggaaaacaccauggaugacuuagagguuaagaguacuggcugcucuuccagagguccugacuucaauucccagcagccacaugguggcucucaaccaccuagaaugaggucuggugcccucuucuggcaugaaggcauacaugcagagagaacauuauauacauaauaaguaaaucuuaaaaaaaaaucucauaauuuuuuaaagagacuuagugauucggagagaugguuuagugguugagaguguaugguuuuguguuggcucuauucauagcuauccugagcugcaucauucgaccugggggcugcagguuggacacaaguuagcucuuccuugcccagcuggcuugggagauuaaucuguccauaugcugcuucccacccaagcugcauucccuagguacugaacacaagaaggcagaacauuagaggaccgaggaacacucagguggaacaaucagugaauccccuaaaaguagcaugaauugucaccagugagguuuuacaauuuuucuuauuaauauuuccguggucuccaguggggcagagcuuuccccuaaccuaacugcuuuuuccggucuguuaucuaccagaagggacacaugguucuuacggucacagaaugagcuugcagccuuucaacucuccugccugagcgcucauccugaaagaagaugucauuuagugaaaccauguagccccaaucauuugccugcuuccuguccucccugcaggcuuuuccucacuccugggagacaugccaccuucuaacaacuacuacguguaccagcagcagcaacagcagcagccaccaccacagccacagccaccaccccagcaaccacaaccacagcagcagcaggcacccacucagggccccucaaauguagggggugccccuccacugcacaccccaagcccugauggcuguacuacaccagggggaaaacaagcgggcgcugaaggcuacggccccccgacugggauggccaugcauccucccccacugcagcacggaggcuaccacccucaucagcaccauccccacucccacccugcccagcagccaccacagccacaggcgcagagccaggcauccaucaacagcacuggcuuuggugaguaagaaggguacagaggggcaggaguacacuguauggagguaccgugggcgaaaacguuaacagucggucuucuagggucaaucgcuugccuucuuacuucaucucagcugguggaaguuacuacauaaagccccauacucuggaggauugagguuggggauuucauuguucccgguccauacugucagaugggcuagggcuaggauuguuuugcaucucugccuguggugcuaacagauaggucaccuucccacuccugcaucucaagugagagaguguccacagcucuggugcugaugcagcggcuaagcugugagaagcuugcauguguugacugcucuuccugucucaccacccaccccucucuucacagccuuuccuccugacuggugcuccaauauugacuccuuaaaggaaagcuucaaaauggugaaccggcucaacugguccagcaucgagcagucccaguucucagguuagcacuuuaaggaccacuucccgggggaagagguggggaugugcuagaacccacgugcauggccaaguggguuugggacagaauuucaucacaucugcauguuacacaagauagauauaucaucaguauuuuuagauuugacucagaauuuugcuauuauucaaauauuacaaugcuuuaugcuagucgucuuuuggggacgaggaaggcucuugagaauucagagacucuagaucacugcucuguaguuuugcuuccuggcagagagaugagagugaguucauuaagucacuuugaacauuuuuuuauucaccaaggagaugcaaauuaaacuaagaauuuggcaaggaacaaaauggaauggggaguugaaaggugaaccuguaauagaaguaacucguggccucugguggucgcguuaggauuccccuuacgaaacgaagaaagcggucucaaacuuggcaagaagcauccuuagcuggagugaaaugaguaggcuuguuccgcaagugucagugcagaauaggguuaauguaggcaguccuagaggagaaaacccuaauuaaaaacuggcacacucaaugguucuuguuaucauaucauauuucaauaaaugcuuauagaagcaaagaaagaaaagguauaagucauuaucguuaauacacaguauuagagguacaagaugugaggagaccuggcaccaggggcggugcggugcgggcuuuggcagcuccucacucaggguuuccauggcugguguucuugucccuagagcucauggagagccuacggcaggcagagcagaggaacuggacccucgaccagcaucacaucgccaacuugugugacucccucaaccacuuccucacccagacuggucacaugccccaacaagggggcucccaccgaccaccugccccuucccgcaucacugacuccugugcccucaccaguggcaaaccggagccauccaugaaccaagguacgacacaaaaguugccagagaaguggagacugcagugagugaagggugaagggaaggggaaagagaaauacccaauccgucuucuuaggcggugaccuggcuggguccugggaccagcuuguugaccgaacaccuauugaaucaauaaaguccuguagguaggccuaaagaauugcugcagaagccuagacuaggauccuuucacaccuugguuuggaagaucagaauuaccuuuuuaaagggaggugacuuguuaaaggaaguccuuauucuaaauugucccagaaguaaucaucaccugaaucccacucaagccaggggaauggggacuugaugaucaugcuucuggugguucucuuaucuuugauccaucccuucccaccguaaaggcugaggacugguagcuuuuguagaaugcuuccugcacguaggaucuauaaaacaagacaagaagagagacagagacugagggacaaagggacauguuuuuccuuccugcuuuguugaccccaguaauccuccaguaaagugacuuguguuuugcuuugguagugaacucuuacgggcacccacaagcuucccaucucuacccuggcccagcaccaauguacccgaucuccacccaagacucagcaggauacaaccgcccagguaagagcuggggagugugcuucacgacauacaagcacacacaccucucgguguuuugcuuuccccuggcaucuucucucugcccuucuuccuguaccugcuagaaugggugauguaucaugguccccaagacugcaggaugagaugagcuacccuccagggaggugcgcauaggugagacuaaggaaggcacuuuuauuuaacuacauucacuuuguuagguggugcugggaauggagccaggaucucacacguacuacacaagggcuuuaccucugagcuacaccccuagcuugggacuuuguggagcuggagagauggcucaguggucaggagcacuagccauuuucccagaggaccgggguuucauucccgguacccacaugguuuauguggcuuacaguggucuauaacucuaauuccaggaaucugccacccuccacugggcuccgauggccuucaugaaugugaugcacagauauacaugcaggcaaaacacacauacacauucaauaaaaugauuuuuaaaaauuaaaaaaauauauccugcagcuacaauacugaaaggaagauuaugaauguaagugugugggauauuugugcccagcuuuggaaccaagagggaagacaggcaaacgaaaugagugcuucacauaaacggccaugucuguuuuccugucacuugaccacuagcaucaggcaucuggggucagcguaucguuuuguuuguuaguauguugcuguuguuuuggguuuguauuugucuuucgcagugucggguugaacuuagggucucucgcaugcugggcaggugcugugccgcugacuugcuuccucggcgggggcuugaguugucuuugaugggagggaggcagagugcagggagacacuggaccacuguagacagugcgaaggaacagaucccucagguucaaauguauuuuuggaauucacuguugcccucuucucugaucacaagucccuucaguuuugaggguggugucuuucauauaauaucacccaauuaagcuauuuuaucagaguuagauagucuucacaaacgugggguuuaaugacaggagugugcuagaucgccaugcucuucaguguuuccugggacgucacugaacugguagucugccacagaaagaacugaaggcuguaacccaggugucaucagaggggugucauccaacaucugaugggagcagaugcagagacccacaggcaaacacuaggcaggcagacccugugaagacgaggaggaaggguuauaggagccagaaggguagaggacaucaugaggauacuacgaggacacagcccacagaaucaacuaagcagggcucauaggagcucacagagacuggagcagcaggcagcgacccugugugggucugagcuagguccucugcauaucccuuauguuuguguagcuugggauuccuguggggcucccaacaguauguguguauguguguguguguguggggcgggggcaucucugacuccuuugccugcacuugggauucuuucccucguacuggguucuacguccagccucgauaugagggcauguguccagucuuauuguaucuuguuaggccgaguuuggugaauaucccuaggaggcuccuucccucccucccucccucccucugucccucccuccccccuuccuuucucucuuccuuucuuucucuuuucuuuuucuuugaaaggaaacaggaggaguugaucuggggagagggaaguuggagggagggaagggaaggguaacuauagucaagauauaauguauaagagaacaauuuuuaaaaagaaaacacucauaugcauaagauaaaaaaauucuuuaaaguuaaaaaaaauacuguaggcuaacuggacuguaggcugacugacuagacuguaggcugacugacuggcuguaggcugacugacuggcuguaggcugacugacuggcuguaggcugacugacuggacuguaggaugacugacuggacuguaggaugacugacuggcuguaggcugacugacuggcuguaggcugacugacuggacuguaggcugacugacuggacuguaggcugacugacuggacuguaggcugacugacuggcuauaggcugacugacuggcuguagacugacugacuggacuguaggcugacugacuggacuguaggcugacugacuggacuguaggcugacugacuggcuguaggcugacugacuggacuguaggcugacugacuggcuguaggcugacugacuggacuguaggcugacugacuagacuguaggcugacuguaccaguguuaucuccagcuuccuucuuggugucauuggggcagaagagcacucacucccuaucuagacuguuggaacuuacuucuccuccaacuuauuuuaugaccugucuuucuucuugacagcacaccacaugguuccccggccaccugucccaccuccuggugccaaugaggagaucaccgaugacuucgacugggacuugaucacuuaaugaaucacaguugacaucagcccaaggccugguggugaauucuggccacgggggaagagcaguccccggcuauccuccccaaaccuguauauagauauauagcuucuuucuguucucucugucagagacgccaccgcaagaugcugccgaggauaauccucuuuuccuccucauccuuuguuucccuccuaguucauuauuauucuaauuauauuauuauuauuauuauugguuacauacugcccagucugcugcccucuuacccugggcuuugcccucccuuugcccguuugaaaucuucaggucucaagaugaggccgugauagcugucaggaaaggcuucgaaugcuaguucaccuuucucucugagaaacucagugcugaucccaccuuucagcucugaacuguguucuguuccugucuguuucaggcuggccuggagaggccacaguaaguagaggggaggcuaagacacugcuuggcaaccaugacguugcaguuuuacucaauggugcuaauuguguccucugcacucucccauuauacauccgaucuuuacuuuuuccggcaguccucaugcccaugauggguggacuuggagagcuggguuccguagagcgccauggagcagugauggguauaacccagcaugagguuggguaugcacugccauaucaaaacaucccuggcuucuuccugguugaugcucuggggagguuagcuuguccgcucgggcaugaagaccacugugcauccuagguucaacuucuuggaaacaauuucaauuuaaggcauuuuggcuuuggaaaaggaauucuuucugagaguuagcuggcuauucugcauauauaaaugaccuuccaucaucucuucuccuucagcauauacuuuuuugucuuccuaaagcuguuuguccaaaucaucuaccuguuuuauuuuuuguucucccauuuucugggaaucucaaaagacaaaaggaagccauucucacuccuaguuucuucaugucauagacaugcuguggaaaccucuuucccuccugucacagcagacucauaccugugauacugcugacgggagguuggggagaagagagggaacuggcggagaugugggugggaaccugucauuuguuuaacugcacagggagacgcuucucuugaagucccugucggugggguggaagcuuuugauuuugacaggcaaugaauaauuacauuccccuguaagagggagaugaauuauacagagacagggcgcagcaagggcaaggcgcacuccuaggcacagaguggggagucuccauuaucaaugaacggccaugauuuauugcugcagaggucuuagugagggugugguugaauucgauucgagagagggaaaucucacuuccaccuuauuuucacuaaauuuucugaaacagacaaaauguguaguguugacagggccaaucuccgugacuuuuguucauaugcuuuuauuuauccaugauuuccaagacacugggcuucccauucucacuuccccucaucaaucccuuuccuuucuuuagaagggggcuuauguaugagacuggugaaguccagugaagcuaaguaaaggggcaagauggggcaguucacuaaagagcacuuuauuucuuuguaaggaaaaaaaaagggaguauaagaaaaaguuuccuccagcagugugcgauguacuggagagcaucuggugggccaguguaugaagcaguaguucccgcuagggaacgggguguuucccuagaggaggcacacaccuuugccaggugcccuacuagacaucucuugcuaugccucccauccagguguagucuccacagcuucccuuugguuuccucgaggucucucccuugcagauuaccaccucuucuucuaagcaccuuuccuggucagaucuguccgcgguuggggagcuaggcugagucauacucccaggugccccggcuucuccaugucuugagaaccagucucccuggugggcagccagagcagcuacagugggcuggagacuggaggguggcuuuaggcccccugagguucuagcucuccagggucaggcuugcagaacggggcaguuuaaaccugauccccucugggccuccgauucccaugcccuccaugacguggaaagggaacuacuuuuauuuuguugguccgguauugcuggacaugaaguacaguccuugcuguugucuugggugauauuugcacaguugugggggucacugccuauaagaggaaauaggggagacagcagaggugcaggacaaaggagaagucauuuguguugcuccaccuauccuaggcuuccucuccucaaccccauguuucugguuuggugaguucuuuauaccacccauaaugcuuugcauuggugcaggcugggaaggggguguaugggcucacaacuuguuugguuuuuuuguuuuguuuuguuuuuguuuuuguuuuuuugcaugcuuucuuaauaaaaaaaaagaaaagaaaagaau

SEQ ID NO: 3365 - RNA, 9026 nt, Mus musculus
cuuccugugcagucagauagcagucaugauccugaguucccuuuacccagggaaaagucagugcucagcaacucguccaaugcacuucacuacuucauuuuggcuggaccagacaggauuuguugguggcucgcagaucaucaguccuggagccuuuggauuccaucucagugugcuugguaagaaaacauagaugagccuuauaguucaugcuugguuuagccugcugauuauguacaauggcuucaaguuccuuaucuucuguuuccuucuauucuuuucccuaaaacuuuuuuuuuuuuuuuuugagagucuuacauagagccuuggaugguugggaacucacuacauagacugggcuagccuuaaacucacagagcuauaucuccuucuccugcgauuaaaguuguacacaaucauaucugguucuuucccuaacuuuuguuuuguuuuguuuuguuuuguuuuguuuuguuuuguuuuguuuuguuuuguuuuuguuuuucgagacaggguuucucuguguagcccugacuauccuggaacucacuuuguagaccaggcuggccuugaacucagaaauccgccugucucugccucccaacuuucccaaauuuuuauuucuccugucuuaucuccaugucuacuuuuauuuuuauguaaauacuauacauucuauuuaucuuggcuuuuaauauuuucauucugaaaauaauaaugaauuuauguuauuuauuccccuagauuauagaucauguuuucuucccuuaguuuugcuucuguaaucauugaucacauguacacacauuuauuuuuauguauauauacacacacacacacacacacacacacacauauauauaugcccauauguggauucuucuucuguugcucucuguaacucucccguucuuugagcuauuccuuaucaaaauagcugguucuaucauuccauaauuauuauuugauauuuaaaucuaauuuuuacucaucauaaauacauuuuaguuucagguuuuuuuuuaauuacucuggccaacucaauccugaaaucuuuauaaaaaacuuaaacauagaggguuuuuguuugguuugguuuuggggggggguugcucagaacuuggggaaauguaauguggucuuguccuggaugacuuuuagggugugagcuuucaaggaagaucauuugugauauuuaaacuauuccucacagcacggaacucaguugcucuuacauuggaauguuuuccuuucaacuucuguuauuuuaaaucgcuauguccacuuuauuaucgagaccacaguuucucagucaugugaucccugcaguaaaaaagaacaguaaccuaggcguuauuaggugaguagcuggggcucuccccggcugcggucacgugaaagccacgucaucuccagaaucucagcaucaaaagcugcacagcgagggaugucuguggguugcucuguuccuagcagucucugggugggcuuugcucucagcaucuuaggaugguacgcauugagguuggaaugggacacuagauccgaguucuugccguucacauaagggaaugguaggacuugaaaaagacagagaccagaguggguaucguuucuccuuuucuucuuauucuguuguuauccuaacuucugcuuaccgcauaagacuugucacaaacuuuugucaaguucagcagaaucgcuuccaaaugucccagcuuccauuuaaaaacaagcaaaccaaaaaaucaaaucaaaucaaauaaauaaaaauggaggaggcugaagagaugaucggugguugggagcaguggcugcgcuuccagaacccugcucuaccaggguucaagucccagcaccuacauggcagcucacaacugucuguaacuccaguuccaggaaaucugacaccaucccacagacacgcaugcaagcaaaacagcaacacacauaaaaugaaaauuaaucauuuuuaaagauauaaacuguuacuacauccaguaauguuugggaauuuaaaaucaagagagaaauuuagaagagacagcauaggaauuaagaagccauaugggaaaaaaauaaaauggcuaaagacuaauauuuuuaauguaauugaaaaugaaaaaauuaaacccgaaagguaagcaucccccuggccguggggguacaugcguuguaaucccaacauuugguagacugaggcagaagaucuccaguuugaggccagccuggucuauauaaucuaacuucaucucagaaaaaaacaaaagaaaaaaaaagugacccuugauccauaugcuaaaugauauggaagaggcauuuguaaacaggucuugucuuuaccaucacacaguuuagggccacuauaaaaauuacaaccuaagauuacaugugccuccucauaggacaugucagaaaaaaaucaaccacacacuucuacauucauguacaugagucagcacacacauguacaagugagagaccaaagaaucaguuucuucgaggauuauaagagacuguuuuagauauagugcauugagguuaaccuugaggaguaaguauuuuaauggguagaauuuuaguguagggcauggaagaagccauucuaggggcguauuucuaaguggaaaccauuagcccugcuuaggaauauaaagcagcauugaucugaagggaugagacgugggcagaaaggaugcauuuguccgagugcucagaacuagggaaggaucucaccgaccaggagggcagacugcagagaacuucacuguagaagauagagaaguccgucuggcuuuggguucuagaugcaauuuuagcagaauaauaagagcagaagacgaaauaaccccaaaccaugaaggagagaauuaagaaugauuguucaagaugggcuuggugacacacaccuuuaagccccucucucaggcggcagaggcaagaguuugaggccagccuggucuacagagggaauuucaggaaagucagggcuacacagagaaacccugccucaaacaaacaaacuaaaaagaaugacuguucagagcaauaagcgcccaaaguuggaaaaaaaauuggaugaaaacuugguauuccuuacauugaaucuuccuuaaguuaaaaguuaaaaguggggacuugaguugaaacagcaaguuuagagaguacuaugugcuagguccacaacugccacccuugguggcuuucuuguaaacuugcuacuagccagaguuucuggaaagaggaaccucgauugagaaagugccuccaccagauuggcuuguagacaaggcugugggucauuuucuugguuaacauugacuugggagggucaagcccaguguucucucugggcagguccugggauacuuugaagaaggcaguguggguagacaugagaugcuacccagugaauagcauuccucuguggccucugcuucaguuucuaccuucgagucccucccugccuuggcucugaccuggaauauguaggaaauaaacccuuuccuguccaaguugcuuuuuggucagucuuuaucacagcaauagaaagcagauaauauacuauuuaaaugcccuaaauuagguaaaagcaauccaaugucuguaguuagaucacuuuauaaacaaaauaugcuucacacacacacacacacacacacacacacacacacuaaaauaucaauuucagaugggcagugguggagcacaccuuuaaucccagcccacgggaggcagaggcaggcagaucucugaguuuggggucagccuaauuuacagagcagguucuaggacagccaaggcuacacagagaaacccuguccugaaaaacaaaacaaauauacauauguguguguaccuaugcaugcauguuuuuuuauuagaugagaacauuuuggaagucaguugcauucaaagugacuagggcaaguacugcugaacugugcacuggaaauggucaauuaaaaaggcugacuuuaugcuacauauguauuuuaucaccaucaauuuuuaaauaugcaugauauaauugaaacccacuaaauuuuguuuuuaaaauguauauauacaugcaaaagaugaaugaaggaauccuugagggccagcuaauaagugcaugcuaaaacuaagucccaaaagucacccuuugaccuccaugcacacaugugcacgcgugugcgcgcacgcacacacauacacacacacacacacacacacauacuuugucaacuaauuaaugaaaauaugcaguucucagcuuuuauaugcuauuguuggugugcuaaaguuuuggaaaguccuccaaugaugccagaucagggagagucugcccacaaguuuuuguauauuuucucacugaggcaucuauucaguuugggcagcagacacugagcagaacguagcacggcaaugcuugguagcaaugccuguccggccagcacucagaagacggaggcaggagaaucauagcuuccagucagccucuucuacaauauagucaguuggaagucagccagcuuagacaacauggagagccugugccgaaagccacuggguaagcccgaaucucaguagcagagagcugcccagggugcguacugcaaaaaaaaaaccucaaacaacagaaguagggagguguaaaauaaaguguagggggguggaauuuaagcugauguggacuuccaaauaaaguuaccuuuuagauaccuauuuaaaucaauagcauagaccugaaacugucuaucagaaaaugugucuauucugaggaaggagugcuaacgagguucugugaggggggccucuggcuuugagaggguguaccaucacauaagacuccuaaaagcacauacuuuuauaaauucaccaugagcuuuaacaucuucuuugucauuucgcagacugagccauggagucuuucgaugcugacaccaauucaacugaccuacacucacggccucuguuucaaccccaagacauugccuccauggucauucuuggucucacuugucuauugggacugcuaggcaaugggcuggugcuguggguagcuggcguaaagaugaagacgaccgugaacacagucugguuccuccaucucacccuggccgauuuccucugcugccucuccuugcccuucuccuuggcucaccugauucuccaaggacacuggcccuauggcuuguuccugugcaaacuuaucccauccaucauuauucucaacauguuugccagugucuuccugcuuacugccauuagccuggaccgaugucugauaguacauaagccaaucuggugccagaaucaucgaaacgugagaaccgccuucgccaucuguggaugugucugggugguagccuuugugaugugugugcccguauuuguauaccgugaucuguucauuauggacaaucgcaguauauguagauauaauuuugauuccuccaggucauaugauuauugggacuacguguacaaacuaagucuaccagaaagcaauucuacugauaacuccacugcucagcuaacuggacauaugaaugacaggucagcuccuuccucuguacaggcaagggauuacuuuuggacaguuaccacugcccuccagucacagccauuccuaacaucuccugaagacucauucucucuagauucagcaaaccaacaaccccauuaugguggaaagccuccuaauguccucacagccgccguacccagcggguuuccuguugaagaucguaaauccaauacacugaacgcugacgcuuuucucucugcucacacagaacuuuucccuacugcuucuaguggucauuuauaccccuaugauuuccagggggauuauguugaccaauucacguaugacaaucaugugccgacaccgcugauggcaauaaccaucacaaggcugguggugggcuuccuggugccguuuuucaucaugguaauuuguuacagccucaucgucuucagaaugcgaaaaaccaacuucaccaagucucggaacaaaaccuuucggguggcuguggcuguggucacugucuuuuuuaucugcuggacuccauaccaucuugucggaguccugcuauugauuacugauccagaaaguuccuugggggaagcugugauguccugggaccacauguccauugcuuuagcaucugccaauaguugcuucaacccuuuccuguaugcccucuuggggaaagacuuuaggaagaaagcaagacagucuauaaagggcauucuggaagcagccuucagcgaagagcucacgcacucuaccaacuguacccaagacaaagccucuucaaaaagaaacaauaugaguacagaugugugaagauguggcccugggaaccuaagcagaguucucaggugaacagugauggaugacaugugagcaggacacuuuagacaauuuggcgacucucagagaaaggucucuuauugacaucagcaucauuugaaaacauuaaagaugcaaaauuucaagccccaucccagauguguugacucagaaucucuggcccaugggaccaguguuuuaacaggccuucuuguuuccaucaguguuaaguuuuaccucauuuggcuuagucuauucccaucccugacuacaccaugugcaaugaauaacuuuuucaucuguuuucaguauucuuuuuuuuuccuuagcaucaucuaaacuucuaguuugcauggaaggcugcucuuauuguucugaauggaagauauucauuuauuguacaguuuugugguggugacaagugauuuuuaaguggggaaagagacacaguaagaaaagaucuaugaaagcagggaguguugaguuagaguuugacagaacacagugccaaaugccacccacuaaaagcaaccugagauaauuccaguguucaugugagcaagugagcacagauacacauaaacacuuuccuacuccuggaguguuuuagaaguuguagcuuggagcucucucuucccuguguauucugcuuguucauagagccaucuauguuccauuucuuuuuguuuguugguuuggcuucuuguguugguugguugguugguugguugguugguugguugguugguugcuugguugguugguugguugguugguugguugcuugguugcuugguuuacuguuuuuucaagacaguagcccuggcuguccugaaacucauucuguagaccaaacuggccugaaacucagagaucagugugccucugccuccaaggagucuucuuaaggucuugaauuccuuucuguuuuccacacagggccuugccaucuccugcugggauuaggcgugugcaggugugcaguacguaccuggccccaucgucuucggcuuuuuacauuagacuuuguaucucacauagaauaaaacaauauccuaaugggaugauggguggaacuucaggaucaaugcaugcuucaacagcaauaucaaaagauuuuaaacaugagucuagguaucuuacaugacaaaagugucaggcacacucucuuuuuuuucuuuucuuuucuuuucuuuuuuuuuuuuucaaauuaauguuugccuggaccaugcuaauauaaaguacuguaugcagccaauuuuaaaggaacuaauuaaaaaugaaauaaaaaagggugguuucuccagugcccaguaguucccaucucucccuacuuugcaagaauuguagcuguuccuucugauauuuaccauggugugccuaaaacaccucuuaugcugcugaucuuuguagacaggaagaaaaggcugucuugauuuugauuuacuuuaccuacauuuucauccagcaccccaguguugacugguaucacacauuaaucuguucgugaucauuuuucucuucccuuuguugucggguuuugcuugccuucgugccaucaucucaguguagcacacacaaucuagcuucagacucccaggucucuuguuauaguaaccagaugagcaccaccaccauccccacccccagcugaccacacaauuuuccugucaauacauuucaauagcauacagcuuuucucuguccucucauuuuucaugcugacauauauuaauuguacauauuaauaagguuccacguggcugauccauccaugcacacaacauucacacuuucacccccagccucuucuuuaucauuauucuacuuacugauugacuuuaaaaaaaaaaaaaaaagucugaagaaucucaugcuggccuuaaaaucacuaugcaaccaaaaaugaguuugaaauucaaauccuccugccucccaugggcugugauuauaggcauggaacacuaugcccacucuuaugugguacugggacucaaaaccagggcuucaugcauagucguuaagcauccuaccaacuaaacuacucugcacccgccccccagccugcucagguugacauuucuggcccucauauaugagacuaugugauacguauguguccauucacauccauucuguuaaaaccaguauuucacucauuguuauggcugaauaacacugcacuguguaugugcaugcacacgcauguguguacauguguaugugcacguguguguaguaagugccauuauccacccaacuaccaaccaaugccuaagcagauucuauaucuuagcuauuauacauaguacuacacucaaccuuuaguuuaaaaaaagaaaaccagcagcucccauaauaaucuauuauguggauacuuuccauguguuaaaucacuagaaagucaagcuuguuuguacagauagguaugucuaagaugaacgaguuaaucuacaaagacggaagauggaauguaguuuagucuugugauacauuauuuauucaguugucaagagaagggccuuaggcuacaacuguuguaugaacaauuauguggaaauuucaaaucacuaaaagaucuuguuuacuacgagguaauucugggcauaagacugcaguucugccuuuccaguaugagcgguuuacauauucccuaugaauaaaugcuuuuaucuacaag

SEQ ID NO: 3366 - RNA, 9496 nt, Mus musculus
cauagcuauggucacuuaggagguaaagaagcgaaggcagagcauucuaugucuucccuccuguccaaauggcagagauugauccaggggucagucuguucccaaguggcauaccuuggcucuaugugguguuugcuauacucuuuguauuuuuccuuuuugucauguucucgccuuuuuugcucgagauagaccagcacaccaagaaauguaaggacagugugggggacuuaggagaacaaaggaacuuuagugacagauuaguguauggaccuagcgggagcaccuauuauacugugggaaacaagaauguucuuuuguguguguguguuccaaggucccacagcucaaggcugugauccauggcucacaggucuuagaaauuguaaucuugugauagaaaagcuuagagggcuugcguuugagcuagcccaagggaucuauggcuuuuauacuugcagaggaggaggaaguaucuauaaacucugacuuaucuaacuugaauaccccaguacaaagacauggggagcccaggggacucuggacugugagggagucucuccagugggcucugauggggguacauugucuuagucuuucucaggugccgauguucucugcgcaauguuuccuauaaggauaaagacaauauuaagaugaagaugaaccaucugggaggggcaaguaaguacucucuguucuucaucucugggaacucaucaguccuaguuuaugugcugauuaagggaauucuaugcuaaaucuuggacuugguggaauagcgucuauguucugcacauacugugugcagauacuguguucuucuacuaaguuuggucuaagggcucugcgacuuuucucuagauaaucuuuuguuucuuuuuaaagcagaggcuuuaaaaacuaaacucucauuaacucucauguuaaucaaaaaguuuguuuugucauucauacuugugauguuucucuucccaugguauccuuucuugcaaggacaaaaaagguggcuuuucuauggaagcaauacauuuccuucucugacagggaugaggaaaggacgucgaaagauacacuaucagauagaaagccuauggaaucaagguuuaucuuuuccugggugauaucuuggugaccuguugaucaaauucaugcaaauaucagugacccuuccuguuguacaugauucaacccagagcuucacucaggcuaaucauaaaccuuacuacugaguuauauccacagccaaucaccacagaucccgaggacugugcguauuauggaauuuguuucuuucaugagggucugcuuugcccuccugacaacuucaugacucuugugacaucacagagaagggacacauuagaaacuaaauuucucuaugaccaccaugucggugguucgugauuauauaccaguugacauucuguccagguuucucucacauaaaauugaaaucucuguaaaacauuauuuuucuuggagauaagcaagacauugaaaaacaugucuccacgugaacaaguaauuggauuuggauuuuuuguuuuguuuuguuuugaaacuuaagagaagaauccguaagaagcugccauuaaauuaaugagaguauaaaauuacaacaaauauauguauuuggcuugguuaaacggauuaucuaagugcuugcauaaagccacuaccucccgguugcuuguauaaaggccucucuucauucuccauguucccucuacuaauguucugagguccuggcugcucuagagcuuaaagucaggugaauauuucaaaggagacaaauagguggcuuugucugaaacuucauguuccagcaauaagugagggauauuuccuccccauggcaggcaaagaagccaacuuaucaucuagggcuuucuguaagugagcaaagggugauagagcaagcacagcuauucucaagagcucagagacugagugaacgaaucuuucaaaacauuucugagaauucucgauaccugcagaggcuggcuaauccugggcgcagugggcuaugccagacuuuucuuuauuuccaguacuaauaugcacaggcuaaccuauuaugagcccaucucucauauuugaaaguuaguucuuuugauggucagccaugcuuugugcuaggauuauguauaaacugaaguauaggggaaucugaggaguugcucaaacguggacaucuuggugacaugauccuaugaugucagugucucauauaauguugauuguuuuaauguuguuucuuggguuagaggaggugaggauuauuccagauuuauuuuuuaaaaacaucauuauuaugcauuuggguguuuuguuuucaagucuacguacugcauguaugcaguauccauaggugccaggagaggcgucuggucccgauagaacuggaggaaggaagggaugcuugccaagugcugggaaugaggucuagguccccugcaaaagcacccagugccuuuaaucuccaaaccauccuuccagauccauccaucuuucuuucuuucuuucuuucucuuucuuucuuucuuucuuucuuucuuucuuucuuucuuucuuucuuucuuucuuucucucucucucucucucucucucucucucucucuuucucucucucucuuucuguuuuuuguuuuuguuuuucgaggcaggguuucucuguguagcccuggcuguccuggaacucacucuguggaccaggcuggccucgaacucagaaaucugccugccucugcgccucccaagugcugagauaaaaggcgugcgccaccacugcccggccagauccauuuucuuauaagguaguaaaaaucuuugugcuaaaaggaccggagcugccauguuagcuacgauaguuuuugacucucaaaugagaaaacuuuguaucuauacaauaaagggugaaucaccuacucagggacaauuuauagacaccaggaucaucuauguagaucauuuugggagucaggaaggaaacauaagauugcagagggauaauucugaguguuuuuucucccuuccauuucuuuuuucuuuuuauauuuuuaaggcauuuuuauuagguauuuucuucauuuacauuuaaaaugcuauccccaagcccccuacacccucccccacccugcuccccaaaccacccacuccugcuuccuggcccuggcauucuccugugcuggggcauauuaucuuugcccccaccugggggauccaucccauauacaaccaucaaacccagacacuauugcauauuccagcaagauuuugcuuacaggacccugaaauagcucuuucuugugaggcuaugccaaugcuuggcaaauacagaaguggaugcucacagucaucuauuggauggaacacagggcccuuaaugaaggaccuagagaaagucccaaggagauaaaggggucugcaacccuauaggaggaucaacaauaugaaccaguacucccuagagcugugucucuaguugcauauguaguagaggauggccuagucggccaucaaugggaguagaggcucccuuccauuucuuaucuugagaaauaauuucuugugguaaauauuuaccaagccauaggaagucaaauaaccacauauggaauuguucuuccagaggaaagaucagccguuuuaugacucagcaaauucuggaccuagagcuaaagauuccuucucuguguuuaagauagucacuuggaaacauuacuggaauguucccaaauguguuucccaguuccacuguugucugaggccaucauuuucugcaaccauagaguagaauguggcuucaugaagcuagaugcauaaugaaagggauugccauaggcuuuagccaccaaagcaccaaauaucaaauuucuauuaacuauauaaaauacaugauauaaucagcuuaaucaaauaaaaauauuuugguucacuauuugagaaguucuaauccaugauaagucagccuuuagcuuuuugaugcaaugcaucauacagaaacagauaauagagcaagacugaugauagggcaugguagcaagagagaggaccuaggagaaaauggcuaauugcugccaguugucaaagucaaagagauucucuuuuaugccacaggagaaaaaaaaucugggaaacggaaauuauaggaagagccaccauauccaucuuaacaccaaucuuucuguuguugcuauucaaguagaguaaaucaaaacagaccuguuaguuauuaguaaugauaaguaaaaaacacucagcaauaguucacauuucugucauuaaacauacauuuuuaucucaauaaguucaaaaguauuuaagcaaucuucagagucugggagaucuccgggaugagggcacugagacccacagagaaccaguuuccccgugucuauccgcugaagccagaagucacuuugggagaccauuuucuuuugguuauucguuuaauuacuaucauuccuaauaucccauaaagaauuuuuaguucuaagaugaucuuugauguuucugucugggaguuuucuuccuccauugaguaagaaacucauagagcuuugggcacauuugaauuccuaggcagugucaugaugguaagucaucuuuuuguguuuugaguuugugcacccugugaggaaauacaugcaaagauacacauugucuuccuagacagcaagccuugggagcaggcagaggccguaugaauagauaauuauuuguucccggguuuccacuguuccuuuuugggaagguugagcugagaacaauuaagauuuuugugugccuugagaaguggugcagagacagagccaucuuguggcuggcaaucuuugggaaaagugacuugaagcuuaaggcaaucuccaauguaaacguugucauuagaaacaaggacaguuggggcuggugagauggcucagcuggucaaagcacccaagcacucagaaccauaaucuuggcaugcuggagcccauguagauguagaagaaacccaaccccacuaaaacauccuuuggcuuucacaugcauacugugacaugcaugugccugugcuuacauaugcagaacagaaagagagagagagagagagagagagggagagagagagagagagaagagaagagagaagagagagagaagagagagagagaagaaagagagagaagagagagaagagagaggagagagagaagagaagagagagaggagagaagagagagaagaaagagaggagagagagagaagagagaggaagagagaaagaggagagaggagcuagagauagauagauagauagauagauagauagauagagagagagagagagagagagagagagagaaugaggaaaccaaguugaucuaaauucuugggauaauguucucuggcuuuguguaggaggcaaggaauauauuauugcaugaagcaaguucgaacuguuggcucacaccagguggcacugcuuaacccuuugguuguauuccaaccuuguuuugccuguuuuggugauaugcagaggagcacaguaccugauacuguucagugccaaagacagcauagcgcccuauugauacauaagaccaaggggacguuacugcagucgguggcaaacguguuucugaugacagagcaucuaaacagagaauacaugaguuucugugaaggguguggaaauucucuucaggaauguugcuucuucuggugucucuauaaucugacuccugagcugaggacuguggggaaagaggcaguaucuuuugcauauagaucuuauuucaauggaggaacacauaauauuucuggaugggcuacuccuggcucuugcuaaguucacauagucuaguguuuugguaguugggggcucuuguagaauugaagcuuacuguucuuaccuaauguuuucuucacuugccuaaguccauguauuaguuaccuuccuguugcugugauaaaacagugacaaaagucaagcuggggcaaagaguuuaucuugguuuaugguuccagaaggaugaguccacacuauagcaggaggcagggaaggaagcugagagugcucaucucaaccacaagugggaagcugagaaagcaaacaggacacagagcaagacucuaagacugaaagccaacuccuugagacacgcuucuuccagcaaggccauaccacuccccagagagggccacaaaccaggggacauucucauuuaaaucaugacaccccaacaguacgaugaugaaugaagcugugacuucaucaccagauccaugaccaguggcaccagaccaguggcccaguagggaaaaagcauuucucauaugcaacaucaucuuguacgaguugaaaucagaaaccaauuugcacuugaugugcccuucuggcuacucacauuuuauguaugaucauccucucccucauuuuuuuucuuguuuacuuagguugguaaaaugugaaaaaccucuaugugaaacuuaagagaacuuauauaagcaauuaaaaugaaaggguuuugaaaaauaugcuuuuuacuacauguugugagaaaaacuuuccucaauguauuuuaaggucuucuaaugaccuuuggguaaagguucuuauaaauuauacacauggcagaauugucugaggagacacaaaucacgacugggcuaggaggcacguuuguaguaugcacauagacaguuauucauuuggaacugaggugaacuggaccuaauguuccaggguaagguucucuuggucaaguuuucuuccacacaauccuagccuaugaaaagugaauauguauuugaucugagguugauaaaauaaucagaauauuuugggugacuacauauuugaauuugaggacauuaacucaaaggaaaaaaauaaugcuugcuguauccuugccuaacuaaaaaaaauauggugguuuuauuuuuagacagcagguaaguuucaucuaauguuauuauggaauaagagagaggaugcuguaauuggagggguuaaguggaccucaaaauucacaggaaguugcaggaaguccuagucaauugcacaaaggccucuccacuggcucagugcacuccccaccuucuccccuuaguguucuuaagguucgauuuugcuccuagaauccaaagccagaacugugagggauggcauccgaagaucaugugagcaccucugucuccacuucccauuccagugauggacaaagggcgugucuguugugacgucugaagaagucucauguuuaugacugggcuguaugguuuucugucaacuugacaccagcuaaagucaucagagaggagagaacuucaauuaagaaaaugccucuguaagauugagcuguaagcaagccuauaggacauuuucuuaauuagugauggauaggggagagccuuguccauuguggguggggcuaucccuggguaggugguccuggguucuauaggaaaucaggcugagccagccaugggaagcaagucaguaagcagcacucuuccauggccucugcaucagcuccugccucuagguuacugccccgcuugcguuccuguccugacuuccuuugaugauguggaagccuaggccaaauacaaauuuauuuuuauuuccuuuccucuccaaguugcuuugaucaggcuguuggguuacagcaacaguaacccucaaccaagacaaugacuuucuguaaauaaagagaggaagguggaguggaucuagcuuuuugucaagaguucagaagcugaaugggcuuuucccccuuuugaaagcugacucuacuuguugugggaauguuuggagaaucaauggagacacuaaaauauuugcauuuuugugacauguuguacuugauggucaccgccuuuauucuuaagauuuauuuuauuuauauuuguguacgugugugcaugugugcaugugugugugugugugugugugugugugugugugugugugugugugcauguggguauacauggaugcccauggaggucagaagagggcauccgauggagcaggaguuacaucuggucaugagcugcugaaaagggugcuacaaacuugugauugaaugacaacgacccucauaggcucauaggcaauggcacuacuaagagaugugaccuugguguaggaaguguugucacaggggugggcuuugaggagguuucaaaugcucaagccagaccuugugugcucauugucucuuucugcugccugcugaugcagauuuagaacucucagcuccuccagcaccauguuugccugugcacugccaugcuucucaccaugaugauaauagacuaaaccuguaagccagccccaaugaaauguuuccuuuauacgaguugcuauggucacagcgucucuucauaguaauagaaacccuaacuaagacagaacuagauucugcuccuuugggagagcagcaagugcucuaaaccagagccaucuuucuucaagcuccgccuuuaauaauuuagaaucuccuccuucuccuuugaggcugagccucacuguguggaucaggaugaccuugaacuacagagaucugccugcuucagccucccgaguucugggauuaaaugcaugcaucauuuacuggcuagaauguauuuaaaaaaccaaauauaauuaaugaauuauauaucagaugugaggggaauguauuccaggauuuuuucauucuuuuucuuuccucuacccucugguaaacacacaaaguuaaggacaacauaaaaaagcucuuucuuuuaaguuaucaaauuuuacaauucucuuuggcucuuuaguagaaugggagugauucugccaggggaauccuuacugcugauuugggauauaggcuaccaagucaugauuauccauaugaaaacuuugagacaucagaaggagaucucacagaaagacuuagccugcauuugucaauaacugaccugagacuuuauuuaacuuccucuccauuucugguaaaaucauccuguuuaaauauuuugaagugaaauucuccauuuucugucuucaugucuucuggcugugcagagaguucaauaucuaccauauuugguagucaucucuugugaugcuugccagagagcacagcaccuguggugugguuuuauucuaauauaaaugcuuugagcuuuucacugggguuugggaauguuugcaauuggagucccuugaaacuguuggugugucuucugucauuuugcuucacuuacagcugagucguauguccuuguguuucaggaugucuucuucaggcccgugggagagaagcuccaagaagagaggcagcuggugggagaggagacagcucaguucugguggagauggugggagagaggacccaggaagucugcccagugacagcaguuugaggcgaccacaucugcgucacaugucacagaaaggugcuucuagcauucucaucauuauuuauacuuaagcgaaugugauaauaaagauuuugagcaucucagaaac

SEQ ID NO: 3367 - RNA, 1241 nt, Mus musculus
gguuauuuugggauaguuuauaaaaagugaggccacagugcagcaucaaaacagcuggugaccacugcgguguccucugaagcccuagccuggaccauggugcagaugguuucaguacagccacauuggucccuucagugauacgcuauggucuugagcucacaaaccagacuuccagccuucucuuccucauucaggagucucuccaucaguucuuccucugggcaauaugaaaaacagaaaaagaaagcuuaggaucuuaugauaauugugacccaaagaaugaguauuggauaaggcucagagcagaaacuuggccuugaaauguuuucuucuagcagagagaacuugagguccucugggggucccauaaaugucuugauaucuucagaacauggaagagccucugggggagacucagaaugcuaugugcagauacugugcacauacuaaguaucucccucaccugaugcaggagagagagagagagagagagagagagagagagagagagagagagagagagagagacagacuaaggaaccuucuccugccuccaauucuuuccccuuccugucucguggccaucagagucauccugacuuguaaccacauggaaauaauauucacauauucacauguggaaauaacuaaagcaaaggcugaacaacaaaaaucgcaccuaaaaugccuuaauauagacucucccugugcucacuagucugcucucuagccaucagaucccaugcccuucaugccucuggacaacccuacaauuccuaccccagucagagccucuuuccugaccucauguucuacuuuagaacuucagaaaaauauccuuuugcuaugacaccauauuucuugacacuaaagucacugaguuugagaaucuggagaacaaaugucauuguccagaaaguuuggggaagucgaggcucaaauccggucucccacagcaaccguucuuccugcccacuaccuacagcucucggaauucccaggaugcugcuguucucuaccuuggaacacucuccucuuucuacacugaugaaucaucaggauaaugagaaagaggaaaauacagugucccaugaugaaaccgaggacacuggccacaaaaaagauccccggacugggauuugaguggaucccugagaaguacaugcugggaguaugagaaagguaugggcuaccuugcccccugcugguaccaguaggcuaccucggaugugaaguca

SEQ ID NO: 3368 - RNA, 1241 nt, Mus musculus
ugacuucacauccgagguagccuacugguaccagcagggggcaagguagcccauaccuuucucauacucccagcauguacuucucagggauccacucaaaucccaguccggggaucuuuuuuguggccaguguccucgguuucaucaugggacacuguauuuuccucuuucucauuauccugaugauucaucaguguagaaagaggagaguguuccaagguagagaacagcagcauccugggaauuccgagagcuguagguagugggcaggaagaacgguugcugugggagaccggauuugagccucgacuuccccaaacuuucuggacaaugacauuuguucuccagauucucaaacucagugacuuuagugucaagaaauauggugucauagcaaaaggauauuuuucugaaguucuaaaguagaacaugaggucaggaaagaggcucugacugggguaggaauuguaggguuguccagaggcaugaagggcaugggaucugauggcuagagagcagacuagugagcacagggagagucuauauuaaggcauuuuaggugcgauuuuuguuguucagccuuugcuuuaguuauuuccacaugugaauaugugaauauuauuuccaugugguuacaagucaggaugacucugauggccacgagacaggaaggggaaagaauuggaggcaggagaagguuccuuagucugucucucucucucucucucucucucucucucucucucucucucucucucucucucuccugcaucaggugagggagauacuuaguaugugcacaguaucugcacauagcauucugagucucccccagaggcucuuccauguucugaagauaucaagacauuuaugggacccccagaggaccucaaguucucucugcuagaagaaaacauuucaaggccaaguuucugcucugagccuuauccaauacucauucuuugggucacaauuaucauaagauccuaagcuuucuuuuucuguuuuucauauugcccagaggaagaacugauggagagacuccugaaugaggaagagaaggcuggaagucugguuugugagcucaagaccauagcguaucacugaagggaccaauguggcuguacugaaaccaucugcaccaugguccaggcuagggcuucagaggacaccgcaguggucaccagcuguuuugaugcugcacuguggccucacuuuuuauaaacuaucccaaaauaacc

SEQ ID NO: 3369 - RNA, 2661 nt, Mus musculus
uagucauccccagauucagaaauguuccuuucagcaguccauucaaacccugggcccgggaucuucuuuguggcaaguauccuugguuucagccugggaccuugcuuccuccuuuuucuccuucuccugaugaugcaucaaugcagaaagaaaucaaaaugccaagguagcuuuagaaaaacaccaggagccuggauugccaaaagcugugggcagugggugggaggcgccacuuguuugggauacaacgucacuuguucccccaaacucucagacugugugucuuugggauagaaauaucaaggaagcacggugucauuuauaagagcaguaaggucaguggggucacagauucaagaucuaaaguagaugaagauugacugaagauaagacugagcagagaaucuagggauacccauggaccauuaaaggggggggggauugauuaucugagagauucaggggaggaucuauguaaagaugugucagaauagucuucacucaaccuuucucagucacgagugacgugaaugucacccaugguggccaggugaggagcaugagaaagagcagggaacagauggaggcccugcccuccuuggcaugcugguuaaguguaaucaucaccuagggaguucucaugacuccugagucccacuucagaaccuuggcuauuuccacagucugaacauggcggcucguuaugaggcccgggagaugcugcgucuuuauaagaggaaaaaugucaaggcugagauucugcucuggcucucaucucuucuucaccguucauguccgucuuuaagaacauuccuucccuggccgauggccaagcaguguaauggcaauguggagugggaguccuccugugcaguucagagagugaucugcccuugggggcccaugugaggaaagggcauagcuuuguauggaagauaaacugagagaauggggcuuugagaaaccguggucuuagucaucugggagaguucuggccuugggggaccauucugaaagaaauagaaugcuagguugacuauuguaaacucuacguuuucacucugacacuugugugacacccuugugaucccuguccacaacuguucuaaccguuucagauccauguuaagguuuagcuauugugacaauauuucucaaacuuaaaaaaaaaauguuaaaaaacugaaagguagugaauaaugucaaacuauuauuucucugaaacauuggcaugugcugaguguuuuguuuggaguagguaauguaauacaguuuugaauuugguacauuuaacaauuaaccuaggaugcuuucaaguauagacucugggggggggcuauauuugaagggaccacagaguuugcacagccccauaaaguaaauaauacagaauuuucucaaggcuuuuggaauccuaggaacaacucuagcccaucuccuugcuuugcaccuuggacccuugucuccucuuaguggauggaagaccaauggcccagaauacaguuacaaaaaugaaggauauuuuguacauuacagaaaugaggaacugauucuacaguuccuccauagcuucacgccugugcaguggaugaucuggguaugcccaagguugcugucaagggaacggaacuugguggcuaaguagcacccugcuccuggcucgcugcucugcaguggcuguauugaaaauaugaauuguguuugaacaagaggcucuacuaauucuuauuacuaggaagauagcauuugagcuauccagugccaguucuuccuuggaagacaaaauuugaagagguucaucacuuccuguuuuaagcacaauggccuuacccugucaucuguuauuucuagauuauuuuggagaggaugugaaaacauuggaguuugagguucccaguuauaacagucgcgugguuuaugaaaaaaaauauuugggccuaauucaggaugaaagaaaaacaaaaugagaaaugcaacuuaaaaacaucauugauuucgaucugcucagagucugguacucuauaaagucuuaggagugcucugagaagcaugaggucucuugaagcaggcuuugggguggagggugcacuccauagcucuucacagccaaagcaggccuaauuacauacuuuacaggcccccagccaaagaggaaaugugggauuccuugcugcucauuuauugccauucucaagggagaucuggaauauucccuguaacguggggucccuuuaagcauaguuuguguuucuuguuuaaauguauguuuaauguuauauagacacuagccuaguugcuucuuuuugccuugcccacauuuuucaugguucccugagacuaucuggcagcuuggucuuauuaaauagaaugaggcucuaaaauuccuauuucuauuuguuuuucacacugcucagaagaagaagaagaucugggaaacgagaaacuucugcaggaggaagagaagcccuauguucagguugcugaguucagagagucuaggaucucacuggaggagaaauccaugugccuguacugacaagcuauacuacgguccaggcuagaaguucagagacugccauagugguacuaggauaggaccaugacacauuguguuccccuuuuacauaaguucuccaauaauaaacacuuugguccuacuca

SEQ ID NO: 3370 - RNA, 11044 nt, Mus musculus
auccuuccauggcuacccuuuauuacaucuugacgagaaaggcaaaaaggcucagaaacguguugcuuaaauacccucuggugugacgugccuaacuaugacugguugcuccacccacgaucucccaagccccaggguggacuagugacuuuuggcgggcuuuugcuccuagcacaugcgcauauagcuuguucuuuguuuagguggcauaaggcacugaggagccagugccaucuuaugaugguaaauguuauugcggcucuccacacugggccacacaaucaaacuauauugaaaacacaacaaaauaccauaacguugaugggauuacagaaaagagaguuuauucuauacacguucugcaucuuugauuuuuauaugagaaucauagugcuuaucaacaauuggucagauacauuuuuuuuaauacacuauacccuggauucugacccagugaacacuggguucaguuuucgucucccaucucuuucuugauccagucaacauaauucaguaccuugguguagaagccauaucccucaccacacccaaugccccaggauacgaugcccguagccacccaaauaucacgauuucugucccugacugcaaaaacacccccacuguccccuuggcaggcgucuugcuguacagcuggguccccagaacagaacauauuuugagaaaauggagaaguauccuuuuuugucuggagccaucucuggcaugccucacugucagcuacaggcagucugacgaaccugagaucgaaagcuaacuuaucuucuguuaucccgaauccgcugacauaacccaugaggccuuggccauagaaggucucauugucugggagacagauggggaggaguucggggcccagugugacacuguuuuccagcuccaguagagcaaugucuccuucaaaauuguuagguucaucuuggcgguagucuggguguaugaugacccuacggacugggugaugucccaguuuuuugaucuguuccacauuuguguggcccaggaaaacaagcauuuugggguuggcauugucguuuuccuuguugugaugcuugggguagauggugugggcugcugugaggauccagcggucuccaagcagggccccacccccucgcccguggguaguggugaaggccugccaggggaaguugccgggccuggcuggcugcccucugaugaugcgcuccuucugugucacaggguugacagguuucccacacacugcagagagacaagaugagaaccugucagcugcagguuccagccccuucuucccucuuuuguucaucacccccccccaacauucccccucuaccuccucaggacaacccccaccccugccucugcugcagcucuuaacucuccuccccuuccccucccuucccccaauaccucucucucucucccuccuuugucuuccuuuucccauagucccuucuuccacccauucuuggcuaacucucccuguucuuacuaauuccuucugggaauuucucuugacuuuacucucugauuccuuguucaugggagcacuagaccaucaggacuaguuuagauuuucuguaccucucucuuuuuccuggcacacacucucucgcuccuuuuccuuacuccuuaucggguguuucccuuggaguugaagcaucaccuuacuugaucucucucuguagaaugcucccccccuccccccacagacugcaaaugacaucuggcucauccacucuuuaccuggcagacaccggggcauuuucucuccuuccucuucauucuuccaaaugccuugggcugugcagguauauaucccugaggauuaaaagaguuugugucaaggcuggaggugguggaccagaaaagcaggcagcagaggccauuggacacugaagguguuauagagggaguuggagaaaggagacaccauagucaaggaucaaaauuaacugguucaaauguauauggauauauaauguuaaaaagaauccguauauguauuucgucuuauuguugagugaaaaaaaacccagaauacuuagcuauauauauuugagcugaugccuacuuuggaaggaagccuuccgagcuuaccagugacugcaucuugauaggaggauugcagacgauaaugccaugucuuccuuccuguauaacucuuuccaggauuuauuguuaagaacaagcugaccuugaauuuacuauauagcccaagcuggccaugaauucuccaucuucagcuauaguaacccaaaugcugguauucugggagugcaggaccacauccagcaauagcaacaucgucugauugcugucacucugccaucuugguuacugaguguuuuaucugcauuaucucguuuaaauuuggugacacuuucaagcauguauuaaguucauuuuuuaaaaugaggaaacuaagauuaaacccuuccuuccuuccuuccauauuuccaguguugaauauguaacucagggacucucacaugguagauaaguccucagucuugaauuuuucuuuuuguauacuuuaaagagaaauuuuaguuagauguggugguauauaccuguaaucccugggguauagagguaggaagauuagauguuuaaaaucauccucaucuauucagagauuuuugggagagagagaaagagagccagagacagagagagacagagacagagagacagagagagagagugagagacugagacagagagagcgagagacagagagagugagagacagagacagagacagagagagugagagacagggacagagagagugagagagagucagagagagagaggaggggagaacagaauauuaaauacaccaguggggcaugcugggacuauagcucaaugguaagagugcaugcuuugaauucaugagagaggcccuagguccaaucuccaugacuacaguaaacaaccccccacagaugaguuugagaaucauuaaguaaaccugaaugcaaaagaucacagcguggcagccugagauuggggagugucacuguacauguggugguggugauggcggugccguguucuuagugaugguagaauggaugguaacuggagauugccaauguugguggugguaauaucaguaugguggugauguugguguugccuauggcuuugcuguugcugcuguugguaugguaguggcaaucguugguguuggaagugaugauggugaugauguugguauugguagugugucagugguggcuauggugguauugugcugguagggugcuauuggugauuagugcauuguuacuggucguggcaguauugguaauaggugugguggugagagggaaguaguggcuuaagagauucgaaucuuugcuuuccauuggcuuggugcucuuuucuuuaaacuauuaggguuuuauguuguuguuguuguuguuguugucaucguuuugggcauuguaauguugaauccuucauuugggacccaggacuccacugaacaaaugucaaaugucccucagagcugaaaggggaauaaaaaccaugaugggucucaguuccuaccucgcauggacucgcugcugccagcucuggucagcaucuuguaauaugguucauggcagugauacuggauacuggcuucauagguggucacgccuuuuguggugauguagcggaaguccccauuagacaggcuuuggggcugcccacaguucuugacuuagagagaacacaggguuguaaggaaguggaggacaccugugcaagacuucagucgggcaauugggggucucagggaccucagagaaguauggucaguagggugcacacuugcacuagauagaguaaaauucaguucuggcagagcccaucaggucugagaugaggccuaaacaguuucuaaggaacaagucaggaggcaggacccuuggagaugaggggucuuucucccucccagcucaagucucaagauuaagggaugugacuuacucauccaguuugugacuuacucuugcaccugggcauggcacgaugccaugugccaucauucuggcaaacagcugugaaggagaguagcgccugauuucccuguuuaagccgaaguuagacaugcagucagcacucaggccccccacuuccaagguguacaacgacugugggaaugugaugggcgcuguguccaucucuuagaccucagcucccucacagaugugccuccuccucccuccuccccauucucccuagcuagugcucucaauucagggcugcagaugggaugccaaguuucaaagcagaaacacacagcaagguuuuaacuuuguuuuuagacccuugccuguuuccacuagacccccaacucccucccaaaguguaauaaagacaagucaggauuguacuuuuguaucaaaacaaagaccauuuucuagagcaaacccaggcuuuugccuauuccugaaacguucuaccagccaaggucuccaucacacuuccucccacauugcaguuuucuuaaagcccagggcuuuccuuaaacuacuagugcuaccugacugcuuucauagggguuuaacacggugacaugucaggugaguggucaguuagcacaaggucaaagaguggcugguacucacuugauaauauuggaaaauauuauuuuuuugagacaaggcuuuguuauauagccuaggcuguccuagauuagcuauguagcccaggcuggccucaaauucaugauuuuucucucaugaguuuccucuugaguuacagguguaggugccacugccccugguuauaaauaacuuauuaagaacaaccaucagaugggucuaagggcacuuguaaucccagcacucaggagguagaggcaggaggauaaagaguuuaaaucuagccugggcuauacagugacacugaucaucaccaaccuaccagccaaccaucccuucucucugucuauuuaacuccucucucuugcucucucucucucucucucucucucucucucucucucucucugucucucuuuuucuuuuuuugagacaggguuuuucuguguagcacuggcuguucuagaauucucucuguagaccagucuggccuaugaauucacagugaucuuccugacucuacuggcucuguguccuuaggagcuaggauuaaagucaugagccaccaccacccagcagagacaucagguucuuaaaacaaaacaaaacaaaacaaaacaaaacaaacaaacaaacaaacaaaaaaugaacucucugagcguuuccuguaugcagaccagacaaaguagauucuuuuuguucuucuuuccugucuguaccuggccuuaaaccuaggaccaccagcauccuuugcaagcccuuuccuucuuagcuauauccucagcccuuuuuucacuuuugaauuugagaugagaucucaccgagucaccccgguuggccuugaacuugcucuauagccugaguggaccuugaucuucagucccuuugauguuuauucagaucugagggcagacagauugauucuuccagccccaaccuccauggcuccauuugagaucuagccaucucuuccuccugggacacccagaggauuugucccaugagccuuggccucuuaccuccaugagcugguagccuugcuugcaggugacaaugaaguaaucccggaacugguacugaggcugcggauccuggaugauggugaacucauccagagccuugggcugggggcacuugauggcugauggugagggcaugcgcuugucagagccauugguccccuccuguuugccuuauuacuggcaggcgagggaggcaccuacauaucuuauuuuaguuuagggggccuagagacaauaccccaggucucauccauguucaacacaaguuucccaggaagccaugcuccacccuaacccucucacuuucagugguguagugcagcuuccagccucggcuguccccugacucaucugugaagaacagcagauccacugcauugcugcuggugucaaggucuggaggccuuugcuuuccacagaauucacccaaguucuucccauuagcguagaucugaugggaaaaggggaggagaucaugguuaguucucuucuuuuuacacaaguccccuuggguggacaaggguagagaagcuacucuagaccucuaugauccuggugaacaaugugucccugucccacucaguccaaggucccaggaaggagcagggaccuggggagccacucgaguaauagaaagaaaguuugaagucuagcucuaccuggagcuggucauaggggcagugcacuugcugguggucaucaauuucaaaaggauccaggaacuugaggugcacagugaggccccucuccacccggaugcuguaguugcagcguagauccgguggauagggcugaggguauucaaggcuggagacauagccugagggcucuguguagagcucacugcugcacucagcuauaaaugcagaaucagaggggcuguuaggguguuaggcuggcccagcaagccucugcucugccuuugccuucccacccuucccacucagccucacccuggcaggauugcccaucuuucugaagcucauagccaggauggcaggaacagaaguagccuccaacauaguugugacacagauguuggcaucggggcugcaaacccucuuccacugaguugggcugcgaugcacauucaucaaggucuggaagggauuccagaaggaaggguuacaucccucuccacagaauucuggggcgaggugugcuacuguugugcuaucucuuccuauguucagaauauuuugugcggguuuuuuuuuccccucaaagagucauguacuagaagccuggagacaaaguccacuucuggccccuuugccucucuauguucucugggagcugcuuggugguagaagagcccagauggucagaccccaucuugaggagagaaauaaggaaagcuaggcuucuggcuucuuugggcucuguugagguuuggucuguugcuuuguguugcaaugcuaaauacugguccccgaggucugguuguccuuagggguaagagaauccucacauccaccaagugauacugugugacuugcucuuuaauuuagaacuguugguugaguaaagauacuggcaaccuauagcuggccagaagagagguagguaaaguuuugguuccugggcuugggguccaaggagguccacgauggacaagauagaagguggagagaagaggagagcaaucaugagaauugcccaugagagcugcccagucugaguaagagcuaucuggauggaauacagccaaucauaucucaggguuguuaacagggagguagauguaagagcauagagaguugauaucugcccagcucuaucacugaugaaggcuuauuauaaauauaaaaguuuuaucugggaacugaaugaucaaaggguagaaauccccgauggagauuaagaaauuacuacaacagggcucaaacaugccccagccccacucccauggcugaggccagagugaagggcuggcuguggggagcacucaccuacagccugguaguaggccaggaagcccuuguagaacaugauggucccauucuccucauuggagaagucuguguggaaggucagcagcaucuuguuuccuugggacaugaauuccuugcuuccugggggguugcccaggggagaauccagcugcccacagaaccuccccaguguuugcuuaucagcagaaaucuguuggagggaggacaauggagagaagcccugcuaaggagucuggucccguguggcagccagagagacccuccuuggauugaauccugaucuaauguuacuaucugucagaucuggcugcugugcacacccucaagugaugcuuauggguccaucucugucuuucauuaaguuuguuuucuuaaguuaggauaucacaauguagccuaggcuugccuugauggcauuaauuaaggccucugucucugucuaugucgaggggcauguuacaggggaauacauggggagcccagaggaugacuugcaaaagucaggucuuucccuccaucauggacauccuugggauugaacuuagguugaagacuuggaggcaagggccuuuacccacugacccaucuugccagcucuggacugggauugagccuguaguucuucugccuucgucccaauucuuguuuuuuuuuuuuuuccauuuuuuauuagguauuuagcucauuuacauuuccaaugcuauacaaaaagucccccauacccacccacccccacuccccuacccacccacucccccuuuuuggcccuggcguuccccuguacuggggcauauaaaguuuucguguccaaugggccucucuuaccagugauggccgacuaggccaucuuuugauacauaugcagcuagagucaagagcuccgggguacugguuaguucauaauguuguuccaccuauaggguugcagacaccuuuagcuccuugggugcuuucucuagcuccuccauugggaucccugugauccauccauuagcugacugugagcauccacuucuguguuugcuaggccccggcauagucucacaagagacagcuacaucuugguccuuucgauaaaaucuugcuaguguaugcaauggugucagcguuuggaagcugauuaugggguggaucccuggauauggcagucucuacaugguccauccuuucgucucagcuccaaacuuugucucuguaacuccuuccaccaauucuuguuuuaaaagccgcacucaacucagccuccugauagacccagcugaacaugauaguacaaaugguacccagaggucuccucacuggccagcaucaccuagugucuucccugcuuugucucacagauuccuuacuuuguccaaagcagacgacguucuccuugcuagcuuugccgugggaugcaccccucccucaacgcugcagacuuguugaguccccuuuguuggggaaguguggaguuuucucguuauuuucuuagucuccuggcuguugccugagccucauagugcgaggaagagcauaggcucugcuugaauccugccuuuuauuuuuacuggauguagaaagaugaggcuaagaaagaaacccuuugaaggguacauacaggggugaccaagguccuugucuucccugaaggacaugugacaccuuucauauguuucuuuucuucuuguuuuggaugcaguagguuaccauucagggaaacugaggcauggcuguuucucaaggccuuaugguuagcuguguccuaacuccaauacauagugaaaucuacuggaacaaacacccccaugccugccccuuuuccucaugaaucucacugaaggccucaaaaguccauggauacccccucuauggcaccagcgacccaaggccaacauuucuacagagcuguacagugauggggugcaggcauauuguccagaguauucagagcacaaacuuccaguuuuguuuccccucccucccacucugacgccuaccuuaacauagucauagaagcagccuucagaaggcuccacgucaaacugccagaagaccagcuucacccuguaccccauggggacagugaucacagugguugucuccaagucacugggguaaggcuugggauacagaggggaggucaccucuccauagagcuucugagggagguaaauggagccuuccaccccauagaacagggucaccaggagggcaaagagccaccugucaaagagagaggcgaguguuuguggggcuggaggaucaaggguguuguguagcacccuugcuauuugaacugccuuaggcaggaauaggaugacuaaacugccugguucuucccccaugcccauuguagacuucauagugguucugugauugggggcaucagcagccucugcaucugcugcagcugaguuucucguaggucagugcccaguccaggggucacuggacucuaucacacuccccacccccagccucugaacugccuucucugcccuucucuuuugccuccuuuucuuccuggaguagaagcuaucugagggugaaguuuuccagugauggcucugcaaaguuucccaaggcuucagcaaagaccccugggagaaacccuucaucaugucugagaaacacagguggggucugagaaacacacgugugugugugggggggggagagaaacacacguggggucugagaaacacacguguguggggggggagagagaaacacauguggggucugagaaauacacguggggggguucucuccucucucagagaguucccuccccucacuguuacccugcuaugaacccagagucaagaaaggagaggcuagcucagcucaugucuaagggucuggacccugggaggagggcugaggagugacccugagaaguaugugcucuggagcuggcaguaugggaagaaggauauuguauuccucuucuuauuccccuuccauuuucuuuccguauucuuuuuuuuuuuucuuuaaaguaauaugggcgcauguuugcuuccuaugcccaacuccucuuuccucccuugauacccaucagucuuacucacaugucucaaggccaguuuguuuuggguccucagcucuccugacagagucuucaggcacuguaaguugaaggagggaguaggcauacaggggagggaaggauuguggcaguggagggggugaccauucccggaggaauguuucagggaaugaagcauuugcauaaacagcaaaaaaaaucugaguucccaguuuaguuuugguuuugaaauccucguugcuugcuggugccaucuggugguccauuuggggaauggcugaggcgaugggaucugaaguuuuagggaccuggaaacauuugguuuggagggccagacucuggggucucuaaaucggauuaacauuuucugggagacuuuccuggggcugcuaguugcccuuuauuccaggauccucgcca

SEQ ID NO: 3371 - RNA, 12018 nt, Mus musculus
caaaggccacucccucuggagcugcaggggcuuaacugcaugaccagaggcaggagaggaggcuggcccacuuguucccaucagcuccugaagguaacaacuuuaagagcaagccuuaaagagagaagcuuugaugaaggaagagggaaagacaaggaaccauguacaguaagguuuggagcaaagauggaggguuggaaggagcucagcgagaggucagaauacagacacggguucucacauguaggacccagccccaccccacaacagccucauccuuucacacagcaguguuucaggggucagaggcaauuugugaaagacuuuucugggaacuaugggaagauaccuugcucuuuaagcaaaggacaaaacaaaccaacucgagaaaaguaagggaaagcauaucugaauguccugacuuuucucagcuuucccuuuuccagcacucugcauccuaucaccacacggccggccauacuuucuuucugauuagcgucucccaaggucccuuccugucccuacugaaggaaacacuuuccuccuucaguggccauugggccaccagcagaagcaacaccuguaauagcuugucaaagggggcaggcuugaaugggagaggaucugucuggaagcuccagccuguuuggaaaugcagagaccgaugcaaggggccaggaguggguggaggaggacacaaaagacagggagaaacuccucacucaauuguaggaauauuggaagauguuuggggacaggguuaauugagggcuggucugggaaguuagucuaaaucucacuggggagggugucaugguaucaugugaugaccauuccugacagguaccuauuucuaugguauucuuucaaaggugacacugagcccuggguggucccucacuaccaaagcaagcaccuguauuugucagauaaagacagccaggacugcugacugcccuuuaccuccaaaaucagagagccagagagccagagagccagagagccaugggcaaaucgccagggaugugguaagugaucagguaucuacagaaaugacuccaucucuaccuuuuuucucucuuucacaguuuugggacagugugucacuaugcagcccaagcuggcguaacaucacccuuccucuguccccagagugcuggacuuagacacaggccuguuguaugugauuucccauuucucuagaaagagcucagauaugaaccuugacuuuuaauuauuuauuuauuuauucuguauauauuuguuuauuccaugacauguuggcugccuaacggucagaguucugcaugaagccaucgguucccggcuucccaccucugugugacuuuuuuuuccucuuccagguguuugguccuguuuucucuuuuggcaucauuuucugcugagcccaccaugcauggggagauccuguccccuaauuauccccaggcguaccccaaugacgucgugaaaucuugggacauugaagucccagagggguuugggauucaccuuuacuuuacccauguggacauagagccgucagagagcugugcauacgacucagugcagguauauuacagcacaggagggagagggaugggaggagcgggggggggauggaggaaugagaggauuuagggggcuguguguugucaagccguccuaugggguaggggcauggcucaauggcaggguacuugccaugcaaggacaugucccugaguuugguccccagcacugggggaacaugaggugggggugggggagacagaccggacagacagacggagcuggagaucgggaguaaagguucugcucucuuugcccauucucaguuuuacauuuccuucuucucuuagauaaucucaggagacaucgaggaagggagacucuguggccagaggaccagcaagagccccaacucccccauuauagaagaguuucaguucccauacaauaaacuucagguggucuuuaccucagacuucuccaacgaagaacgguuuacgggcuuugcagcauacuacacugccauagguaaggcauccgucuguacgugacaucuggaucaaacuaaaagaugggaggcagguaaaggaccacgcagugcaugaaaugaggauucuguuuucucucuuugagucauagucuggcuaugcagccauggguggacacuccaagacuccagcuuugugccacugcccccgggcugcuuacaucuuuaaugaauguugacuugcccugggucugcuuaggaauugccuugccuuugugugacuuuaucgcauguuaguggugguaaagcagauaaugagacugagaaccacugagaaaugguucucuaucaggaggcuugcuuacaugaaugcaaccuucaccucaauucugcaguguggucggcauggucuuccuauaaagauacggaucuggucucaguggugcaggacuguaaucccauacacucugaaggcugaagcagaagaacugucaacucuaggucaacaggggcaacuuaguaagaaccugucuuccuaucagaaguaaagagaacgcuguugagacaguucagucagugaaaugguugcuauacaaccacccauuagaguucagguuccaugagaagguagaaggaauaacgaacgcuauacgcuuguccuuugaccuucauaugucugcccuggcaugccucugucaugcacauaaacgggcauggauaguaauaagaaaugcuaauuuaaucccaucacucaggaagcagaggcaggcauaucucugugaauuugaggcuagccuggucucuagagugaguucugguacagccagggguauauaaauagagauccuguuucaaagaaaaaaaaauuaaaaggagggcugggaauucugucauggugcacacaccuguaauuccaguccuaagcagaggcaggagaaucaggaauucaagggcagccuggguuacagaagacucuguauuaaaagauaaucacuccagcuuagugaaugaaugcuuccuuugugucugaaaggaucucagaaaccucaagacuagggaaaaacugaaaacugagaacauuaauacuuugccaaggaauguauaagcaggacuaugugguacuagguccuucuacauccaucuccagguuaaaaugaaguuaggccugcucguaaguccaaaugucaucaguuuuacagaaagaccaacauccuauaaaguagguccuaaccuuucuccccaggugacgucaccaccgucuuuccuuucagcggugucucuggcacagauucuuuucuuuuccagacagagugucucuauguagcccaggcuggccuugaacuccugauucucuugcuucagucuucugaaugcuggaguuacagcauguaccaauugggcaggguguuguauaguuuguacgcaagaaaagucauaggguuuucaugguggagcuccuuacagcgccguggcaaaacacagcucugagucagacuucagaaaaguaguuuagauuguauucguagauuuuaaaauauggggcuggaaagagaugacccagcaguucagggaacuugcuguguucauagaggaccagaguucaguucccagcauccacauggcagcucacaacuguugguaacuccaaaacaagagcaucuuauacucuuuucugaucucaaagugcaccagaccugcauguaguauaaaauaucaauacaauaaauacauccauaaauauugaaaaacuaaaguguguuaagauuuauuuuauuauuuuaaaucuuuuauuuaucucauguguguagguguuuugcuugcuagcaaguaugugcaucacauacauaggguaucugaggaguccaccagaaggcauugggucccuggaacugcacuggaauuauagcguugugagcugccuugugggugcugggaauugaaccucuggaaugauagcacauacucuuaaccagugagccauaucucuaccccuccaaacuucuuuuauuaaaaugucuuaccuguacauaauaaugguuucauuaugacauguucauacucaucuauguuuuuguccaaguggcccucaguacauugucuccuccuaauccccccucucuucuguguuuugcuuuucaguccuuuuuauuuuuucauuaggauuguguaagagcuugucuagggguuacuuauagguacaucggcaccuuaccaguggcugcaugcuaaagaugucucucuuccugcaguaauaaauuaguugccuauagcgccucggggugggguggaguccuccugaguccuuccccaugccaugacaggauaucgccaggcacagucuuguucagauaauaacagccguggugaccuaagagugucguggccuaucacgccuggaagacagcaucccgcaaaacuuccgucuguuccucuggcuccuacauucuuuugugcaugucccccucuuucaugauguucuuggggccuuagagucuuccuuccuuccuccuuugcugucuccuacucuuccucucucccuuccuccuucacuucuuccuuccuuccagcugucccucugucucuuacucucugucuugucugucucugacucugucugucucucuuccuuucuuucuuggagaaaagguuuugcguugaagcccaggcuggcuuugaacucaugucuuucuguuucaccuaccugaauacugggauuacuggcaugagccauuauaccuggcuuggagaguauuuaagcaacaaaccuuuucugguuuaguuuguuuguuugugcuuuauccuuauagauuuggcuuccaucguucuuccuucuuggucuuuguucuucaccuugaguuuucucugcuuuuugcagacauaaaugaaugcacagauuuuacagauguccccuguagccacuucugcaauaacuucauugguggauacuucugcuccugucccccagaauacuuccuccacgaugacaugaggaauuguggaggugaguuuagccuccagaggucuucauguucccugggauuugggauggauugagggcuuagucuaucguuccaaguuugauuaggcuuucccuccaaauugcaccugcuguuagcuguucacaaacugaauaggauccucaggagggggaagauaagguccaucaccuuuacauugcugugaacggugacuucaacaguuauaaggauacaauguuuauuuugguucaugguguagagugggcagauccauuguuuuggggucagugaccagguggaucaucacgaaagggagucagaugguagagcaaaguugcucaucacagggcagcagggaggcagagagggagggcagagguacaaauguccuuuucaggucauaguuccaugaccuuacuuccagcuaacaggcuagaugaagauuccaccacccaccuaacagugucacaggccagugaccaagcccuuagcauaugucacuuuuggagaugauuaagacccaaagcacaacaggaggcuucgagguaaaguugguuuauuggaaaagagggauagaugccugugaagagacugcccgaguuuguucacaacuauggaaaguuccacauggaaacuuucauauauaaccacagcaaacagagagaccaugcaaaggcauuggcuagcuugccucauagcauuguggguaauugcuucauggaggcuucuuuugagaacagaugguaggcuagucugaauggagaacucugagguuaugagguaaggaacagagagggcggggacuucuugucucuguaucugauugguccuuucccauuuucucuccucuagucaacuguaguggagauguguucacugcccugauuggggagaucucaagucccaauuaucccaauccauacccggagaacucaaggugugaauaccagauucagcugcaggagggcuuccaagugguggugacgaugcagagagaagauuuugauguggagcccgcugacucagaggggaacugcccugacaguuuaacugugcguuguagauaaugagcuugguucugacccccaacucauuuagauugcugaggcuucucuggcagccgcauucucugugguucugggcaaacacuccacugcauagcuacagccguugcucagagacuaguuuuacuuuuugauucucucugucucuuuccucucuuucucuggcucucucugucuacaucuuuauccugguguuuccuuaagccagggcuuugcuauguagcccaggcuggacucaaaacucaaaaugcccucucuucacagccucuugagugcuaggauuacagaugucaguuuccacuccuggugagagcauccuccuuccuccuuuaaucucccucuccucucucucccucccucccucccucccuccaugccuuuauuucuuccuuccugcacuggggauugaaccuuuggccccaagcaugauagguaagagcuauaccacugagcuacuuuugcagcccuuucuauuuuuguauuucagcacaauguuuccuugaauugcccaagcugacuuuaauuuguaauccuccugucucggucuuccaaguagcugugauuaaaggccuacacuaacagacccauuguuuguaauuacagugaucuuuccuccuccacuuucucucucucucucucucucucucucucucucucucucucucucucucucucucucucucucucucucucugucucucuccucuuccuuucucccuucccuucccuucccuucccuucccuucccuucccuucccuucccuucccuucccuucccuucccuucccuucccuucccuucccuuccuucucucucucucucucucucucucucucucuguuccacuaaggacacucucacuucauaccacaucguuuaauuauuuccuauacauuuuucucucuuguguuuuguaacauuguuuccuuccaguuugcuucaaaaaaccaacaguuugguccuuacugugguaauggguucccuggaccgcuaacuauuagaacccagagcaauacucucggcauugucuuucaaacugaccuaauggggcaaaagaaggguuggaagcuucguuaccauggagaucgugaguacccuaaaaacuccucuuugacuggggauacaacauuauuuggacauguagacuaaaaacacagagacuguucuucagcuaauauuuuuuuaacuagucucaaaaauacagacaagggggaggaggggcagccaauguguggcaucauauccuuuuacaaguuggaauguuagacauuagaacugaggacaaugggaaacuuuggaacguuugugggaacagggauagugugcuaggcaugaggaucugaguuuguauuuauagcaaaaaucuagccauagccaaguauguuuguaacuccuaugucuuggagugaugggcagagaaagggacaccacggggucuuggggucagcuagccugggcaaacauggcaagcuccagguauagugagauauccucucucaagaggguaagguacagagugacagagcaggcacccaguguccuucuucagccuguggguugguacacuagccccccugccccauacacagaaaaugugagaaugucugaagaugcuauuacacagauauaauuccaguccuggagaaguggaggcaggagaauuacugcaagauagacuagcuugggcaaaccccaaucuauccuaugguacacagagagauccugucucaaaacggggguggugguggugguggugguggugguggugguggugguggugggaaugaugcaaaauagcacacgguuuccagcuauuuaguaaaaucucauuucuguugucuccaagccaucuccugugccaaaaaaaucacugccaauucuacuuggcagcccgauaaggcaaaauacguguuuaaagauguggugaagauaaccuguguggacggauuugaaguuguggagguaaaguaccacacaggcaucuuuuuaaccucaggcuuggaucaguauuguagcacaagagguugucgcugccugaucaagguauuaaccccucccaaggaugggccgaaucaagguugucagucguuccugugaggucuggaucucuugguccagcuugcccucucugcccucagucuucccguggacggggagcugaaaugccgggacagaguugucuucucaucgcagcuccuggguacauuggguuacucuucuaaagauguuccaaguaucuuuugaaaaggacuugucauugauccaagaccagagauucaauuucauuauuggauuugguuuucuguaugcuuauuaaauuaauguugauauuuguuuuccuccagggacauguuagcucuacuucauacuauuccacuugucaaagcgauggacaguggagcaacuccggucuaaaaugucaacguaggugucucuucaaagcagaauuccucuuuccccucccaagguggauggaauaaucaacacaucaaaauucaaaugcaugguuucccuccaggcucucaagaaaaugacuugcauuuuugaaggagucugucauagagaauugucuagcccucuccuagucuuaggccaauuagacuaccauguuucgucuaaagaaacgggcaaugggaucuguuaucaauagcucuaugggaguacauuccaggcuugcacaggaggcuccuaccaaccagagaacuauguuccuccuggucucuuucaagagccaucugcauuggcagcucucagagggcuagagaauuguguuagagaaggugcugcaagaaggcuggcuuugagagauucaucaaggggugauuauggguguggcuaugggaggggugaagauggaaugggucccuaacucuuucugggagggagugacugucuauuuccccaauucuucuuguagcuguguauuguggaauuccagaucccauugcgaaugguaaaguugaagagccagagaauaguguguuugguacuguuguucacuacacgugugaagagccauauuacuacauggaacaugaagaaggugguagguucuucuaccagagaagagagagggaaggagugugggugauuuggaggugguuacugcuuuuucucucugguuggagagacagagaagauauugucauccuuuuggcuuagucuaaggacacaguugucuugugggaugggguuuguacucaggaucauucaggaugucauagaagccaccagcuuagugucagcgugcaacaggaguuccuuaauagcacugauuucauguaguuaucugacuccauagcaguuauuucagauaaaauccacaggaggacaggcauggugguggagguuuguaauccuagcccuugaaagauaggguaggaauuguugaaggugagccugagcuaucccccuuuucuucuucuucccccauccucuccuccucaucucucucuagucuuuuugagauggauucacaggguuuaaggcggccuuuucuauguagcagaggcuggccuggaucuuucugcaucuaccugcuaaguguugggcuuacauagcagugccaucauucccagcugaagguucuuuucuagcucauuugaucugcuuaccuguucaauguccaaaggggcuggagcuuugaauaaagggggaaggaggagagaugugcggaaugugauauguuccuuguauuauucuaggggaguaucgaugugcugcaaaugggagauggguaaaugaccagcuggguauugagcuuccaagauguauuccagguaaucugggcugugguguggguagaaacuguagcuauacacgcagggaguaagcauugcaugaaauuagcuguuacccucccggaaagggcuuagcccugucuccgggagcucagcacagugaagugauaggaacucuggacugggaaauuccuucaauggcaucaacuuaggucaacuugaagggaaauagaaaagacugccgucaucaacaguugcugucacaucagucacuagggaagugcagaucaaaccaugcuaagagagcuggguguacacuuguaauccuagcacucuggauucugagaaaggauugugaguugugagaccaaucuggacuacauagugagaccccacaacccugcaccacacacacacuagauaaggacuucaucugaguagcaguugaaggcagaaagccugcugcuguuaccuguguccagugaagagucucucagcauuggaucuaguuggguuuuuggccuuagagguuaagcaugaauuaugccucagaagggcugugggucaagcagugaacugugaaauacuagcucauuuagauuuagucauucauuuaacccuccuguugagccaguauccuccauaaaucugcuuggcauuggcaaaggggguguuuuggugagaggaggaaaagucagauguggagguaguugacuaauauugauuaagacaugcugaagaacucugccacccauuggguagaacauuugagaggcugaacuuuucagaggucaucaucauuugaugcaucucucuauuugguucuuauuccuuccuagccuguggaguacccaccgagcccuuucaagugcaucagaggauauuuggaggacaaccugcaaagauugaaaauuuucccuggcaagucuucuuuaaucaccccagagcuaguggggcucuuauuaaugaguacugggugcugacggcugcucacguuuuggagaaaaucuccgacccuuuaauguaugucgggaccaugucugugaggacaacucucuuggaaaaugcccagagacucuacaguaaacgugucuuuauucaucccagcuggaagaaagaagaugacccaaacacacggacaaauuuugacaaugacauugcccuggugcagcugaaagacccugugaaaaugggacccaaagucucccccaucugccuaccaggcaccuccucagaguacaacgucucaccgggugacauggggcugaucucaggguggggcaguacagaaaagaaagucuuuguuaucaaccucagaggggcaaagguaccaguaaccucuuuagaaaccugcaaacaggugaaagaggagaaccccacuguaaggccugaggacuauguuuucacugacaacaugaucugugcuggcgagaaagguguugacagcugucacggggacagcggcggggcuuuugcuuuccagguccccaaugucacgguccccaaauucuauguagcuggcuuggugucuugggggaaaaggugugggacuuauggggucuacacaaagguaaagaauuacguggacuggauccugaaaacuaugcaggagaauagugggcccaggaaggacuaauccguagggcgacaacuccccucaagggcauagcaagcucacuguucucagauccuauggugguccccuuauuucacaacgauggagagaagaugugggaguaugguuaaugcugaacuugauugucaaagagucugcauggaggcaggguugaucacugagccguguugguuauucaguuacuauugcuaacaacauggcagaaacccuucuaucuugcgcuauuccacagggauaucuuauccgaucuucccucauuuaaccugcuugaaauuccugaauaauuuacagcaaagcaugcuuccaaccugguucuggcuguauggagagccacgaagggagagagggagauuugggggcauagcaucauggaauucaggcaucaacagcauggaacucugcaucucuaacaagaugcagacagggaacacagccuuuuauucuuucuagugagacuuaccgaauacucagaaguuagaaaugacuaccuuaguuuuucucugugaguugcuucaauauauuuccuagaaauuaauuuucuuguaauccuccuuuguaucauacaguguaaugacuuaguaaaauagaaauugaacauugc

SEQ ID NO: 3372 - RNA, 45389 nt, Mus musculus
cgcucggccccgcccccggcuggcucgaccaauaaucgggugggucuagaggcucugggcgggcccgcagccaaugcgcacgccgugggcgggcccccggccggaauugggggugaagccaccgcguucugcccacauucggggcgcggagcuggggguccccggggggcgcccgcaguuaagauggcgucuacagcggacggggacaugggagagacgcuggagcagaugcgggggcuguggccgggugucgaggaucugagccuuaacaaguuggcgacgucucugggcgcgucggaacaggcgcugcggcucaucuucuccaucuuccuggguaaggacccuccugccugccucugcccccucguggagucccaaggaaaugggcagaauggggucuggggacaggaccugucugucugccccgaaccugggacccaggagggcuugggggugcgggucaucaagcacaccagccagcuaucgaagggaagacaagucuggucucaagucugggggcccguacccucugaaccucuucccauuuucuuuggcccauacugugcccuuuggcuccucagucaccucccgccuugucaucgauaugccggacugugcccuugcgaccuaugucugucuguggcucucaagaguucgacuguggccaugaguacuacuuauuuguuauuaacagcucccaucaugcgcucuccuuacgagaggcauaggcccucgaacuuaagauauuuuagcccuacgggccuccucugcccgauuauuucauacuaugucuucucggucuauuuuguguauugccaacguauaguguacuuucaucucuuuucuguccacuuucuaguauuuucuuguaccauauugcuuucccccuuagccgcccaccugucauuuacucuggaauacauucuuacacugggcuugggaaacagcacuauuaacaaccuuaaaaacuccaugcuuguuccaagggacuauuauucauaugguucaaaggaugugauguaccugaauuuaugucgcaacaagcuguguuauauauuauauauauauuuuauagucuuuuaaaaaccgcacucuucgagguuuuuuaauacaugagguaacgugguaugauggaaaaaguguggacuuugaaguuaaaggagucccacucuuuaccguuugugaguagcaaccacucuugucgcuacucacaaacgguaagaccccccaggcaagccauuuaacugcuccgcaucuaauucucuuaugagaugaagacagccgugcuuagcauuggaucgcuguaaaguccgguaagaauucuuaggucaagaucagugaucagagacucgauucaguagguuuuuaaguccuuggaacuuuuggggaaggcugcauaacuuuaaccugagagaggcguaaguagaggguuaacuguaggaaguuugagauaaauuggguguggugacuuaugccuuugcggcucagugcccugggacuaaggcaagagaacugugaguuugagccugggcuaaugguuugagacccuauuuuuaaaaaggggggggggaggacuggagagauggcucagcagguaagagcacugacuacucuucugaagguccugaguucaaauuccagcaaccacaugguggcucacaaucaucugugaugagaucugacacccucuucuggagcguacuuacauauaauaaauaaauaaauaaauaaauaaauaaauaaauaaauaaauaaauggaaaaaguuugagacaauugggcugagaagaauaaauaaaagaaaaaaaaaguuggagacaauugggcugggaagaguuuaaauucgagaaagaaauguggaaguuauccuggagucagcugagacauggacacauaaucaccagaggguguggauccaaucuacaggaugacuggaacuuuaauccauacugaaacaaccuuggcuaaaaccauuguuauuucauaucauaccaaggugaucuuccuuugcucugauaaaaguuuugcucuuccuuggugggauccuaagauuuuagagguggagggaccuuagguuccguggcuggcucaauacagugucacucaaacaucacccaaauuuaucagcaucccacaucucuggcuuuauguaccaccgcagcuuugagcuugcaacucuuugaaccuugcuucugacccaguuuguuggcguuggcguugggguuggcaauuaagaacgcuugcuguucauuagguaggagguuucacaucuguguacuggaagucuaagacgggaagcagugcaucgucaggucggccuguuaaguggaaguaagguuggaauuaggacuuggaauugucuuuugcgugcugacaucaaauaccgccuggcacugcugcuaugcgaugucacaaaaguaagccugacgaggaaaucaucuuccccaugucccacccccccccuccuuuccucuucugccauggcgacacauaaucagaguaauaaguacauggaacaacagucccuuuuccaagccuucuggccuguccauacuaucauucccauggccaccuucuccaucacacauaugcuguuuccucugguccuuuguaggauuucucauuuucaaaucaauucugggcuccucuucuuccuccuccuccuccuccucgucauccuccuccuccuccuccuccuucucuuucuccuuccaguacuggaguuaaacucaggaccuaccucaugcuaggcaagcccuggaccacugaacugcauuccaacacaauuauguguaggaugccguuucugggcauggguuaaauauauacauguaaauacaaacgcauacaguuggccugacuuggaaaguauguuuugcugguaaauacauuuuccuugaagugguauuagccuguguaacuccagcccuugggaguggaggcaggggcagcaugagugucauccuuuccuacacagcacaugugagaccaaccuggacugcccaguaccugccucgaagaaccaaagaaaaacaaacaaaauuagggcuagagagguaacucagagguuaaaagugcuuccagaggaugcagguucaguccccagcauccacaucaugaggcucacaacugccuguaaccccagguuuagggguucuggcacaucuggccucuguaagcacaugcucucaccuacacaaacccacacacaaguacacagaaauuuuuauuuuguuuuauuuuauuuuguuuugauuuugcgagacaggguuucucuguguagcccuggcuguccuggaacucacucuguagaccaggcuguccuggaacucagaaauccaccugccucugccuccgaggugcugggauuaaaggugugcgccaccacugcccuacauacaaguacacagaauuaaaaauaauaaaagauaaaucuuaaagaaaucaguggugcugcccuggggugguggccguacacaccuuaaaccccagcacucaggcagaggcagggggagcucggaguuugaggccguccuggucuccagugugaguucugggacugccaaggcuacacugagaaacccugugucacaagaccaaaaacaaaagaagagaaaacagugauaagguacugggaacugaacucuagccugguuuuccgcuuucucuccuuaaacucuguggguugaagaguauuaaaacacuggcuuucugaucuccuugcuaaagaccuacgauaagaggucuuuccauacuguauacuuuccauaguguauaaauguauuagaaacacguuuaggaaaacaacauuggcccuugcuguguuauuuuucauaccauuuauguccucuacauugaacucaugaccuauuaaugaguuacagaaagcaaucuggaaagucaaaggauaauucagagauuaucauuugagagaggaagguagggagaguugggugaaccaggguuucacacaugaagcaagcacccugucacagggucuuacuguguagcccuggcugcccugagacucguuugauagaccagacaggccccaaacucacugagaucugccugugucugauacccagugcugggauuuaaagugugugccaccaccacccagcucaccaucuuuaguauuuaguaccuaagguauguugcgugcugaguacuuccgacagccagaagacuguggauguagacauguguguugagugugauuucgaggaugauaaagaugugucuugcugugagccccagugcugacaagugccccugggaagcaccuuccccuuaacagcuuggguuuuaucauuccuuaacguaauguacaacauggauucuuuauagaaucaacaagguauacccguuaugacaaggacaagcaguguucuuuauggcgcaagggcaggagcaguaagacucuguguguuuguguguguguguguguguguguguguguguguguguguguguguguguguaauaaagccgagcacuuggacauuauggguugucaguugcgguagggaucucauguggcaucaaugggcugaccccaguaaaaggcagaaacccaaaugacuacaagaagucccacgcauuaugagguuuaaagaugaagcauucauacauaaugcacuuuggaaccacaguaaguuuccuucuuucggcuuagaugguaaagcuuaagaaggacgcaagcacuuaggagccugauguaacggguaggaguguggaucuggguccuuauggcuuguaggcaagguggguccuucgaagggagagacaacuuugagacuugaggaaugcggaauuguuugaaaggcggacuuugaaaguaccuucaucuacaaagcugguggaaaccaaagacuccaccuugucucuucgaggucacucacugcccacauccgagucaccaguuucuuucaggacaacaucaaaugugucuccagaucuccuccucuucaucaccggccaccugucccguugucccacccacccccaccucuccucucucucucucucccucucucccccucucucucucucucucucucucucucucucucucucucucucucucucacacacacacacacacacacacacacacacaugggcagccuccugacuggucucuaauucucuucuuaccccuuccagccuccucccuaaaagcagccugcgucucucugcaucuccuccccagcaccuuucaggggcuuccguaaucccuggcuggugagcccuugucugcggcuccagcuuuguuucaaacaagugcauagccucgagccucauggccuuucuucccuuccucagggaggcuggaaucccuuccugccccugagccuuugugcacacugacccagcaaguucuuugcucaguuagacacuugacgcgccaaaccaccuuuugggucucucaucaaauuguugcuuccugugagcauucuuugcugacuccaucugaaaucaugccccugucacaguccuaugcugaaugaagucuucuaaccauauauuacgucuaguucauuauguguacccagaguucagagcacuugacucuguaaauaauuguugauuaaaugaauguaugaaugaaugauuugggaaaacaaaaguaauuccccuucagaaaaagacgaguggugcacgccuguaauucuaacaucaaaacaaucaugaguucaaggccagccuagacccuaaacaaaggacuagguauguagcucauugagagagcagcaguccuaaaacuacaccugccuaaggugcacauggucuucagcuccauccucagcauagcaggguagacaagagagugacggccaggacccaacuccaucuucugccuagauagcccgacacagagauggagaaagaaagucugguacuguugacugcugcuuugugaucuaguuugagucuuacuuuaaguuccaaggaaauuuuaagaccugagcuugcaauuggguuuaggcagggcugggggccugugcgucaguugauuugagccuuggguuugagcuccagggguggucgucuacacuguaaucccagcacccaggaaguggaggaagaagauguaggccucagcuacugggcaagucugaguccagccugugcuguguuaaaagccagguggaaggggguuacuuauuaguaacagaaauaacuaccacuguuuuccuguuugguuuuggugagaugguguccucgguagccuaggcuggccuugauccgucuaccucuaucuccccccccccaccccacccccagugaugggauuacaagugaacaccaccacacugggcuuuguagcugcuuuccacugaacauugccccaaaugguccucaggcgauucucugaagccugcuaguaucaauagaugauuacagcacuguuguaacuucccuuguugcguuucuaacagcuggggacuagaaaggcuaaguuacuuaagaccucugcccuuaucuaccaggagucuugagcucauggccauaggggauugaguggagccuuaucgagcuguaaaauaaaauuccuuccauaauccuuucugucaacuuagugguuaaccaagguguaaucagcacacggauaccucaguauccaaagucagagcuggccaaauggaacagauggccacucugccuaccacaggguucuguggguguggucauggccgaagacugcuugccuggcugcucaaaaauugcgguuaggaguaagcauugguuucacuaauguuagugacuugaaaaauaaaaaucaaaaccaaaaaaaaaaaaaaaagccgggcgugguggugcacgccuuuaaucccagcacuugggaggcagaggcaggcggauuucugaguucaaggacagccagggcuauacagagaaacccuguuucaaaaaaaagaaaaaagaaaaagaaaaaucaaccaagcccgugggucagcuccuuauggaccagcgucacagucggcccuucaagggaaaggcuguucguuguccagcgccgucuuucuuaggguagcauugacaucaaagauaacuaaacggaacuuaaaauugaaucacacuaacuaaacaacugggguuucugacuaugacccacacuauaaaauagggacguguccugaaugacuuucacgggcccuuccaauugaaaaagucuaggaauauucuauuaugucuguguucuugaacuuuacacuaauucauagccacugauuuuccucagcaucugaagcuucuggucggagauguguuugugauggcccagggugaccuugaucuccugauccuccagccuccacuucccagguguugggugcuggugugugugugcuaccccagaccuggacuaguuugauauaugagcugauuagauauucccccgcaucucaggccagccugaaauccaccugcagcccaggcugacaucagacgcacagggaucugcccucagccaccugucacaccuagccugccacuugccacuuuuuguuuaguuugaaaccagccuugcgcucuaggcacuagguuauaugcauaucauuuggaaggcuuugaauugguucuuuucuugccucagccuccagaggaucuggcaucccaggccccgcagcaccaagaccaguugaguaaucugcuagccuuugagauuaggucuugucuucagcccaagaagucuguggagucacucuugccucagccuccaggugcugggauccaggcuuccucaccacgcccugcugugaucaccuguucagagaccagguuacacuugcugcccuagagcucaggacugugaaaauccuuucaucauuuauuuuguaguacuugaugucugcgugcucucaaacuuuuugaaacaucaguguaugcucagaucuuuggcagagcaacucucugggauucuuuaggcuuaguguccuccacuggccagcuagugcgccuugccauucuuuguuaguauuuugcuaaaagauuaugaucauguguugucaccauuaccaucacaggagcuccagaugacagggucagccacagcgcuuccucauagcagcaugggaccagugcugccaacuucgcuuuuugugucagcucggcaucuugagcaguguagcauuuccuuuuccuuugucuaucugucugucugucugucuguuuuucuaaggcagagucucuguguaguccaagcuggccuggaacucauguggccuauaggcuugccgugaacucagagcagugccuugucguucuucaaaucucagauuauugagucgucacucaacucauaacuuaaccgaugucccauuuauuaaugcaguuacaaaacugaccuguggcuaugacaagaacuaggucccagcugcaccugccagggaaaggauuucugucguuuguucucaugccuaaagguuuuaaauugugugggugucugugugucugccugucucugugugucucucugugugcaucucucuguguguggucugucugucugucugugucuguuuccagcagcuaagaaauuaaagacuagaauguuuaaggcccaggaggaguucuccaggugaagcagaaguagcuucuuagagaacaugaaagcguaucuguuugcuguuguuaugagacaggaguucauauguaaccuaggcuagccuggaacucacuguuguagcccaggauagccucaaaaaaacucucuuagcuucagcuggaauagcaagcauaagacacuacaccuuguccugucucuuguuuauucagaaagugucauauguguucuuucccuguuuucaaaacaagaaagggauguggagaacaaaaguagaaaagcaguaauuucuaggugaggguuuucuuuggcuugaagugcacuguguguaaugucucauuuccuccccauucaaaucauagcuuugaagaucugucagaagaaugcgcuaugggcaccuugcauguacuguacuauauaagaaucacggaagaguaaaugcuaauaaaggcuuugggucccugugacauugcagaaggagagggaaggcucgucagaggggccuaacuaagugcucagguuuuaguuugggcugaacgugugaaggcuuuuuggagacagggucucacaaaguagcccugucuggccugaaguucagagauccuucugccuuuagcuccaaaaugcuggaauuaaaggaaggccugugucaccacacccagcaaauaagauugucuuauccuagguucccgcggcuccacccagucccgagcuucugcuuucuacuguagagggacuuaacgagcuucuugcuguuaacgccccuuacacacaaaucauuuaggaaucaggucagggaucagaggccccaacuccuuguggcaucucuggccucuggcaaggaagaggccaaaguauguuuuggcuuuuaggcaaaagagaaacugcuuccuuuggagggugaggugucuuuugacugucuaccaguuguuaccuccugcuccucucauuccuucaucugugugugcacgcguaugcgcguguguacuggcaaguacccucaggggucacggggcccccuagagcuggaguugcaggugguugugagcuucuguguggaugcugggaauugaaauuggauccucugcgagagcagcaaaggaucucaagcacuaauccauaucuucagcccugacaggaaaagguuguuuuguuuucuuuuuguuugauuuuucaagauaggaccucucucuguaacccugucucuucuaaaacucuguagaccaggcuggucucaaacucggagggccaccugacucucugcucuagaguguugugauuaaaggugugugcccaugugccaccauaucugacuugaaaaaucuuggcuugaaaagucuaaaguggacuauuuaaaugucucauucuaacugcaugcuaaacuuaaauuaaaaauaaaaagucaaagggugcucgccuuuaauccccacacuugggaugcagaggcacucagaucucauaaguugaaggccagccaggacuacacacacacacacacacacacacacauacacacacacacacacacacacccugucucaaaaaaccaaaaugacuagacuagacuagaauaaaaaggguaugccacauauggugguccaugccuuuaaucccagcacuugggaugcagaggaaugcagagguuagcccggucuucaucugaguuccaggacaaugagagcuacauaaugagacccuaucucagagagagagagagagagagagagagagagagagagagagagagagagagacuagaaagcuuuuaucaauuaaagguguuuucauuaccaaauaaucauguuguuauggcauuuucauaagaaaaccauaaauggcagggggaguggugauguaacacaugccuugggaguccgcggcaggcaagaucaacgugaauuugaagcuagccugcugaguuccaggccagccagggcuacacagugagacccugucucaaaacaaacaaacccauauguggcccugucugagccauaaaauguauguaaagugggguaguaauuuuggaaguaauaaagacuuuccuauaaaaauaaaggauuccuccacaugcagaucuugguguucugcuggcucucuguuggcacgcugcuuugagacguggcagaccuguagcuguggagaaugcauucuagcucccgagguucucccuuugcugucacggcaguucuaaacugagaacgcuggcgccgcucuagacuacugcccaugaauaggaaacuccuguuuccaagccagcaggcagcagccaacuggaauggugccccuuaaggcuccuggcacacaccuccaucaaaagccgacaagauugggucaaguuagaguguagacacgaaaccuuagcaaaacuacagaccugugaggcccccuagaagugcucauuccuguuuuuaguccacauuucguaguuagaggacagucuaucucccuuuguuuugauguggauuuucuuuuaagacagggucuuacuaaguuccccaggcuggccuggaacuuacugucuugcccagucuagccucaaacaugcagugauccuccugcaucagccuuccaaguagcugggauuauagguaagcaucaucauaccugauugacuccauuuuugaaauucuucauugauugccugugugggcuugaauaaaaauggcccccaaaggcccauagggaguggcacuguuaggagguguggccuucuuggaagagagugugucucagccugcagauccagauguagaacugucaguuccuucucuagcaccuuguccgccugccugccaccauguccgccugccugccaccaugcuucccaccauggacuucccccaaagaacuaacccucuaaacuguaagccaaccccaauuaaauggcuuccuuuaggaguugcuguggucauggugucucuucacagcaauaagaccugaacuaagacacugcccauaugaaaaucuagggaauuaacggaggcgcagggagccccuggauagcgaaugguauuuugcuuugauuuugugaugcagacaaacagaacccagggucuuguggcggacaagcucucuacuucugcgccaugcccaguccacgugguuuuuguugaugugagacaguuuuguuuugcagcccaaacugaccuugaccgcccagugaaguuuuggagcauucggccucacuaaugcccucgguucugaccugaacacugggaaugcaagcaccaugcucccagccaugugacagcccaaggcaccuguauguccuuuauuuguuuaugcugucagacagcagauguacuguaggccagaguuugucucucccuaagauccuaagguugucagggguccccaagucaccucauaagaagccccagagcuuugagucugagguuuugcuguuuuguuuugggguugggaccuuucugguauagggugcagagucuugugugugccagacaagaguguguccucugugacugagcccuauccccaaccuucuugcuuauaucaagauguuauuuuuauuaauuucuaaaaggauuuucuuaacauuuucaaauuuucuagccaaaccaaguaaaauugaaaugccagcguggaaaguagcaagucauuucugacuggagcagucagcaaccagguuaacuaacgagccuaauuaauaacucuugcacaucaaaggguagugucgugagaauaaaaaaaagaacacaaaauaggagaaaauauuuguaagucauguguuucacgucuaguauacagguguuggggagggagguuuguauauguauucggaagacuuuacaacacaaccuaagcuuauaacuuacugaacaucuauuguguacaacuguggagcuccacuaagcucuacaguuaaaaagcugggccuggcagaagcuaauuauccaguaugggagagacaaucuggaaaaagauucaucuugacaaaauguagcagaauaucagcuauauacaacuacauaguauacauguauacacacacacacacacacaagcacacaauauucuuaauaauagaaagaauccaaguguccaggcaccacaagaacacagccuacagaaacaacuaagcagggcucauaguggaucacaggcccuguacaggucacagccagguugucugaucugaauauaccuuaugguuggguagcuuggucuuccucugggacucccaacagugggaauggggagugucuuugacucuuuugccugcucuugugacccuuuuccuccuacuggguugccaguccagccaugauaugaggguuugugcccagucuuauuguaucuuguuagacaguguuuguuggcuauuccuaggauggcugcuuuuuuuuuuucuuuuuuuuagagaaacgggaggaguccgggagaggggcuggugggagaggcuguaauauaugagagaagaauaaaaguuaaaaaaagaaaaacgcaagugaagaauagacaaagacuucaggugcaggggcucacaccuucagucccagcacuugagaggcugagacagcaggauuaucccaaucuaagugagaucauguguccagaaagcgggagaggaggaaguugcaggcugguggcacacaccugaaaccccagaacucaagaaauugagaccagagagucaccucaaguucuaguccagccuuuggacagguggugaaauccuguccaaaaaaaaaaaaaaaucuggcaaaagugguaugugugcauuccagcagcugauguaaucccagcguuugggaguagaggcaggaguucacgggcaucuccagcuagccaccgaguucaaagucaaccuaggggacuugagacugucucaaaaggcuuuuuuuuuuuaaagggugaacagccggguguguuagcaccuaucuaagaggcagagucgggcagaucugugaguucaaggccagacuugucuauggagggagucaaggacagccagggcuauuacacaggaaacccugucucaaaaaaaaaaaaagaguuucuggcucccuuuccagaggacaggguucaaucccagcacccacaugguggcucgcacuugacuguaacugcagucccaugagcuccaacgcacucuucuggucuccacgggcgccagacacacauaaaauacaguacaguaaaagaagggaugacucugagaugugaggaagugagaaccaguuagcaacauguauccauggaguaagaaggaacaguagcugagcucaauaggguaaagaacuagaaacacccuccagccucugugcaccaugaacacuacggggaaaggaccguuuaugccaccuuagaaucugguaaaacugcaguugguagagacucucucgagcccaguccgcacacuuguuuuaagucugauuuuucuccugaacccugcuccccuaacccguguacuuaagccuauauuuaaagaccuuaguaagaucgccaacucucuuucauuaaacaaacacauuuaaugaaaauauugaauugggaaaugcuuacugcuggugugcacugguuuuuaauuaggccaguuucauguuuguuauuuuaggcagggccuugcuauguaguucaagauggcccagaacucaggaaaaucauccugguucagccugcaagagcugggacgacagaugugcaccucugccacacccaccguugcuguaaaagagaggguagcacacacauuguaaggguguggguguggcggucaggguggguugggggagucaguucccuccucccacccuguggguucuccacgcuuguccagcaagcgccaacucaccaguuccagaugguuuuuaaagauuaaauaauaauaaauuauauaauacaauaugauaugauaauaaauaagaaaaugaccacguugauuuauuugugcuuguuuaugugugcacacgugugccauggcaccugugggggucagaggacaucuuuguagacucaguucucgccuuccacuacggggguccugaagguugagcucaggucgccgggcuuggccacaugugucuuugccugcugugccaucucacuugcccaagaucuuuuuucuugcacuucuuauuuauauacauguuuuaaauaauuuacuuauuuccugugcuuugguuguuuugccugcguguaugucugugugaggguuucugaaccccuggaacuggaauuacagauaguugugaguugccaugugggagcuaggaauugaaccaggauccucuggaaaagcaaccaguguucuuaacugagcugagccaucucuccagcucuucugugcauguucguaucagcaugcaggugccacagaggccagaagaugcugucggauccuuuggaguuggagggggucauaggugguugugagccaccugauaaggguucugggaagcaaacuuggaucuuucacaagaucagcaagcacuccuaacugcugagccaucucuccagcccaaaguguuugauuguuuguuuuauugaaguccguuuaguuuguucauauuucuguuguaccuuuuaauuuuuccuuuuaaacgggaucucacaauagcccaggcuggucuggagcucacugguaggcaaggcuggccuuguacuucugcucuacugccuucauugcuuggauugcaggcaggagcuguccugccauuguaggcagugccggggauugagucuagggcaggcaagugcucugcuaaccgaacugaagcccccaccuggaagauacuuuuauagaauucaagcuccugaacuuacacucgcaauccuccugccucgggccucccuaauacuaugauuacaggccugcacaccacaccacccagcuccucuuuauauauauaaauauauagagauaauuuuuuuuugagacagggcuucuccacauagcccuggcuauucugaaacacucuguagagcaggcuggccuugaacucaugagauccgcccgccucugcuuccugggugcugggauuaaacacuugcaccgccagcaccaccacuggcucucuguguuuucucuuaaagcagacagaggagcggaauccaacaguuacggaugcucagauugauaaggaccauuuuggauaccuuuucuccugcuagcaucacagcuaggcagcacacagccuauuuuauuugcagagacaccuguugaacaaagaggugucaccugccuuguuuauauuuacagcaguuagguuugaccccaauaauggcaaggaaucaguauaagggagguuggaaagaaaccagguaaaucacaaggcagcgagaucaagcaggccuugagcaauccucgcccagagcgagcagauaagacaggaauggacuuucucucuccugggagcgaggcccauguuagacuucuaugagagagugccauauacauucugauaagcaagccuugggcauaagggcagaggugguucagaguccuucuugcucuuccagagaucacaaguucaauucccagcacccacgccgggcagcuggccagugccuccuacggcaccugcacucaaacauucccacacacaagcacacacauauacacacaauuaaaaauaauaaaguaaaucuuuugaaaauggaauaaagccguucugagagaaagaugagauggugccauaagaugugggagaaagaugagcaaguggauguagaccugcuuccacggaaccacguggagguccccuucucccaggcgagcaagcucgggcugcauggucucuaccacuguuuccaccccuggccauucccagccccuggcugcugaaauacauagcauuggucuaagaauuguagggucccuagacuccagcaucccagugccuucucccugccugcugaaauucuggcugcauuccggccucugauaucuggaugcgcacugaaacuugaacacuacauauaaccauguuaaugaccaaggaggaaccaaaguucccuauucuauggaacguucccuugcuaagcccagugagcuggaagugacuguuuauuccaaaguccagacaaaucauccccucagauuuucuugggaggugccacccacaucccagcuggcuucccugggagucacagcccuggcaaucuucucagccuggccucuccuagggccugaugcuggcacaggcagccagcauccuuccccaccugacaguacagauuuguugucuugugggugauuuuuuuuuuuaauacuugaaggcuauacaugacagucuuggggcuuuuuguuuguuuuguuuuuuaagaaaaagugccaccuggcacgguagugcacaccuucaucccagcacucaagcggcagaggcuggagaaguggcucgguggguaagaacaugugcuguuguugcagaggguaggucugguucccagcaccuacaucaggcaguuaugaaaugccuguagcuucagcuccagggaaucugaugcucuucugaccuucuccaccuccuccuuacacacacacacacacacacacacgcacgcacgcacgcacgcacgcacacacacacacacacacacacacacacacgaauaauuaaaauuuaaaaaagaaaauggcuuuuuaaaaaggagccaugguuaaaugagcuaaauaccuaauaaaaaauggggaaaaaaaaaaaggagccaugggcaggcagauuucucugaguuugacaucaggccugguuuacagagcaagcuccaggacagcuaaggcuacaaagagaaaaccugucuuuaaaaccagacagacaaaaaccaggcaugcaacaaacgaauauauuuuuuuaaacccacaaacaaacaaacaaacaaaacucacaaaauacaaugcaagugugguugugaaugccugaaaucccagcauucugcaaagugagcaggcgagccaccaggagcuuagagcagcucagagacuaccugcuucuuaagaaguuuggcaucaauaugaaauaaauaucuaguauuuaagaguagacaucuucaaguuguuuaaaguauaaucucauauucauccauaggguugcaguucaagucugagugaauuccaccaagccuacuauguacuuauguccccuacauacacgcugguaauaaagcuuaauugcuaaauuagguacauaaggaucagcaguaauuuauaauaaaggcacaauuauaagauugaacugugauaacaguuaugccauacgugugauagauacguacaaaguuuggauagauaauaugcaugcaugcaaacagaaacaucuuauuauacucuaacucuuuucagccacccauaguggcucucaccuguaaucccagcacuuggaagaccaacaggaggcuuuccaugaguuaguuauagacagccuuggcuacauagugcauucuagaccaaccagagcuacagcuucaggcagacagacagacggauaacaaaacaagccuugcaccuaaaggaagcacauggcuuuucuggcacggcugaguugcuagcaucccugcccucacuuugaggucgugacugaguaaaacaaaauuacucucgggcugaagagauggcucagugguuaagaguacugacugcucuuccaaagguccugaguucaauucccagcacccacaugguggcucacaaccaucuguaaugggaucugaugcccucuucuggugugucuaaagccagcuacaguguacucacauacauuaaguaaauacauacaugcauacagauuacucccaugugcagacacuaauguggaucugccugugugguggccaagugucgagugaugagcaggcaggucguguguccagcauggauccccuccauaaaaggcuggagggucugugucugugcaagacucauccacagcccucaggaugcuggaugaaucuuaggacuuguuuaguccugaaguucuccauucaguauucuugauggcaaaauuucauuuaguaacugaaaucaguaaacacugguuuuuuuucuuuauugggggggggggggggaugcauagcaggcaugugaggucaaaggacaaucuuguggagccuggucucccgccaccuuuauguagguucuggagacugcacuuaggccgucaagcuagugcagcaagggccuuuacucaccaaaccaucucugcagcuauuagucagcaggcuggucugcaagauggcugccaccuucccuaguucagaaauggauaagguaagguacaaagcuuugacuuucucgggcuguagaucugaaucuugacuggaccacuccaguuccagagcccagauaaucugacuaccacaugcuguaguaauuugcagaaaauuaaaaugugauuaaaugccauuaguagcaccagguggaacauuuaccuuuguuaggaugcagauagggucugucagugaugccucaaaaucaguccgaaugucuguugucgcuccccuacugaaauggagagaugauguugugucgccccuuguauguuacagcuguagggaauacuaaggucuggauaucaggcacaaggacauguucuuggcauugcuuuugccaucugauuagcuaggaugugcuccugaggggacacucaggaugacuuucccugaacuaauaauaauaguaagaaguugguguugggccaggcgucuugucgcacgccuuuaaucccagcacucgggaggcagaggcagguggauuucugaguucgaggccagccuggucuacaaaaugaguuccaagacagccagggcuauacagagaaacccugucucaaaaaaccaaaaaaaaaaaaaaaaaaaaaaaaaagaagaaguugguguugggagagccugacuccagaguccacuaguuccucguucagcaguccuagcauucauucagcuuuuguugauacugguuaggccgucacauuccuagaucagccauuagcauugaaguggaaaggcugccuuccuaaaagcacucggcuucaauggagcaaguaaagaaacacucuuggcggggcuuugggaaaaucaggguuuaagcuguuuugauacauugaggaaaacaggucucauguaccccggggcuguugucaaaggcuguccugaaacaucugguccuccugccucuguacaucuguaauuuacagauguacacuauccaucucugguguuaaaaaauacuucuuaaaauucuuagaaaugcuuuucuuuuuccacuguccaucacuucaucugcuggugucccacagccccagguguggugcucacaccaguaaucccacaguccuggcacuagagaggcaggaggaucuggacucugaguugagggauagccuuggcuuauaaguuccaagccagugugcucuacauaccaagauccugucucuaaaaugaauaagacaggucacugucaaauccuccagcccagagcuguagcuuaguuaccacuaacuugcuugcugcuggccgauuaugcccucguugggauccccgauacugcgaaauagcaguaauaagacuaucucccucugcccuccaucccuggucacuuccggacauuuguccuuagucccuucucacuguuaucaaaaugcuaaagagacucaagcccaggacuuuacuguagaguagaggaggaauagaguguccaguauuagacacauagggugcaggacauuacuguagaguggagaaggaauacaguauccaguauuagacacauagagugcagggagaugcuuacgugcggcauuaaaaugaaaucauccaguuuaagauucacuauauauguugcccaagcugaccuuaaauuccuggguucaaaccauucguauucccagcuggcugggacuacaggcacgugccacccacacuucauccacccuaaaagaagauuuuuuuaaacauuuuuaaacagggaguuaagcauaaaaauacaugagcaugugcauuugaacaagagcuggauuuagguuguugucuaaagaccaagaacauagcugcagcuuuacagaggaacaguuuaguuauuaaugacaccacucccaggacacugccaaguuccaaggccaguggcgaaaggaguagauccgagucaggagcaguggagacuaaugugagccccacucuguuaacuucagcacaccagucauccccuuuggggcucaguuucuuaucugccuagugaaggcuuugaguauuugaucucuaagguuucuucaguuccaggaaucuaugacucagcugaagauaugcaagguuaccagaguguagaagcuagggguggcacccugcccagacuuccaggcaggcuuaaucuagaccaucaaaaggaaucugucuugagcagauucagagauaagcuacaccacuccuaaauggcccuggucuacaagccuugcagcuauagagugcacccguaaugaagcccagcacugagcacuuaacaguaacucauuucgacacuucagcagguccggccggccuucccaccucauuuugugugucugccuuuucuaucaggucucuuacacggggaauucccauugcuggugaaugaauggaagggggaaaugaaagacuuuaagugacaaaucuucagaguaaagaaaaaaugcuaaaauuaccauaugaaaauauuugacaaaagcaaacugaaaauaaaucauaucugaaugucguccaucugugcauuugugcaugugugcacgugugguggugcacaccuuugaugccaacauuuaggagacaaacgcaggagaauggcugauuauuuaaaaaagaagaagcuagccgggcgugguggcgcacgccuuuagucccagcacuugggaggcagaggcaggcgaauuccugaguuccaggacagccugggcuacagagugaguuccaggacagccugggcuacauggagagacccuauuuuaaucccuaccccaacauuuuuuauuuaaaaaagacugaauguauauuuaucaugaguucaggaauccauagcauaauaaagauaggauggcugacaguuugaggccagucuaggcuacauauugaagacacugcuacuauuaaaauaaaauaaaauaaaauaaaauaaaauaaaauaaaauaaaauaaagagguacuccuagaacucaggaagcacuagcaaggggucuaacaguuccaggucagcuagggcuccauaguaagaccuugucgaaggaaggaaggaaggaaggaaggaaggaaggaaggaaggaaggagagagaagggaaaggaaaaaggaaaggagaaagaaagaaaagcugagugugguguugucugccuuuggauuccagcuuuuggaagauagaggcaggaaaaucaggaguucaacgucauguuuggccacuaugguaaguucuagaccagucugggcuccaugagaacagauagauagauagauagauagauagauagauagauagauagauagauagauagauagauagccuagcaacaaaugagccacauugcucugccuuccgguggcuacuuugugaagacuggcagaugugccugcagccauauuugauuccguugucugagguaucagcuucuauagaggaaaggaaggaaaggagaaaauagccagcuucuaucuuaaguuccucucuccaagagagaagcgggcucuggaugaguagcucuauggaguagacugcugccucuccugcccugucuucuccuguugcccuggaggagaguguccuuggcuuggauguucucccgucccaucugcagggaaagguugggugccccccgcccccaaguccccuuuucucaaaguaaaccauucccgugguuggguacuuguuuucuacuccacuuuucuucucccaugaaacauauggaacuucugucuuagaaaaguuucauuucagccaggcggugguggcgcacucccuuaaucucagugcucaggaugcagaggcagguggauuucagaguucaagaccagccugggcuacagcaugaguuccaaagaaacccugauguagaaaacaaagagaaaaaaauguuucguuuccucaguagcaaguccuugaaggacuucauuuguagucucccuuucuaccuguccccacccucagggccagcggauccugucucugugcccgcccauccagcugccaagaacuuaucaugaggcuccguaacgguugaauuuccgcauuggcuuuuaccuuuggugauauuugacaguuuguauaacuuuaucuaucugucuucugucugucuaucuaucuguuuuguacauggauauguguggcauucagguggcauagcacacauauggagcuuacagggaucccauucgggucaucaggucacccguggagccaccuccauggcaccuaugacaacugaugugagugagcucuucccuaucugaaaugaucucuccuccuggauguaguagguuugccuccuuguuuuucuggggccuuuguucucucaggcucuuuggcuuccacucccuuaaauauaggcauuugccagcauucagccuuuugucugccuuuuuuauggucugccuguuucuuuaucucucuuccugguuuuauauaucacuaacaauaccacugcagcagccaaucucuguuucccuuugagugauaccacuuucuuccuaaccaacaagucaugcagccggcagccuugagauaaguagcuucaagucaagguacaaauaagugcccgauggugcggggaccuaacaaaucagucccauagagagaggcgcagaggcugggccugccucuaaaacugcuguacuuaaagcuaugcugugcaguuuguucuuuccugucucucucaugagcaccccuguuuaaaaaaaaaaaaggagguggggcuggccgucagauggcccauggcucgaaucucaacacuuacucucugugaguuuaaggugagcaaaguaaguuccaggacacccaaggcuacacaguaagacccugcuuaaaaaacaaaaacuggggcuggagagauggcucagcgguuaagagcacugacugcgcuuccagagguccugaguucaauucccaacaaccacauggugacucacaaccaucuguaaugggaucugcugcccucuucuggugugucugaagagagcuacagaguguucacauauauauaauauaaacuggggucuggugagaugguucaguggcugagaacacugcugcucuuccagaggucaugaguucaauucccagcaaccacaugguggcucacaaccaugugaucugaugcccucuucaggcaggcggauguauaugcagcagagcacucauacauuaaauaaauaaaauuuaaaaaaauaaauaaaauaaaaacuggggagguugaggcuguuagaacaccuggggagcacacucaggaccacagguucagucccaagcaucacaagaagagaaaggaugucguggauggccugggcugaaaacucaucccagaauauggcagacauaaaggagcagccgguguguaucuguguguguguauggugcguaugugugcaugugugugcacauguauauguauaucucuuaagugacacaacucugggagcccucugccucauccugccgucuuaauuacgauucagagugucgugggagguuucauugcaguguuuguuagaacugagagacaaagucuggacaggauacaacuguaaucugacaucugggcagcuggcucaggaggauuaagaguuugaguuaaacagaguuccuggccugucagagcuaaauagaaagauucugucuugauguuuggccaaggugauugauuugcugugcaguccgucaaacagaauuacggcagcuuaguuugauaguuuuaauuggcuuuacuuuuaacucguaacaauaaaagggcuggcaagggggcucagcacguguaagcacuuggggcucaagccuggacaccagagugagaccccugggauccaagugaagguggacacggagaacuagugacagucuuuguucugagcaccacacaagcacacaugcaugugcacagcuuacgcacaguaaucauaguauaacauuuuuuugaagauuagggaauacuucguucuauaaaauagaauaucaaguggagaacacaugaagagugguuuuugguuuuuuuuuuuuuaauuguuuucagaauuugaguuuuuguuguuguuguuugguuuuuuucugcacaaguguuuugccuacauguauguauaugcaccgugugcaugcauggugcccacugaggucagaagaagccaucagagucccuggaacuggaguuagaaauggcugugaacgaccauguggguucuaggaacugaaccugggucccaugcaagaauaagugcuuguccuucgccacugggccaucuuuccagcccuggaagggagaucguaacagaaaagaccuagagagagcagaugcaggcuggaaacugguccuuucaguuggcucucuaaccccaauguguucuuacgggcuugaucuaguuuauuucaacuggcucucagcggccuccaagcagggagcuccaggagucaggagguaaauggagcuugcugagaacuuagagcugugucagggacagguucacaugaguacaagacccugagagucccuuccugguuacaucacagagucugggcaccuccugcuuacuaccacacugggcuggauggagcugugccuuggggcaguggcugaccacucccugugcugcaguugcugaccucguaagaguggucaggagucugaaagugacaggguggcagguggccccuggaacaccugcucuguccuaagguccuguuccaucccuugugcagguugcuccugcacaccaacaagguccuuuugagguuuauuuuuacguuggggaaucugcaaguguaugaacccguguuucacauacuuccuguuuucuugucuuuaccgcuuccucccugcaaguaucuuagucaccccuuaggaauaaacaguguuccuagcaauccugccauguguauuccucuuaaugcuuagcgcagugcugcuaauuuaauauuacuggcuauggagaggguauuguuuucaaccguccuaaaagauacuguucgagaccagugugcaacaaaguaggcagcaaucucugccuucaaagacucagacagacagacagacagacagacagacaguauguuagagagcagugagugccuaugggagaauuaggcagagcacagaaaguauagcaugccuugcuggggugguuauaaggauggaacgguacaaugagaugcucagagaagaccucacuguggcauucuaccaaauauuugaagugcuaaagagccuuauggaaagaucacuccaugcagggaacuucauaucauaauaugaaggcucuaaaacuggcccucuuggaacauuccagaaagggguaguuuacuuccagggcagaaaggugaaggucaggaaacaagaugaaucagaaaaaaaaaugggccagagaggaugaccguacacugaauguucugguuggucuuugcccugggauuagccaucacaggguuuccagcauaagauugacucuggauagcaucacuaucugacucaggacugaauccucuggaugcugcaauagcauccagagucaaagccgcauugaugcuggucagaaggugacuaauuauaauggagccuugaccuggggaagcagcagaggugaagagaugugggcagaaacuugauuuacuuucaagguggaccuacagaauuugcugauucggggaaggaagcuaaagacgauagcaggauuuuagaucugagaaacagaaaaguugcagucuggaauggggaaggggccggucaugguggagcacgccuuugaucccagcacuugggaggcagaggcagauggcucucugaguuugaggccaaccaagacugcauagugagaccuugucuuaaaacaaaaauaagauaaagugaggaaggccccgggaggggaagguuuugcugugcggcagcucagcuugugccugguagguucaggguauccccugugcaggcacccacacaagacgucaagcaggaaucaacagaggcgccuuggcuagagacagcggagaugggguaaaccugagcauauggcuggacuggacuauagaacuagaugagaucacuggacccgucacacuguucaggcagaggugacuacacgacaguagauaacccacucacugcuuagacucaagaagacugacuucccggcacuuucuagcagcaggacaggcuuuaagaccuauugucucagccgggcgguagcgcacgccuuuaaucccagcacuuggaaggcagaggcaggcagauuucugaguucaaggccagccuggucuacaaagugaguuccaagacagccagggcuauacagagaaacccugucuugaaaaaccaaaaaaaaaaaaaagacccauugucucacucugggguccccagaucuucuaccagugcugugccuuaacuuagaugggacacgaagcacugcaaucccagaaaccccaaggccaaagcaacagaaucagaaauaaguccaaggccagccugggcagcagaguagacugugucucaaaaauaaaacagcacuguugggaugcuagcuagaugguacggugggcagaagcauagaagccugacaaccaaguucauuucucaaaacccacauaaagacagaaggagagagggggugucacagaauuguccucuguguauccaccauggcacacaagugccaauagugacuaauggcucaggacaauaaugauaagagagcuguguuagagugcuugccuggcauccauaaggccccagguucaaacuucaguaccuaggaaggcagaaaggaguaauauaaucuacaggauuugggggcagcagggugguucaguggguaaagcacuugccaccccugaguuugguccccaggacccaccuagaagaagaagagaauaacuuucauaaguuguccucugcccuccacacagacauguguaaucugccaccucccacacacaucaguaaguaaaugugucugaguccggguuaucgugugaugaaacacccugaccaaaacaacuuucggagaaaggaauuauuugcuuacccaauaggcuagaccucagucaaucacuaauuaagaaaaugcccuacaggcauuuucucaauugaggcaacccccucucugauaacuugugucaaguugacauaaaacuagccagcauaaaugucuguauguauguauguauguauguguguauguauguauguauguauguguguauguauguguguauguauguauguauguauguguguauguguguauguauguauguguguauguguguauguaauugugaugugaggcuuuaauggcaaagaccugaaacugcaacuacuugggaugcuaagacaagaggaucacaaguuuaggauagccuagauagauaacuuacugagagccuagcucagaaaauucuuuuuacuauuacuuuuuuuauuuuaaaaaccgcugguguaguggcuuagcaaggaaaggcacuugccgcagaacccuggcgaccugaguuugguucccagaacccacauaaagguggaagagaacugacacacaccaccacacaugcccacguucacacacaucacagguguacaugcaacacacacauacaauaaugauaaacuuuuuuguuugguugguuuuguuuuuuucaagacaggaucucacuguguagcccuggcuauccuggaacucacucuguagaccagacuggccuugaacucaugagaucugccucugccuccuaagugcuaggacuaugccuggguauaauagacucuuuuuuuuuuuuaaaguaaaagaacaggcuggagauauaguucagugcuagagcaugggcccaguguaaccguggagccuuucuauguccaucccaauuccuaaauaauuacccagagacuuuguaauuuauuuuuaaauuuuuauuuauuuauuuuauguaugugaguacgcuguagcugaacugaugguugugagccaucauaugguuggugggaauuugaaugcaggaucucugcucgcucaggccuaaagauuuauuuauuauuauaucuaaguacacuguagcugucuucagacacaccagaagagggcgucauaucucacuacagauggcugugagccaccaugugguugcugggauuugaacucaggaccuucggaagagcagucagugcucuuaaccgcugagccaucucuccagccugaggcuucauuauuuaugaaugaaugccuaggccuuaagcuaggcuugcuccccaacuagcucauaauucaguuaaccuguuuauaugauagccacauggcuaguuaacuuuccucaguuucauacuuccagcuuccuccaagucaggauggcgaauucuccugcaccugacugcuucccagagugcgcaccugcccccccccccaugucccaccuucuaaucccggcucagcuuauuggccaucaguuuuuuuacugacaggugaugcuuuuacacagugcacacaagauuaucccuacaccuagcaggcaggaagaagcccuaaguccaaccccacauucuacaaauaaacagugcugaaguaaggaauuagggugauggcuagaagccaucaguaucccugagaucugcaugguuuggggagcuuuuguucugucgcugcugcuguuuuuggagacaggaucucucuguguagcucuugcuggccuggcuacaaguacucacagcaauuuaccugcuucugccucucaagugcugggauuaaggaugugggccaccacgcucagcugucucagagguuuugaagcaggguuuuugugauguagugucgcugagguauguggcugcaagcaguuaccaguaggaggccauugccaccacuuaugggugagauauagggacguaacugaaaauuauagcacguaugcccucccacacacacacacacacagcgaaaggaaggaaggaaggaaggaaggaaggaaggaaggaaggaaggaaggaaggaaggaaggaagggggaggaaggaaggaaggaagggggggaggaauggccuggagauaugacucagcaguuaagagcauuuguugcucuuucagaggacagaauuugauucccagcaccacauggcagcuuuauaacugucuguaacuccaguaucagggaugggacauuccucuuccggccuccaugaguaugaagcacauacaugugcacauucauacauguggacaaaacacuguauaagauaaaucaucuuuaaaaagcauaauuaucauaauuguaauuaacaaagaaggcaagagaaggcugauuuagguagaaaaucagcuuuaguuauacagcauuugagagaguacaaaaugucauacuaaaaauauccagggaggacccaggggacacaggacuaaccuagggaaaguuagugcuggcguaguuuggcauaaagaucauauuaaguugugugagcaucacggaguuuucacagaggcaauacagcaaaauuagagaaacaagcuugaaacuuuuaggagccagaaaaagagucuucagugggaguguggggaaguucagcacuugccuagcaugugaggcccuaguucaguccccgacaugggugggcgggagguagggugugcuguagaauugauaucaacagcugguucagcacauagcacuuggaauuccuccuucuuccucacauuggacaagcauagcuuacucucugacccagguccuucggucugcugccugaccaaguggggccauaucguauuccugcagaguucguaaauggcuaacgggaugaaaggcuaaggggauguaucauauuuuaaugaaaacaguucacuucuguuuucuucaagugaagcagcacgccccucaacuucaagauuaaugaguaauuguacaaguguacaggaaauaaggagcuaacacuaacacaggcagugugacguccccggucccaaacacaacucagugagaagcacagagaccccagggaauagucucacugugcuguuaacccgcugaaccuggagucccugccccuagcugcagcccgucaguacacagcacauccuggacuuugcucuccuuagaacgagcccuguucuaacaggauccuugaccuagggccccgaugcuucaccagcgauaaccuccuucagcaaucagaaaggaggaagacugaguucuaccacagguucucagauccucugaccaccgauauuaaaaccuguuuggugagauuaaacaaaagccaguggccugucaagcucaggauuccauucccagggccauuguuaggguuuuagugguacugaggccuacugcucguagacuugugugcagcucauuuuuaaaguacauggccuuccgguuagacucuggugugcaagcaggugcacgugucacggugcuugguguucuugacgauucguaggugaugguugccacucuuaucaagcaccaguucccacaaagaaagaauuaagacuuggaaauagcuuguagggcaccacucucccuaaaaacagcuucucccugaaggggugaccuagcugccaggcugccaagccugcugagcugggcagcugccaagagcaagguucaguguuuacauacccaccaugggccgggguugucacagcaacucacccagcacaguuuguccccuccuucccuuggcaacuuccgagcaagcuuugcccucaccucuuguggucucgguguucuggguaaccccgcuuucucuguucuuuugauuuuccugccuguacuucagcuucucacauacuccccagucugcgcuauacugaccugagugggaccaugcaaccugcacuccucccaacuucccaagccagguccccugcagcagccagaaccaaagcuagcuggccuguacagcgucugcaggagcacgcccgagacccuggcuccugccaugucugcuuucuuggucuuauaaaauuaugcuuucuaaauucccugguaaguuagaaaucggggaaggaucuaggcuuggcuggccuguugaaagcucaagacgugacccuugaccccaaaauagcaagggaaaagacaggaaaaacguaagccgugaacacaagaacucagaauucagggcaguguagguccugcagaguugaggcagcuucccacaccccaaagggcaggaagacagcguggcucuccugaaauagcaagguccaguauuaucgagaaauguuaaauuagggcugggagaguacaaacccuggguguggcccaggcgugggaggugggagcgggguuagggauuaaaggccagccucagcuauaaagcuaauucaggcaaucuggcauacacuagaccccauccuuaaaaaagaaaauuuuaaauucucuucaacugaagaggacagagaaaugcauuguguucuuuacuuuugguacaucucacaugcuuaaagguuuuaguacucaaaaagauuaauucuaucuauccagaauuuuuuuuaaagauuuauuuauuuauuauauguaaguauacuguagcugucuucagacacaccagaagagggcaucagaucucauuauagaugguugugagccaccauguguuugcugggauuugaacuccggaccuuuggaggagcaguccuguacucuuacccacugagccaucucaccagccccuauccagaauuugugagcucucccagacaauuagaaucuucugccucagccuccuaccugaauucaauccccaggaccuguauaaugguggaagagagcaaacuccaaaguugcuauuugauuccaaacacuggcuguacacacgugugcauacacacacacacacacacacacacacacacuuauauacaauaauauauuuuuuuagaguaaaaaguuugagguuuuguuuguuugguuuugaggugcguuuucaugcagcagacuggccucucacuugcuauaaagccagaaauguccuugaauuccugauccuccuccucuccaucccaaggcugggauuucaggucugugaccaccacgucugguuuauguaguccuggggaaucaaagcaagaaagugaguuccaggccagccuaggcuauauaaaaacaauuacaaggaaccaagcaugguggcgcaugccuucaaucccagcacucaggaggcagaggcaggaggaucucugugaguuugaggccaguguggucuacaugguaaguuccagaacagcagagcuacauagagagaccucgggucaaaacaaauaaacaaaaacgggaacucugcguuuccguguaacacagaacuggugacgaagacacucugggguaaggcgaacaaguagaaggccuaucuaggcuguagagaguucagggucagcuugggcagcuucuuaacacccuaccucaaaacaaugaacugugcagagaggccuggagcuauaacacagugguagacaacucuuccagcguguaugaggcuccggguucagucccuuacacuguaaguaacgacauaauugagcauuuuguuuuauggauugacaguuuuuaagccacugggcgauaguggcgcacaccuuugaucccaaaacuggggaggcaagggcaggcagaucucugugaguuucaggccacccuggucuacagagugaguucuagggcuagaaacccugucuuggggaaaauaaauaaauaaauaaaaguaaaaauaaaagaaauugcaauuaccacacacucaaaacuauauugccaaugguaaaacuaagaauauuuuuauuuuaacuacuuuauuacauugacuuauuugcaugugugcacaaacacacacacucaugugcuagucagaggccaacuggcaggaguuggcucgcucuucccacuguguaguccccagggaucuggcuuggugauaagcacucuuaccggcucagccaucacccugaccuuacauuuuauauucuaaaagcaagaacuguggcaauuauaaaccaugaccaacucuggaacacuguacaggaauagaauaggcaagguguccuuccagaaaacaaagaggagacugacuguccacacaugcccaagugcaagcaugucagcuccaccacuugauagacuguugaggaccagucugcagcgaggccauuggcuacgcucucucugacuuagggauacagugcacuggccucucugauuccuugagcaacccuuggcaguguagaacucauugcccucuaggagcuccccugagaguuugcucacagccugaaucauaucacaguuuguaucauuuccugaauuaagcuugaagacauuucuuaguguucuaaaacaagcucuauaaaugggucgauacucgagcaagcccaccucauagccuaguguuaacugucuucucagaaguccgagggugcuguccucacaggacagaucacaaaguguaaaauacuguuucugagcagaauggacaucuucucuucuuugguuuggguuuuuguuuuguuuugucuuaucuguaugugcuuugugcaugcuaggcaagcacucuaacaacugagggagagcccuagcccuugguagguuuuugaaacagaaucugcuguggaugcgaggccugccaguacucgcuguguaguccaagcuggccucagacuugaagaaucuccugccucagcaucuugggggcugagauuacgggugucggucacuuccucaauaguugguagguauaaaugaaagaaaguccugagauugcaccuuacguuguugccucgguuaaaaauacuugaguucuagccagguaguggugguacacgccuuuaaucccagcacuuggcagguagaucucugugagcucauggccagccuggucuacaaagugaguuucaggacagccagggcuguuacacaaagaaacucugacucaugaaaaacaaaaaccuugcaguucuaaaagcguauuuacaaacagcaacaaaccacuugauuugggggaguacuauucugucuucucuguuagcauccauaaaaugcuugguugguugguugguuuuugaaggccauugagaugaccccagugggguuaucaguuaagccuuccagaagaccuaaauuugauccuuggaucccacauaagaaggagaaagcaaaguuguggucuaacacuguagcaugaacgcacccacaccuauacaucucucucucucucucucucucacacacacacacacagagagagagagagagaaagagagagagagagguuuuuuaauccugguuuuuucccucucugaugucagcaggcaugaguaaccucuuccucuucuccucccaucuaggcuacccguuggcucuguuuuaccggcauuaccuuuucuacaaggacagcuaccucauccaucucuuccacaccuucacgggccucucaauugcuuauuucaacuuugguaagggagugggcucagcagggaugcagccaugagaagaaaccuggggagggcuggaccagggggaaaucccugaaacaagcucgugugugcuuuaggaaguguuagcucuuacaaagcuuucaucuuuacaaaaagaguacucagccaauaggaacacaacuucauugugcuuugguuuuguucugggagucaggaagacggcccagcaauaaaggguauucucuucugaagggccccaguucagucuagcacucaggccagauggcucaaaaccaccugggacuucaguuccaggggacugaggcccuccuagcuacacagacacacacaugcacaugccuacauacacucacacacaggugaauaagaauaauuauuuucaaagauguggaaaaacaguaaauuaaauaauucauaauaagguaacauaucaaaacaucacuugguacccccguaaguguguacauuuuuauguaucaguuaagaaguaaauuuagcguuuggcauuauggugcacaccuuuaacccuagcacucaggaagcagaaaggggccagcuuggucuauguaaugaguucugggcccaucagggcuacauagugagacccugucucaauaauuaauaauaauaauaaugacaauaaugauaaucaggguuauuuaggagauggcgagguggcgcaacaaggaaagcacaagcugccaagccugguggcuuucccacccgguggaugaggauaacaaacuuucucuagucgcccuuugaccucugcacuuaccauggcacaccuacacuuaaaguuuauuuauuuugagacagugucauguaacccaggccgaccuuaauugugaaaaaggucaccuugcuccuccugucucuacuucccaagugcuagguggcaggccugguccagucuagcuggggauugagcccagggcuuccugcaugccgggcaggugcucuaaccaccuccagugcugcauacuguguccucuucugggaaucucaggaggaaugggcaccacgguccuaaacgcugcucucuucucugcacccaggccaccaguucuaccacuccuugcuaugugucgugcuucaguuccucauccugcgacucaugggccgcaccgucacugccguuauuacuacccuuugcuuccagaugguaaacuuuucucauagcagcucaggucacaucugacaggagguguggagaggggcaaggcagggggugguagcacagugaccgaggagaccuagcuugcaaucccuccgcccaacacacagcaucugacugugggcaggucacucggcacaggccuuaggcagacuguagcaguaacucauuacuggccuccagucuaugccagcaggguuccuugguucucaccaguuagcccagcugaccaugaguuacaaccaaucuagacugagcugcagaagcugugcaggcaaauguccauccaaugcccuaagcaagccauuccucugaggugguaacgccccuguuuguaggauuuguuucuuuauugagaugaggcucacucugugaccaaggcagcuucaaacucuauagcucaagcuggcuuccaucucucucaagugccaggauucuaggucugcaccagcaggccuagcucauagauaggaaggaccagaagagaggaaaggggaaggauugcagagccaggggaaaugaagucagacaugguggcacaggcuuggaaggcugagaggaggguugugacuaggaggccauagacugccccccaaaaaaaggaggggggguggaaugugaacgauggugaagaugcccccucuccuaggccuaccuucuugccggauauuacuacacagccaccggugacuacgauaucaaguggacaaugccacauugugucuugacacugaagcuaauugguaagugggaagaaagguacugucuuccuccuuuacaggugggccccucccccacagagccaaaauaaaccauacugaugucaugcuccacagagcacgcccucaugucugcccuccccuccccuucucucuuugcucagggcuguguauugacuacuacgauggaggcaaagacgggguaaguguccacgcugucagaggauagggacuaaccagcgggaaggggaagggcugcucuuaccaagaccgauccccaccagggcagagccucugccucauucccuagccuaugagcugucuuccagcugggcagggccgagccaggguaacuuguccaggcuccagcucuugcacaaaguccagagaugagugccagcaaggcauuugucaccacagccacaggcagcuguuggcuaagcuaccccacacauuuucccaugaagcaaccuucuaccucccaucccacacuaaagagcuccaggcaguggggcacagauuggaaugcucagagggaaugccucugggguaaaauucaaggcuauccugagccguacauucuauucuuggcauagaauuccuugaccucugagcaacagaaauaugccauacggggugucccuucauugcuggaaguugcuggcuucuccuacuucuauggagccuucuugguagggccccaauuuucaaugaaccacuacaugaagcuggugcggggacagcugacugacauaccagggaagaugccaaacagguaaucacaccgcccucccuccccccgcgcccccccuugucaagaccuccauguagggauucuaccuaguacaaucacucuaaagugacucuccuaaaggucagcccuagcacaguggcccgauugucacagugucacauggacaaugucugccccagccguucaagcugacccuaaagcacacauguuuugcccacaaguuaugcuccucccuucaaagcuuccucauagagggagacccuguucaauauacaaaaauguacacagaaauauauacuuaagagauaaugcaaacgccgcuggaaugccuucacugggaaccuguccuccugugugccagcgcgaauugagauugcugguuguucugcacaugguuguuagccuuaccacugacaaguucugggcucaguagcucugaggguuaaagccuccugcacacugcucccuccugcccucuccuguaacugggguuuucgaauagccaagcagagaaagcugucucucugggaaacagcccgcagccgucgccacacccugacaugcuccuuuccgugacuacaggucagagggugaagggcgaugcucugcugucugugaccccacuuguuccuuuccagcaccauaccugcucucaagcgccugagucugggccuugucuaccuggugggcuacacccugcugagcccccacaucacagacgacuaucuccucacagaagacuaugaugugagugucugucagcacaggaaugugacuacugccucacacaaagggauaagcagagagcccuguagauggcagacaagcgccaucucagaugugugugggguuuugcuagucugugagaguuggugccacccaggcuaaaaccugcauggacaaaccuugggcaugggggggggggagcuccagguguacuuuugcacgccuugcccucccucucccccccccccccaaauaagcucaagaagcucucccuuaguguugugacuuggagugcugcaucagguggcuuuuuucuuaaauugacagacuuaggggcuuguccagagguggugcuucgagaggaaagcuggcuuuugccacuuccccugaaaagcucacaggagcuccccgucauucuggguagauuucucugcauuccagacugugcggcuggcucugcaaggccccucugcugacaacaaacgccuaggccgugcagaggagguggaugcauauuggcaccucuuggcugguuacaggcaggugggggcuaggcugccguggcacacgugacaucagaacugauaggaguggaggagccauccgccaguuugaagauaucuaggggacugugccaugcccguaccuucccuaauguuccuguguucucuucuucaagaaccgcccuuucugguuccgcugcauguacaugcugaucuggggcaaauuugugcuguacaaauacgucaccugcuggcuggucacaguaaguaguaugucacauuuagacaagcugagaaaaggggaggcuuggaggcggcgaguggcgagagcccuaaccauccuucccuucaggaaggagugugcauucugucgggccugggcuuuaauggcuucgaugaaaaugggaccgugagaugggaugccugugccaacaugaaaguguggcucuuugaaaccaccccucgcuucaauggcaccaucgccucuuucaacaucaauaccaaugccuggguagcccgguaaguauugaggccugagcccaggcuccucccacacuacacugaggguagggguguugucacuucuguccauguccuacuuaacacucuaagcuuuuguucuaaggccaccaccccccaaaaaaucaaccaacucuguggaaguagcucauccuguccuuccuugcgugcuguuuauagugucccaucacugggucuaagcagccugagaaccauagcagcguuggugccagacccucaggacucagcuguaccugcugaagcaagcggccaguccucauguacccaccuaagcccauagucuguguugugucugauguacccucaguggccacaagugggagccagucagcacucuacuccucagggcagacccagaugcaggagucaagucugagcuucauccuuaccccacccucuucucuaguuacaucuucaaacgccucaaguuccuuggaaauaaagagcucucacaaggucucuccuugcuguucuuggcccucuggcauggccuacacucaggauaccugauuugcuuccagauggaauuccucauuguuaucguggaaaagcagguaggacucgagggugggaggaaaacggauagggaggaagacggggaccgugaccucucucuuuccaccccaggucagcagucuaauucgggacagcccugcccugagcagccuggccuccaucacugcccuacagcccuucuacuacuuggugcaacagaccauccacuggcuguucauggguuacucuaugacugccuucugccucuucacaugggacaaauggcuuaagguagugaagaccuguaaggcugaggggggugggggugucacuaaaaccucaaguagcaagggacaacccacaccucacaucuauuucagugguuucugucuccccgcagguguacagauccaucuauuuccuuggacaugucuucuucuugagccuacuauucauauugccuuauauccacaaagcaauggugccaagaaaagaaaaguuaaaaaagagggaaugaucucugucuuucccugguaaguaaagucugcaggcuacaggcaggcuagaaccagacuagaaaugccacuggaaacugagguggacuucagugcagcuuguccccaagggggacacuguagguucugccuugcuagaagggccuggggucacucuggcagccuucugagcacacgccuugcccugcagguggccgagagcuggacuggugcagaaacuacuugucucccuucucacagcacuccucaccccagcagagacgccaggagcuggaagucacagcacucccagcugugccucugcgacagccaaaggggaagcucuugugggaggagcagaggggcugcacccccuuuggacucccccaugcacguugccuuaucucuccccucuagccaggaaucuguuguuucucuucugccaaucuacuacgauuguauaugugccgauaccgccaccccccccauggggggagggaaggguacaaggcccugccugcuccacuuuuucuaucuuggaacuauaccagauaaaaucacuucuguuuguucaguuuuucacugcuagcaucccagacugcuuucuuucauacauaauucuccaugcuugcuaaaggucaucauggucucucauugagagccacagaaaucuaggaaaucaggaacgccuacugucaaaaucuggaacaccagaaucuaaggggaacaguuuacacuaccauguacugcuaaguuuaagaacccucaaaacaaucaggucugaaaaagaaaaaaaacgaaauaaaacucuuuauaggaaaaacaaaaaacaacuauacaguguugucuccccacucugcagucuugguacagaagauuaucuuccagcagaucuuaggagccaaaagacaaacugccaagaguccuuccugucugagaaccaggcccugcugggcucaaaugacaccccauacuucuucaaaagcuguggugacuuuagcacagguaagcgcagcagagaguggauaguugcugauggacaccaucuuuucuguguacuccacacugaccugaggagagacagagcuggucagguucaggguagaaaagcauaggggcgcuaugucucaacagcagugugguuccuaucaaacuuuacagagcuggccaucuuagcucucugugugagaaacaggugagcccucaaagugaaggcugggccaggacugcagcuaccgccugucuuaccccauuuguaagaacggggauucuuaaaaugccaacugcuccuggaacccugcacugagcuucagcuccaggaagaaccuaaguacacagcccagacuguaccuugccaugggcaaaggcccccaccacaaacacaacugggucacuacugggcaccaacucucgaaugucacugaugucuucaacagaaaaggaagugccaauuuucauacagccaacugggaaguggucggacacuggauucuuaauuaccuaaagacaaaaagaagagucagcgccagaacuggcccagaaccuuaccaaaagguuucuccggcuuaccuucaauagcuucugagggccgucggcugcucggacgcucaguuuguguaaaagcugaacugggggggaaagagaguucagacgugggaagagccgacacucuuccgccuaagcuacacagccuggggaaacugggcuauguguccuuuacgucacacaacaguuauggauuucacuaauaccgaugacaagcucagacagcuuuacccucagagagacuucagagagcagggggcugaacuucccuggacuccguccugccagucacuccccacugaaggaaugggugugugauucuccugucuccucucuuuacuuugccaguucagucagaacuuuaguccuaaggcuucucacccaugaggccacaaaaucggucaaagguucuaggaauucgagucuggggguucacuucaaucagcacguucuucuguguguggauguaaaccuguagcaagccagcucgguucagggggcuguccauaagcaucagcaggcucugagaaaggaagagggaaaggcguggugaagccugagaaacagcauucgcucagagggucauuagcucugcccacacagauaccuggugggugaugucuggucugacuuccccugggucccguccauucuucaacaacauggacuugugccugucacaguugaguagcucguaaguuuucccuaccugcagaacagaacaugaugagagcaaugggaauccuaucaccuagcccacucuagaccuaagccagaaagacuaaguagggcuagaaagcuuuucagaggauugccauauguccacauucacacacaggauaacuaucucacacaauaaaggagacaagucaugccacauuaagcuuuuaaggccuauggcuaucacucaaggucaccuaaguucuagaaucagacaagaguucaugaacaagacuagucucaaaagcagcacguauaugcugaggaacaugccagucuaggauacagcaagacccugcugccucaaucaaaaccugacaauagcaaaccauugagaaaaagcugguggacugcagcucagcagcagagggcuuggcagggccugacuucaauccccagcacuacgaaacgagcauaugaaaagugggaguaacccagaaucugcacaagcaaagagccaaagaucuagugucagaaaaaugcaacaccauaaauagcaagugaggucugcucgggccugcacucagaaauaacucauuugcaaccucaaaucucaagggacauuagaauggucaguaagaccaggucucaaccugacuagagagagagagcucagcagacaaagguacuugccaccaaccccaaagaucugaguucaauucccaugacucacauggcgaaaggaaggaaaccaacaagcuguccucugaccuucauacauguccaaguauauacacacauauaccacacaaaagaacccugggacaaggccuuugacgugggucaguagguaaaggcacuaguucccaaaccugaccugacaucaaucccagaaugcacaugguaagagaaaaaccaccucuaccaccucagguugucagugacugaacauacguacgcuggaagguuuuuguaaaucuaaaaacauuguuauaugcaaacacuauuuuuaggauuuauuuuauauaugugagugcacuuugcucucuuuaggcacaccagaagaggguauuugaucccauuacagaugguugugagccaccauaugguugcugagaauugaacucaggaacuuuggaagaacagccagugcucugaaccacugagccaucucuccagcucacaaacaagggguuuuuaaagucuguguaucacuagaacuuguuuguuuguuuguuuguuuguuuuugagacaggguuucuguguagcccuggcuguucuggaacucacugcguagaccaggcuggccucgaacucagaaaucugccugccucuaccucccaagugcugggauuaaagccgugcgccaccaccgcccagcuucacuagaacuuuuuaugucuagagacaaagugacaauacacauuucaaaauauuuggggauguaauuuuuggaauuaaccaaauaguucaaacaaugucagaggccugaaaaaugucagugguuaagagauauuaauauuacucuuacagaggacauggauuugauuuccuaccauccaugucagguggccuguaacuccaucuccagggaaaccugaaaacucaagcauucaaaggcaugugguacacacacacacauggauaauuacaaauaaauacugucuguauucauguaaucuuaugugcaugugugccugcauguaugucugcacucuaugugcauagugccagaggaggcuaaaagaggacccugggcccccuggaacuggaguuacaguugugagcuaccguguggguauuaggaauugaaccuguuccucuggaagagcagccagugcucuuaacugcuaagccaucauuucuccagccccacauaaaucuuuuuuuaaaagagucagaguaggagcuggagacggcuccgugguuaggagccuuacugugcuuguuuuucuugcagaggcccagauguaggucccagcacccacuuggugguucacaaccacccgaaacucagcuccagacaacaggccugcacacacauacacauauguaaagauaaauuuucaagccaaugucagaguaaaguacauggucagaaacuaaguccuuuggauacucuuaaauguaaaagagaaugaacguggaaugguccgauuucaacccauuauuaggauaaaaguggagguuuugugcuuuuaauuuaagauguaucuaauuuuacacggaugaguauuuagccuguacgauacauaugcaucaugugccugcccggcgccuguggaagucaaaggugggcaucggauccuguggaacugcaguggcacagcugugagcuggcauguggaaagaaccacaacagaaaccauccaagugcugcacugagggcagcggagagaaugguuuguggagccugagucugugcacugaucggaaaccacaaacuggaaugaccagaacgaaaccauugccagcaguucucaacaguucuuagaaguuacuaaagagacaggagaaaguucaaaaucucauacucugucuucauagaaagaguaaacaaucuugagucuacaaacucaagaacagaaaugguuccuaauagaugaacaggaaauaccca

SEQ ID NO: 3373 - RNA, 5645 nt, Mus musculus
aguuccuucagcagugaccuuggagccuugaagaccaccuaggccuccaggccaacagccucugaccuuuaaccuucuggauggguguguguguguguguaucacuuggcaaaggggaacaaugggaaagagacaaaauggcugccuucagaacagcagcaagauuuggaaacacauuuggucccaagacgcuggcuuccguugucuuuucacccugggaaccugaauguccauggggaacgugggauacgauuccgguccauucgguggucugucuuaggcuucaggagagaccuacuuccucuaagaacccaaggagcugaagcucugcugcacccucucgcccagucaggcucacccuuccucuauuguauucuugucugcccagaaggaaaaaaccaaggcaacgguucuagcgaaguccgugagcaauggcuugauuuccccaguacuggagacucggucuucguaagaaagguagucuguggaaaauagguucaguugggcucccgggcugugggggugggaaggccuccuccacagggagaaacuucagugcaaauagcucaucguaccuggugacuaaguaacagcacaccgggacuuaggaacacggaaacccuugggaggaacacgccaucucccggagcuaaccaggagcugguuaccaaggaagcagcucccccuggggucaucacguuuuuaguuuggcucagcaaagccucagcugcuucagcuuuuaaaaagaugucauuaagucuguggguucauuugguagaccugcggguggggugaagguguaguugggccugagaucggcugcucccagcuuagguccuguugaggacccggcggcaguccgaaugcuacaggccagacugcuugugcccucugcuggccgagucccagugugaucaaugucuucgcgcaaucuacguacacacucagacacaaaauuuuuggcuuuaaguaauaaaaauuuuauugagaauuccuggcauggugguuaucucccccacucugggagaggcucaaggcuguaggaaaucacggagaaaucacauugucccaccccgcuucccagccaacacaggaaggaggaaagccucugaaagggcuggucucagucuuccuuaauccaagagggcagauacagaaaaguccaucacaugaugccuggggcagggugggcugugcuugacccccgagcuggcuccuccaagcuggacaagugugccaacuucucugguggugggguucuugauguccacacucauuucuuacccuuaaugaggcugucacuggagaacaaagggaacauuccuauuaucggggauguaagugugaggugcacaacaccccaaaccacagcuucuuccuaaauaaaggccugacaauggggagaaaggggguguaggggcagguccaggaagcagauggcccccaggaccccauagcaaggaggcagccacuuaccuuccccugcaaccagcaugccaugaagugagcaggaaauaugugaaaagagaaauaaaucguuagucagcuacaggcucagcugcuccagacccgcacuccccagugaggacggcucuuugccacuaucugugcggucccagcaacgugggucucacgugaaauugcuaccagucgucacuucucauuuagauauuuauaaagugccuuucccauaagacauccugcuuugcuuuauaaagucaguccuagaagaugcaagauaggaacugccaaccagacugacacccacuuuucugacugguguucagagaaacuguccacggcccugguaacuagauaguccaggauccaggguaguggacgggugcuuugcucucuggacagugggaucucuuaccgaguaaaacuuucauccuguagauucagcacaagguugucagcugugagauagauucgguucugugauguggcgaucuacaggacauggaacagacguguuaacaggcuucaagucuuugauucaauggccacccaguggaagacacaguaacagaacaggcuccugcucuaguacaaagacccgaugcaagaaggcuuagugucauagcucuguaacagccauaaacaaaacccggggagcacuguggggucggucacucugcaggaggaagggugcccaaagacauuguuuaaguagaaacucaagccaguucuaaugccacugugugacuguguagcagcccuuggauggugaagccuuccacucaccguuuuagagauguucugggcggcccggaucuuucggagcuugauauagccaggauucuugcucagugcuucuccaaggugagcagacaggguuaaggguucuucugggccagguuacauugguggcaagcucccucugcccucgaauccccugggcugucagauucaagguugcgcucacauggcuacucacauguuggcuacccccugugggccucccuacaggaugcugccaguacuguguggcagcugacaugagggcaaggccaguagugcuauugaucuggccuuacagcagggagucaggccuuagguacccccaccaagauuucagaucucaccaguuguccccccccccccaacccccauucccaagccaagaaagagucaguaggccaagucgcauucgccuuggucucaucaaccggcccaugguggaagaugggaaacaggcugaccccgggaugaggccacgcucugugcaacacaaggauaucaucuuggcagccuccgccucccccucagccugcacaaucuucugucgcuguuccugcuucgcuuucuccaccaaaaacugggcccgcugggcuuccugcugggcuguggauuaagugugagguguaagaagcccaagaacauguagccccccuccucccaccuccagaagccccccgaccagugccugccuccauggacuuacccacuugcuuggcuucuacagcagcuguguacucucggcugaagcucagcucugugauagcuacaucauccaggaugaggcugaaguccuuggcgcgcucugucagcucucuucggaucaacagggacaccugggggcaugggucgggaggggaagggaggcuugguuugaggggaucagagaacuggaaggaaggugguggcauugcuguaaccaucugaacaccggagcuccugaauaugggcagcaaacccaccacuuaaguccucaaacauucacuagaaaaaacuugguuccauuucuuccugugacagccguggcaucaccagacugccccacaucacacugagaccuaaucucuucuuuucaguuuaugcaucucuuuaguuuccaguuaacggaggaagaccuucuguggagauguaaggcaauacugccacuuucuguacuaugcuuccuucuuagggucgacuggugucagguucuaccguuuuucuccucauuucccacagucacagcacagcuuucccacaguccaugcagcuaaggauaaccuuaaaccccugauccccuugccucuaccucgagugcuaggauuacaggcaugugccacaccugguuuaagcaaugcuugagaauaaaaccagggcuugugcauguuaggcaaguacauaucaacugaacuacagauccgucccaccccaucccgaaauaccuucuuucaguacccaguaacccugaccaaggagagacacaggcugccgccgugcagacagugauaggagucagaccugagcccgcugggugaucagcugcgaggcauugaacuuggccaccacacucuugagcaccucauuaacaauggacggcagcacucgcuccucauaguccagcccuagacgcugguacaugcuggggagcuccugggcauugggucgggacagcacacgcagggagauguucaccaucugcaggucugagggaagaggucagcaguggccgccggguaaggccaaauucccccuuuuccagcgcuuucuccuaggagugcuucccaccaugccuaguguuacuguacagccuagcacuccagcaggaagauagucaugucaacacagagcaugugaacaacauggaugggcgaggcagacccuuguuuacuguggaaucuuuucuauggaccuuccaccaguacagcuauuuuuuuuuuuuuuuaauaaauugcuacuccuccuccaaaguggauuccaccaagcagcauaaucuuggguuucccccuugccauuagggccuugagaaccagaacuguguuuuauuuccaaggccuauggcuuagcaaacgcauaaaccacacacaccacaaacagcaacagagaagcacacuucugugggcuacuugccucgguguguacaugggaaugaggcccaggcuuggggaaucucaaaggcaggccuucuaacuauggucuacagggcaacagcuagugaagagugggggcacuuucuccagagcaagguguacuguggauguaaucaacaaaucaacagaaaaaaaaaaaggccuuaaaaacagacuuggaccuaggcagccaggaagaaaggcaacucuuaucccuuuuaugcuaggcagaagguaacguuaaaacgugcaugcaugccaaguacuggaaugcaccguuuuuugaaccgugaggcauggcucuuuugcagacguagaaaccaagaccucagaaacacaaccaauucuggcagccuggccaggcucauuuuacauuuguuuccccacgugcccugaggcucccaguugcccacguuuaccuuuggagccugugggggaggagauuuuucgaggucuggcccgaaugucauagaugaugggguacuggaaccaggggauccuggagaggagaggucauggacaggaguugggaaacugcaguuuuauugauuuugaugguuccccucaccacucguccuugggccuguuccuccccacgaccacaaggacucuucccagucgagaacagcccuuuaugcauugcuggaguuucaggcagccacuguccucaagagcaggcgugaggaagggguaaagcagcuccgaauuguuaagucuggcugcagccgucaagggugaagggucagggccuguucgcucugcccgccauuaccugaagugaaggccuucggccaggaucguguccugcugcacgccaccaauacgauuaaaaaagauggcucuaugaccgccuuccacugcggagagaggggugggagucagggcaggcuacuggcccgagugcuggucagcguaggugggacggggacaccugggggauagcaggaccgugggucuggggaccgcaacguccggccagcggaaggaggcugcucaccggugaacacggauucgcggacgccguaggccaccgccccggcccccagcagcagcuucagcgccgugcccaugccccgaggcccggcgggcaggcguccagcuaaguccuucaaguucugggccaugucugauccucccgaaggcggcggcggcggcaccagcggucaggagggggugcccgccagccucugccccgcuccagcuuacagaccucgccuugcacacgaggaucggcggccuuagagcucgcgggagaaagggcaccggaagugcgccucccuccggacccgccccccuccg

SEQ ID NO: 3374 - RNA, 3251 nt, Mus musculus
caggugaaggaggaagagcgagaguggaggccaagucggcucuaggcggcugaauccgggccguugguacaccuuucuuucuucugcaccacucuaggggucaggcgggucuggugccagguaaaggccaccgaucagggggguccuggggcugcgcuagcgacgguagaacgcaguaaauggguguguuggagggcagggacaggccguggaauggggggggggggacuggcucgcagguggauaguagaggcuacagaaagcugguuuuggccucagugaugggcaagucaggguaggccugguggggagcagccaggcucucccggaagugucccaaaugacgcggaggugggggaugggagcaggagaucugccgcuucucuugaggggcuugggcuuagccagggcugaucuugaagguggacugguuggguaggggcccucgucuuacccagcaguguuugggugcugguugggagucucuaauacugccggguaaugauggaggccccugucccagugucaucggcguccauugcgcguccaucgcuuuaggcacuuuuaucuggcagcaacccauuccucccacacauaaccuggaagccccuucuuccgaguuaaggguggcucucggguuggcugguugcccacuggaagaacacaauggccccagccccuccuccaauccagugugauuugucaucugguagauccagaaccuacuagaagcagaccuuggccuugggauugucuacgcgcacacaagaggccacagucagccagccagcagcggcuucccucuagcgcuugaucagcgguagaucaauuuauauuggcuggcucuggguccaucuuccagugcaguguuggaugguugaaguaugaagcuccuaacacugucugguaaagauggcccccgggucaguuccuucagcagugaccuuggagccuugaagaccaccuaggccuccaggccaacagccucugaccuuuaaccuucuggauggguguguguguguguguaucacuuggcaaaggggaacaaugggaaagagacaaaauggcugccuucagaacagcagcaagauuuggaaacacauuuggucccaagacgcuggcuuccguugucuuuucacccugggaaccugaauguccauggggaacgugggauacgauuccgguccauucgguggucugucuuaggcuucaggagagaccuacuuccucuaagaacccaaggagcugaagcucugcugcacccucucgcccagucaggcucacccuuccucuauuguauucuugucugcccagaaggaaaaaaccaaggcaacgguucuagcgaaguccgugagcaauggcuugauuuccccaguacuggagacucggucuucguaagaaagguagucuguggaaaauagguucaguugggcucccgggcugugggggugggaaggccuccuccacagggagaaacuucagugcaaauagcucaucguaccuggugacuaaguaacagcacaccgggacuuaggaacacggaaacccuugggaggaacacgccaucucccggagcuaaccaggagcugguuaccaaggaagcagcucccccuggggucaucacguuuuuaguuuggcucagcaaagccucagcugcuucagcuuuuaaaaagaugucauuaagucuguggguucauuugguagaccugcggguggggugaagguguaguugggccugagaucggcugcucccagcuuagguccuguugaggacccggcggcaguccgaaugcuacaggccagacugcuugugcccucugcuggccgagucccagugugaucaaugucuucgcgcaaucuacguacacacucagacacaaaauuuuuggcuuuaaguaauaaaaauuuuauugagaauuccuggcauggugguuaucucccccacucugggagaggcucaaggcuguaggaaaucacggagaaaucacauugucccaccccgcuucccagccaacacaggaaggaggaaagccucugaaagggcuggucucagucuuccuuaauccaagagggcagauacagaaaaguccaucacaugaugccuggggcagggugggcugugcuugacccccgagcuggcuccuccaagcuggacaagugugccaacuucucugguggugggguucuugauguccacacucauuucuuacccuuaaugaggcugucacuggagaacaaagggaacauuccuauuaucggggauguaagugugaggugcacaacaccccaaaccacagcuucuuccuaaauaaaggccugacaauggggagaaaggggguguaggggcagguccaggaagcagauggcccccaggaccccauagcaaggaggcagccacuuaccuuccccugcaaccagcaugccaugaagugagcaggaaauaugugaaaagagaaauaaaucguuagucagcuacaggcucagcugcuccagacccgcacuccccagugaggacggcucuuugccacuaucugugcggucccagcaacgugggucucacgugaaauugcuaccagucgucacuucucauuuagauauuuauaaagugccuuucccauaagacauccugcuuugcuuuauaaagucaguccuagaagaugcaagauaggaacugccaaccagacugacacccacuuuucugacugguguucagagaaacuguccacggcccugguaacuagauaguccaggauccaggguaguggacgggugcuuugcucucuggacagugggaucucuuaccgaguaaaacuuucauccuguagauucagcacaagguugucagcugugagauagauucgguucugugauguggcgaucuacaggacauggaacagacguguuaacaggcuucaagucuuugauucaauggccacccaguggaagacacaguaacagaacaggcuccugcucuaguacaaagacccgaugcaagaaggcuuagugucauagcucuguaacagccauaaacaaaacccggggagcacuguggggucggucacucugcaggaggaagggugcccaaagacauuguuuaaguagaaacucaagccaguucuaaugccacugugugacuguguagcagcccuuggauggugaagccuuccacucaccguuuuagagauguucugggcggcccggaucuuucggagcuugauauagccaggauucuugcucagugcuucuccaag

SEQ ID NO: 3375 - RNA, 18010 nt, Mus musculus
cccaccguucuucucucagagaccuguaauccaggggcuuggccucagagucccauugguuugacaggcuggauagaggaggaaguggccaagaaacgaaauauauucuuccugaaggucuggaucccugaacagcugugccacucgauuggccccgcccccgucgcccuuugccugugacuucuccccacuccucccgggagauguugucccgcggguaaguccccuccaccacuugugugugucccacagacuccuguuugucuagguggauggacauuguucacacccucaacaaauaugccuacaaaaauagucuacucccacuaauaccccugcccuggguccccguccugucccugugaacucucucuccuuaccacaagauacaagaccuccaggcucauuuccucugccucuucccccgcccccaccccaaaucuuuucuuauuuuuaaccacuggccugugguccuccugcuucugccucuugucuaggaucucuuucccccuuguguagcucgcaucaccucagacauggcagucugagggcacauuugagaaagcucuuccauuccuagacaccccacguacccccacacacagacaguuugguucuuucacuguuccccaaagaaagcaaacuuugauagaugaauggugagcagacaugguggacagguacugaugacgauguuuguugguaauaugaauaugaggcagacaugaucucugcuuagagagcaggcauuccagccagagaugacagagugaauacacaggcaauaacuaggauuauuucagauggccgaagcacuaacuaacuaacacgcaggaaaagaagcagcaagugauguauucuggagacauaauuggcugacagggagggcuuccagaugauguuugagcugagcugagugaugucuggggacaaaugggcaaaggauaguguguucacccaagaagaaagccaugggcaccuuagacuucugguggaguuuggguagugaaggcccacucagagaguucuggugacuuuguggguggucuguacagggguccugcugaguuuggcuuuucauacucauucaauucuuucuguguacccucuuccuccgguguguaucucgucccugccggcccggggguggugccgagacuucccaucugccuugacaaggaaucucccauuauagaaccuuucuugguucuuuaaccuggacuuggaagaccucugcuucggggguccagccccugcaugcuuugguucagcugcuuugcucugcuuacaccgaacaacccaagugcacgguuuccaugacaccucugugucuugguccaucugcccgugggggugaccuguauccgccaucuccaucuccaggcuuuucgguacccggcagcuccuuaaagccugauggugcaguuggcaaacagaucucuggccucagacagcuuuggguuuuuuucaccuucccacucacuggaaccucgugacugugggcaaguuaccgaaugagccuucaguuuucacuuuuguuucuaaacuugggauagucacaucacgaguaaacaggauugucaugcuacaauaacagcgauacaguugucucagcugggaagagugguguaggaugacaggagaggccgagguaggaggaucuugaguuugaggcuagccuggccacauacagcaagaugucgucuaaauaaauaauaaaaacaaagauuaggguuauuggcuagcaggcauaaagccccgaguuggcuggcacacaccuguaaucccagaauuuaggaggcagaggcgggcgggucucuaacuuccaggcuagccugaucuacagaaugaguuccaagacagccgaggcuacacagcaacagaaaacagucacuugccagagucuaugggggauugauuccagagugacuggaagauaccaaacuauacaaauguauuugcauggaacccacaccuauacuacuguggauuuuaucaucuuugaguaccuaauacgauguaaauacuaugcaaaucauuguaucguaguauugaggaaauuguggcuagggaaaagggucugugccuacccagugggagcauacuuucugucuauagcuggcugaaccugcagaugcagaaucagaagacagaauccaggguaaaauguugaagcugaugacaugaagcuaugccacguagccguuaugucgucgaggaagaccucccaagggcaggcauggaccaucacauuuggccuucugucccaggcuucagccuccugaauacuggggcuacaggcaugagccaccacaccuggcugcuuuauuggcuuuuuaggucugaauuuaggaaaccuugugaaguucauuuaucgggcagaaauaccaagauccagagaauucuaguaccauauaauggugguauuuuguccuugguagguacccagggccucucuuuccugcaucaccauugaccuugauguguucuuuuaucucuugcuucccaaaggaaucucuuucucugcuagacaccacgcauuuauguuuaggacugucagccuccuuaagucugcuuaaaacaaagacgaaaucccaacaucauagguggucaaaggcccugugccuugcuucuuggaagacuguuauuauuuuccugccuggggacaggauguguauuccgucuuauuagagcacuacauuuucuggcuugacauccuuuagauacacaucaggggucagaaguauuaggugccucgugagcucccucccacagagugggcuuaauucuggaaagagagucuucguacuggugcaguuaguauggugccaagcaguaugggccuuccugugugccuguuguguuggggaucugcccagcaagggauggauaugggugaacccagauggugggauaugugugaguugugcuucuauacaagauaugucauuggcagagaguaagcggcaugaggggcgugcauacuuguaaucaugucuguuuaagugaagucacgagucuuuugcuagauaugacccugaagguugggauggaggcaagcucagauguuggcagaucuccccccugcccugaauuuuuaaaaauuagauauuuucuucauuuacauuucaaaugauauccccaaaguccccuauaccuucccccugaccuacuccccaaaccacccauucccgcuuccuggcccuggcauuccccuguacuggggcauaugaucuucgcaagaccaagggccucuccucccauugauaaccgacuaggccaacuucugcugcauaugcagcuagagacaugaacucuggggguacugguucguucauauuguucuacggaucucccuuugcuggaacaagcuuuguauguggucuuccugacgcuugggaugagcugagucuaucggaguucuggaucuugcuuaauguaauacccaagcaugcauauuuucagggguauuagcaagaagagaaagccuaaaaggagggugggagggagagaggcaggaagguuaaguaauauuugauguuuucaauaaugauaaaguacucgucauagacuguuaaacaaaacaaaaccagcucccccccccccacccccccccccccacacacaccaggggcuugcuauauagcccuggcuggcuuggaacucuuuaugaagcccaggcuggcuucagguuuguucucauccccuuaccucugucuuccaugugcuggaauuacagaugugugacauggcauccagcaagacuguugguggugaaggccaggguuucccacccaaaugcuaagcaagcauuuuacacagagccacacucuagccauguuuggguuuuaucgucucuuacuucuccuauacuuugagauaugacuauauacugugaauaaauauuaagcauacaacuaacuauacacucacucaugaaacuacugggcuuggagcagagagagggccuuauguuaccaucgagccgcaucauucaguuuuaaagaaguguaagggagccagaugugguggcaaccuccagcuacuggagagguggaggcagggagauuacaaauucaaggcuacagagugaguuccagauuagccugggcaauuuagcuagacccuaucuccaaaaaaguaaaaagagaacuaacagggggugugacucugugguugagccuuugccuugcgaguuugagguccuaaguucaaacccuaggacugcagaagugugaagggaaucaaaugaauaaggaaaagaaauaggguggaagauguacacugcccaaggaugccugcccaaggaugcuccucacacuguuuaagggacugagagucuggguugguuuuguuguucuuguuguugaaacaggucucacuauauagcgcuagauauccuggaacucacuguauagaccaaguuggccucaaacucacagagagcugccugccuaugccucccaaguguugggauuaaaggcauggguuaccaugcccagcuaggacugggguucuaauuucaguauuauaaaacaaacaaacaaacaaacaaacaaacaaaccaaaacuaaccaaucaaaacaccucagacaauaaacccuuaaaagauauaaggugcucugucccaucucccuucuccagcagccugugucccuugcuaaggaagauaccaauauaaauugggcagcuuguuuccccucuggucuuggcuugguaguauuugcaucuuuuuuuguauucauccugggguuuacauacacaaggucccauaagccugaaggcugagcgcuccuaaaguuuaaagcccucccugugagcgucugcccuuguugggacccuggccauaaacccuaaccuuuaggagauaccuucccaccccaccccucccugcugacagucaggguauaggaaggaggccuaggcccaugaugacagagcugcacaagguugcuuugugggggcucucagcugugaugauagcaucuccuuuggacaaggagucuauugacuacuguucuuuggguccugagggcuggcaagcagaauucaaaagucauuggcuuugaaacuauuuaggucugaauccugcaacucacuaaggguaagaccugggggcaauuccucaaacuucuuggccucaguuuccuugucugugaaguggggauaaagauagugccugaggaaugaggcccuggugaccuguaacucacaggaggcaugaaaaugacauuguagcaaugagucuggcaggcugcgacacuccauuaaaugacggugccacugcacacgaucauuauuagacugugccuaagaauaauucugaguagaggcagcugcuggaggaggaaggguugaccugauaauguggauauucacugugcgugacucuugaccugccacacgugugccuuaccucuugagucaugaauauuuacugccuugccccugugccuuuguuggcagacugugggaagugggcccucccccacccugccacccuccagcuccucuucccucgcucugaaaagagaaguucuagugaguuccccuaaggggucggccgcgccccuuccugucuccgcccugcuggcugccccaggccaguagagugguagcccggggagcaggacugcagguuggcuuuggaggccugggcucugagagccuugccugaggcucaucucuagaguuuguacgugccugcccagacaaacuguucccuccacauuuucugcagccaauucagugagaaccccaggauggugagguaagggccugggacccauggaggauaggaaacaaggguggcuggagcccuggggauauucccucacugcccugugcacuuuuaggugguuucaccgggaccucagcgggccugaugcagagacccugcugaagggccggggagucccugggagcuuccuggcucggcccagccgcaagaaccagggugacuucucccucucagucagguggguggcccucccugcaccuuggcagcucauuguguggguccggagcauuccuggguucccuggguuguguugucuccucaugauacauuucuucccuucugucccugccugucgcccuagcaugugcccauaacugucuaugucuacuccaugccuaugugcuuuugcaucgagaccccuguccccccaagcccaccccgcugcugcucauguaucucacuaccugguggugccucgcaggguggaugaucaggugacucauauucggauccagaacucaggggacuucuaugaccuguacggaggggagaaguuugcgacgcugacagagcuggucgaguauuacacgcagcagcagggcauccugcaggaccgagauggcaccaucauccaccuuaaguacccacugaacugcucggaccccaccagugagaggugaggggcauugcagguuggcccugucccuugagauaaguggacauccagaccagguguccuucuguucccaguccguucuucaucccugaucuuccacaccuguucucucaguguucucagccucuucccucuguaggcugaugauucccauguaucuaaccaauccccuguccccugaggaagccagagaaggguuccccuugccuuccugcaggguuccugcugccuagcaaccucauccugagaguaacagagaggccacuccuugucucugguguuucucaucaggucggcccuauuacuagaaagcuuguccuaccauggaacucuggugccuucuuccagcccucuacacagccuggggcucuaggucccugucuuaauaaggucuuagagguccacugguacugggguacucagggacuucucucagcaucacacugagguggggcuggacagagcuuggugaaagcaaggucgcugagguggucacagguagagaagggcccaggcuuaucugacuuaaggagacccucaggauauccccaacuagugcugcaaagacacggcccccauagcugggcuggcuguucucuuguggucuucucagagcaugugcaaagggaagguuauggagauaaaugucccucauucauuacacuggggcucgucuuagcuguauagcacagggacugacuggcaaccccuauuaacucaggguuuucuuauggacucuggggcucugcguaccuguuccuguccugugucuguguauuuacaguugaaaugauuccgaacuugauccccacacccuucucugcuggggccugaacccggggccuugucugaguugagugagcgcuuugccacuagcuaccuuccacgcaguuuuaaagucuguuuugagauucgugccuacaaacuuagcucaauaguuuuguucacaaguuacugacuaaaacugaggacugaaggucuagggacuguggcucagguggugagugcuugccugccaugcauuaaacacuggguucuauucccugucgugcauaaaccuagugugagugacacgugccugugagcccagguggaggcaggaagaccagaagaaggucaaguuuauccuccauuccauagcaaguuugaggccggauagggcuccaugagaccuugacuuaaacuaaaacaagcggaguggaggugguaccauaggccuuuuaucccagcacucaaaagaggcaggggaagguggaugucuggaaguucaaggccagccuggucuaucaaguaaguuccaguacagccagggcuccacagagaaaccuugucuugaaaaaccaaaacccccaaacaaaacaacaaaaaaacuccaacccaaacaaacaaacaaacaaccaaccaaaaaaaacccucaaaacacaaagaaaaccacaaacaaacaaacaaagaagcuggaggacacucccuagaaggcuuuccucuucugcuggugagugggaagggagggccugccccagguugucucuccucuccuauccuaccugcagcccucaggaugguuuggccucucucucagauucgcuuugagccccuuguuuucucuuuguugcugacucaagccaggaugcgcccugcuagaguagaccauggagguacagcugaaugguggcugcaguguucccugugaucaggaaggaggugggagcuaaacagguguuaggagaacaggccagggcaguggggaagcacaggacacccuguggaugauacccucugacagggcugcggaggacuccaagggacacuuuggauggccauuugggaagaagcugucucaucccuaaccuuaguguguguggaagccaugacccaauggcuccucucuuugccccuccucuucugggaaauuugcauuuguccccucaauagugaacucucugccuguggucuguucacauuugcauggagacuuccucauccugucccugagggaaggagcugagcccccucacauugcuuggggucucuggccuguuccugaggugggcuaggauggcccaggaggccuggguugggguaggaaccucugaaggccuugagcuaugguguccucuggacagaguugagaaggaccaagaggacugagccccacuccaccccccccccaauccuugcgguuggaaaaugcucucccccccaccccccgagcugaagaaaccucacaaccucacuucucacucucuccccagaaggaguuuuguguuuuuuccaucacgugguuuccugugaggcuaggcauuguggggcuacaguuuccuccugggaagaggaccuucacggaccgguccuuaguucugcuuucugcccugcagccccucggagcuccuuggagccccuuugaaccucuggaacccugaaacuacucucuccucagugggauauuugugccucccccucccacaaaugcguuuuccaucaguccuucuggacuugugucuccucuugacacccacugccuucugugguuugggucaaucuacguuuuucugucccuccuuuuaacucagucuguuucauggggacacuucauuuugucccuccaaauauucuggauaccgucuuucuguuucuugugaacagucaagagaggcuuuggcuagagcccuuccuuuuuuccucccccccccacucccucccucccucccucccucuaucccuuccuuucucuuuuggagacagaaacuucgcuuuuuuuuaagacagccucuagcucaggcuggcuuggaauucacccuguagaccaggcuagccucaaacuuacagugaucccucuugcuucugccaacccagggcuguaauuacagguauauaucaccaggccuggcuguuuguuuuguuuuugagauagggucccacuguguagcucaggcuggccugaaacuuaacacauagagcaggcuagccucauugagacaguucuucugcacagccgacugaaugcugggauuauaagaguagcugucauugucugcuauuuauuuauucauuuguguguuucuagaaggugagccuuaaagguauguuuguguagaucccgcuggucuuaaauuuacgaccauccucaugucuccuaaggaguuggaauucuagcuccaagcugggguaauagcacaaagucuaucuuuuuccucacaacauuuucugaguuaguaacagaucugaauguagugguggauuugaaagcuuguagcucaagccuggcagguagcaggccucugugcccacucugggaccugguuaccaucuucgccauguacuuucucuaggugguaccacggccacauaucuggagggcaggcggagucacugcugcaggccaagggcgagcccuggacauuucuugugcgugagagucucagccaaccuggugauuuugugcucucugugcucaaugaccagcccaaggcuggcccagguuccccgcucagggucacucauaucaagguuaugugugaggugagucagccaggcugugggguggccucacgcuggagcuucaguggacuuaaggcugggggugccacgaggggggacucagcccugaaggguggccuuacuuggugucccuucaggguggacgcuauacuguggguggcucagagacguuugacagccucacagaccugguggagcacuucaagaagacagggauugaggaggccucgggugccuuugucuaccugcggcaggugaggggccgacaugcuugccucuuccccugagccaucggagauguggcuuucugaggucucucggccgcugacuucucguccucccucaccucagccuuacuacgcuacucggguaaacgcagcugacauugagaaucgggucuuggaacugaacaagaagcaggagucggaggacacagccaaggcuggcuucugggaggaguuugaggugugugguggggacagcagggcugggauggaugaggucaccuugccuucuuuauaugccucugaccuauggccucugcgaccguggaugcaaccuugggcgggggacucaguucucugacauuucagagucuacaaaagcaggagguaaagaaucuacaccaacgucuggaagggcagcggccagagaacaagagcaagaaccgcuacaagaacauucuucccugugagcgccagcagcccugcccgcccucacugccucccauagacucccaccccaccccguccccacuggccagcagagcucuccucccccaggaggccucuucuuuaguuccuaagagccucccuacaacuaccaggcaguaauucccacccugccacgccuuggccaugaagccucugcucccauccuagacacauuuaucccugcccgcugcccuaucuaugagucuguagcucuggggacaagaacaucugucggcuugggaaaggucugccccagggaguggcccaagcuguucguucucuauucaugccaguugaccacagccgagugauccugcagggacgugacaguaacaucccaggcucugacuacaucaaugccaacuacgugaagguguguugggugaccuaggugggaacaggugcugaucucugagagcucccugugucuugguuacauaugccucugggguuagaucugaucucuuaugugggggugauggugggugguacaggcacacccaaagcccagggauucacuguccuugguugggucucuuucugcuugcacccagaaccagcugcuagguccagaugagaacucuaagaccuacaucgccagccagggcugucuggaugccacagucaaugacuucuggcagauggcuuggcaggagaacacucgugucaucgucaugacuaccagagagguggagaaaggccggguagggcaaagccccaacuuccugaccccuacauuuucuuccuugguccuuguucaauaccauacacaaguaagaucaggggcucgugagacggcucagaggguuaaacgaguuugcugccaagccugauaucaugagugcaauccuugggacccacaugguagaagggggaacugacuucugcaauguagccucugaucugacuguuacaugcaugccauaacacacguguauccauacacagaaguaaaucuaaguuuaugggucuauacgccauauacacauacauacacacacuauacacacacauacauacacauaauacacacacauacacacaacacacauacauacacauacacacacauacauauacauacacagauauacacauauacacauauauacacacacacacacacacauacacaauuaaauguaauucuuuuuuuuuuuuuuuuuuuuuaaauuuauuuauuauauguaaguacacuguagcugucuucagacacuccagaagagggcgucagaucucguuacggaugguugugagccaccaugugguugcugggauuugaacuccggaccuucggaagagcagucgggugcucuuacccacugagccaucucaccagcccaaauguaauucuuuuaagggcaagaucagaugccaauauagaauaggacaucaaugacaaaggcccagugcauguugggaaacuaaggccugagauagucuccacucuauuccaugacuccuagacacccagcccuccugagugcucagcugugaugacauagcccaacggcagagcacuuggccagggugaacccugguuuucauccucaacuccacucuuuagugugugccagggcaagcauuccucacccacccucccaugcccccguccucucugccucuuaccugaguuugagccacagcguguuagucaguuucagcggucacugaauggauuacacgguaagauggcugaucagauccuaccuagccugaggccaggucccagggcugaucugagccgcucauccguucuuuuaacaagcguccucaggucagggauggggagaaggcucagugguuaagaauuugccaugaaagugugagguugggaguuuggauccucagaaacccugugcguucugggugucggaguguguacaccggcaauuccagcuuuggaaggaggguacaggggacucccagagcaagcuggccugcaagauuugcuguauuggugagcucuggguuugaugagacaguaccucaauacgguggaagagugauggaggaugacgcccaacauuguccuuaugccuucaugugcacacuguccccccauguauguaugugucuguacacacaugcacaccaucccauguauguaucgauacacacaugcauaacauccucucaugaauguaucuauacacacaugcccaccguccuccauguauguaucuauacacacaugcucaccauccuccauguauguaucuauacacacaugcccaccauccuccauguauguaucuauacacacaugcacaccaucguccauguauguaucuauauacaaaugcauaccacccuuccauguauguauuuauacauacaugcacaccaucccucaugaauguaucugcacacacaugcacaccaucccuucauguauguauguauguauguauguauguauauacacaugcauaccacccuuccauguauguaucugcacacacauguacaccauccccucaugaauguaucuauacacacaugcacaccauccuucaugaauguauuuguacacacaugcacaccaucccucaugaauguaucuauacacacaagcacaccauucuauguauguaucuauacacacaugcacaccucccccccauguauauaaacauucaaaaacaguauucaggucuaugucuaggggcccagaaggagccccagagccccgccucugugccuuacuguuucucauucucuuuucagaacaaaugugucccauacuggcccgaggugggcacucagcgugucuauggucucuacucugugaccaacaguagggagcaugacacagcagaauacaaacugcgaacauuacagaucuccccacuagacaaugugaguguccccaagccucgcacauuaauguauuuucuagucuggggggugggggcagggaggacaaggauauuguguggaagcagcagacauuaccucuuuguccuuggccuagggggaccugguucgggagauauggcacuaccaguaccugagcuggccugaccaugggguucccagugagccuggggguguccucagcuuucuggaucagaucaaccagcgacaggaaaguuugccucaugcagggcccaucauugugcauugcaggugagcauaauguggaguuaguguaaaaagaaccuagcggcugggggcuacaggaacuguggcuaagagguuaggagcucugagccgcuccuccagaggaccuggcuugauucccagcaccugcaaagggacucacacccuucuguaguuucagucccaggggauccaacaccaucugauagccuaccagggcacugugugcucauggcguacuaacacauaugcaggcccaacacccacacauguaaaguuaaacugaccguugaggaacgaugcugagucagcacugucaguugcugguggcagcgaggauagggacucaucuaaaacuucccccgacgccagcuucugggcucccucauugcucccggccuacccugcaggccuggucacucucagccagcuucuucacagcuuccguccggggucagugugggcccuccaccuuccccauugccaucuauggcucuguggcuagguaagaggugguuggccgauagguuagcguggggagaggugcuaaaaugagguggccuugccuugauugguggggggcgacaaguaaggggucuuggacagaggacuugcuuguuaccagcugugugaccuuaggugaggcacuuaacuucugaccuuggguuucucuucccacuacucauggcuggggauaguggccuaagccuauaguccuagcauuuggguguuggagacaggagaaucaugaauucucaucaauacaaggaagaauugucuaguuuuuuuuuuugcuuucccaccucccuccucccuagacagggcuucucuguguguguaacagcccuggcuguccuggaagucaccuuuguagacucauaggcuggccuugaacucacagagaucugccucccuagugcugggauuaaagaccuugucuuuuuuuuuuuuuuuaaguuucuguguuuguaugucucuguguguaucugugcauguguguuucugugugugugagccauugauggcuccuuacguccaacauggggaaacaggaagcaguuuaguccucuuccuauucuguccuucuaauaccaggccugugaucgcuucagacuccuccuuguucccauuaaugacugaccugcagcugggcuggaaguaccccucucgcaaugucuuaggggccaagcccugcccucugccaucuuggggcggcacauccccaaaaacccgucuggcaccccucccuauucacguacuucuugaaauccccacggccuuuauuuagaaaucacaggaaggaagugguguggggguguuauuuuugacaaucuggguuugaaauucgacagcuuagcuuguggcaccagugguauggaccgggcuguagguggguuuggggucugcaccaacugcuugcccaggggugguggaggaggaccugggcaaagggagaccugccauggcaccuucuccacuguguguguguccugggauagcccuuaccuuuccaccagguugaagaaaagagaaaucaaguuccacagagaggaagguuaaaugucacucuuugucucugucugucugucugucuguguugcuggggauggaaccacagggccuucaacaugcuaaguacaugcuuuaccacugagccacccccuaagccaaauguaacucugugucuguguguguguguguuacguaugucucuacgggucucaguggccuggaacuugcuagguagaccaggcuagccuugaauucacagaaguccacugugucugccuccuagugcugggauuaacagagugcaccaccacgcccggcuuccaccuuacuuuuugagagaggguuucucacugaacuugaagguuaucacuucagcuagguuggcugccagggagcugucucuaccuccugucauccccugguggugugguuacgugaccacucugccuggccuuuuuuuuuuuuuuuccauaagcaugcuugcuugcacgauaaucauugaauaacuuuuucuuucuuucuuucuuucuuucuuucuuucuuucuuucuuucuuucuuucuuucuuuccuucucuuucuuucuuuccuucuuucucuuucuuucuuucuuucuuucuuucuuucuuucuuucuuucuuucuuucuuucuuucuuucuuucuuucuuucuuucuuucuuuguaaagacuggguuucucuguguagccuuggcugaccuggaacuugcuguguagaauagaauaagcuggccuugaaccucugccucccaagugcuggaauuaaagggguacagcaccauuuuuaaagaguuacucccucuugaaaaaccaaaaaaaaaaaaaaaaaguucggggaggggcggugguggagugggagaagcccagguauccgaggaaaggcaggacagugguggcagguuguggaucuuuuuuuuuuuuuugguuuuucgagacaggguuucucuguauagcccuggcuguccuggaacucacuuuguagaccaggcuggccucgaacucagaaauccaccugccucugccucccaagugcugggauuaaaggcauguuccaccacuguccagccacagguuguggaucuuguuucuccaagagacgaggacagccaucauuugugaggagugggggacagaugcuuggaaggagggaaaaggugucugcaccucaaaacaggcccuggcuuguuuauccugugacugggcagaaacauggggacagagcgaggcaaaccccuccuucacugcccuagugaccucuauacacacacacaugcacacacacacacaccugccucgucuagugcugggguggaccucgagacucaccauuuccuggggagggccaggccucugauggcagucccuugucucugcagcgcuggcaucggccgcacgggcaccaucaucgucauugauaugcuuauggaaagcaucuccaccaagggugaggagcccuggggagugugugugggugugagaggggggcaagccaucccuuggccuuugucuacccugaaguuccccugccacccuuguccagggcuagacugugacauugauauccagaagaccauccagaugguacgagcacagcgcuccggcauggugcagaccgaggcccaguacaaguuuauuuacguggccauugcccaguucaucgaaacgaccaagaagaaacuggagaucauacaaguguguccggaguggggcuggugggugguaggggagugugggcaucaccuaguccugcugguaccaccauccucccaccgcaccuuugcccacagucccagaagggccaggagucggaguaugggaauaucacguacccucccgcugugaggagugcccacgccaaagccucgcguacuuccuccaagugagugguucuguuugccuuccuaggcucuaucccccacugcccagcccuaacuguccuuuucuggaguggauuaguguggaggcuagagaaacccugguucaaggucaaguuucuuccuauucccucuguucuuaaauuuucccugaagugcccguuaggaccccacgugggcccgugcuauggacuugugugagaagccgucucuguccccgggccauguggguccacuguacagagugagcaggcucucuuguucuccuggcuucacauaccgagagucucagaggggcugcuggugcugggucacccugcacagucuccagaugccuccuguccccucccaaccccaggcacaaggaggagguguacgaaaacgugcauagcaagagcaagaaggaagagaaaguaaagaagcagcggucggcagacaaggagaagaacaaagguucucucaagaggaagugaucugggcauucgucugcagguggccauggugcggccccuucuguguguucuuucucucccugcccccauuuccccaacuucaguucagacgugcgugcauggcacggucacagucucacgcuacccugcuagggugucccuagcucuuguauccccuucccagacaaccuuugauccacuuccucucuuuuauuugcagcaucagccuugaucccugcagaggcuuccacccgauagacugagaccuguggcccucaccagacccuaggaccacccccaucuucuuguaauuuaagugacuguggucaucugaaucuguauauagcccggcaaguccccagggagagccgggcccuucuauucuuguaaauaaauucccuggaccacuguguauugccucca

SEQ ID NO: 3376 - RNA, 17544 nt, Mus musculus
agguuuagucacaaguacauuuauuauccucuggaacacaagggccgccuccacagcagcagcacacauacgagaaccaaucucaggaggcugccacacugcuuccagaagcaggcccauggggcggcagugucauggguggcaggaacagggccuucagcuugccugacaggcuggcaaucucgggauccugggcuucauaagacuugaccaggcgggcaaacuuaaggacaccugcaaucagaagcaagucaagccacacugcuggggaccaguguguggaggcagccaagggggcucccuagagcagaagaucuccuuucgucaggcagccaucugcaauagaggacaauucacccccauguccugcauggcuucaaccaaccccgccccgguuuucacuaggcacaacuggaugcaauauaaaaaagcccuaaaacagcugggccugcccuuaaucccagcacucgggaggcagagguaggugggucucuugaguucgaggccugccuggucuacagauugaguuccaagauagccagggcuacacagagaaacccugucucaaacaaacaaacaaaaaauuaaaaagcauuauguuuucagucucgggugaaccacguucagcagcuuagccucaagcagccugauuugaaagagacucccugguaguccuggcuagcuaacaaacaaacaaacaaacaaacaaacacaaaauuaauaaacaacuguccuugggaagagagggcucaaccugccacaccaaaccuauuagccaaaaggcagacaagaaagaguucagguacacgagagaguucagguuagagcugggcccagugacucaagccugucacuuacucaaaaggcugagaaaggugggucucugguucaaggccauucugggcaacuuacugcgauccugacucggggagagcugggaaguucgagggccauggagaaacacuugccuauguagggcuuuggacucuagagccagaacuuuuguuugguggguuuuuguuuuuucaagacaggguuuucuuuguauagccauggcuacccuggaacuccucacccuacauaccaggcuggccuugaacucagagaccugccugccucugcuucucaaaugcugggaugaaaggccacuguggccaugccuggcuucaagagccauaacuuuucaggcggggcuuaagucuagucccugaacugugaguggcaauguuugaugugacugccgcccuguggcgagaaaaagaucgaucgggggggggggggggcaucaucaugcgucccacccccaguccauuccuuugccaagcccugugggacccaccuuccccgucgcagcugaagccauaggcuuuaauaaccucuuguuggaucuguguggcuacgggcagcacaaauugcagcaucuugcccauaucguugcacgcauugucucuagccucguccaugcgcacggcauucucuggggccgagaacgcuugaaucaccuccgccaggaccacugcgagacggaagcaucccagagagguccgcggaggacggcgggcgagcccagaggagggaagaggcagggaauuagugggccgaggccugcaagcaacccgauaagcuuguccucccaacccuucgcccuaaugggcaagggccccacuuggagaggcaaagaauaguaucgcgcccuccccccagaagacggcccacacccagacuaggcucuuuccucacccuuggccugcuccgcgcucagggccgcgggcugagccgaggcggacgccauagaacgccacucggugcuugaguagugggaacacagaagagauccggagaacccugcagccagccaccucccccacggaugcaggccagaggaggcagaaaggaagcgggaccgcacgaggcggaagucucagagcguggcucuagcacauacgcguuuccuaggaaaccagagaaggaucaaagccccucucacacaccggggagcggggaagagaacuguuuugcuuucauuguagaccagugaaauugggagggguuuuccgaccgaagucagaaaaccugcuagacaaauucuaaaagagcuguaacacuugcggaagugcgucuguagcgagccagggaaggacaucaacuccacuuucgaugagggugagaucaaggugccauuuccacaccccuccacugauaugugaaucacaaagcacaguuccuuauucgguucgauaaacaauauucuaaaagacuauuaaaaccgcucguuucuugaguuugugaccgcuuguaaaggcuaugcaaaugagucagugcugauuggcugaaaacagccaaucacagcuccuauguuguuaaaaaaaaaaaaagagcuucgcgagauuaaaggcuuggagcuaaagccgaagugaaucggacuuaaguaguggcaggcgauguggcccgaugucuuguagucucauccuuacaaguuccccacacugcaaagacucuggaacaucaggcccgaccgggcauagcgccacauuucugugauaccagcacaaaagcugagaaguucaaggccagcuugggcuccauggcccugcuucauuaaaaauagagggguugcaaagauggcucacccugcuuggcaauuccuaacugcccuaacuccaagcuacagggacccaacagcuucuggucucuuuugaggccuugcauucauaagcgcagacaugagcucauacaccuaacuauuaguaaaucuuuuacaaauacuaaucuuauuggccuccauguuauacaccuuuaacuguuucaaaucauaaacuaugcugagaagggauucagaucucugaaacugucucuggagcacucugguggcacauuaugucagugauguacuuccaagggcugaguaggucuuagauuugcuuaugcuugcugugcgccuauucuugcucugaacggccucaggagccugaacuccccaaucuaaaggucuaggacagggcaccccauaaguauagcugagcauccaagaucaagaagagccuugucagguuaaagagauggcucaggggguuaagagcacagacugcucuuccagguguccugaguucaauucccagcaaccacuugguggcucacaaccaucuguaaugggauuugauauucucuucugguaugcaugaagacucuuguaaaauaaaugaguaauaaaaaagagccuuguccaacuccuaaguuuccauaagaaaaccccauucaucccuucccacuuccccuacaacaaccagaccucucucccuacccaccccaacacccuacccacugcaaccacccucccccaaauaaaaaacacgucacagacauauuccuggggaacugugaggauguuuuuguuugguugguuuuggucaggauguuuuuuaaagagcaucauauagauauuuauauauauaaauuauuaaugugggacggguaagggcacauaucgccgagggagggggugcacacacagggauggggcggggcagcacacaaugcuacgcaaaacagccacaucuaacagaugaaaaaaaucacaccaauggguuaggggaggggcaguggccaccaaggauucggcauagaggagaagaaaagcaggggauaggaggagggaccugguccaagauacugugcacuuucugcccccacccuugccacuucccaccucugcacacaaccccgggcccugaccuugucugucccuucuucccucccucccucuacccagcugcaggagcucugcaagcgggcagcacccucuccucggcugggggugggguggggucaaaagguuggggugguccuccaaggucuggaugaaggagcagugggugcugucuggaucgcagcucuacagcggcuugucacucuccuucuucaggugacuagauaagaggcaaugcagagaugagacugagaaagggggcuuccccucccaagggcucgguguccuguuggaccaugcccagaacccacuuccccuugugcucugggggcaaccuggaguaccuguaguagucuuccugggcagguaguggcacgcugugcaaugggugaugagcauguagccacugcugcuguuccagcgccaagcgcugcagcucagcugacugcgcgugcauggccugcagcugaugagccgcugacauuggagcagaaagggaggccggcaggucccgguaaggggcagcugugagaagaaggcacaggaguaaaugacugcuggauggggacagucagccaacguuccagacagacagaggaagcugaggcuaaaaugcaaaguuacagcaccuagccuaugcucuaucugucggccugugguggaacggaacgagcccuagcucuugaggcuccuuuagaagggaacgagcccuagcucuugaggcuccuuuagaagggccucaggucuccguuucuaucuuagcugcucacaucucucuccaaacuccauuuggcccuucuacccccccgaguuccucuguucuggucuucccucacguacgccuccccuccuccauccuuaccaaaaagcuggugacgaagaacuucguucucgugcagagggugaggaagaaggggguuggggagggucccagcuggguaggggauccggguaaggugagacccugaggccagggggucaaugagagggugcaccgaggcagaggcuggagggcagagaagaggaaggugucaccaggaggcaggguuggggacaacuaugcacugggguggagggaucuagcuugugaagagacagacacaaggauccaaagcagaaccaaggugggagagaggagcuagacccucugagaugacagagcagcuggagaagagacacggaagacugaagacaggauauuacagagcagagaagcaaagaaaagacuggacuccucagaaaagaugaaggguaaguuuaggaaacacuucuuucuuaaguuuaagaaauguaucagggagaacuauuaggagcuggugugaacaugagcagacugugaugccuaaaaaugcccggaguugaauugcuuaaggccagccgggcaguguucugggcuauaaacuacaguauauaaaacaguauauaagcucauuauugccuauggcuaaguuucauggacuucccuaaaaaguucuaaaucuacagaugggcagaaauacagaagacuccgagauguaaggaaaaggagacgcugacaccaaacaagcucuguauacagagaaacaagcacaucgaugugugaagggcacggagaggguaugaacauaagaaaggaaggugguucuuccaaaggcuccauguugaucuguuaucaaggauagaggggcugggcuacgagcagguacgagacagugugaagacgagcagguacgagacagugugacgggaagccaaggaagcaaacacuagaacggcaaucucaggagaugggaguucuggccagaagaagggaagaacguuauuucacacuuccaaguaggaaacagggucuuaccugcguggauagcauccugcuggugcaggugaaggugagaguggaugugggagugcugguggugauggggagucacguugagcaucugcagccgggcuaguggaucauugcccagggcugccacccuuucugcaugcugccuuucagcugccaaccgcucagcauaagacaugucaggacgcaaggcuggcccagcugccagcgcuagccguucucguuccaggggccccaggcucggaugaaaagggaaaggaugcaggccagguggcccgggcuguagagccaggcccccgugucgggggaagggauccaggccuggcccgggaaccccauguagggguuccagcucacuagguuucaccucaaagccaggcuugagccggucacggaggucacguucacgggcuucccgcucccguucucgggcagcugggucgcugcuguacagggcugggacauuguaacccagaagccccggguccacugcccccaagggcacauagaaugggugguugcgauugccaggagacaugacaugaggucgggcguauucacugagagugcgcaaggccggaguaucaggacccagguaagggggcacuguagccacagcgcugccaggcucaaagggaggccgauggggcacuggacccagagaugggcacuccacuggagcacggcccuccugggccaguuucuguagaaaucagacagaaaauggagucaaaauaacagacaugggcacaguuacccgccccaggcugcccaucggucucagcaguccauugcacccucccccagccuggaaaccugagcuuuuccgggcugcggcggcuccucccguccaccagguggcggagcgaccggcggcguacgccggggcccgggagaggcgcggcgcaccuugugacgcacucaccacacugcgcuccagcucgcgcucuuucucgcgcucgcgcuccuuuucgcguucccgcucgcgcucgcgcucuuucuccucgcgcgcgcgcugcucggccucgcgccgcacuuucuccaccagguccgcgcgcuucuuggccagcuuggagcccuccagcggcacgaaguacaggucgcugcgcgcgcacgaguugaagccgcgguccaagugcuuauugaaccugccgggcgggcgcggaccugugagccucaaaggcagccaguccccaccaguuugucgcucgcuaaucccggcagcacgccggccacgaacgcagagcccccuccgucugcaccuuacagacccacccucccccaagcccaccccagggcggcucaccuggcugacuggcuggcauggcugggcacguccaccaccuugggagggggcgaggggcugcgggccggaggcaccggacucucgggagguucauacucuuccgccggcuccuguuugaucugcguggcggucaggggcggcccuguagucggggccgcagguggcggaggcagagaugacaaacuugaaggccccgcggguggcaggggccccggccccacggucggugaaccugguuugaaggucccugggccugcuggcggagaggugccucgauagccggguggggucccuguucugaaggaggguggugaccccgguuuguauccaggcgggguggcugucuuguaggacccuggggauggggcucucuugcuguacugagggggcccagguggcgaagcuguuuuguagccugcuggcgaggaagccacgguggcgaugacaguggaaaggguagcugaggagguggugacuggagggacuggugggaagggguaggaugcuccuugggggcccugggaugaagaggggugugaacaugaauaggaggcuugagaggaagacccggaagaguuggaagaagaaacugggggaccauugggaccugcuugguuauaggacaccuggccaugagguggaggcaggugugcuggcccugggggguagggccuuaaagaccccagggagggugacauguuguaagggugugcaugaugggaguuacugcucucuagagggugaggauacgcuccggguggagggggcccagaguuuccaugaugauguuguugcuguggcugcugcuggugauggugauguguaggggcugcugggugggcuguagauugacccccaguaggagggaaagggccuggauggguguuguuguuggccaagaggcggccauagggaggaggaggagguggacccuggcuccacacagcuugggaugggagagaaggcuggguguacuuggguggcugauuagagacagacauacuaguugguggggggaaggaaugaggauaacugggcagggccugggaagcaggguacugggaggcagaggaggaggaggaacuagaagaggcugcggcagagcuacuggaggaugaauauggauaucgcauuggaggcccaggggcagaggaagaagcugggggcaaaggguggggagaaggggccaggguuggacccuucucugggccaggaggaaguccacucaugcccugccccauggcauggggagagggcagaugcccagggauuggcugagcccccaugccaggaggagaggcugaggcauuguugaggggucucagggcagguggaggaggcagguuuggugucacaugggggaaagaagcuggugguggugcagaagguaagcucccaccacccacuggagcacuggguggcuuugcuggaggagcaccacuggccccagaacuugauauuggaauugggguagugggugggggguguugcuugccuccgcuaggggcacccacugaggaggcagcggcucccccuuugggacccaugggggguccagauaaaacaccuccacuagcauucccaggguagagcugugggugugugggaggagcuccagguggugggcccuggaauaaucucgauguggggggcuccaucggagcaugauauccaguaggcggcacagaaggaugagguucaaagccagacucuggcugucggggagugcugucuggugguggaggggaaggagggaagaguggaggugggugguaggggcgggcggggcccugggacaggccagaggaugaguccgagucauuuuccacgcugcccgggcuguagaugcugggggaugugcuucgguuguccuggucuauaucucuagggucgcugcugccgucaucguuaaugcugcgcccauccaagcuguccagauccgagggagacugcgggcgagggagcuccugcugucagggaaaauggcuggauuuccucuuuuccuuccccgcuucccaguuauuuccuccuccuccucucaggacugcugugccgcagugugaugugauggggaggcucgcucaaggcgcccgucaccuaguaccuccuucucccacaucucggcugcucccuaauagucaguguauuuccuuccuuguccuagaccuucaggcagucccuucacagcugacugcagacccucgcuaccucaugugcacccucucaucucagguauucuuuggcuaucuacaaaugauuggucuaucugucucuuucucuccuucucucucucucuuuuuuuggggguuuuucgagacaggguuucucuguauagcccuggcuguccugacacucuguaggccaggcuggccuugaacucagaaaucugccugcuucugccucccgagugcugggaugugugugccaccacacccggcucucucucuccucaagauuuguuuuuauuuuaugugcauugguguuuuaccugcauguaugacugcaugaggguguuggauucccuaggaacuggagcuacauacaguugugagccaccauguguguauuaggaauugaacccagguccucuagaacagcagccagugugcccaacugaagaaccauuucuccaagugcccccucaccuucuauuuuaaagacugugagcugggcgugguggggcacgccuuuaaucccagcacuuaggaggcagaggcaggcggauuucugacuucgaagccaggcuggucuacagaaugaguuccaggacagccagggccacacaaagaaaccuugucucaaaaaaccaaccccaccccucagaaaaaucaugguuauccugugauauauggugauuuggauaucagccucugucuuucuuuguuuuguuuuguuuuucaagacaggguuucucuauauagcucuggcuguccuggaacucacuuuguagaccaggcuggccuugaacucagaaauccaccugccucuaccucccaaaugcugggauuaaaggcgugugccaccacugccuggcuaacacauacuguucuuacuaaaguuucaagagcucuccacuguauuauaggcaggaccacucaaauagguaaugggacaggauuuuuuaucuaagcagagagcaagcgggaauggugcucaagagaaguuugcagaaagaacagucagaacacagggcacaacggcugcaaggucucucaccucgguuuuggucuuuuugggcgcacuggucuccucgcucucacucucugagaucuccucgcuccggcccugcuugcuggccuuuggggcagagggcuccucuauccgggccuucuguuagagagaacauuucuucuaucucaagucucugccggaccucaaccccaccccaaacaccccucagcugcggugcugugcauccugaggggaccagaggacagaauaccuuggcugucugccuggacuucucagcuuugccaucacugcuggaugugcugaccccuccaggggaggcccggccccuugaucucagcucuucccggggcccgggggccucuuucuuccguccacuccucauugacaucugagagcgggaugguacagguaauguuuucacagggcccuaacuuuaggcucuaugcugccuguguucuccgcuccaagcccuuccuccuggcuuccccgccccugcccuuggucugccauaccgcuuaggauaguuucuacucaccgagucuuuauucugucgugucuucauucuucaggcuguggagaccccauucuccucugccugggcagcugaauacagaaacgagucugcuguaccccaagcuccccacagcuguggccugggaagcuggcagcaguuguaggcacgugguacuugcaggguguuuucagugaaucuguuagggaaaaacaucagcgucuucauaucguaacagaaacaguggggccgaguaaccagcgugaguugggaggcugggacuugcuccacaggcuacaucagcuaagggaaggaaauucuuacaguaucaucucuuucauaucuaaggaacgcagaauauccagagguaccuaugagccccaaccuaacaaacagcaggacuuuacccuccacaagcccuaaagaguauuuguggccaccauggugugguggcagaugccuguaaugccagcacucagaagacuguaucaugggcaucacacacucaaggccagccuaaacuaaacagcaaacuccugucuaaaagccaaaacaaaacauuugucuacucaugaguuccagagccuuccaaauuccaaugaagcacaaagaaaugagauucaagcgcugguuuacugaguaucuccugugucaagcccuuuacauacaauuucaguaacaucuccaacauacucuaaagugggcauaagcaagggaacugaggcucaaagaccgacaaugaccugccccaccuuccaaagggaagaacaaugacccuacaacgaagccagagccaagcccuccgcaauccgacuucaaaggccacgcuugcucuucuaaacuuuccucagaaguaggggagaauucuaagaagaccuagaucagucacacagauaagaaucuuuucacaucagaugaugucagaagaacgucccaucuacaauaccgagcaacacagccucaccaacaucaacuccaaaucugggcaucuucaaaacugcagaaccuuuuagacagccucaagaucugguaguuggccuuuuccacuuagacgguuuuuguccauacauuuagccaaacuggccuaacaguauuugggaagaaaaauuccagaaaguuccaaacaaaauuugaaucugcuacauggccaccaccuugcuccaccuuuaagaaugaaugauaugcugggugugguggcacacuccuuuaaccccagcacucgggagguagaggcaggcggauuucugaguucgaggccagccuggucuagagugaguuccaggacagccagggcuacacagaggaaacccugucucgaacaacaacaacaaaaagaaugaaugauauguggguccaaguugcuguaaugucccaccuuuucacaaacccuaagucccucuccagugucugccauucagccacucuucaccuacuaugcaugguaugucuacaacgguuugcaaccucagcuuugaaggcgucaacuuuaucaaacauuuacaugguauugguuacuauacaugaucuacagaugaucuaaagaacauggaagagugugugcaggcauauauagacacugggacuugaguauguguucauuuugguguguguguaauauacuagaacaaaucucccagauaucaagggaugacuagauugguguuuccugugcuuaaaggaugucaaaacauucacauuauccacacucaaaauauacugauugacugaggggagaggugugcagaugcuaugauguguggaggucagaggucaacuuguaagagucaguucuccccucucaccccgugggacccaggggucaaacuccaguugucagacuuuauggcaagugccuuuacccagugagccaucucaccagcccaacucaauuuuuugagacagaguuucucuguauagaccaagcuguccuccaacucaagagauccaccugccucugucagugcuaggauuaaagacaugcuccaccacagccuagcccaacucaaaauauuuuauuuuauuuuuuaaagauuuauuuuauuuaugaguacacuguagcugucuucagacacaccagaagaaggcaucagaucccauuacagacggggucaugagccaccaugugauugcugggaauugaacucaggaccucuggaagagcagucagugcucuuaaccacugagccaucucuccagcccucaaaauauuuuaaaacuacaaagagacaaagugucagugaacauagaaugcagauuuacagauuugaagccuguacucucacucggcaccaacagccuaucuaucuguaucuagcaguacaaauacggauaucaucaucugugucuccacagccagccauucucaucuguacuucagccuccacucccccagugcugggauuacaggcuuaccugguguugagcacugagccagggccucaagagugccaggcuagcacacugaacuguauuucuaguugcuaagagccaaacuacuucauaauacuacccauaauuuuuuugaguuuaauuuucuauguaucaacguuugccugaauguaugugugccaugugugugccugguuccugugggggucagaaaaggacagcagauucauuggaaguagaguuaggaugugugcacuaucaugugggugcugaggacaaaaccugcauccucugacugagcaacaagugcucuaaacaacugagccaccucuccgguccccucucacucuacucucucucucuaucuuuaccuccuucucugaaacauauagaccaagcugggcuugaacucacagauaucugcuugccucugccuccugagagcaggagugugcacuaccaagccccagccuguaagauauuuuaagagugaaaaaugcuauugucauaguuuuccuuuuuauacuuucuccugaugucauguacagacauacggggucuugcccauaucugagacagaaucacccuaugcaccuuaugcaggcuacaaaugcagaaucuuccaucucaggcucggcaggagcgccucacccagucaaguguacuguugucaaaccacgugaaugucaguagaucuuuuugguuguuauuguuuuguguuuuugagacagggucucaagugcugaaauuacuggcauacccugggcuaagcagguuuuuuuaauuagcugggaaccuuggaaagaacagacucaguuuacccacucauucugaauuggcagguacagguuaaugacauuuuuacauguacuuucucuaaggaacacaaggugauuacucuuuguccaucaccccugggccauacugaggcaggcaaugaggaaccagugagucuaaccuuuccaggaaacuuaacuacuuauuccuaagggggcacaaaauggaugggacagagccccaaguccaaacuuucaacugaugcuuugcccugcaaacuaguguacuucaacuauagcuacaauuacacuuucuagauaguuuguggauugguuuuuaacagaguaugcauuaccagacacgggacgcauuccugaaauccagcacuugagaggugaaggcaggaccagccacucucggcaaauagcaaguucaaagccagucuaaguuucaugaaauccucucaacacauaaaacuacagauggaaaaacaagaggauggagaagaagcaaauguccaaagaacaguacugaacagaagagaguacgguaacaaggauaacagagaugaccaccuguggcuaguuuccuuaucaggaccccuagagccuagugacagucuccucucaucacagagccuggucaccaagcuaguuuggauccuaaaagacccaaaaggucaaaaauuacaacaaaauuuguuggagaacagagcaaucaccuucuuaccuuuuuuagucagcugaaaucugaaagaaaaacagucuucaauggggaagaaguuccugggaucggcagaagaaggaauggaacugggaagagguuggggucagaucguagguuaagucuaacacagguacagugggacucuaaaaccaacuggccacguggcgcuucaucuugccugucuaacacuuagacacuuagaaggcugucucugucuaacacuuagaagcaccuaccauguacaacaacacacauuugcccucaucaccuuauggcaaaaagaaagcaaggaagaccaaaacuuggaaggcagggaaauaagaaaucagaaaagaguccauggguaggcagagggaagaaaacuaagagaagugggugugggucagaggugagauuccgagaaggccuggguuagauccccagcaccuuauaaaacagggugugguccaggccugcaaucucaggacugcaaauagagggaaacucaaggucauuuccuuaggcagugaguucaaggacaguuuuggcuaaaagcccaucucaaaaacaacaaacagagauuacuacuaaaaccaaugaccugaguuggaccauggaacccacaugguagaagagaaccaacucaagucacgcucugaccugcacaugugcacuguagcacacacacaaaauaaauacauacguauaauuaaauuuuuaaaaaguaaggagcaaauaugacaggaaugucagaaaaugaccaugucacagacuuccugggaagagcuuacaagauguauuccaggaucaccaaccaccccaaauccauucuagaccugccacauuaacaaucaggugaaaaugaccaagacauccauaaagcacagaggagcagauaaugcagccugguuagaacccaggucuguugcaggaacuagaggccaucucaucacaccaagaaggugaagcgcaaagacaagagaagugacuugcccaaggucacagagggacaucggucucccagcccccauuccagagcauccugcucugcucuaaccucucucauagccaucgccccugggccacccucacccagacaggcauggagagcuacgcuacauuuguagguucagaaaaaaaggccaaagaucaguugaaugaaagggucacccugagaacugacaaagaaggaagagagacccaaagaggaauucaaggagauaaaguaguuuaaagagucaaccauuuauaagacaauaagagugguagaggccgacagaaauugcccgcggugauguaacuugguuguuuuuuuuuuauuuuguuuuugguucuggagcucaaacccagggccuauuguaugcaugcuaggaaauaacacugcuacugagcuacccccagcccaagacaauauaguuugaacaacaacauuuucaucuucgcaccauacccagguagaggcuugcaggaaugaccugcaagcaacaggguuacuuguuccaauagacuucuggaggagaagggaugccuccuuaggaaacccuacuuggggcaacaccagaaacaucucccggagacccaccaaggacaaagcuacaggcugagagaggcccaaucuacauacugaauccccaccuauuggacuucccacugucucacuaccauggcaacaaaauggauaaaaaaaaaaagugccccccaagagaccaucccagggguccaucuggcagccacuauuaccaccuuaguugccagagcaacuccaaccuuucaggaaagggagcuuuaggguaaccuaccccaggcacaaagagaucucugagaucaaggcaguaaggaaguccuccuaugggacagccaaugcucugggggugaggguggaggucacaauuccuuggaaugccuauaugauugcccaaucuucucuucuuucccauccucccaaccuucccaauucucccuucaguaucccugccuuucuuauucguguuaggaggacucacacuaccaagacucagugcccccccuucacgaaguaacuaggucugggauuaggaaaacggggucagaggugaccaggauugggggaaagaaaacugagucacaaaagauauggccuucccauuuccaccccaaaaaacgucggucuucucaaagcugggccucucccgguucaucuccauuccccccagguucaaucccccgucucggcagcuacaacccucauuuuaccaccuaccacaccccuuucccuguucccaagacccgcaaccuggaaacccggugcugggccugugggguuacuggagccuucacgccccaccucgcugccaucucuccgauccguccugccuucuccgcgaaccacccgcacagcaucccccgguuuaccuccgccaagucuccaccucggcguuccuccccuuuaggcucugguccuggcgacgcucggccccgucagcccuccucccaaaacccuccuccccccaccucccgagcucgcgacucccaggcccgcgucccuccuccgggcggccccacccccugaguccccagccucgggcccggucgugcccgcaaugagggaacgcgaccgggaaaauaacaaauggaggcggcggcgggaggggggaccgggaggggugggggcggggagccgcgggccggaacggggcggcccgggccggcggcagcggaccuuaccugcgagcagcucgggacggcuggcuggcugcgagugcggucgggcuccggcgccucccggggacggcggcggccacuccccgccccuccuuacagcgcggcuucagucgcugccgcggcggcggcggcggcggccccggcccccccggagggcggcccccaugcccggcuccccgcgcagccccgaucggcuucucgcgcuccucgcccgcccucccgcccggaacgcgccgcccgcgcccgcccccgccgcaccgcccgccuccgcccgcacucgcggucccggcgaggcccgcgacccccgacccucccgccgcuggugccgcgcgccccuagcccgccccgaggccugccaccccgaaacgcguccuggcccgaggccccggucgggcgcggggcugcgggcggacggacaggcugggcggcgc

SEQ ID NO: 3377 - RNA, 9631 nt, Mus musculus
cguuccccaccaccacccgcgcucguacaugcgucuccgccugcagcucuugacucaucggggcccccgggucacaugcgcccucccggcucuauaggcgccgcccccugcccaccccccgcccgcgcugggagccgcagccaccgccacuccugcucucucugcgccgccgccgucaccaccgccacugccaccgccaccgccgccaacgccaccgacugagucugcaguccucgaggugaggcccguaucgggccgcauccccuuacucgcuccuugccgccuccacuccccguuguccugggcuuagcgacccgggcgggugacgcugcauaccugacugucaccugccuucccuggcacccuccaucucuggccuucccggacagcucccggcuuucuggcugucaccuccuccugguuuagguaccagcuuucugcauccgcuucucuaacugcacgguuccacccucgccugccccucuccccgcgccgguauucgucuaggguccugccgauuuguuuccuaaguucgaugucuccacaggagaugguuguuauccuggcacguccuuuuuuucuuuugcguuugcgaagauacccucucacccuuccuugacugccucagacuugcucuagacucguccuuuggucccuccuucucuuccccucucucugacauuucauuuucuccgauguuugggggagggauaggaggaguggggaauuuguccggggguagaaaagcgaugggucuaccucaucauuccccaccguagccucuagggacuggaggccuggucccaggacgcuguccccagacuccucuugaaaugaggaacucguguuugggagagaggugacgaccccggaguguuuucuagaccuuguguauaugggcugucaaguuggggauccaccugcccagacaaccccucuucuuucuguuccaagauccaagggaaaaaaugccagucuggcagccaucccgccuggggaagucuaggggaaccccacuggucggugaagcugcugaggggcgaagaaaucgcugcuugccccuccccucaucacugcgguguucucccaucuugucaugagauguacuccgccccuacugcagugaccuccccuuccucacugcauugaccuucuccucucuccacggggaagggagaaccccuucuacagugccugauugcagcccgcuccuccccacccccuacccacugcaguaaccucuuugccagcccucccagccucuggccccucccacuggccucaggcuccacccuucuaagccucuuaucuuucuccuuccuccacuuccacccaaggagaucccagccaucaugucuauagagaagauuugggcccgagagaucuuggacucccgugggaaucccaccguggagguggaucucuauacugccaaaggugaugggcagagcauggacuguccuuagcuccuacuucccccuaugcugggucaaauccaggggcuguggggugcuaggccagguucccaaggcuggauuguggagucugaucuuccuuggcucguggauucaggcucggugagucuauguucuaguucagcgugagaaaggcccugccagugugagcacaggagcacgcaugcucugccuagcauagcccuguuucugaggccucccacuugugcuuaugaggccucaguugggcggacaagguggcccggcucgugcagauggcacggugucugugagagugcauguaucuguguguagugucagggaaccuuguggauguggcaggcaagaguuuagacuagaaggcucagagaauccuaggccccaaaggguccucccuccuuccucacggcaugucuucuuccaggucuuuuccgggcugcaguccccaguggagccuccaccggcaucuaugaggcccuggaacuaagggauggggacaaacagcguuacuuaggcaaaggugaugaacugcucuccucuccuaacaugccccaguccccugucccuccucacucuccacccccuccuccuggcuugaccagcccccuuuuccuuucucuagguguccugaaggcaguggaccacaucaacagcaggauugcaccagcccucaucagcucagugaggcccgcucuuuuggggguggggggugggggugguggcugcuacgacagaauccuaggagaaaucuuggauccagggauggacaaggggaggcaaaacaaacaaacaagcaagcaaaaaccaacaacccacaauccccccaaaccccaccccccauuccuuuuuuuuuuuuucagagcugaggacgaaacccagggccuugugcucuaccacugaguuaaauccccaaccccaaccccccacucuuuaggaauuguuuuuacacugcaagggugggaaaaauacugcuuacugcccccaacucccccgcacgaacucaagauuccaaaagcugacagggcagggaucuggugguccccugcucagacaugaggcuaugugaauaggggacccucugccuuuggguucaucucccaucuuggcucugcccucaggguaucuccgugguggagcaggagaaacuggacaaccugauguuggaacuggaugggacugagaauaaauguaagcaggggcugggcggggagggauagguaagcaggaggacugaggagccaugcuggggacacuuagacugucagagacuccccuccucccucacccaaagccgcacggcagugggagggggugacauuagacagaaggaagaacuucucaaagcuugaagacaggaguuggcaugagguagucuaagggauguuuaggaagaggcgaggccuucccuuucuugucaccucuguccccaacccccaacauuaguaguagaaaaugaauugcuguuggggggcgggagugggaggucuccuagguggaggcaggggcuacaagagagguggacauuuuuacucagugccuuccucugugccucccagccaaguuuggggccaaugccauccugggugugucccuggccguguguaaggcuggggcagcugagagggacuugccccucuaucgccacauugcucagcuagcugggaacuccgaccucauccugccugugccggugagcacuguacuugcccagccucucccaggggaggagggagcaugcaaccaggugagggaugagggaggaaggugaacaggcagcuaaggugaaaggaugggaacuugagaccugagccuggcaccugcgcaucucagguuggcauucucaggggcaggaggaaaaggcucugacucuccuguaacucugugacuccccaggccuuuaaugugaucaaugguggcucucaugcugggaacaaguuggccaugcaggaguucaugauccucccagugggugcugagagcuuucgggaugccaugcgacuuggggcagagguguaccacacccucaagggggucaucaaggacaaguauggcaaggaugccacuaacgugggggaugaaggcggcuuugcccccaauauccuggagaacagcgaaggugaggcccagagcccuuccuccagcucugagucucacgaugggaaagcuggcacuggcggguccugcaggguacuggugggagguccuugagccacugaaaaucuuaagagguagcaagcauucccuaggguggguucccaggccuuccaauuucacucauagaccuuggagcucggucuguuaccugcccauccaaaccuguuaguuagcauagguccucacuggacggcugagaauauugguaaguggucuggguaaagcccauuucauccuuuaaugccacggucuucauuagaugacguacaccaugcuccagggagguaauuccauauugguaccauccccuucccagccccuuggguaucaaggauuccuauauuuccugugcugcaggagaaccagaacuauaaagguagugguuaaaagccaagguacuagccaggcagugguggcgcaugccuuuaaucccagcaugugggaggcagaggcagaagaaucucugaguucaagaccagccuggucuacagagugaguuccaggacagccagggcuacacagugaaagcuguauugaaaacaaacaaacaaacaaauaaaaagugaaaguacuagguagggguguggcucagagguagagcaccugcucagccuguuugaggccaccacaccacauccaaauuuaugcacauacauguaagugcacacguauucauauacauucaugcagacucuggaaucagacuacuuguauuuauuugaauucugaagaguuauuggcugggaucuccaacacuugggagucugaagcauaaggguugccaugagcuuagagccugggcuacuugaaaccccgucuaaaaagagaaaagauaauaauaauaauaauaauaauaauaauaauaauaauaauaauaauuauuauuauuauuauuauuauuguuagggggcuggagagauggcuuagugguuaagagcaccgacugcucuucugaagguccugaguucaaaucccagcaaucacaugguggcucacaaccauucauaaugagaucugaugcccuuuucuggugcaucucaagacagcuacaguguacuuagauauaauaauaaauaaauuaaaaaauaauuaauaauaauaaaaagaaaagaauaaugauaauaauaaagacacagaaguggucuuuuuaagagccaagcauuugagcagggcauggagguguauaucccugccucuauaccagauguaccugccucugucugagauagaggcagguacaucuuugaguucaaggccagccuggucuauacagagaguuuggagcuagaagcuagggcuacauuguaagaaccagucucaaaacaaaacaaugcggguggcaggggaaggaaugaucugaguucuaucaguggggauuaaauuaaauaauauguguacaaugcuagcaugaggugauacuagagaaagucgcuauuagggcucaguaguuaaggacauuugaauucugaagaguuauuggcuagaauccccaacacuugggaggccgaagcauaagggauaaggguugccaugagaggucucagguuugguucacagcauccauaugguuccaggggaucuaacacucucuggcaucuguggguucgagcaugcacauggagcauauacauagaugcauggggauacacaaacacacacacacacacacacacacacacacacacacacacacacacacacuagccaggggccugguggugcaggucuagcaucccaaccauuuagaggcugagggaggagaacugaaaauucaaggcaugcuuuagcuacagagugaguucgagaccagccugaacaacuuagacacugucucaaaaugagaaagaaaaaaggggacaggaauguggcucaguggcagagaacuugccucaaaugaaugaggccuuagguucaagucccagcaccaguaugaugugugaugcaguaugggggagggggaccaacauuaguaacuaguaacacaauucuacucuucugucucccuagauagccucucuccacagacccuagucacaccucccuuccaacaguccccuccuuccacccugaauugcuuuucuugcccuccuuccuucacaccuauuucuccaacuuacaauuucacuggauuuguuucuauagccuuggagcuggugaaggaagccaucgacaaggcuggcuacacggaaaagauggugaucgguauggauguggcugccucugaguuuuaccgcgauggcaaauacgacuuggauuucaagucucccgcugauccuucccgauacaucacuggggaccagcugggggcacucuaccaggacuuuguccggaacuauccuggugagagcgagggguugugggagauagggaagggaaaggacggagcuaggcaaaggugaacuuuauggggugcagagucuggggccaggugagguccugaggaggcugagaagcaaggagaaggagcaguaggcucuugcagagaggcgcuuugagugucaugugacugcgcauguagucccaggacucaucauaggauggggcuccuccgucuguuucagacccugggcucugagagcuacuugguuccuagggagggcucuggauggagccagggaugggaaaaccaugaauggaugugacagaaaagugccaggcuuuagugucuuugauugaugaagguggauacugaauggaguuggcgcggcgccuugggggguugggggggggggcgagucucacugagguacagagucuccacagccaccaagggccuccgucccgcuccacagaggcaguuggccuccaucagagcaggcgucucuaggaagaaccaguccccucuccacucccccugcaguggucuccauugaagacccauuugaccaggacgacugggcagcuugguccaaguucacagccaacgucggcauccagauagugggcgaugaccugacggugaccaaccccaagcgcaucgagcgggcaguggaggagaaggccugcaacuguuugcugcucaaggucaaucagaucggcucggucacagaagccauccaagcgugagugguccuggccuccgcccaccugguccucguuucuucaggacuccucuugggagcgcccuccuagcuggauucugcccaggaauccuagcgaacccuucacacucuucucacuucuagucucucuguacuucccuuagucaccuuccuccaggugcuuccugacauaggugaagcccggggcugggagggaguagccgugcuucggggcaggucagugcugguguacguacccugcaggugcaagcuggcccaggagaauggcugggggguuauggugagccaucgcucuggagaaacggaggacacguucauugcugaucuugucgucggacuguguacaggccaggugaguagagccagucugugggauugggagaggucuuugugggguugguggguucuaggcccagguaguuauuguccugccgaaaauuugagagucagagaaguuugagaguagaagucuggccaggcauaguggcacacgccuuuaauaccagcacucaggaggcagaggcagguggaucucugugaguuuaaggccaguuugguuuguauagugaguauagcaggaaacccagggcuacaccgagggacucugucuuaguaaauaguaaaaagaguagaaguucugggcuggugagauggcucagcccaguccuaagccugacucucagcuuuagucugauuugugggacccacggguuaggagagaaccaacucccaccaguuguccucuggccuccacaugcacaccguggcaugagcagauccacagacguguacacagacacaacuuaaagcauuaauuuuuauaauuaauuaauuaauuaguacaaauacagauguuucagaguuggagguucagcucauuuauagaguacuugccuaguacgugcaagacccuggguuccauuuaaaaaaaaaggggggggggaguaggauaugacauugcacgccuuuagucccagcacccaggagccagaggcaggaggaucucuguaaguucaauaccagcuuagucuauguagggaguucgcuacauaguaaaacucugucucaaaacaaaccaaaagcccuggacuuggggauacaugccuuuugucuccacacucgggaagcagaggcaggaggaugaggaguucuaggcuaaccugucccuuuagaggacaaccuucauaaaagugucucaaaaaaaaauguauguauguguguguggcagggguggggcauagggguguccuaucaggcgaaggaaauccuuaagcugccuaucuccuggaauguuucagaucaagacuggcgccccaugcagaucugaacgucuggcgaaguacaaccagcucaugaggugaggaggguccccgaagaacaagaacccgaaacccggggucuaaacgccccauuaggccaccauuccaccuccugcauccaggaccuggauagcaguugaugccaagaaaaguuuugcuaaguggguucaaggaugguccgauugacagaucacuaacugaccacgaaagccagggaccguucaccuuggggcagcccucaaagggggagcauugagggacucagggagaaaggcugaucccgucuucuccccugacugucccccuuccggaucaucugucagaauugaggaagagcugggggacgaagcucgcuucgcgggacauaauuuccgaaaucccagugugcugugauccccuucccccaaccccgcuugccugaacgcgggaacaucucauucuccuggagccucuuucuugcugcccugaccugccauagucacucugauacccugagccccaagucacccagaacaccucgacucaccgcuccugcuguucuuggcuuccacaaccccccuugcucucucugcucuuccuccucucugggccccauuuuuggggggauucagucuucccacuuucccuucuauucucucuucucuuuaaaaaaaaauuaugaagauuagaaggggguccacagaagaauccucagugucugacaggagcuucaggauugguguguugggguguuuaaaguggggucacgggcaugaguguuucagugcuuaccaugguguguauaagccuugaacuaugcauagaacuggaguuuggggagugcuggauguguggucaugcuugguugaggcuuuaguguauguguuuacauacacaagcacaguuuguuuguuugcuuauuuauuuauuuauuuauuuauuuauuuauuuauuuauuuauuucucagcuggucagucagccaucuccuguaacucuccagucugaaagugaccuaacuugacaggacuaggcaccccuauuccauguggcuucauuccaagaugacccaggauggggauuuugcuagcaugggaaggggaacagaaaagggccuuagcaauugcuucauucggugcacuaaccgaagcucggaacuuuacagaauggggcuguggaccuggggaggcuuuucuccucuaacccucuccccagcccuaggcuccuccgucuuucuccggcugcaccagagcgcugccucacuccccugcgccaugucccacaguugccaccaucuccguggcuuugaaaugaccaccaccauuaaagucugaaucacagcgcaccaccccuugucugaggacucuuacucucugcuccaugugagaggacgaagagaaacgacuggauauuggcgauccuagguagcagaucaggggagggcucaaaaagcggcaagccacugaacucaugaccaaguuugcagcauugcuggugaugugggauccgugggguuuuuguuucccaagacaggguuucuacguguagcccuggcuguccuggaacucacucuguagaccaggcuggcuccaaguuuacagagauccgccugcuucugccucccgagugcugggauuaaaagcuuguaccaccacacuuggcuga

SEQ ID NO: 3378 - RNA, 1961 nt, Mus musculus
cgccagggaguccugggagggacaagagguuacccacucaaagagugugcuccacaaagcaugcgcgcuuguccacgucuggagucgucacuuauuuuuugccuggauucuuuguagccgguggguucucaaggcgguaagugguguggccgccguggucugggaggugacgauaggguuaaucguccacagagcccaggggcggagcgcgggcgggcguccgcagccccgcuggagccggaagcaguggcuggucaggggcgcuucuagccuucccuaucuguacuuccacagaggucucugcgagcuagggggacagugaggugcgggguaggggcccggcguuagagccagcaaggggacgguucacgguaaggucugagggagagagagcuccugagaaacuuggggggcgcgacacagauagggugaaagcagagugauagaccugggaugguuaggggaccaagggaagaccaggcugguuggcauacaccggugaacggaugggaguccuagggaaagaugaugcgccuaacaguccuuucugucuccacaccacuccaggggacgauccggagcucaacuuucaaaagcgagacgccccagcaagccuguuuugagaaguucuucagcggcucuccucaugggccagacggcccuggcaaggggcagcagcagcaccccuaccucgcaggcucuguacucggacuucucuccucccgagggcuuggaggagcuccugucugcucccccuccugaccugguugcccaacggcaccacggcuggaaccccaaggauugcuccgagaacaucgaugucaaggaagggggucugugcuuugagcggcgcccuguggcccagagcacugauggaguccgggggaaacggggcuauucgagaggucugcacgccugggagaucagcuggccccuggagcaaaggggcacacacgccguggugggcguggccaccgcccucgccccgcugcaggcugaccacuaugcggcgcuuuugggcagcaacagcgaguccuggggcugggauauugggcggggaaaauuguaucaucagaguaagggccucgaggccccccaguauccagcuggaccucagggugagcagcuaguggugccagagagacugcuggugguucuggacauggaggaggggacucuuggcuacucuauugggggcacguaccugggaccagccuuccguggacugaaggggaggacccucuaucccucuguaagugcuguuuggggccagugccagguccgcauccgcuacaugggcgaaagaagaggugagauacggacuagguguggggagaucacuacucuuggcaaugguuugggcuggaaacucaugguuggagcacaggaaguaggcuucuugucacuuuggccugucacuuagauggccuuggaucuagcuucacucccaaucccuauuggaugugaugcacaaauucagagccuuugggucucccucagcugagguggcgguggaaauggaggaagaaggaagggugccugagcaggaucucaaguucaaggaugccuggaguugcuuacuuaccuugucuuccuucucucuccgcaguggaggaaccacaaucccuucugcaccugagccgccugugugugcgccaugcucugggggacacccggcugggucaaauauccacucugccuuugcccccugccaugaagcgcuaucugcucuacaaaugacccaguaguacagggugugcuggcacccuaccguggggacagguggagaggcacccgcuggccuagacaacuuuaaaaagcuggugaagcuggggggggggggcuggaccccuucaccuccccuucucacaggagcaagacauauagaaaugauauuaaacaccauggcagccugggacaaagagguuuuugaaguaaaaaaugagauguauugucacaac

SEQ ID NO: 3379 - RNA, 5485 nt, Mus musculus
gccuucccuaucuguacuuccacagaggucucugcgagcuagggggacagugaggugcgggguaggggcccggcguuagagccagcaaggggacgguucacgguaaggucugagggagagagagcuccugagaaacuuggggggcgcgacacagauagggugaaagcagagugauagaccugggaugguuaggggaccaagggaagaccaggcugguuggcauacaccggugaacggaugggaguccuagggaaagaugaugcgccuaacaguccuuucugucuccacaccacuccaggggacgauccggagcucaacuuucaaaagcgagacgccccagcaagccuguuuugagaaguucuucagcggcucuccucaugggccagacggcccuggcaaggggcagcagcagcaccccuaccucgcaggcucuguacucggacuucucuccucccgagggcuuggaggagcuccugucugcucccccuccugaccugguugcccaacggcaccacggcuggaaccccaaggauugcuccgagaacaucgaugucaaggaagggggucugugcuuugagcggcgcccuguggcccagagcacugauggaguccgggggaaacggggcuauucgagaggucugcacgccugggagaucagcuggccccuggagcaaaggggcacacacgccguggugggcguggccaccgcccucgccccgcugcaggcugaccacuaugcggcgcuuuugggcagcaacagcgaguccuggggcugggauauugggcggggaaaauuguaucaucagaguaagggccucgaggccccccaguauccagcuggaccucagggugagcagcuaguggugccagagagacugcuggugguucuggacauggaggaggggacucuuggcuacucuauugggggcacguaccugggaccagccuuccguggacugaaggggaggacccucuaucccucuguaagugcuguuuggggccagugccagguccgcauccgcuacaugggcgaaagaagaggugagauacggacuagguguggggagaucacuacucuuggcaaugguuugggcuggaaacucaugguuggagcacaggaaguaggcuucuugucacuuuggccugucacuuagauggccuuggaucuagcuucacucccaaucccuauuggaugugaugcacaaauucagagccuuugggucucccucagcugagguggcgguggaaauggaggaagaaggaagggugccugagcaggaucucaaguucaaggaugccuggaguugcuuacuuaccuugucuuccuucucucuccgcaguggaggaaccacaaucccuucugcaccugagccgccugugugugcgccaugcucugggggacacccggcugggucaaauauccacucugccuuugcccccugccaugaagcgcuaucugcucuacaaaugacccaguaguacagggugugcuggcacccuaccguggggacagguggagaggcacccgcuggccuagacaacuuuaaaaagcuggugaagcuggggggggggggcuggaccccuucaccuccccuucucacaggagcaagacauauagaaaugauauuaaacaccauggcagccugggacaaagagguuuuugaaguaaaaaaugagauguauugucacaaccuguuucauuauuguuuuuuguuuuguuuuacacucccccaccccaggcuagagccccaucacugucuuaaggaauuaugacaacccacaaagcucaggcccagguguuuauuucccuuacauguaggaugguucacaaacacaauacaggggcuuuggcaccgugggggaggggacuaucccaggccucuuagggucucauguauaccgaauucagacccgaaagcucugaauuucugcaucagacauccaguagaacuugggagugaagcuagagccaaggccaucuaagugacaggccaaagugacacgaagcccacuuccugugcuccaaccaugaguuuccagcccaaaccaauggaaggugauuucacuugucagggcccaaagggacagucaguucuacucccuccccucacuaggagccaccuuggugacaguugauucuacccacuguaagugguaaagggauuggccuggucccaaccauaauagggcgguggaaacggcucaggaggguacagcguggauuaggccacaagauggggcagaugaugucaucagaagcaugugaccggugggagcaguuacuaaacuucugggcaaccuaguccaugcuaugcaggcagguagagggaugggcagugcucauuguuuggcauugaugauguccacaaauucaggcuugagagaugcgccacccacaaggaagccguccacgucaggcuggcuugccagcucuuugcagguugcuccagucacagaaccuguaccaggaacaagaagacaguuuggucaggucuaugaucagaacacuuaagccccaccucucugugcaaggcagccucagucugucuuagcccauuuccgucuuagcuagagccaaagccacucaccuccauaaaugauccgggugcucugagccaccccaucauugacauuggauuucagccauccccggagcuucucguguacuuccugugccuagaaggaggaggcagagcuacuaaguaagcuccuuccuaucuaucauucaaggaguaaaaaccacugguucucacauagaguugaguuuccagaaaagccccgggaccagagaguggcaaggcuccaaucccaccaggcuuggaaugaacauuuuuggcaaagucacucuccuuggugaguuugggggcccucugucucuaaaggggcuuggaugggcuccauagcugugugagucuguuaaagccggacaggcugaggagcucuggguaguuaccugcugagggguugccgucuugccagucccaauggcccacacagguucauaggccaggaccaccuugcuccagucuuucacauuaucuguggggcagagaggagagugaguaggaaggagcugacccgccaagcucuccuguuauaacaguuauggccuacagccccuggugggcuucuccuucccccuuuuagaaacaacuugugcgugcgugugugcgcgugcguguguacaagcuauagcacacauaugagggcagaggacaacuuguagaagcuggaucuuuccuaccacguggcugucuuuggaggacucaaacucagggccucaggcuuuacccacagacccugcuagcuuuugaaggugggguuugagccuucuguaggaacagugacaagaaccauucaggucgcccucuuuccccggggucaguaugacucaggcaggcugugggaccuuugaccucccgccuccaucccuguggccuuugcuagacucagagagccgugucugcagagauaccugcgaugaccuugguuugcucgaacacgaccuucucggugaugccggcuucccuuucgucuagcuucuccccgaugcaggcgaucaccccgagucccucugcuagggcguggcucacuuucuggccaaucagcuguugaagaacaaaugcuagguagguaagauacccucucccccaggaucaaagcauccccuaucuccccuccuguuuacugaccucaucugauucuccaaagacaugucuucuuucugagugccccagcacgacccagguggcuccuaagucuuugaucaugccagggcuaaaacaaacacacaccaaaguucggcaagaagcccucacgaggaagguuuucccucuacaucccucucugccuccaucucaccugauuuccccagugaaggccccauuggucacuuuguagcaguucugugcggccacagcaauuuugggauccagcuucugucuggcaaagucgauguaagcggugggcggugcacaaaccaccucugaggacgagaucagagaaagccccucacucuucaggcucccggucuugcauucacuuucuugguucuacuuuccuucguuuuucaguccagaaaguugaccuuuguccacuacagagcccaggcuaggccuguagcaauaccagagccuucccaaugccucugauaggccacggcccuuacccugcccucugcucuuuuaacagcuguggcucuaauuuccucaggcuauucugggaaugggcaucuccucgacucagcauucuccagggguaaccccuuucuaaaauagcccaucccacauacccaucccgggaaggauuuuuuagcauaagagguccaccgcgggaguuuguauugggcucuucgggaaauggaugaucagagagaauacccuuuggccauucuccagguuccccgauuuagguggguagaagcgggaaggauggagggguagugucgugagcagcagggaacugacuagcccacagagaccuuguguuuuccuauuuccagucugagaagagcugaauuuuuuuuuuuuuuaauuccccaacggcucagcauguuuggcaucugcuaggggccuaagguggaaggcaggaguggcccaugcugugaaggauagggauguggaagcccccagcucagaggccuaagcauacgacggcgcggggaggaguuucgggcuacgugcagagacgcacggagccagaggccgagggggcagguagcugagagcccgcgcaagcucagcuuccucccucacaaucugggggacacgugccacuugcuuauccaacccgacacugguucuucuucucgacccuaaccccuaacuggugcagcuccgguccacucccaagggcgaucuucuuugcacccugcccccaaccccaagaaccccuuucgggccccacaaacccagugcagcauuuaaaugcuuuuccucuucagcaagucucugcugccgggacaccaaauggcucuuguccccaggccaccauccagguccacucagacacugagcagguggugccacgcccgacccuccacccccacgucccgccgccccugcuaaacagagagcucaccggugccugccggcacguuggcugcguucagggugcagaugaguucucccaggcacuucuuccucccguucaucuuccaguugcccccaacgaagaacuuccugguaggcgccauuguaccaggcucaagucucugaaggucaguacaaacgcacggcucucuccacuggccacuuauauagauggcugugaagcagaacuccuccuucuccccgcccuccgccaugguuagcccggccccuugcugcuccgccuuccccuccaucugccucuccaccucccgguguuucgacguucuggcguucuagagcaaucaauguucuagaggguucagggggcucaaacguccugccucaguggcucgacaguugagauguugaaccucgcgcucagggaaacaaacuuu

SEQ ID NO: 3380 - RNA, 743 nt, Mus musculus
aggaagagagagggaaugagugaugccaaagaaaccugcuggauuuaggccugccccugggaaaaccgaagugagacggagugagaaauccgagggacacaugggucuaguguggguaagaaagggaaauggagaaagaagggugaaauagggcuccuggccugugacguggggguaacuucguuuccguccauccuugaguccuggaaaaggauuguggacgccccucacacguucaucuacccacgcuccugccaacccaccaugugaagauggauuuucgaaacgcugccuggaagagggugacuccguguuugggacaccaauucuggcaccaaaacuuuucuacucagaaacugagcgcccagacgcauuuaggggagaugggaauugaguacuuuuuacuaauuuaagcaaagauccuucccauucaaacuaacacacucuagugucccuugcuccaccccaggaucuuacgcuccuacgcccauuucuccuaugucugucugcgucguauugggccgucucuuucuauaccucuucccccugcccuuuauccgguuuguccucuagccacuuucccucgcccaagccacugaccauuugcccccccuccccgcaaacgcugaacaucaagguuuccacggcaacucagccuuuuaauacauuuugcuaggggugaagacgggugcguuggguaucuggucacuuggaugggagagagcuggggcucuagagcccgg

SEQ ID NO: 3381 - RNA, 743 nt, Mus musculus
ccgggcucuagagccccagcucucucccauccaagugaccagauacccaacgcacccgucuucaccccuagcaaaauguauuaaaaggcugaguugccguggaaaccuugauguucagcguuugcggggagggggggcaaauggucaguggcuugggcgagggaaaguggcuagaggacaaaccggauaaagggcagggggaagagguauagaaagagacggcccaauacgacgcagacagacauaggagaaaugggcguaggagcguaagauccugggguggagcaagggacacuagaguguguuaguuugaaugggaaggaucuuugcuuaaauuaguaaaaaguacucaauucccaucuccccuaaaugcgucugggcgcucaguuucugaguagaaaaguuuuggugccagaauuggugucccaaacacggagucacccucuuccaggcagcguuucgaaaauccaucuucacaugguggguuggcaggagcguggguagaugaacgugugaggggcguccacaauccuuuuccaggacucaaggauggacggaaacgaaguuacccccacgucacaggccaggagcccuauuucacccuucuuucuccauuucccuuucuuacccacacuagacccaugugucccucggauuucucacuccgucucacuucgguuuucccaggggcaggccuaaauccagcagguuucuuuggcaucacucauucccucucucuuccu

SEQ ID NO: 3382 - RNA, 5934 nt, Mus musculus
auuuaggggagaugggaauugaguacuuuuuacuaauuuaagcaaagauccuucccauucaaacuaacacacucuagugucccuugcuccaccccaggaucuuacgcuccuacgcccauuucuccuaugucugucugcgucguauugggccgucucuuucuauaccucuucccccugcccuuuauccgguuuguccucuagccacuuucccucgcccaagccacugaccauuugcccccccuccccgcaaacgcugaacaucaagguuuccacggcaacucagccuuuuaauacauuuugcuaggggugaagacgggugcguuggguaucuggucacuuggaugggagagagcuggggcucuagagcccggauguaggcccccccccccccaucucccuggaggcagcugccauagacucagggccaggaugaggcauacucacucgcucgugccuccccccccccuccagugaagcaggccuaugcggccucacagggucaacugggggaagaugggguuaccuggcccccagggucuuccccaagcccuugaacucccuucgcucccggucagggaacagcgucuuccugcacuuaaccccaaaggaaguccaacggcucggcuauccggagacccaagggagagccgucgaggugaaaaacccaguggucuaggccuacgaggagaggguccuggugacgcaguuggagaaggcagaggugucucaucgaugaagguggugaucuccucccggaaaaaaccgggaccucgugggggucccccacccgaccccagaaccccacuuucuagaaacugucgaaggcuggccaagcccccgccuucagccucuuccucauccuccucauccuccagccugugucucugucccagguauucuggagggccuccgagggcucggcucugggcugggaggauccggauaucauccgaugaggaccacuugugcaggaaggagccuggugcccgaggaguagaaaagauguuggucucaucgugggauaaucgucgggacaaagggaccugggaagaggagcaggugagaccuggagaugcugcagagacaaagguaaaggugacaggaaccaagguggggacucugcaagauggcuucauacucuuccuuuucuccaacguguuuacucuaguaggcaaaccugguucugagagaucugagggaaacuuucuuccucuugucucuccuuuaccugacccccuaggguacccugcaguccaaagccaaagagcaguggugcaggagaccagaauggaggugaguccuucugucccauaccuguaaguaguguacucucuccagcggugggaagagcaugugccgcccaggcagcagcuucaccuggguggggucccgacucccugacccuguggccccguuagcaucaaagcgaauuuugcacacucggccaucuguguagucgucacaggugccaucuaggagcgagaaggagcccaguggguacaggcagagaagaccuacccucuagagccccaugcccuucauaaaguccaggaggacucuuugacucccaucagucuguaagccccaaucccuguuuggcauggaccaagcuggccggccgguguaggcuuccagagaggagcagaugccuagugaaaggcucaucaaaggaaacagggcuuggauggacaagucaucaggcuagacggagccuggaguuggcuccagcuuaguccagcagggggcaccccagggcagcacgucuccucaaggagaagggcaguagaaaggacagaaaauagagguagcuauccaggaaagaaaaggccccgucccuccucugaccgucaucaccgucauccucggacaugaucgccacacacugcucccacacugugcgcacaucugcacgguagcgcucacaggaccagaugaaggagggcaggagcagugucugugccauggagcaccacagcacugccaacaccauccauggcggagcugagucugacuucaaggagaagaagcucaccaccugacggggaauaggcaauggcuggucaggcuugagaguccaggccccaccuaagccugauacccaccuuuaaagcaagggauuaggaagggaggcgggugagccucuggaagggguugaaugaugaaaggggagaagugcuauaaacaaaucccugacguugggcgcuugagcggagugggagagaugggggugggaggagagugagacuccaagaaagucaaagacagaggaacccaggagucgggccuggauaguguggucgggugagccugggguuucuacucauuuccacucaggagugcucagagaaugaucuccagggagaagcagggaauagauaaaggcucagggcagcuagccgugugacagguugaagagugacagggccuguggagcugaagaauagaaguggaagcaaggaauggucaaaggagcugggggauugaguaguggcgggugaggacugagacagggaaccccaaaugucaggagacagacagacgagaggacgguagaugccgggcuggagauggagcuuuugcguggcugguagaacuggaaggcccuguauauuaaaaaaaggcugaaggaccucaaucucaccaaaaugggcacccccgugagugagucauagagaaagacgauggcgcugaccaaguuggugaccugcaaggaugucuuggcagauucagagccauccagcgaggaccgccgcuucccucgaguauccuccaccacaauggcuggcaccucaaaagcuggccggguacccaacccccccagccccccugcuuuggugcccacacugccccccgcucuccgggccugccgagcccuccggggccgggcccacagugucugauagaaugugauagccacacagaccaaccccaugacaaugcccccaagaagcaggaggcugaagcagacaccaaaaccgaggccgaucuuggagacuaugaacuggcagccucgggcauaguagcgcuccccguuguugugccagccgauggagggcagcguggagaggaugaagcugaccauccagaugcccaugacggcaugcagcgccugcuucuuggcguugcugaggcgguaguuaacgggccaucgcaccauccacaugcgaugguaggagagcgaggcgaccgugaagcagguggccagggccagcguguaguagguggacacaaagaccuugcagaugcucucguuccagucauagucagaggaagccuggcgccggagcugcaccacagcaaaggugguaaggggcacagccgccaugaguauaugaguaccggccaggaagcagagcaguaacuccaguggcuuguguuucugcuguuuggcugagaugcuaaggaugauccaagcguuggccagcagggccaggagcccacaggccagccaggacaaugcguuugagcguagggaggccucuucugcccccaacccuccccgagccauucuauccucggccccacccccacccccuugaauuccugggggcgggggcuaggucucacccuggagccccgcucacacacacccccaugaugcccacaguccuugccugguagccaggcaagcugaccccaagucuugcuuacuucucagcauugcaugagugacccagcuaaggccaggugggcagggcaggggagaaggcagggaauuaauagaggcgguaguccucagccuccauauuggguggggcuuuuucucaguuaucccuguaauugaugggggaggcaagcaggcugcuuccccaucuaugaagcuggcugggcagcucugauucucaugcugggacuucccggucucuuucuccagcgaggcuugaccagugggggguggggugggugucuuggugcacagggguggagcucagucaccuggacaagcugugagggaggaugagaugaggagcaagcauuaggccugugcugugcuuggcucacuuguacccccuuucccuugaaacuauggaaaugacugaugcugagggucgcuggggucauucagagcauucccuugccuuaagucagaugcccccuuacccacaggcauaagaccucaucuacuugcagacuacauggaagggucuccauuccuuuuagccuuuucucccugcuuuggaauuccaaguuuugugcuuauaauagcccaugcucagaacuacccagcccugucuccaugucccuaggucucucuucaguugcuaaugggagacagacagugugauguguuccuccuuggggacucacauuaaagcaggagcccuucuccugcaugccauucuccuggacuuuguggucuuugugcucagccuacuuaucuaagccuggguuuucaccccuucagcuaccuaaggaaaaugggaggaaggagacugagacugggguggggguugggggguuguagcuagggaaccugaaggcggggaagccacugacaucagaagcauccagaaauggaaagagggggaacuagggagaaggaggagaguuugagcuggagagaaagaggggggaaacugguaguaucuggaaauagacgggaagguccagaagccccccccccacccgaggcggagauauuggagggaggugggugggaaggaggaggauggaggaggagccugggaacagugauggggggggggguagaccuuaaauaggcuggcugaccucacuaggagacuuugggucuccuccccugguccagagccucaguuucccucugaugggagagagcaggaggguucuggucuuagugauacgguucagggagagcuggggaaggcacuaggaaaccaagugaaacacugaacagacuagaggcuauaagaccggugugaugguuuuggggcagacggggaaaguggggcacagcugugccaccguucauuuccugcgaagagccuuagacccuagcucucccccagaggucccaguccacccccaucuuugucucuuccccccuagcccaguacauccuaguugccauggcaauggacagccaggaggagguguagggaauagguccggaugccccccacugcccucccuuacagccuuuggaccccuucccacucacccucaucccacccccagacccaguuggugguuccgaaagaaagagagggagagucagaaagggagggaagaagaaagacgugaaggacagagagaagggggugaaggacagagagcaaagggaaugggaggaggaagauugggggcuuucuggccgacaggggucccucgcccuucgccuggaugggauaaggucaggcggcuccucccuccagucaccuaggguguucucuagggcagaaacagcagguggcuggggaggagggccgggaggaggggcgcggaggcagcucgcggggugggguggggugggggaguggagacacgcgggggaccgggcagggguccacuuaccucuggcugcguccugcucugccgaggagacgcacucccgacgaggcucgcccgggcucccgccgccugccggcuccagcucgccagcccuccuccuuccuucacucccucccuccgggccucccuccccccagccuggccucucgggcucagcccgcggcgcgcuaguuugcggccccucgaggccccugucucccagggucaucagccugcgagcccgggguuagggagccgcugaccagucuuggggucggggguggcgaggguggggcggggaaacuggacggcggugacuuagaggaggaggggcaaggaaggcgcggggagggagggggcgaggaggacggcggggagcgggcuucauuggugaagcgguugguguccugcccccaccccaucccggauuuucaacacgaaugagcccgaagaggcagcuggugu

SEQ ID NO: 3383 - RNA, 2236 nt, Mus musculus
aggaagacauuuaauaauggcuuagacacacacacacacacacacacacacacacacacacacacacacacacacacaaauaaaagguauggagauuuauguuuauaauccagcaccaaggaaagccacugaggcagcagcauuagaaauucaaaguuauccuagcaaguuugugaccaggcugggcuacaagaguagacaaggcuaucuggucaaccugaucuacauagugaguuccagguuagccagagcuacauagugagacccuauccuaaagaaacaaagauauaaagcuaacuuuugcgauuccuggcugugacuuugggggaagaagucacuugaacugacagucccacuuuaauuaucuguagaauaagaucauagcucuuuguuagaguaauuuugcuuucucacuaugggaacccauuugcaugagcugagacagaccuguggcuacauauacuuacuaaauaaauacauaaauaaacaaacauuauuuuaaauacuaaagauucuuuccagauuugguaccgagauggauuucugguaaccaugucuuuuaaucacuggcuacuugaagcagaggaagcuggcacaugagugccaccaggcaccugcagaacaaaggaaauuacuaacagucacagucuuaagagagguagggggucucagagccuagcagauuagugaagguagcagauaggauguaaagaaggcauuuuugagcugggugguuguggcucaugccuuuaaucccagcacuugggaggcagauuucugaguucgaggcuacccuggucuacagagugaguuccaggacagccagggcuacacagagaaacucugucuugaaaaaccaaaaccaaauaauaauaauaauaaauuuuuuuaaauuaaaaaaaagaaggcauuuaugaaguuagucccauugccccauccuaccuuggggcuguuacaugcuagcaguuuagcagcuuagggaaggcccgagauagaaggaagcugagcucuacagggucagcaucugugacuuuacacauauauuauuucaguaugugaaucagauuccugacaaucuuuuuuuuuuuuuuaaaucuaugagcuuucuguuuauuguaaacgggauuaaauaaagucagucaugggucaagaggaagaacaagagaccaguugacagggagugaagguaggaaagggagauaagguagacagauagagacacauaggaaguccugacaaucuuaguagggauucagauauauaaauuaauuaaaguuaacaguaaaagcaauagacuaagagaucucaaaaauccuacuacuuaggagguggaggaaaguggaucaaggguucaaggccaguuuuaaauacaccaaaguaagcuccggucucgaagacagagacauagcugggucacgggaggcagaggcagacagaugggucucugaguucaagggcagcuuggucugcagggagaguuucaggauagccaaggcuacacacacacaaaaaaaacccugucucaaaaacaaacaaacaaacgacaaaaacacaguaaaugcuaugaaaaauuaaaaaaacccuuuggguugcagcaaucagggaguuuccugcaauaguuuauaauguucauuuacguaucaaacguuuacuggaaugcuuaacaaauucugggaucuggugauaccaucgggagcaauucaaaguccuugcccuuauggagcugggcaacaacaccaggugagcuguaaacaacagcagguacgcugaauguuguacuuagaauuaaaacccgguaagaagauaagagauguggguguuggcaaaaagaaaagaccaaagugaaaagaguaacggaguggucagaggaagaccgauugaacuuugauagcaccgaucccgaaaccucaaacaacuaugggccuucuuaccuuucuugaauauucaaagaaauuaguuucccccacucuagcucagcaaaaagacauucgggaagauccaagaaaaaaggguaacguccuacaacaaccuaguccauuaagaaaugagcugugacucccgucuuuuuaagauuccgcauggucggacuggagagauggcucagugguuaagagcaucgacugcucugccagagguccugaguucaauucccagcgaucauggcucacaaccaucuguaaugggauccaaugcccucuccuagugugucugaagacagcuucaguguacucaaaua

SEQ ID NO: 3384 - RNA, 28913 nt, Mus musculus
cuccccccccccguuuucguuuccggcucucccgccuucuccgagaaacgacugcacauugaagcuguugggggggguggggggggagugggcguggaggacucgggguucccgggagcacgagccgcagcaccacuuccgggugaguguccaggagggcgggggcccccccacaccucgccucgcgcccccgcccugcgggugucucgcgcgccgcccggccgagcgucgggguccgucuggcgccugcggugcaugccggcgagccccgccucgcgguuccgagcccgcgccccgcggguccucccgcucccucggcuccuuccuuccccggugaccgccgccccucccgcgcgcuggcucuggcgcuggcgucgccgccgccgccgccgccuggugagugucgcgccgcugcagucggugcgcgccgcugccccucgcuccucccccccccccuuuaccucgggcgaguggggagggggggguccacgaugggacugugagugcgacugucccggaaccggaaguggcggcgguggaggagcgggcgcugaggaggaaugggggggguuuagggggcgggugccugucuaguggguggcagaguucagcucccuggaggggugaaggagggacgucccagagaccggucuuugaggaaggagugggacuugacaucgggaggaaggaccggguucggugucucgggggagcgaagguuuuagggggacagcugggagccuccaguauauagaccacugaagguugaaggaaguacuucuuggcacaaggccuuggguaggaagggggcgaaguccuagcugaaguguguguguugggggguugggggggcgaggcuagaggaaguggcugggcccgaacuuggcacugugccugacacagggcuagggcauccccccuacccucagcuuugcuuucuaaagccacuucccaggagcagggaccuuccuucaccucugacuccugguucccuguagcccuggggggaacgaagaauuaagugucugagcccaggaguggaacccaaaugcugcuaauagaauucaucuuaguuuuggggaacuggcuuuauuucccuuauguacacuuagugggugucacucaacgccugugacucuagcccuuccauccuuggauuguugguuggggaagcuguccgcuuuccaaauugcugacagucaacuugugaggcucuccacaguucucugguggccuuuacauacuggccucuguaaccuagacaauuuuguuuccagaaaguucaggagcccuggaaaggagaaggaauaagacgacaggaggaagagagagagaggguaagacaaucuugguuuaaugauuuggggagagauggggucaucucaaaugguuuuucuuuuuuuuuuuuccuuuacagugugauagaauuauugaaguaaccaacaccagcgcuugcagagagagagauaaaagccuuuucuuauuguuucccauaguacccaggagguuuuuguguaaaaaauugguaguuucuuuguuacccuuucauggccacugguacucaacaggaauaaaaugugaaauacucaggugaagccacuaaaugggcuuacauuuugucagagauguauucugcuguggagacacagggacucugauuacaguauagucuuuauggugucacuuagagaaacaacaaaggcaaguuuggaguuucccauucuugguguucaguggaguguuugagugacucuguugagugaugaagacucuaacaugagacaauuugaguuugaugugucagguaauauuuuucagagaacacugcuucuuggauaguuugaaauaaaagagauaaaauuauaugcuuucugcucuaguaaaucugggagaaaucaaagugauaccugaugcuaauacugaaaccuuucuauuuuuuucgggggagggaaacaaaaaauuuuguuaugaagcccaagcuaguguggaacucacuaaguaaaccaguuuggccucggccucgaggccaucucuucucccugugcaagcuaaguguuuggacuacaggcaucgccacugugaauggcgaugaaagguucuuuaguugaaaaaaauagcuguuaaacacaacaguuaggggcacugguugcucuuccagagguccugaguucaagcucagcaccccccauggcagcuaacaacugucuguaacuguagucccaugggaucgaugcccuccucuguuauacagaugagacacccacugcuuaaauccauaaauaaaucuuuaaaaacagcagcacuggagggcuggagaggcagucggguugguaaagugcuugucaugugaacaugaggacccagguuugcugcccagaauacaggcaggaaagcagagcaugguggacccagcgcugguaaggcagagacagcuagauggaucccuggugcuuacgagcuagcuauccagcuuaccauaauuggggaggccuagguuagugaaagacccaauguguaaaaauaaaccggagagcaccugaggaaugacuccugagguugucuucugacuucuauguucacuuucuaaacacaaaagacaagauagcagguaauguaaacugagccuccccgaguucucaggccgugaccucucaccuuugagugguuggaaacgccuuaaguggcagcauaggacggaagagugcaggagugcucacccuacugucaucaucuccucgcugccaguaacuccucuggaaaacaaaucuuuguacuuuuaaaauuugguuuuuauuuaauuuguuuauguuuuggggagguggucagaggacaaguuugagggaguuguggauucuggggcccaaacucaagucauuaggccugguggcaaguggcuuuuucugcugagccaucuaggcagcugucuuuuuuuacuuuacuuuuuaagauaggacaccauguugccacagaugaccuugaacuugugauccuccugccuccguccgaaugcuggagguagcagcuuuaccucacccagguuaagugguguugggaaucaaucccagaggcuuaugcuggacaagugcucuaucuaccagcugagccgcaucaccagacggagccuggggacugggaagaaaagugaucauuucauuaugacuuacucuucuccuuucuguggagcuagccuucccuucuuacuaacuagucguggccugauggaggagcaaaguugaagcucauuuugaaucugaacucuuuccucuuacuccuucucuggagcuauaagagaagucuucuacuuguucccaaguccuagagcagagccgguucucugguucuuuuccuuccuuucuuuuuguuuuguuuguuuguuugagacauagccucacguagcccagguugguuuuuacauauggaagguguggcaguggaaagaagaaauaagugugugggugcuucugccaugguacaaggagaguggucagaugucagcugcuggaaacccuguggguucugagcaucaaaguuaggucauugugucuggugacaaucacuuuuguccgcugagccauacugacagcucuagucuuccugccccagcuuccuaagugcuggguuugcaagcaugugcccucacaccuggcccuuuuuauuuuuguaguaugugugguuguuugucagcauguauaccuguguaccacuggcaugccuagcggcuauggaggacagaagagagcauugacuuuccugaaccugaaguuacaggugguuguggcugcuguuuggaugcuggaaauugaacccuggagagaguggugggugcugugagugcuugucauacugagcccucuuucaggccaucgcuccugcuccuuguuuacgucuuuauuuuugagaggaggucuugcuacauaaaccaggcuagucucaggcucaccgggacccuccuguuucugucuccugaaugcugggauuaaaggcugcaccagccaccacagugagcccuuuguuguugaaugugccugcauaauuaaauaaaacugggaaagauguuuuguggagagaugguguccccuguaauaucaguagccaucuugaaauugugagaacauuagggagagagagugggaagaugggaaugggaaccugagagguaggcaucugggggcaccauuugcauugcaguuuagccaugaccuucauucuuggcuguccagucaaucucauaccaaggaauauauggauuucggauaacuuaucaguagaaagguaguuauagcuuuuugguuuuuuguuuguuuguuuugguuuuguuuguuuguuuugguuuuuuucgagacaggguuucucuguauuguccuggcuggccuggaacucacuuuguagaccaggcuggccucgaacucagaaaucugccugucucugccucccuagugcagggauuaaaggcgugcaccaccacgccuggcaucuuuuuuuuuuuuuuaacacuuauuuuugugugugcuugcacaaauaugagacauagcacacauguuauagucaggacgacuuggaggaguugguucuuucuuucuaccaugcacauucuggugauggagcucagguuauuagacuuggaagcaauguguucaccugcuaacacauguugucaugucugucguuuuugagguagggucacacuugguauccaaauuggccuggaaccagguagggccgacuacucacaguaguccuccugucugagucuuucaagugccucgguccuaggaagagcuccugugcccugcagauuacagcacucuccucgugugucauuuuacagcuacauauguaugcuuccuuccugagcacuaauuaugugcuugguuugggcugaccuguuaaugagaagugccucuuuauuuuauuuuauuuugagacaauuuuauucugaauccuuggcuggaacuauggagaccaagcuggccuugaacucaccaagucccuuuugccucugcguccucauugcugcugauauuuaaacuaugugccauuaugacuggcagguugagguuuuauuuuauuuuuaaauuuuuauuacauuuuucauaugggugcaccacagaucacauguguacuuauauuuuuuuucccaguuauucucuauauugugugaguccugcagaguaaacucagguugcuaggcauggcaggaagugccauuaccaucugacccucgguuacuuuaaaaaguauguuaauguguguaggaacauuuugcuuacauguauguauuuguaccaugugugugccuggugugucaagauuaggguauggaugguugcaagauacuaugugcuagaaacugguccuaucuguaagaauaaggacuuugaauuccugaggcaucucuucaacccuggcuuggagcucaacccuguuuaaaacuauucauuuauuuuuuugagauaggguuuccuguauccuagacuggcuucaaacauccuggcuauagccuaggauggccuugagguccuuuuuuuaacugauguguaugugugguuaugucuauguaaguacucugugugugugugugugguuaugucuauguaaguacucugugugugugugugguuaugucuauguaaguacucacgcccucagagcagaggguuuggaucccucuggagcuggacuugaggcaguugugacccaucugaugugggugcuaggaaccaaauuugggucuucugcaaaagcaacauacacuuuuaaccaccaaguugucucucuugccccaacccuaaacuucuuuucuugcuuccaccuucucauuagccuccuagugaacugugucuuuaaaaggccauuccaccauucagucagaucagcugcaugagcaugguggggcgcauaguaggaucauggaguacaugaacgugggcccgcugucacaguuugugucugggaaggaaguuccuuggucagaagcaauuugguguggaaucccaugaugguggauaacgggugggaacaaaacaaaucuaaaacaaaacugauuuuugaaguuaccuuuugaugggcguuuacaugggacacugguauuuuggcaucuuucccuuauuuggagagaucuguccacguucuuauuccccaggugucucucaccaauuuucuaaucaugcucuuucuaagucccugaccuuacagccagucuuuuggcuacaacccuguugucucaguuaggguuuaacgucugaacagacaccaugaccaaggaaacucuuauaagggcauuuaauuggggcuggcuuacagguucagagauucaguccauuaucaucaaggcaggaacauggcagcauccagcaggcauggugcagggggagcugaaaguucugcaucuucaucugaaggcuguuagcaggguacuggcuuccaggcagcuaggaguagggucuuaaagcauacacccacaguggcacaacuacuccaacagggccacaccuucuaauugugccacucccugggccgagcauauacaaaccaucacauuccacucccuggcccccauaggcuuguucaaacauauaagucuguggggggcauaccuaaacauaguauaauaaaaaauacauuuaguccaaauucaaaaguucccauagucuauagcagucucuauaauguuaaaaguccaaagucucuucugagauuccuccagucccuuaacuguaauccccagaacaaaacaggaaaccaguugggcaauucugcaucuccaugucugaugucaaaacggucuucagagcuccaacuccuuuuucaucuucguuaacuguaucaaacucuuucuccugggcuguuucuacuucccguuagcaguuuuuuccucagcagauagcccauggcucuggcaucucgaacaucuuggggucccaaggcaacuucaguguuacagcuucuugauacgauaucugagauucacacaugaacuucugggcuccuccaaagcgcuggcuggaaucacuucuccagcucuguccuuuguagcacucuaggcucugguugacuccacuccacugcuacugcuggugguggugauaucccaugguacuggcaucuccaauacccuggggucuucugcugcaacuaggcuucaccaauagccucucauagcucucuuuauguugccaagccucaguuccuuugcaugaccccuucaucuggguugucaacuacaacugaggcugaaccuucaccaauggccuuccauggucucucauagugacaagccucagcuguucuucaugacuccuucauaccuucaaaaccaguaccaccugggugacccuuacauauuuaccaaguccagcugcagcacgagguacaaccuuggcuaucucuggaacacagccucuuugugcccucagaaaacacuucccagaagaugucaccucagugaugcuggucucuucuuaaucaccacuauuucuuaacuccagcuaacgagcaucaauugucccaguagucccuucuauuuuucacucuaaagccagagccacguggcugaagcugcuauguucugcuugcuggggcuggaacauggccccccuuguucuguuaccagcuuucuguuuuccagcucccucacugccuaagcuuggcuguccugguucuugcucuguagauugaccuugaacucagagaucagcaugccugucucccgggauuaaagguguguaccaacaugccuggauuuaggcuucacuucaccuuucaacuucugaggcuucaacuuucucugucugaggcugaacucagagaucuguuuggcuuuaucuccggggaugggggguggggguucacaacuaccacuccuggaucuaaacuuaguuggguaggaucuugccccaaaguccuacuccauuaaucuguuaucuccuagaacauagaauucaguuccauuucacuuccugaugccccuuuaauacuggaaccauauuuuauauuuuuguuuucucagcuugcuaugcuuguuuaaaaugcucuucaugagugagacuuaaccagagaacaaagucuaugaugggcauuucugagacuuccuuugucaaugcaguuaaucugagacucuucaccuuaaccuuaggcagacguuucagacaagagcaaaaaguagccauauucuuugccaaaauacuacaaaaacagucuaggccacauauugaaauuauccgggcugaagagauggcucagcgguuaagagcagugacugcucuuccagagguccugaguucauuaaaaaaaaaaaguugacaaaaggagccugugauauagccuuaaaaaaaagaaaagaaagaagaaauucuccucugaaaccucuugggccagguccacacaauuuaaaucacucucaguaacaaaguuuuacauauuucuacuaggauagcccaucaagcccaacuuaaagcauuccagugcuuuccaaauccaaaguccacaaaauccacauucuuucaaacaaaagcauguucaggccaaucacagcagucccugguaccacuucugucuuaggguuuuacugcugggaacagacaccaugaccaaggcaacucuuauaaggacaacauuucauuggagcuagcuagcuuacagguucagagguucaguccauuaucaaggcaggaacaugacagcauccaggcaggcaugauacaggaggagcuaaaucuucaucugaaggcugcuagcagaauacuggcuucaggcagcuaggaguaggccacgcccgcagugacacaccuacuucaccaaggccacaccuacuccaacaggcccacaccuaauauugcuacucccugggccuagcauaauacaaaccaucacacccauuaaucaguaaauaauugcacaucugaccauuucucuuuuccaguaaaauauacauccauguguucuacccacagugaauauuucccuucgucuuucaggguuaucccagaaagguguuguaaugcugcagcugucuacuuuuugguuuucccugcauaaaauauagaaccaucaguaaaccaggcccauucuuuuuuucuaccucagaaagcugaucauaggacacacccaugaggcuauagacacaggcuuggaugcauacaacacuguaacagaaguagaaaccauagguauuuggggaacuucuucaugauguaacuugugccaucuaugaugggauuacaggcuguuguggguuuucuuuguuuugucuguuuauuuuuauguagaugaguacacuguagcuguuuucagacauaccagaagaggacaucagaucccauuacagaugguugugagccacaacgugguugcugggauuugaacucaggaccucuggaagagcagucaaugcucuuaaccacugagcuaucucuccagcccugucuguuuuaaaacuuaauacuucuauaugugugggggcuugggugugccacugugcauauacauaggucagaggacaacuuguaguugucaguucucuccuuuuacaacauaggauccagggauuacaucagacucaagcucucaggcacagcagcaagugcccuuaccuacugagcuaucuugcaagccccuggcuguuuguuuuuugagacuggggucuugugugucucagauuggccuugaauacucaaguuucaauggggaaagguguccuugaacuccugauccuccucuuucugccuucuacagguaugugucaucauuggcuguuugauucauucauacuccauuccaaaaugaauugaauugguaccuaagugaaguuuugugagaauaugauguugauguugaauggcaugcuauuuugcuguuuucagaaacuucaucuacugugguugcucaugcuuuuaauccuagcacucaggaggcagaagcaggugguucuuugugaguucaaggccaacccgugcuacauagacccuguuucaaaaauauaaagcagucuuuaauuugagggacuggauagaaggcuaggcaguuaagagcacuugcugcucuugcagaagaccuggguuaaauucccagcauccacaugguaauuuacaauggucugugccucuagcuccagggucuuuaacagggauaugaaguauguacaugguacauacacauacacgcagacauacacauacauuuuauaaccccacauuucaguuugggaguugagagcauagcuuagugggagagcacaguuagcuaacauuggggagguuccauauucaguccccaguguuacucagauaaauuugaaaacaucguugagaacuaccugaaaaacaguucauucuuaggaaagguacagguguuugcgcaaguaugugacaagggagacagaggacagcuucagguaucguuccucuggggccuucuguuauuuuagaugugucucucauuggcuuggacucacugacagucagcccuaggggucuaucuguuugccuucuuggauuuacacacuugcuaacguguguguguguguguguguguguguguguguguguguguguacauguggaggguaguagguaagcagugggagucuguuucauccucccacuuugugagcucugggaauugaacuuagaucuuuaggcugaugugucaagaacuuugacaacugagcugucuccccuucucccaaauuuuaaaauuucaguuccuagaucaagccacacccucaguguguuacuccauuuguagucuuuguuuuuguaagaaucccuccuuucuuuuugagugauuauuucaggguauaguccugauuagcccugaacucuagagugcuggguuacaggccugcucaccauguuuggcucuguguguguucaagauuuguguguauuggugucuuaccugugugagugugugugaaccuuccuuuucuuuggugcugggauaaaagccccaccacuguccagcuucuuccuuauucuuuagggaaaaauuagaaauuagauuucccacuuggaugguugguuggcuugcuuuagguuuuuuugagacaggauuuuuuuugguuuugguuuuuuguuucuuuucuuuuuugagacuggguuucucuguguagcccuggcuguccaggaacucacuuuguauaccaggcuggccucaaacucagaaauccgccugccucugccucccaagugcugggauuaaaggcgugugccaccacugccuggcuugagacaggguuuuuuucuguguaacuuuggcuauccuggagacucauucuguagaccaggcuggccacaaacucagagauucaugucuaggggcaugucuucuauuuuauuucuauucaguaaaagaggagaaagacagagguuauacuugacauuugagcuccuaguauuuuuuuuuccaaaauuuauacauauagagagacuacuaguauucaaaucauuaaguacaaaauaacauuggagugauaucaagguuagugggaagacaucaauguagaauaugucauuaccgccccccaaaaguugagccagauuggauccccuuaaacuguagugagauuguuucuauugccuuagaagguccaggaucagcgagguuagcaucuuuaaggaguuacauagccucauguucagccaccccuagcuguagaucuacuaagaaacaguuacauacuaacaauaaugugcucucugugggugugcuugagaugauagucucucugaagaaggaaagaacugacucccuuaagauauccucugacucccauacaugugccacaauuacacauguacauucauaccgacauaaaugaaaaauuuuuuuaaaauauaaagggacuugaacauguacuuuugauauuccuugggaaggagucuuagaaccauuucacugggaauaccuagggugacuuuuuuauuuaacauaagaccaggaguugccuggcauugcucagucauuuaguauugauccuuguguaaaacugccaaagccacagauuugguacauuuuucucuuuggcugaaauaaauuuaauucccuuuguagacuuuaagaaaauucaaggguuaauaauauagcuuagagggcaaaagcccuugcuaaccaaaccugaugacuugaguuugaucccuggaacccauaugguaggagagaccuguuacaaguugucucugaccuccauguggauacugugacuuguguaugccuguacucacauaauauaagcacacggacauaaauaagaauaagcaaauggaaagucuagugaugcuaggacggggguugcuguguguuccaugccagccugaacuacuacaucagacccugucuuaaguuauuuaauuaaaaguuuaaaagagcugggcaguggugcacgccuuuaauccuagcacuugggaggcagaggcaggcggaucuccgugcucuacagaguugauuuccaggacagccagggcuauacagagaaacucugucucaaaaaaaacaaacaagcaaaaaagguuaaaagaggagccacccuucaggaggcagaagcuagcaccucuaguuccaggcauacagccagcaaagccuuuccaggggaggugaccagauuuugaaaauuagugaugggcaagacuagauucuaaacugauuugugacagcuuuuaauguuuuucuucuuaaaauuguguguguguguucaagugcccaucaaggcaagaaaguggcauuggaucucuuggagcuguguuaacaguccuuugugagcuuccugauacaggugcuaggauccaaacuccaguucucaugauugagcagggagcacucaugaccacugagcuauugcuccagccccucuuacuacacucugugugcgugugugccugcaugcauggaggccuggugaguuggaguguguuccuugaucacuuuccuccauagaaauugaggcagggucucuugcuaaaccuagauuuagcuccuuuugauagucuagcuacccaugcaauacccgacuccaggucaugaguguuaagauuaugggugagccacccaccacucaccuggaauugaugugaguuuuagagauaccgacucagcuucucaugcuugcugagccaucugucuccccagcccgcuucacuuuucuuucucaucuuuccuuuucuuucuuucuuuucuugucuuucuuuuuguuauuuguguauuauuuuggucaguuuuuugauacaggguuuuuguguauuccuggcuguucuggaacucauucuguauaccagguugaccuugaacugagagaucuggcugccucugucuccugagugcuggaauuaaaggcauauaccaccaugccuggcucauuuuacccuuuauauauguguaugcauguuuuuguguauuuguaugcauauuugcaugcagguccucuauguaagaaggggguuuugcauuguccagagcuggagcaauaagggcucuuaacccuuaacugcugagccaucuguucagacucuaagccucacuguaaucugcuuccugagugcugggauuaaaggcaugcauuaccauaccuggccagaauuccuuuuaaaaacuggugucuguauuugaagagugcuuucuuuucuuccagauguuccaaguuauugagugucucacaaccaccuauaacuccagcuccaggggauuugauccucucuucugcccccaagggcaccuacauacacacauccacacacaggaacucuuuacaguuuuuuuuucaaagacugguaauuucuuguuucucacugaccagcccauuauguuuauuacucagugagcuaucaugaauguucuucaaucuuagauuuaugugggauugucccaggccucauuuuauacccaaagauugauucuaggccaggugugguagcaugccugugagccuggguagaaaagagauggaagauggaggaucacagugccagccugaggcuagggcucuguccagauagcucagcuuccugcuggcuuaaaaccuagccgaaaacuguuugaagugguguagaauugcaguuucauagaaguguugauuggaaaucuagaaaaaaaauuuuuucccaaggaaaauggauuuaaggaauaagggaaagggaaaaugcugaaagguagcauggcuguucucaggcuguggaugaucugcuggguguguccuuggacacgccgcuuuucuuaaacuccuuuuuuuuuucuuuuuuuuugaaacuugauaaacauuuugcaacucaaugagaugcacauaaauuuugucauaaacauuuaaaaguauguuuuggggugagccauacugcucagugguuguuucuguucuauuauuuuuagagacuuugaauaaguaguucauacuggccucagacuccagcuucuugagugcuaagauuauagcaccaugucacuuugucuugucuagacauugaggucaugauuguuaauucucaaacuauguggccaggugcuagacaccagaauuucaucaacuacucugagccguuacuaccauucaguaguuauucauaggugugaucuuuggucucucucuuuucagguagaauggaagagucucacuucaauucuaacccguacuucuggccuucuauccccacagucucagggcaggugagugagacuuguuuguuucuccccaguauuuacuucagcucugaguaguaaguccgucacgcuguuucuaccgugugggagcugaagcagaguaaaacacgugcuucacugaauccguuacuacugagaguugcauggcaugggucuggcuccuguccagaaacacagauaucaacuccuugugccuugaucuuaaggaagacaaugagaaguccuuagggcacagacagaaucggguuugcucuuucugaagaggguacuccucuuccuuuucuuuuagauugaaaacacuauguucaucaacaagaugaaggaucagcuguugccagagaagggcuguggacuggcgccaccucacuaucccacuuugcuaacugucccugccucagugucccuguccucuggcaucagcauggacacagaguccaagucagaacagcugaccccacacagucaggcaucuguuacccagaauaucacagugguuccuguaccaucuacaggacucaugacugcggguaagcaccccugcucccuccaaucugagguguugaucucccaugaucaguaccccagucuggagggcucugaggacauggggagugggguauguguuuaaucccucaaucagauuuuuauuaagugccuacuguguaccuagcaaugugcuaggcauugugggggauacaaagaaguagaagaugcggucccugccuuugaggaggugacauucuuuccuucucugaaucaaggagucuccuguucucagagguggagaagagaagggagucaaucaagggguaaaucucacuguuaccgggguacuggggacagggguuaggagaccauuauuuuuguacaggguuugggauuuccuguagacugggcuggagggugguggugagggguuacuuagacaauggucuggggaaaugagguggaugacugucagaugaacagcgugaccccaucucccuuuucucccaaccccagguccugguuugguaaucacauccccgucaggcucucuugugaccacagccuccgcagcucagacuuucccuauuucggcucccaugauugucucagcucuucccccgggcucgcaagcccuacagguggucccugaccucuccaagaagguagcgucaacccuaacugaggaaggaggcggagguggugguggagguggcacuguggcuccuccuaaaccuccucggggccgcaagaagaagcggaugcuggagucagggcuuccugagaugaaugacccuuacguccuugccccuggggaugacgaugaccaucagaaagauggcaagaccuacagguaggagccaaagccagggccaggauggguugaggguugcaauuugaagucucccuuaucuguuuuggguccuuccccagucaggcucugugcucuaagcagcuuucugcuugagagccauuugcauguccaaguguccuguauugugguaggaagguggagccacuggcaccuguaguuuccuccacuccuuuuuaaaacauaggcuugucauaauucaggacuaauuuuucaaugacaagagagucucucucuuguaguaaggcuucagacuggguuccagacaacgucugcagcuuuuuguacuuuguguuuauucuuuuccaagagauccucugguaagcaccuuaccuaaucugugugccauccaccagcuuuugggcuguguggagcacugagcccaucagccccugcaugguugggaugggaggaauaggacaccuauaaaaugacuguggucacuuucuaauucaugcaagucauuuugauccuccacuuuucucuuacguuguccauucuaaaaaagcacaugcauaauugcaugugguacuguguacaaagaaauuccuuaccuuuugaaaguugaaauaacuuaaccuccuugagagcugucagggucccuaguggguucugggcacuuggucccaauguaugaaauggguuaacuuuuacacagcuuuaauauagacaggggcagauuugcauggcugggagacugguucuguccuuaguguaccgagaugggcaauguuguucccauuuuaggagcgaagggaacugcggcacaggaaauggacagagccuugggcucauggauucaguucccggcuccaccacgaacuugcugugugacccugggcaaguccuuuuuccccucucugcgccucaguuuccucaucugcaaaauggggagaauucuuuguaugccucccauuuguugggaguauagaugagauaaucuuuaaaacguugggaaguucagaaagaugagagcuaaucguuauuuagcauuauuuacuugaauuguauaguuuuucuauggagacguccacaacuacacuuuuaaauaccucuuuauacaugagaaagagggcgguguugcuaugcagaauauauugagcacugcagaauuccagcuguaauccagaaguucauuguagcuuuauuauuacagguguaccccacuuuauacaauaaguguuccuggaaaauguuuacaucauaccauauuauaaagguaccugacaaguuugauucauuuaaaggcauucuuugauuauaucaguaaaugaaaaucccuuuaaacuugguuguguagauaccuggauuuuuuauguauuugcuuaaagugaggccaugugacaugagaugcauuugauaacauguugaacguggaggcagaccuucugguugaccagggucuucaauuguaccaaguuauuuuuuuuucuccauacuaagauuauuacuguggauuucccagcuguguaugaauauacacauggaucuauauauacaucuauacauggucuauagaggauugugagcacccagguggcaggaagccuucugggaccuucuacucccaguguuuuuggaauucuuaaaagccccauacuuggaugauuaaauggagggaacccuggaacagaaaugacuauauccuaguugaaaaaaauuacuucagaaacuuaaaauucuaaaguccaaagggaucuuauaacucacaaagaauccuggcugccugucuuaucuaucaugcauuugaacuaaaacagaaagaauccuggguuuggugcauauguaugucaacucugcccaucgcaauugucaguagcacggcuggguaaugaagaaucagguacugcuacuguggacaaaucaacuuaccuccaagucuuuguucccaucugugaaguaaacggggaggucagucagacuguccaguguguuaaaguauuuugagggaaaaucagaacauuugaaauuguuuucagcaucuuagaaaaaacugggauaauaauucaaagugaucauugaauccaaggccgcuaaauugcauaucauucuuaauguauuugauauacaugguguccauugacguaauggacugaauggugcggggugcuagcauucccucccuaccgccagagcuguccugagugagagucuuaauagccaggaccuuacaguaaaggacucauuugguuuccuaggacuccaguguuuuaaaauacagguugaauauucccuguucaaaagugguuaagacuggcuauuuucuuuuuuucuuuuucuuuuuuuuuuuuuaaaguggcuauuuucaaauuuuggaauauuugcacauauacaaugaaauaccuguggggauugggccaagucugaacacgaagcuuauuuguuaagcuggaugugguaccuugcacacacuagcagucuccagaagcugacaggaggaucaggaguucagugccagccuggucucucugcuucucaaagccaaaauagagucggcugcuguggagcuucugugagccuguuggguuugccagccugucucaguccuggcucagaaaggcauagcuauucccucuccuccuccccaacaccccauccccuucucccucuccaaguaguggcucaagccuaggagcacucucccuaacacuuuggaucuccucccucguucucuaaaguuucuccaacccaccuaacugcugggaugucccggggcugccugcuugcugaaccuucaugccuaacucaaaaaggcacaacuuucuucuuucuucuuuuucaucugccaagauuuacagccugccuucccuguuuuuucuuuuagauuuuaguaaaacuguguucaggcuuuaaguaagggaagagaauucauuuauuucaaauauaccuuauuuaaauagccuagagguaauuuuacgcggcauuuuuagugaaccuguguuugauuucugucugcccauaaggcugcgugcagaauuuuccacuuaggagguggugucagggcuuaguuuuggauagugcagcauuucagguuuuagauuuguggauuaaagaggcacagccugugcauuaauggucgucaaaggucagugccuuuaccuggcagauggauguucagccucugcuugaauacuucagggccaagacuguggugcuagguuagcauuguggcagcauuauggcaaacagcucgccccucuggcaaaucgcuuauuuugggagcuuuuggguucauuuuuauagaauuagaauaccuucaagauuauuuugaguagaaacaaaaggugcuuaauuaaaagcacccaccuacccugucccuggcaauagcagcagcaguugugguugucaugacaaccaucugaccaucgucaugucauuguacccuaggaucuuugagacuguugccagacuucuguuuucuguuuugagacaggcucucaggcagcccaggcuggcuugaacuccugcuugucuugucccccacuucuuggguacugggacuauaggcaugugccacuguaccuagcuugccauucuguuuucaguuaaguuuuucauauucuucucuaauuaaagcuuuguugaagauuucuuucugguuucuuaacacugggucucucacuguagagcaagcuggacuacaagcccaucauaguccucagucuaggauuacuuucuuuuuauaauuaacuuucauucucaaggugguaggauuuaaauuaaaaugugugucggagcugaggcuacaauucaguaguagagcacuuuccugguauguggcaaggccuagguuugagccccagcaauguaaaaacauuucuuuguaaacaaugaacauguucuaccuggacugagaaauuaguuaucaaaggaacuucacaacauuaauucagugucauacaaguagcauuguguccaguuucugaccucagucuuuguaaaaugcuuguaucauuauuggcucaccuaucaucaauacugaggcugcuagcaauaaugcuguuuuauuaauaaauauuuagcuuaccuuugauggucaugggugcuugcuggcucuccuagaagcaaaaauuaaugucauuuuaaagaugagaugauugaggucuaggcuauaguggguaaccuauaacugaauuccauuggacuagggcucagguaucuagacuccuguugacuguuuacuuuggaccacgcugaucucuacugugguguuuggaugucucagucacugauaaacuaaccgggagucaggaguuugcuucagaguuacaaaguguguagagaaugaagacugguuaucaaguuacuaggauuuuagugaacucauuaauauagaggccacagcaaaugauacuauuuucucaaagggaacuuguucuuucuagucuugaucuuagcuauuuucaaaaauuacaaaaugaaaaggacacaggaaucaucccauacccuuugauguccaauuuacaaagauggcucaauuuggagagaggccuccuuauuucauauuguuggcugguaugaaaguaggaaggauccacugguucaggugaccagcaaauguguacucaggugcuguggaugucaucuaggagguccaguauuggcuuuguguguuaacaaaagaaaagguuuagcauagcacaacauugcuuuucaauccuuuuuucuuguuaagacuuaaggauuauaauccacuucuaacagugaccuuggccuguuucagaacuggcucucacuugauuggcuugaggcaagggcaaaagaugaauggagcaucagggacauagaggccgagaagggcugagaaagccccccaaguaacucugguacuucccaucaccauuucuuuagcaguugcuaggagaaggaagcaggggaaaucccugaagacaguuaucggagauggacgcucucaucuagucagcuuuccuucaguagugcacaggagaguugaauacuaagcgggaaauggacauggagaaggaauaggaauucauuguagaaauuuggaaacuuaacuggccuaauaaaaucuucaucagagguucucaaacugugagucaccucuccuuuggaggucaaacaacccuuucacaggggucacugagacuaucggaaaacacagauaguuacauuaugauucauuacgguagcaaaguuaagguuaugaaggagcaaagaaauaauuuugugguuggggggggucaccacaacaugagggaguguauaaaaggucacagcauugggaagguugaucuguagucacucagcucauaauauuuuucugcuucauuuuguauacuuaggguauguagucauuuaccaaacauuuauuggguauuucugaguccugggcacugugucugucagcuuaggcaauaaagagaaauaagaggcugggcuugguggcacauagcuauuauaauugcagcauuugggagguaagaaacaagaguauuaugaguucaaggccagcuugagcuacaugagacccuuucuuuaaauagaaaagagaaaguuucuagagcuuccccguguaguuggaacaggagaugagcucagcuaggugggcuucucugggcagggcugaggggcucagcagcgccuccugcugggcaggcucuaaugcuggcagggcugagaggcucagcagcgccuccugcugggcaggcucuaacauugcgcuugcuuggccaggugccggaugugcucccugaccuucuacuccaagucggagaugcagauccacuccaagucacacaccgagaccaagccccacaagugcccgcacugcuccaagaccuucgccaacagcuccuaccuggcccagcacauccggauccacucaggggccaagcccuauaguuguaacuucugugagaaauccuuccgccagcucucacaucugcagcagcacacccgguaaggcugccuuaccccuaccgagguacaaaaccuccaaggccgugaggccugugccaaccguucucuccuuugccuuuugaaaucuuacuuuuguuauuuucugaaaauuaaacucuguauccuagcaguguguauggugggggggccuugaaaauugugauuuccaauccccaguucuggaacgauuuuugugguuucuuucugugucuguuuggaaaucuucuacagagcagacccugcuuuuacuauaugcuucaguucagagccauggugugcauucaacuucagguccauggggaacaggcgguauuggccuauguucaaauugcuauuuggaaacaggguaacuguggugaguguguaaccuuaggaaaaggccgaggguugacaagacaguguuguaagguuaccaagagccauggguuacagucuucaucaucucacugccauucuagcaccgacuugcagucagcagcaaccuagacauggguguccucuucauuagccucugcagccggagcuuuauugggaggagggagggggugcucucauccgucaagcaacaucauuucacccagcagagagcugagcccauggugucgaacugcuuccuccuccccccuucccuccucuccucuccggcaggauucacuccaagaugcacacggagaccaucaagccccacaagugcccgcacugcuccaagaccuucgccaacaccuccuaccuggcucagcaccuccguauccacucaggggccaagcccuacaacugcuccuacugccagaaggccuuccgccagcucucccaccuccagcagcacacacgguaagggagaggggcgggcucuugaucccgccccgcuggcaugcccuccccacccccgccccggagacacacaaccacccgcaugcgggggggcgggggagagaccuggcuggaggugagaccuggcuggaggaggcuauaacuggcaacagagagaaaagaaguggaugccaagagagucuuucuggagcacacaguguauugaaaagacacagugauugugugauacuuuccugauugauuaaagacagacaaacuuggaacaaagaugacuguuuccuucguuuuccuccuugaaaauaccaagcacacuucuuaccagauuucuucucuggugccucagggcaccaguuauaaauggaagauauaaucagauguaagcuggcaccagcuuggauacacucaacuacagcaagcaagauuccacgggaugccaagagaagagcacaaaaggaaacaugaccuuaacauucacacagagaacuggagacaaaugaaaaagcuccuacuucauacguaggaugcuugcauuuaaucugucaauguggaguuacuagggagaagggagucugacaacuugaagagcugaugguuccuuugcugaugucucaagauaaaguccagacuccuagcaauuggcugccucaccuuguuucuuguggaugugauggucucaccugaacguggucagacuuggaguuugcugucuucauguauuugagucauugaucacagaaaugacugugaaaaggagcaggugucggugcacccucuugucuugggcucaucuuaguagacagagugcccuaugguguugggggaagaggugcaauugguuccaaacucaggguuuccugucauuaagggcuuagauugggauaucccuaggaauuucaaugaguuuccacuaaaauuacuguuucuuucaacaaucacuguaucguauucuuugaucacagaacuaacucuggauaugauggcucaaaguugaggggacaguuucugccuguaggguaaaagcaaggacgaaguguuucuuuuccuugucauuguguuuuccuguuguuugugaauguuggaugguugcuacaggagcaaguuuguaugucagaucaugcccugccugugaccugggugcugagcccucaguuccucuucucccagcagaaugagaaucuccgagcugagugcuguaggcaaugagcagagaucaggcacacaaaccacuccagggcaaagaggagcugccuagaacuagcacccugggcacaugcaucugaggagcuuucuuggaaggcagccugaagaaccugaguucuuguauggagcuagucuguuaagugaccuugcucauguccauacucugccucuucucguccucuguagaauccacacuggugauagaccauacaaaugugcacacccgggcugugagaaggcuuucacacaacucuccaaucugcagguaagugucugaguuccacaggagaccuugagucugagacuugagagugccauuuagcuguuacugggauucucagaguuuuucaagagaaauaaauucucuuaaaauuacugaggugaagcuggcccugauaggcguuagucccagcugcuuggaaggcugaggcaaaggauucaaaguuuaaggccugccuaugcuacaaaaugaguucaugucagccugagcaacauaaugauaacagugucucagaauuuaaaaauaaaauuguuguaaaguuagaucagacaauaaagugcuugccacaaacaugaaggcuugaaauugaucucucagaucuucuuuuucaaaacaauaauuagcauuaguauguauuugugguugcagugcuggcaaggugggcacaggcacccccggagcucacuggccagccagccuaaacagauuggcuagcccuaggccacugggagacagugucugagaaaacaaggugggcgucuccugggaaaugacaccaaaguugucacuggccucugaauucaugugcauuuggacauacacccaaaaaggacuggagguugauaagauggcccagugcugaaacauacuugccauacaagccugacuaucuugaguucgacuagaagagaacccacucugaaaguuguccauuauccuuuauccaugugucauggcagguacgcacacccacacacaauacauucaugaauucaugagugcacacacacacacacacacacacacacacacacacacacacacuaauaaagggaaagaaaagacugguucuguagcucacuguuagugcuugucuaguauguaccaggccguagguucagucccugguacguacaaaauuagaacaaaccagaaagccaaaacucucaggugaugggaacagugcugugugccuggaaccagccuccccuggacgccauaguaagcaagaagaaacaaagaaauagcaucuggagaguuagcacuuaggggcuuuauguuccaguacccgggccaggugacuacagcgcccuaccucuaacucuacuccagggaauccagugccacucuggcccccaaggcaccugcacaaauacacuuuuugagucuuguuuuuuguuguuguuuuugggguuuuggguuguuuuguuuuguuuuguuuuuugagauagauagcacugcuguccugcaaccugccacguagaccaggcuggccucaaauucagagaucugccuacacaaauauuuaaaaaaaaauaaaaaaaauuuaaaaaaaagccaggcagugguggcacaagccuuuaauccagcccuugggaggcagaggcagauuucugaguuccaggacagccagggcuacacagagaaacccugucucaaaaaaccaaaaaaaaaaaaaaaaaaaacucaaaaaacgcacaaucuaggcuacaugaaaccccauuucauaaaaacaaaauuauaauauauaacccaaucccauguagcauuaaaagaacauuaauauucccaaaucucacuaaaggaacuuaaugggagaaugauauuucauauuuuacaagguuuuuguuuuucauagccuacucuacacaagcacucuaccacugaacuacacacccagcccuugugauuuuguuacucuuaaaaugguaugcuguguagcucaggcuggccuugaaccugccauccuaacuccucagccuucuaagugcugggauuucaggcaugugcugcugugcccaggauuuuugcaaggucuguggcuuaggugagugugagcccacuccucucaugggauacuauaauaaugugagagagcgagcgagcgagcgagcgagcagaggcacacaccuggcucgugugugugugggcauguuggggaggcaccgugggcgucugcuucuggagcaccgccugauuugugagacaguguuuuacugcauguccagcucacuauuuugugacuagagcaggaggccucagggaugcuccuguuuucacaaggccucaccuacucuuacguggaugccgaggaucugagcaguucuuccugcacagcaaacacucuacccacucagccaucucuuuagcccuuagcucaucgugaagaguugauucugugagcccuuggaaaggaccauguagucuccauaccucacgagaccacuggaagccaguguaacuuuacuacgacccaagguugugccuuuugagacacauuuccucucccagucauuaguccuaacguucuauucaaagcagucucuacugccuuccuguagaacgggaagcuaggauggccugugaucaccgugaggcuaacucucuauaggccaaggaagaaccgggacucacuuugguuucucucauuguuugcagucucacagacggcagcacaacaaagauaaacccuucaagugccacaacugucaccgagcauauacagacgcagccucucucgaggcucacuuaucuacacacacagugaaacacgccaagguuuauaccugcacaaucugcagucgggcauauacaucaguaaguauugugugucucgucgucucccucccacccccaucucucuuaagacagcaguccacugugucuuuacuugauggagucugugggugacuggcuuggcaucugcuuuccccuguucucaguuacuagagucagcauucagagauaauuagugccauaagcagugacucuucauucuagauuucagguauuuucuaugagauucuagaacaagguuguaauggcuucacucagaggucuuugagagaaauagguuucugucugccaacucagcguccgccgugacuucuaaagguucuguuccuuuuugccccacuccagaacaucucuucguagacagacacuacagaguaagagcccagguugagacuugcagguugucuuuuucccuuucuuuuaucuuaacuucuuuucauacccaucucccucaggaaacauaccuuaugaaacauaugcgcaaacacaacccuccugaucuucaacagcaagugcaagcagcggcagcagcagcagcgguggcccaggcccaggcccaggcucaggcccaagcucaagcccaggcccaagcucaagcccaggcccaagcucaagcccaggcccaggcccaggcccaggcccaggcuucacaggcgucacagcagcagcagcagcagcagccaccgccacaaccaccacacuuccaguccccuggggcagcuccccagggagggggugguggggacagcaacccgaacccuccaccccaguguuccuuugacuugacccccuauaagccggcagagcaucauaaagacaucugccucacugucaccaccagcaccauccagguggagcaccuggccagcucuuagagauccguacugccauccaucggaacggggagaaguccuggucccuccuuugucaacucuucuuggugggaaaguucucuucuuccuugacaaguccugucuccagcuccuugggucucaggcauggcuuuucuucgcaagauaaccauccuuauucucagcugcuccugauuggccaaggaauccugagcugauaguguuauccaacagcccccauccaggcagagcuuuuaaaacuggggcuuggugcuugagagaaggauccgcugggagcucacacaucuuauccaguguggggcgcuuaccuuucucucucuucauccucaaaguugagguugauggaagacuaguggcuggcccucccagauaacagagaaggaagcucuaaaugccaccagccuuccguucuaugcuuaccuguaaaagaacagauuuugcacguggccugaccccugugagccauuuucuuccccuuccguggucucacuuuauauugggugaugacuauaccuuuuuauuuguaagggggcaauagcugauucaugguugccaaggugccagagauuccccggugaccaaggguggcuuaagaguaugaguuauuuuuccuuaacagccuccuuccuucucugccaaccaagggccuauauacucagucucgcuaucccaguccaaggagcucugggagcugugguagcuguguucucugcaauaccauucggucuuuugcagagaagggagaauucagggcacacacaggacuggacuuagccucccuaggugccacggucagaugccggacauggauuuauauauaaauauauauauauaaauauauauauauauaccugcucaucacggccaucuuuguuguaaccauuucuguguuuauaaaugcauuaucucugagaauuuucauauugauguuuuauuuuugucuuauuuuuuuuucuccaccuuguccucuggccauggcauuuuaauuuucuuuugacuuuuaauuuuuuuaaucaugggagauuucagauaaaauaaucaggaauuauacaguuguuauaaagcaauuuaaaaaugaaaaucuuauguacaaacuaagggguguuuuuagaccauuguauagaaauaaauucauguuuaaggaugagaggcagugagcuacuguguaagcuagcguggggaaggcuaucuggggagcucuccaggccagcaggaagaauuuagacuggagagggugaagaacagaugcuaggcucauaagccaccggauguguuauuccgaagccauugccag

SEQ ID NO: 3385 - RNA, 39683 nt, Mus musculus
cuuaguuuuggggaacuggcuuuauuucccuuauguacacuuagugggugucacucaacgccugugacucuagcccuuccauccuuggauuguugguuggggaagcuguccgcuuuccaaauugcugacagucaacuugugaggcucuccacaguucucugguggccuuuacauacuggccucuguaaccuagacaauuuuguuuccagaaaguucaggagcccuggaaaggagaaggaauaagacgacaggaggaagagagagagaggguaagacaaucuugguuuaaugauuuggggagagauggggucaucucaaaugguuuuucuuuuuuuuuuuuccuuuacagugugauagaauuauugaaguaaccaacaccagcgcuugcagagagagagauaaaagccuuuucuuauuguuucccauaguacccaggagguuuuuguguaaaaaauugguaguuucuuuguuacccuuucauggccacugguacucaacaggaauaaaaugugaaauacucaggugaagccacuaaaugggcuuacauuuugucagagauguauucugcuguggagacacagggacucugauuacaguauagucuuuauggugucacuuagagaaacaacaaaggcaaguuuggaguuucccauucuugguguucaguggaguguuugagugacucuguugagugaugaagacucuaacaugagacaauuugaguuugaugugucagguaauauuuuucagagaacacugcuucuuggauaguuugaaauaaaagagauaaaauuauaugcuuucugcucuaguaaaucugggagaaaucaaagugauaccugaugcuaauacugaaaccuuucuauuuuuuucgggggagggaaacaaaaaauuuuguuaugaagcccaagcuaguguggaacucacuaaguaaaccaguuuggccucggccucgaggccaucucuucucccugugcaagcuaaguguuuggacuacaggcaucgccacugugaauggcgaugaaagguucuuuaguugaaaaaaauagcuguuaaacacaacaguuaggggcacugguugcucuuccagagguccugaguucaagcucagcaccccccauggcagcuaacaacugucuguaacuguagucccaugggaucgaugcccuccucuguuauacagaugagacacccacugcuuaaauccauaaauaaaucuuuaaaaacagcagcacuggagggcuggagaggcagucggguugguaaagugcuugucaugugaacaugaggacccagguuugcugcccagaauacaggcaggaaagcagagcaugguggacccagcgcugguaaggcagagacagcuagauggaucccuggugcuuacgagcuagcuauccagcuuaccauaauuggggaggccuagguuagugaaagacccaauguguaaaaauaaaccggagagcaccugaggaaugacuccugagguugucuucugacuucuauguucacuuucuaaacacaaaagacaagauagcagguaauguaaacugagccuccccgaguucucaggccgugaccucucaccuuugagugguuggaaacgccuuaaguggcagcauaggacggaagagugcaggagugcucacccuacugucaucaucuccucgcugccaguaacuccucuggaaaacaaaucuuuguacuuuuaaaauuugguuuuuauuuaauuuguuuauguuuuggggagguggucagaggacaaguuugagggaguuguggauucuggggcccaaacucaagucauuaggccugguggcaaguggcuuuuucugcugagccaucuaggcagcugucuuuuuuuacuuuacuuuuuaagauaggacaccauguugccacagaugaccuugaacuugugauccuccugccuccguccgaaugcuggagguagcagcuuuaccucacccagguuaagugguguugggaaucaaucccagaggcuuaugcuggacaagugcucuaucuaccagcugagccgcaucaccagacggagccuggggacugggaagaaaagugaucauuucauuaugacuuacucuucuccuuucuguggagcuagccuucccuucuuacuaacuagucguggccugauggaggagcaaaguugaagcucauuuugaaucugaacucuuuccucuuacuccuucucuggagcuauaagagaagucuucuacuuguucccaaguccuagagcagagccgguucucugguucuuuuccuuccuuucuuuuuguuuuguuuguuuguuugagacauagccucacguagcccagguugguuuuuacauauggaagguguggcaguggaaagaagaaauaagugugugggugcuucugccaugguacaaggagaguggucagaugucagcugcuggaaacccuguggguucugagcaucaaaguuaggucauugugucuggugacaaucacuuuuguccgcugagccauacugacagcucuagucuuccugccccagcuuccuaagugcuggguuugcaagcaugugcccucacaccuggcccuuuuuauuuuuguaguaugugugguuguuugucagcauguauaccuguguaccacuggcaugccuagcggcuauggaggacagaagagagcauugacuuuccugaaccugaaguuacaggugguuguggcugcuguuuggaugcuggaaauugaacccuggagagaguggugggugcugugagugcuugucauacugagcccucuuucaggccaucgcuccugcuccuuguuuacgucuuuauuuuugagaggaggucuugcuacauaaaccaggcuagucucaggcucaccgggacccuccuguuucugucuccugaaugcugggauuaaaggcugcaccagccaccacagugagcccuuuguuguugaaugugccugcauaauuaaauaaaacugggaaagauguuuuguggagagaugguguccccuguaauaucaguagccaucuugaaauugugagaacauuagggagagagagugggaagaugggaaugggaaccugagagguaggcaucugggggcaccauuugcauugcaguuuagccaugaccuucauucuuggcuguccagucaaucucauaccaaggaauauauggauuucggauaacuuaucaguagaaagguaguuauagcuuuuugguuuuuuguuuguuuguuuugguuuuguuuguuuguuuugguuuuuuucgagacaggguuucucuguauuguccuggcuggccuggaacucacuuuguagaccaggcuggccucgaacucagaaaucugccugucucugccucccuagugcagggauuaaaggcgugcaccaccacgccuggcaucuuuuuuuuuuuuuuaacacuuauuuuugugugugcuugcacaaauaugagacauagcacacauguuauagucaggacgacuuggaggaguugguucuuucuuucuaccaugcacauucuggugauggagcucagguuauuagacuuggaagcaauguguucaccugcuaacacauguugucaugucugucguuuuugagguagggucacacuugguauccaaauuggccuggaaccagguagggccgacuacucacaguaguccuccugucugagucuuucaagugccucgguccuaggaagagcuccugugcccugcagauuacagcacucuccucgugugucauuuuacagcuacauauguaugcuuccuuccugagcacuaauuaugugcuugguuugggcugaccuguuaaugagaagugccucuuuauuuuauuuuauuuugagacaauuuuauucugaauccuuggcuggaacuauggagaccaagcuggccuugaacucaccaagucccuuuugccucugcguccucauugcugcugauauuuaaacuaugugccauuaugacuggcagguugagguuuuauuuuauuuuuaaauuuuuauuacauuuuucauaugggugcaccacagaucacauguguacuuauauuuuuuuucccaguuauucucuauauugugugaguccugcagaguaaacucagguugcuaggcauggcaggaagugccauuaccaucugacccucgguuacuuuaaaaaguauguuaauguguguaggaacauuuugcuuacauguauguauuuguaccaugugugugccuggugugucaagauuaggguauggaugguugcaagauacuaugugcuagaaacugguccuaucuguaagaauaaggacuuugaauuccugaggcaucucuucaacccuggcuuggagcucaacccuguuuaaaacuauucauuuauuuuuuugagauaggguuuccuguauccuagacuggcuucaaacauccuggcuauagccuaggauggccuugagguccuuuuuuuaacugauguguaugugugguuaugucuauguaaguacucugugugugugugugugguuaugucuauguaaguacucugugugugugugugguuaugucuauguaaguacucacgcccucagagcagaggguuuggaucccucuggagcuggacuugaggcaguugugacccaucugaugugggugcuaggaaccaaauuugggucuucugcaaaagcaacauacacuuuuaaccaccaaguugucucucuugccccaacccuaaacuucuuuucuugcuuccaccuucucauuagccuccuagugaacugugucuuuaaaaggccauuccaccauucagucagaucagcugcaugagcaugguggggcgcauaguaggaucauggaguacaugaacgugggcccgcugucacaguuugugucugggaaggaaguuccuuggucagaagcaauuugguguggaaucccaugaugguggauaacgggugggaacaaaacaaaucuaaaacaaaacugauuuuugaaguuaccuuuugaugggcguuuacaugggacacugguauuuuggcaucuuucccuuauuuggagagaucuguccacguucuuauuccccaggugucucucaccaauuuucuaaucaugcucuuucuaagucccugaccuuacagccagucuuuuggcuacaacccuguugucucaguuaggguuuaacgucugaacagacaccaugaccaaggaaacucuuauaagggcauuuaauuggggcuggcuuacagguucagagauucaguccauuaucaucaaggcaggaacauggcagcauccagcaggcauggugcagggggagcugaaaguucugcaucuucaucugaaggcuguuagcaggguacuggcuuccaggcagcuaggaguagggucuuaaagcauacacccacaguggcacaacuacuccaacagggccacaccuucuaauugugccacucccugggccgagcauauacaaaccaucacauuccacucccuggcccccauaggcuuguucaaacauauaagucuguggggggcauaccuaaacauaguauaauaaaaaauacauuuaguccaaauucaaaaguucccauagucuauagcagucucuauaauguuaaaaguccaaagucucuucugagauuccuccagucccuuaacuguaauccccagaacaaaacaggaaaccaguugggcaauucugcaucuccaugucugaugucaaaacggucuucagagcuccaacuccuuuuucaucuucguuaacuguaucaaacucuuucuccugggcuguuucuacuucccguuagcaguuuuuuccucagcagauagcccauggcucuggcaucucgaacaucuuggggucccaaggcaacuucaguguuacagcuucuugauacgauaucugagauucacacaugaacuucugggcuccuccaaagcgcuggcuggaaucacuucuccagcucuguccuuuguagcacucuaggcucugguugacuccacuccacugcuacugcuggugguggugauaucccaugguacuggcaucuccaauacccuggggucuucugcugcaacuaggcuucaccaauagccucucauagcucucuuuauguugccaagccucaguuccuuugcaugaccccuucaucuggguugucaacuacaacugaggcugaaccuucaccaauggccuuccauggucucucauagugacaagccucagcuguucuucaugacuccuucauaccuucaaaaccaguaccaccugggugacccuuacauauuuaccaaguccagcugcagcacgagguacaaccuuggcuaucucuggaacacagccucuuugugcccucagaaaacacuucccagaagaugucaccucagugaugcuggucucuucuuaaucaccacuauuucuuaacuccagcuaacgagcaucaauugucccaguagucccuucuauuuuucacucuaaagccagagccacguggcugaagcugcuauguucugcuugcuggggcuggaacauggccccccuuguucuguuaccagcuuucuguuuuccagcucccucacugccuaagcuuggcuguccugguucuugcucuguagauugaccuugaacucagagaucagcaugccugucucccgggauuaaagguguguaccaacaugccuggauuuaggcuucacuucaccuuucaacuucugaggcuucaacuuucucugucugaggcugaacucagagaucuguuuggcuuuaucuccggggaugggggguggggguucacaacuaccacuccuggaucuaaacuuaguuggguaggaucuugccccaaaguccuacuccauuaaucuguuaucuccuagaacauagaauucaguuccauuucacuuccugaugccccuuuaauacuggaaccauauuuuauauuuuuguuuucucagcuugcuaugcuuguuuaaaaugcucuucaugagugagacuuaaccagagaacaaagucuaugaugggcauuucugagacuuccuuugucaaugcaguuaaucugagacucuucaccuuaaccuuaggcagacguuucagacaagagcaaaaaguagccauauucuuugccaaaauacuacaaaaacagucuaggccacauauugaaauuauccgggcugaagagauggcucagcgguuaagagcagugacugcucuuccagagguccugaguucauuaaaaaaaaaaaguugacaaaaggagccugugauauagccuuaaaaaaaagaaaagaaagaagaaauucuccucugaaaccucuugggccagguccacacaauuuaaaucacucucaguaacaaaguuuuacauauuucuacuaggauagcccaucaagcccaacuuaaagcauuccagugcuuuccaaauccaaaguccacaaaauccacauucuuucaaacaaaagcauguucaggccaaucacagcagucccugguaccacuucugucuuaggguuuuacugcugggaacagacaccaugaccaaggcaacucuuauaaggacaacauuucauuggagcuagcuagcuuacagguucagagguucaguccauuaucaaggcaggaacaugacagcauccaggcaggcaugauacaggaggagcuaaaucuucaucugaaggcugcuagcagaauacuggcuucaggcagcuaggaguaggccacgcccgcagugacacaccuacuucaccaaggccacaccuacuccaacaggcccacaccuaauauugcuacucccugggccuagcauaauacaaaccaucacacccauuaaucaguaaauaauugcacaucugaccauuucucuuuuccaguaaaauauacauccauguguucuacccacagugaauauuucccuucgucuuucaggguuaucccagaaagguguuguaaugcugcagcugucuacuuuuugguuuucccugcauaaaauauagaaccaucaguaaaccaggcccauucuuuuuuucuaccucagaaagcugaucauaggacacacccaugaggcuauagacacaggcuuggaugcauacaacacuguaacagaaguagaaaccauagguauuuggggaacuucuucaugauguaacuugugccaucuaugaugggauuacaggcuguuguggguuuucuuuguuuugucuguuuauuuuuauguagaugaguacacuguagcuguuuucagacauaccagaagaggacaucagaucccauuacagaugguugugagccacaacgugguugcugggauuugaacucaggaccucuggaagagcagucaaugcucuuaaccacugagcuaucucuccagcccugucuguuuuaaaacuuaauacuucuauaugugugggggcuugggugugccacugugcauauacauaggucagaggacaacuuguaguugucaguucucuccuuuuacaacauaggauccagggauuacaucagacucaagcucucaggcacagcagcaagugcccuuaccuacugagcuaucuugcaagccccuggcuguuuguuuuuugagacuggggucuugugugucucagauuggccuugaauacucaaguuucaauggggaaagguguccuugaacuccugauccuccucuuucugccuucuacagguaugugucaucauuggcuguuugauucauucauacuccauuccaaaaugaauugaauugguaccuaagugaaguuuugugagaauaugauguugauguugaauggcaugcuauuuugcuguuuucagaaacuucaucuacugugguugcucaugcuuuuaauccuagcacucaggaggcagaagcaggugguucuuugugaguucaaggccaacccgugcuacauagacccuguuucaaaaauauaaagcagucuuuaauuugagggacuggauagaaggcuaggcaguuaagagcacuugcugcucuugcagaagaccuggguuaaauucccagcauccacaugguaauuuacaauggucugugccucuagcuccagggucuuuaacagggauaugaaguauguacaugguacauacacauacacgcagacauacacauacauuuuauaaccccacauuucaguuugggaguugagagcauagcuuagugggagagcacaguuagcuaacauuggggagguuccauauucaguccccaguguuacucagauaaauuugaaaacaucguugagaacuaccugaaaaacaguucauucuuaggaaagguacagguguuugcgcaaguaugugacaagggagacagaggacagcuucagguaucguuccucuggggccuucuguuauuuuagaugugucucucauuggcuuggacucacugacagucagcccuaggggucuaucuguuugccuucuuggauuuacacacuugcuaacguguguguguguguguguguguguguguguguguguguguguacauguggaggguaguagguaagcagugggagucuguuucauccucccacuuugugagcucugggaauugaacuuagaucuuuaggcugaugugucaagaacuuugacaacugagcugucuccccuucucccaaauuuuaaaauuucaguuccuagaucaagccacacccucaguguguuacuccauuuguagucuuuguuuuuguaagaaucccuccuuucuuuuugagugauuauuucaggguauaguccugauuagcccugaacucuagagugcuggguuacaggccugcucaccauguuuggcucuguguguguucaagauuuguguguauuggugucuuaccugugugagugugugugaaccuuccuuuucuuuggugcugggauaaaagccccaccacuguccagcuucuuccuuauucuuuagggaaaaauuagaaauuagauuucccacuuggaugguugguuggcuugcuuuagguuuuuuugagacaggauuuuuuuugguuuugguuuuuuguuucuuuucuuuuuugagacuggguuucucuguguagcccuggcuguccaggaacucacuuuguauaccaggcuggccucaaacucagaaauccgccugccucugccucccaagugcugggauuaaaggcgugugccaccacugccuggcuugagacaggguuuuuuucuguguaacuuuggcuauccuggagacucauucuguagaccaggcuggccacaaacucagagauucaugucuaggggcaugucuucuauuuuauuucuauucaguaaaagaggagaaagacagagguuauacuugacauuugagcuccuaguauuuuuuuuuccaaaauuuauacauauagagagacuacuaguauucaaaucauuaaguacaaaauaacauuggagugauaucaagguuagugggaagacaucaauguagaauaugucauuaccgccccccaaaaguugagccagauuggauccccuuaaacuguagugagauuguuucuauugccuuagaagguccaggaucagcgagguuagcaucuuuaaggaguuacauagccucauguucagccaccccuagcuguagaucuacuaagaaacaguuacauacuaacaauaaugugcucucugugggugugcuugagaugauagucucucugaagaaggaaagaacugacucccuuaagauauccucugacucccauacaugugccacaauuacacauguacauucauaccgacauaaaugaaaaauuuuuuuaaaauauaaagggacuugaacauguacuuuugauauuccuugggaaggagucuuagaaccauuucacugggaauaccuagggugacuuuuuuauuuaacauaagaccaggaguugccuggcauugcucagucauuuaguauugauccuuguguaaaacugccaaagccacagauuugguacauuuuucucuuuggcugaaauaaauuuaauucccuuuguagacuuuaagaaaauucaaggguuaauaauauagcuuagagggcaaaagcccuugcuaaccaaaccugaugacuugaguuugaucccuggaacccauaugguaggagagaccuguuacaaguugucucugaccuccauguggauacugugacuuguguaugccuguacucacauaauauaagcacacggacauaaauaagaauaagcaaauggaaagucuagugaugcuaggacggggguugcuguguguuccaugccagccugaacuacuacaucagacccugucuuaaguuauuuaauuaaaaguuuaaaagagcugggcaguggugcacgccuuuaauccuagcacuugggaggcagaggcaggcggaucuccgugcucuacagaguugauuuccaggacagccagggcuauacagagaaacucugucucaaaaaaaacaaacaagcaaaaaagguuaaaagaggagccacccuucaggaggcagaagcuagcaccucuaguuccaggcauacagccagcaaagccuuuccaggggaggugaccagauuuugaaaauuagugaugggcaagacuagauucuaaacugauuugugacagcuuuuaauguuuuucuucuuaaaauuguguguguguguucaagugcccaucaaggcaagaaaguggcauuggaucucuuggagcuguguuaacaguccuuugugagcuuccugauacaggugcuaggauccaaacuccaguucucaugauugagcagggagcacucaugaccacugagcuauugcuccagccccucuuacuacacucugugugcgugugugccugcaugcauggaggccuggugaguuggaguguguuccuugaucacuuuccuccauagaaauugaggcagggucucuugcuaaaccuagauuuagcuccuuuugauagucuagcuacccaugcaauacccgacuccaggucaugaguguuaagauuaugggugagccacccaccacucaccuggaauugaugugaguuuuagagauaccgacucagcuucucaugcuugcugagccaucugucuccccagcccgcuucacuuuucuuucucaucuuuccuuuucuuucuuucuuuucuugucuuucuuuuuguuauuuguguauuauuuuggucaguuuuuugauacaggguuuuuguguauuccuggcuguucuggaacucauucuguauaccagguugaccuugaacugagagaucuggcugccucugucuccugagugcuggaauuaaaggcauauaccaccaugccuggcucauuuuacccuuuauauauguguaugcauguuuuuguguauuuguaugcauauuugcaugcagguccucuauguaagaaggggguuuugcauuguccagagcuggagcaauaagggcucuuaacccuuaacugcugagccaucuguucagacucuaagccucacuguaaucugcuuccugagugcugggauuaaaggcaugcauuaccauaccuggccagaauuccuuuuaaaaacuggugucuguauuugaagagugcuuucuuuucuuccagauguuccaaguuauugagugucucacaaccaccuauaacuccagcuccaggggauuugauccucucuucugcccccaagggcaccuacauacacacauccacacacaggaacucuuuacaguuuuuuuuucaaagacugguaauuucuuguuucucacugaccagcccauuauguuuauuacucagugagcuaucaugaauguucuucaaucuuagauuuaugugggauugucccaggccucauuuuauacccaaagauugauucuaggccaggugugguagcaugccugugagccuggguagaaaagagauggaagauggaggaucacagugccagccugaggcuagggcucuguccagauagcucagcuuccugcuggcuuaaaaccuagccgaaaacuguuugaagugguguagaauugcaguuucauagaaguguugauuggaaaucuagaaaaaaaauuuuuucccaaggaaaauggauuuaaggaauaagggaaagggaaaaugcugaaagguagcauggcuguucucaggcuguggaugaucugcuggguguguccuuggacacgccgcuuuucuuaaacuccuuuuuuuuuucuuuuuuuuugaaacuugauaaacauuuugcaacucaaugagaugcacauaaauuuugucauaaacauuuaaaaguauguuuuggggugagccauacugcucagugguuguuucuguucuauuauuuuuagagacuuugaauaaguaguucauacuggccucagacuccagcuucuugagugcuaagauuauagcaccaugucacuuugucuugucuagacauugaggucaugauuguuaauucucaaacuauguggccaggugcuagacaccagaauuucaucaacuacucugagccguuacuaccauucaguaguuauucauaggugugaucuuuggucucucucuuuucagguagaauggaagagucucacuucaauucuaacccguacuucuggccuucuauccccacagucucagggcaggugagugagacuuguuuguuucuccccaguauuuacuucagcucugaguaguaaguccgucacgcuguuucuaccgugugggagcugaagcagaguaaaacacgugcuucacugaauccguuacuacugagaguugcauggcaugggucuggcuccuguccagaaacacagauaucaacuccuugugccuugaucuuaaggaagacaaugagaaguccuuagggcacagacagaaucggguuugcucuuucugaagaggguacuccucuuccuuuucuuuuagauugaaaacacuauguucaucaacaagaugaaggaucagcuguugccagagaagggcuguggacuggcgccaccucacuaucccacuuugcuaacugucccugccucagugucccuguccucuggcaucagcauggacacagaguccaagucagaacagcugaccccacacagucaggcaucuguuacccagaauaucacagugguuccuguaccaucuacaggacucaugacugcggguaagcaccccugcucccuccaaucugagguguugaucucccaugaucaguaccccagucuggagggcucugaggacauggggagugggguauguguuuaaucccucaaucagauuuuuauuaagugccuacuguguaccuagcaaugugcuaggcauugugggggauacaaagaaguagaagaugcggucccugccuuugaggaggugacauucuuuccuucucugaaucaaggagucuccuguucucagagguggagaagagaagggagucaaucaagggguaaaucucacuguuaccgggguacuggggacagggguuaggagaccauuauuuuuguacaggguuugggauuuccuguagacugggcuggagggugguggugagggguuacuuagacaauggucuggggaaaugagguggaugacugucagaugaacagcgugaccccaucucccuuuucucccaaccccagguccugguuugguaaucacauccccgucaggcucucuugugaccacagccuccgcagcucagacuuucccuauuucggcucccaugauugucucagcucuucccccgggcucgcaagcccuacagguggucccugaccucuccaagaagguagcgucaacccuaacugaggaaggaggcggagguggugguggagguggcacuguggcuccuccuaaaccuccucggggccgcaagaagaagcggaugcuggagucagggcuuccugagaugaaugacccuuacguccuugccccuggggaugacgaugaccaucagaaagauggcaagaccuacagguaggagccaaagccagggccaggauggguugaggguugcaauuugaagucucccuuaucuguuuuggguccuuccccagucaggcucugugcucuaagcagcuuucugcuugagagccauuugcauguccaaguguccuguauugugguaggaagguggagccacuggcaccuguaguuuccuccacuccuuuuuaaaacauaggcuugucauaauucaggacuaauuuuucaaugacaagagagucucucucuuguaguaaggcuucagacuggguuccagacaacgucugcagcuuuuuguacuuuguguuuauucuuuuccaagagauccucugguaagcaccuuaccuaaucugugugccauccaccagcuuuugggcuguguggagcacugagcccaucagccccugcaugguugggaugggaggaauaggacaccuauaaaaugacuguggucacuuucuaauucaugcaagucauuuugauccuccacuuuucucuuacguuguccauucuaaaaaagcacaugcauaauugcaugugguacuguguacaaagaaauuccuuaccuuuugaaaguugaaauaacuuaaccuccuugagagcugucagggucccuaguggguucugggcacuuggucccaauguaugaaauggguuaacuuuuacacagcuuuaauauagacaggggcagauuugcauggcugggagacugguucuguccuuaguguaccgagaugggcaauguuguucccauuuuaggagcgaagggaacugcggcacaggaaauggacagagccuugggcucauggauucaguucccggcuccaccacgaacuugcugugugacccugggcaaguccuuuuuccccucucugcgccucaguuuccucaucugcaaaauggggagaauucuuuguaugccucccauuuguugggaguauagaugagauaaucuuuaaaacguugggaaguucagaaagaugagagcuaaucguuauuuagcauuauuuacuugaauuguauaguuuuucuauggagacguccacaacuacacuuuuaaauaccucuuuauacaugagaaagagggcgguguugcuaugcagaauauauugagcacugcagaauuccagcuguaauccagaaguucauuguagcuuuauuauuacagguguaccccacuuuauacaauaaguguuccuggaaaauguuuacaucauaccauauuauaaagguaccugacaaguuugauucauuuaaaggcauucuuugauuauaucaguaaaugaaaaucccuuuaaacuugguuguguagauaccuggauuuuuuauguauuugcuuaaagugaggccaugugacaugagaugcauuugauaacauguugaacguggaggcagaccuucugguugaccagggucuucaauuguaccaaguuauuuuuuuuucuccauacuaagauuauuacuguggauuucccagcuguguaugaauauacacauggaucuauauauacaucuauacauggucuauagaggauugugagcacccagguggcaggaagccuucugggaccuucuacucccaguguuuuuggaauucuuaaaagccccauacuuggaugauuaaauggagggaacccuggaacagaaaugacuauauccuaguugaaaaaaauuacuucagaaacuuaaaauucuaaaguccaaagggaucuuauaacucacaaagaauccuggcugccugucuuaucuaucaugcauuugaacuaaaacagaaagaauccuggguuuggugcauauguaugucaacucugcccaucgcaauugucaguagcacggcuggguaaugaagaaucagguacugcuacuguggacaaaucaacuuaccuccaagucuuuguucccaucugugaaguaaacggggaggucagucagacuguccaguguguuaaaguauuuugagggaaaaucagaacauuugaaauuguuuucagcaucuuagaaaaaacugggauaauaauucaaagugaucauugaauccaaggccgcuaaauugcauaucauucuuaauguauuugauauacaugguguccauugacguaauggacugaauggugcggggugcuagcauucccucccuaccgccagagcuguccugagugagagucuuaauagccaggaccuuacaguaaaggacucauuugguuuccuaggacuccaguguuuuaaaauacagguugaauauucccuguucaaaagugguuaagacuggcuauuuucuuuuuuucuuuuucuuuuuuuuuuuuuaaaguggcuauuuucaaauuuuggaauauuugcacauauacaaugaaauaccuguggggauugggccaagucugaacacgaagcuuauuuguuaagcuggaugugguaccuugcacacacuagcagucuccagaagcugacaggaggaucaggaguucagugccagccuggucucucugcuucucaaagccaaaauagagucggcugcuguggagcuucugugagccuguuggguuugccagccugucucaguccuggcucagaaaggcauagcuauucccucuccuccuccccaacaccccauccccuucucccucuccaaguaguggcucaagccuaggagcacucucccuaacacuuuggaucuccucccucguucucuaaaguuucuccaacccaccuaacugcugggaugucccggggcugccugcuugcugaaccuucaugccuaacucaaaaaggcacaacuuucuucuuucuucuuuuucaucugccaagauuuacagccugccuucccuguuuuuucuuuuagauuuuaguaaaacuguguucaggcuuuaaguaagggaagagaauucauuuauuucaaauauaccuuauuuaaauagccuagagguaauuuuacgcggcauuuuuagugaaccuguguuugauuucugucugcccauaaggcugcgugcagaauuuuccacuuaggagguggugucagggcuuaguuuuggauagugcagcauuucagguuuuagauuuguggauuaaagaggcacagccugugcauuaauggucgucaaaggucagugccuuuaccuggcagauggauguucagccucugcuugaauacuucagggccaagacuguggugcuagguuagcauuguggcagcauuauggcaaacagcucgccccucuggcaaaucgcuuauuuugggagcuuuuggguucauuuuuauagaauuagaauaccuucaagauuauuuugaguagaaacaaaaggugcuuaauuaaaagcacccaccuacccugucccuggcaauagcagcagcaguugugguugucaugacaaccaucugaccaucgucaugucauuguacccuaggaucuuugagacuguugccagacuucuguuuucuguuuugagacaggcucucaggcagcccaggcuggcuugaacuccugcuugucuugucccccacuucuuggguacugggacuauaggcaugugccacuguaccuagcuugccauucuguuuucaguuaaguuuuucauauucuucucuaauuaaagcuuuguugaagauuucuuucugguuucuuaacacugggucucucacuguagagcaagcuggacuacaagcccaucauaguccucagucuaggauuacuuucuuuuuauaauuaacuuucauucucaaggugguaggauuuaaauuaaaaugugugucggagcugaggcuacaauucaguaguagagcacuuuccugguauguggcaaggccuagguuugagccccagcaauguaaaaacauuucuuuguaaacaaugaacauguucuaccuggacugagaaauuaguuaucaaaggaacuucacaacauuaauucagugucauacaaguagcauuguguccaguuucugaccucagucuuuguaaaaugcuuguaucauuauuggcucaccuaucaucaauacugaggcugcuagcaauaaugcuguuuuauuaauaaauauuuagcuuaccuuugauggucaugggugcuugcuggcucuccuagaagcaaaaauuaaugucauuuuaaagaugagaugauugaggucuaggcuauaguggguaaccuauaacugaauuccauuggacuagggcucagguaucuagacuccuguugacuguuuacuuuggaccacgcugaucucuacugugguguuuggaugucucagucacugauaaacuaaccgggagucaggaguuugcuucagaguuacaaaguguguagagaaugaagacugguuaucaaguuacuaggauuuuagugaacucauuaauauagaggccacagcaaaugauacuauuuucucaaagggaacuuguucuuucuagucuugaucuuagcuauuuucaaaaauuacaaaaugaaaaggacacaggaaucaucccauacccuuugauguccaauuuacaaagauggcucaauuuggagagaggccuccuuauuucauauuguuggcugguaugaaaguaggaaggauccacugguucaggugaccagcaaauguguacucaggugcuguggaugucaucuaggagguccaguauuggcuuuguguguuaacaaaagaaaagguuuagcauagcacaacauugcuuuucaauccuuuuuucuuguuaagacuuaaggauuauaauccacuucuaacagugaccuuggccuguuucagaacuggcucucacuugauuggcuugaggcaagggcaaaagaugaauggagcaucagggacauagaggccgagaagggcugagaaagccccccaaguaacucugguacuucccaucaccauuucuuuagcaguugcuaggagaaggaagcaggggaaaucccugaagacaguuaucggagauggacgcucucaucuagucagcuuuccuucaguagugcacaggagaguugaauacuaagcgggaaauggacauggagaaggaauaggaauucauuguagaaauuuggaaacuuaacuggccuaauaaaaucuucaucagagguucucaaacugugagucaccucuccuuuggaggucaaacaacccuuucacaggggucacugagacuaucggaaaacacagauaguuacauuaugauucauuacgguagcaaaguuaagguuaugaaggagcaaagaaauaauuuugugguuggggggggucaccacaacaugagggaguguauaaaaggucacagcauugggaagguugaucuguagucacucagcucauaauauuuuucugcuucauuuuguauacuuaggguauguagucauuuaccaaacauuuauuggguauuucugaguccugggcacugugucugucagcuuaggcaauaaagagaaauaagaggcugggcuugguggcacauagcuauuauaauugcagcauuugggagguaagaaacaagaguauuaugaguucaaggccagcuugagcuacaugagacccuuucuuuaaauagaaaagagaaaguuucuagagcuuccccguguaguuggaacaggagaugagcucagcuaggugggcuucucugggcagggcugaggggcucagcagcgccuccugcugggcaggcucuaaugcuggcagggcugagaggcucagcagcgccuccugcugggcaggcucuaacauugcgcuugcuuggccaggugccggaugugcucccugaccuucuacuccaagucggagaugcagauccacuccaagucacacaccgagaccaagccccacaagugcccgcacugcuccaagaccuucgccaacagcuccuaccuggcccagcacauccggauccacucaggggccaagcccuauaguuguaacuucugugagaaauccuuccgccagcucucacaucugcagcagcacacccgguaaggcugccuuaccccuaccgagguacaaaaccuccaaggccgugaggccugugccaaccguucucuccuuugccuuuugaaaucuuacuuuuguuauuuucugaaaauuaaacucuguauccuagcaguguguauggugggggggccuugaaaauugugauuuccaauccccaguucuggaacgauuuuugugguuucuuucugugucuguuuggaaaucuucuacagagcagacccugcuuuuacuauaugcuucaguucagagccauggugugcauucaacuucagguccauggggaacaggcgguauuggccuauguucaaauugcuauuuggaaacaggguaacuguggugaguguguaaccuuaggaaaaggccgaggguugacaagacaguguuguaagguuaccaagagccauggguuacagucuucaucaucucacugccauucuagcaccgacuugcagucagcagcaaccuagacauggguguccucuucauuagccucugcagccggagcuuuauugggaggagggagggggugcucucauccgucaagcaacaucauuucacccagcagagagcugagcccauggugucgaacugcuuccuccuccccccuucccuccucuccucuccggcaggauucacuccaagaugcacacggagaccaucaagccccacaagugcccgcacugcuccaagaccuucgccaacaccuccuaccuggcucagcaccuccguauccacucaggggccaagcccuacaacugcuccuacugccagaaggccuuccgccagcucucccaccuccagcagcacacacgguaagggagaggggcgggcucuugaucccgccccgcuggcaugcccuccccacccccgccccggagacacacaaccacccgcaugcgggggggcgggggagagaccuggcuggaggugagaccuggcuggaggaggcuauaacuggcaacagagagaaaagaaguggaugccaagagagucuuucuggagcacacaguguauugaaaagacacagugauugugugauacuuuccugauugauuaaagacagacaaacuuggaacaaagaugacuguuuccuucguuuuccuccuugaaaauaccaagcacacuucuuaccagauuucuucucuggugccucagggcaccaguuauaaauggaagauauaaucagauguaagcuggcaccagcuuggauacacucaacuacagcaagcaagauuccacgggaugccaagagaagagcacaaaaggaaacaugaccuuaacauucacacagagaacuggagacaaaugaaaaagcuccuacuucauacguaggaugcuugcauuuaaucugucaauguggaguuacuagggagaagggagucugacaacuugaagagcugaugguuccuuugcugaugucucaagauaaaguccagacuccuagcaauuggcugccucaccuuguuucuuguggaugugauggucucaccugaacguggucagacuuggaguuugcugucuucauguauuugagucauugaucacagaaaugacugugaaaaggagcaggugucggugcacccucuugucuugggcucaucuuaguagacagagugcccuaugguguugggggaagaggugcaauugguuccaaacucaggguuuccugucauuaagggcuuagauugggauaucccuaggaauuucaaugaguuuccacuaaaauuacuguuucuuucaacaaucacuguaucguauucuuugaucacagaacuaacucuggauaugauggcucaaaguugaggggacaguuucugccuguaggguaaaagcaaggacgaaguguuucuuuuccuugucauuguguuuuccuguuguuugugaauguuggaugguugcuacaggagcaaguuuguaugucagaucaugcccugccugugaccugggugcugagcccucaguuccucuucucccagcagaaugagaaucuccgagcugagugcuguaggcaaugagcagagaucaggcacacaaaccacuccagggcaaagaggagcugccuagaacuagcacccugggcacaugcaucugaggagcuuucuuggaaggcagccugaagaaccugaguucuuguauggagcuagucuguuaagugaccuugcucauguccauacucugccucuucucguccucuguagaauccacacuggugauagaccauacaaaugugcacacccgggcugugagaaggcuuucacacaacucuccaaucugcagguaagugucugaguuccacaggagaccuugagucugagacuugagagugccauuuagcuguuacugggauucucagaguuuuucaagagaaauaaauucucuuaaaauuacugaggugaagcuggcccugauaggcguuagucccagcugcuuggaaggcugaggcaaaggauucaaaguuuaaggccugccuaugcuacaaaaugaguucaugucagccugagcaacauaaugauaacagugucucagaauuuaaaaauaaaauuguuguaaaguuagaucagacaauaaagugcuugccacaaacaugaaggcuugaaauugaucucucagaucuucuuuuucaaaacaauaauuagcauuaguauguauuugugguugcagugcuggcaaggugggcacaggcacccccggagcucacuggccagccagccuaaacagauuggcuagcccuaggccacugggagacagugucugagaaaacaaggugggcgucuccugggaaaugacaccaaaguugucacuggccucugaauucaugugcauuuggacauacacccaaaaaggacuggagguugauaagauggcccagugcugaaacauacuugccauacaagccugacuaucuugaguucgacuagaagagaacccacucugaaaguuguccauuauccuuuauccaugugucauggcagguacgcacacccacacacaauacauucaugaauucaugagugcacacacacacacacacacacacacacacacacacacacacacuaauaaagggaaagaaaagacugguucuguagcucacuguuagugcuugucuaguauguaccaggccguagguucagucccugguacguacaaaauuagaacaaaccagaaagccaaaacucucaggugaugggaacagugcugugugccuggaaccagccuccccuggacgccauaguaagcaagaagaaacaaagaaauagcaucuggagaguuagcacuuaggggcuuuauguuccaguacccgggccaggugacuacagcgcccuaccucuaacucuacuccagggaauccagugccacucuggcccccaaggcaccugcacaaauacacuuuuugagucuuguuuuuuguuguuguuuuugggguuuuggguuguuuuguuuuguuuuguuuuuugagauagauagcacugcuguccugcaaccugccacguagaccaggcuggccucaaauucagagaucugccuacacaaauauuuaaaaaaaaauaaaaaaaauuuaaaaaaaagccaggcagugguggcacaagccuuuaauccagcccuugggaggcagaggcagauuucugaguuccaggacagccagggcuacacagagaaacccugucucaaaaaaccaaaaaaaaaaaaaaaaaaaacucaaaaaacgcacaaucuaggcuacaugaaaccccauuucauaaaaacaaaauuauaauauauaacccaaucccauguagcauuaaaagaacauuaauauucccaaaucucacuaaaggaacuuaaugggagaaugauauuucauauuuuacaagguuuuuguuuuucauagccuacucuacacaagcacucuaccacugaacuacacacccagcccuugugauuuuguuacucuuaaaaugguaugcuguguagcucaggcuggccuugaaccugccauccuaacuccucagccuucuaagugcugggauuucaggcaugugcugcugugcccaggauuuuugcaaggucuguggcuuaggugagugugagcccacuccucucaugggauacuauaauaaugugagagagcgagcgagcgagcgagcgagcagaggcacacaccuggcucgugugugugugggcauguuggggaggcaccgugggcgucugcuucuggagcaccgccugauuugugagacaguguuuuacugcauguccagcucacuauuuugugacuagagcaggaggccucagggaugcuccuguuuucacaaggccucaccuacucuuacguggaugccgaggaucugagcaguucuuccugcacagcaaacacucuacccacucagccaucucuuuagcccuuagcucaucgugaagaguugauucugugagcccuuggaaaggaccauguagucuccauaccucacgagaccacuggaagccaguguaacuuuacuacgacccaagguugugccuuuugagacacauuuccucucccagucauuaguccuaacguucuauucaaagcagucucuacugccuuccuguagaacgggaagcuaggauggccugugaucaccgugaggcuaacucucuauaggccaaggaagaaccgggacucacuuugguuucucucauuguuugcagucucacagacggcagcacaacaaagauaaacccuucaagugccacaacugucaccgagcauauacagacgcagccucucucgaggcucacuuaucuacacacacagugaaacacgccaagguuuauaccugcacaaucugcagucgggcauauacaucaguaaguauugugugucucgucgucucccucccacccccaucucucuuaagacagcaguccacugugucuuuacuugauggagucugugggugacuggcuuggcaucugcuuuccccuguucucaguuacuagagucagcauucagagauaauuagugccauaagcagugacucuucauucuagauuucagguauuuucuaugagauucuagaacaagguuguaauggcuucacucagaggucuuugagagaaauagguuucugucugccaacucagcguccgccgugacuucuaaagguucuguuccuuuuugccccacuccagaacaucucuucguagacagacacuacagaguaagagcccagguugagacuugcagguugucuuuuucccuuucuuuuaucuuaacuucuuuucauacccaucucccucaggaaacauaccuuaugaaacauaugcgcaaacacaacccuccugaucuucaacagcaagugcaagcagcggcagcagcagcagcgguggcccaggcccaggcccaggcucaggcccaagcucaagcccaggcccaagcucaagcccaggcccaagcucaagcccaggcccaggcccaggcccaggcccaggcuucacaggcgucacagcagcagcagcagcagcagccaccgccacaaccaccacacuuccaguccccuggggcagcuccccagggagggggugguggggacagcaacccgaacccuccaccccaguguuccuuugacuugacccccuauaagccggcagagcaucauaaagacaucugccucacugucaccaccagcaccauccagguggagcaccuggccagcucuuagagauccguacugccauccaucggaacggggagaaguccuggucccuccuuugucaacucuucuuggugggaaaguucucuucuuccuugacaaguccugucuccagcuccuugggucucaggcauggcuuuucuucgcaagauaaccauccuuauucucagcugcuccugauuggccaaggaauccugagcugauaguguuauccaacagcccccauccaggcagagcuuuuaaaacuggggcuuggugcuugagagaaggauccgcugggagcucacacaucuuauccaguguggggcgcuuaccuuucucucucuucauccucaaaguugagguugauggaagacuaguggcuggcccucccagauaacagagaaggaagcucuaaaugccaccagccuuccguucuaugcuuaccuguaaaagaacagauuuugcacguggccugaccccugugagccauuuucuuccccuuccguggucucacuuuauauugggugaugacuauaccuuuuuauuuguaagggggcaauagcugauucaugguugccaaggugccagagauuccccggugaccaaggguggcuuaagaguaugaguuauuuuuccuuaacagccuccuuccuucucugccaaccaagggccuauauacucagucucgcuaucccaguccaaggagcucugggagcugugguagcuguguucucugcaauaccauucggucuuuugcagagaagggagaauucagggcacacacaggacuggacuuagccucccuaggugccacggucagaugccggacauggauuuauauauaaauauauauauauaaauauauauauauauaccugcucaucacggccaucuuuguuguaaccauuucuguguuuauaaaugcauuaucucugagaauuuucauauugauguuuuauuuuugucuuauuuuuuuuucuccaccuuguccucuggccauggcauuuuaauuuucuuuugacuuuuaauuuuuuuaaucaugggagauuucagauaaaauaaucaggaauuauacaguuguuauaaagcaauuuaaaaaugaaaaucuuauguacaaacuaagggguguuuuuagaccauuguauagaaauaaauucauguuuaaggaugagaggcagugagcuacuguguaagcuagcguggggaaggcuaucuggggagcucuccaggccagcaggaagaauuuagacuggagagggugaagaacagaugcuaggcucauaagccaccggauguguuauuccgaagccauugccaguuuaggaacaguuguauacauguccuaucgugggacugccuacauaugugagacaagguuacauuuaacaaaacggcuauauucuuuccccuuugccacccccacaccgcaaaaaauaaaaaaagccaagccguggugcacgacuuugcucaggagggagaggugguuggaucucuaagaggccagccuggucuaguuucaaguucuaagacugccaggacuacacagagaucuuuugucucuugccagguaugguaggggcacagacauguauggccucuugaaaggaacccccaaccccauauuauccaaauucuacugggcacuguguacguauacauagugucucauuagacugcagugcaaagguuuccagugauggaaacuauaaccagcuacuggguuuaagauggaagaaaaugccaaaugcagugagcuucccaugauaauaaugguuaucauguucaccuaaaauggaagaccauugugcuggacagagcagaacaagaaacuuaagaaacuucucacagucuaccaugaaaggauucggcuaauuucccaagacugcuucaugaagauuaaauccuucauacaguacugaaaagauuggcaaauguucuccuaucugagaccuagccagcugucacuacuuggugauguggauaaagaagucucauuuaauuugggacugggcauccaggacaguaguaccucaguauuguugguuagcugccuggugcacuuuccacucaccaacuauggagaguuugacaaaccuguucucaucacaaggauugcaaucagcuccuccuuugugggugaacauccauuuccacuuuugcgcaaugauaaugucuguuauucucauuguauaggaaaaagccggccgagucaguuauccgacagcaugcucuuagauuagaauggaguccacauccugcuguccugcuuuagcaacugcucagcaggaaacuugggcuuauuggguauaaaagagcucaaauuuuaucuuacaaguauggggucuaacuacugugaaggguauaucaacuugaggcgacaccuaucugcuagaaucuaccaccaauacuaagagguuugaguucucuuucccuaagagcagcaaccugacagguuuugacuagggugaaggcugcuaucuagcauauacuuugaugacccagucuuuucaguacauaaguccauuacaaaacacaaacauggaucuccauaucgcacgccuuuaaucccagcauuagugaggcagaggaaggucucuuggaguucgagaacagcgagggcuacacaaagaaacuuguaagugaugagagaugcaaaggguuaaauuugcaaagccugacaacuucugaagaaagcaucugccuccgagacuauucuacuuaagcugggacguugguggccagauucauaauuagaaaagcaaaacagcucgauucccuacuuguugaaagcgauuauuugcaaaauauaacuacacauaauagauucccccauuuaccaaacauuccuaguuuuggagggaaaaaaguuugcuagagaaugcaaaauggcgacuucgcgugacgucaugccugucgcagacacauauugccgccuuauuaagggcggaagccaggcuaaaucagccucgcuguagaugaccgugaauaggcgcaaaaaaaaaaaaaaaaaaguucaguuuccggcggauguauccgaggcagauaguuuaguaagggcggaaguucagguacggaaaagguguaauccaagaaugguuacagcgccugucguguaucagucacuuccggggaagaucggaaguugcuuuguuuugcuucaagauggcugcugggauguauuuggaacauuaucuggacaguaagagccaacuggagaagggggucaugggccauagagugguguagaggguccagguugacagacuucauggccccgagguucugguagccugaagaucacaggaaaaggguuccgugggaagauuuauucgagggggaagagggagggggcggggcagugggcuuagaggccucgcucaagaucuggacgagggaagggcugcuccgugggaucagggcugggcuuuaaaggguuagggguagcaggaaaguaguugcugacucaguucuugaggguagauuuuuuuuccccccuaaguugugcagcgucguuacuuacgcacugccauuuggagcagcugcagauauucgaccuaauuccuuuagucauuuauaucucaaaaguugcuccucauuaagcuugcuggguggaauagagcgaccacugaguugaucgcugaaaugcuuuacuuuaugagcaaaauccaguucucaaaaaaugaggaauaugucugucugucugucuccucgccucccuggucuucccccucccccgucguguguguguguauguguguauagagacugggaagugagaaaucggcuggggauauauuagacuuuuaggcaacucuuaaccugggcaucuuaaaauagagcauugauuuuaauaaaagaaaguaacugaucaaauaaugguagcaguccaaaucagaagugcagaccuggucuuagagaaugacagaaaguuuuagauauuaaacauggcacaccuuuaaucccagcacuugggaggcagaggcgggcggauuucuaaguucguggccagccaggucuacaguuuguuccaggacagccagagcuacacagagaagcccugucucaaaaacaaacaaacaaaaaaagauauugaacauggcaagauugauugaaugacuuugcgauugagagagaaggaaaauccaaggugaauucugcuuggaaaauaaacuaucuaaucagcaguguaggagauucuggaguaauaacaauacauuagucuuugccuuagaaauaggcauucaaucugacagugagauuauucaggaaaaaacuucagacaguaaaaaagacacugagcucaagaaagcagcauuuaaaggauaagauguagugguucacgccuuuaauuccagcacucgggaggcagaggcaggcggauuucugaguucaaggccagucuagucuacaaagugaguuccaggacagccaaggcuacacagagaaacccugucucgggagaaaaaaaaaugucgaugcuggcaauaccagaaggccucugaccuaguauucacugcuaggaggaaguaaguuacuugaacgagaagguggugccgacugccucgggaaagaugagucaucugauuugguaaucuguugugacuaguaauccuagugaacugcugucacagacuuaagaagcccccucuuguuuugucuuuucagacagugucugauuuagcccagguugaccuugaacuccaggcccuccuucuaucuccacagugcuauugauuauaagcaccaagccauauucaguacaaacauuuuuuuacauuugaguucgacuuacagaaacacaaguuuggguagcacauaccuuuaaucccagcacuuggaaagaucucugaguuugagaccagccugguauuauaaggugagaucucggcccgccauggcuacauaaugaaagccugucuuuauguuuauauaggagaugacacuagaccacuugccuaacaaggggcagccccugggauugaaguucagucugccccaccacagggagcgagagagugagguuaagcucuguagagaaaauuugcuuuuguggagaagcuuaacuaauaauacguuuauucaauuauuuauuugacacuuucuaaacaugaggggaauuuaaaauuugauccaggcaugugucuccuggaagguuagggagacauacccaaaguaacuauuaguuauuucguuaugguuggauaaauacuaaaaauacuggcuagacuaucucuuuuuuuuguuuuuuuuucauuuugguuuuuuucgagacaggguuucucuguguaggccuggcuguccuggaacucuuuguagaccaggcuggccucgaacucagaaaaccgccugccucugccucccgaguguugggaugaaaggcaugcgccaccaaacccggcucuagcuagacuaucuugacagccugucuauguaaggcauuuguccgagucugggaaaguccgguucugaaacugcacuuugaagaaugagaagaaguggagugggggaagcagguacugugugggugggaugaggaagccaggacuccuggaaaguugcugacaagugugaggcgcuuagaaggccaguguguuaucagagagagcaagaagauggcaaggcugagugagcuaagccagauaggaaguguggaacacagccuuaaguuacuggacgguuacagaacgcaugaugagugcuaaaguugagagcaaagaagauggagguugaagcuaaaagagagaaagcugguuuauagaauaaggucaccaaauaagaagagguuaggaggcuugcagagacaggaggcuagcugaaaaagagguuuccccuuuugagaaagggugaaugaauccugucacaaauaaaucccucauuucaggcugggcauggagcucaguugguagaaugacugccuggcaugcaagggcccugagguuugauccccaacacuguauacagcuggcauaggacuauuaacacuggacuauuaggagccaacacaugacaagaaucagaauuuuauuguuggucaucguuggcuacaaagcaaguuugaggccagccuggccuacagagacccuguccaaaaaaaaaaaaaaaaaaaaaaaacuuaaaaaaagaaacaaacaaacaaaagcaagaaaaaacuccaguuucagaugaggggaaaacugaaucacacuccauuuuauauauauaugcauauauauuuuuuuuuaaguuuuuuguauuauuauacauaaguacacuguagcugucuucagacgcaccagaagagggcaucagaucucauuagggauggcugugagccaccaugugguugcugggauuugaacucaggaccuuuggaagagcagucggugcucuuaaccauugagccaucucuccagccccccuuuuuuuuuucaaaauacugaauugcacuuuagaaaaguauuuuuuuaaagauuuauuuauuauauauauuugaauauauauauauauuauuacuuauuauauguaaguacacuguagcugucuucagacacuccagaagagggcgucagaucuuguuacagaugguugugagccaccaugugguugcugggauuugaacuccagaccuucggaagagcagucgggugcucuuacccacugagccaucucaccagcccuagaaaaguauuuuaguuaauuauuuuuuauuaccuauccaucaaucaugggaauggguauguauguguguguaugcaugaaugcauguccccuuguaacucagaaacauuguauccccagagcuggagcuauagggacuuguaagccacucagucugggugcagggaaccaaacucuggacucuggaagaacagccagugcuccugucugccgagcaucucugcagccccugaacuuuacuuuugucuauuuuccuauucuuuguuuugucuuuuaaaacaauuaucuuauguaacuagguggcuccagauucccuauguggccgagccugacuugagucauaauuccccugccucuuccuuuuguuuccagccugaacuucauuuucaaaggagccuucagucggcuaggguuguagaucaggggcagcacgcuugccuagcauacgcaaagcccuggguucuauccacagcaucgcagaaacaguaaacaaaagguuaaauagaaagauggccgcagcaagcugaggucuagcuuagugguagagcacuugccacaacuuagguguacugcaguaacuauuucugucucuucccagguauugaaaaccucccguuugaauuacagagaaacuuucagcucaugagggaccuagaccaaaggacagaggguacguacagaauaauaggcuuuucuugaucacugugugguuuccugcuuucugcuaccguaccaucuggugaacugugacuuacuugggggagggagguguguaugcacguauguauguauguaugaauguucugcccauauguauaucuauguaucaugugugugccugguacacagagaccagaagacaguaucagaucuccuggaacuggagcuauaaagaugguugugagccaccauguggguacugggcuccaaacccagguccucugcaagaaaacagccaguguucuuaaccacugagccaucucuccaccuugacuuucauggacuccuuaaaagaagauaauggccauccuuuucuacuuuuccauaucaaaugaaggauugagauaauaccucaagaauucagugaugcugagcuggcgaaacaguucaguggguaaagguguuugcuaccaggccugaugcccugaguuugauccccaggacccacacaguagaaggagagaaccucccagaaguugguccugugaccacaaccugugggccauuguacacguucauccacacacauacaaacuaugcacaaaauaaacaagguucagggguguuacaguuuuuguaccucuuuccucaagacuagaagauacgaagccuagacguugcuccugguuuuguuuuuugcuuuugcgugaacgcaagguaugccucauugcaguguuugcuaucaccaaauccacagcacuugaggcuacauacgccugcauggauggcugcuggcaacuuugccaagaagcuauuacaaagaaagggcagggcaugguagcauaggcagguagaucuuggugaguucgaggccagccuguuguacauauugaguuucaggccagcaagggcuauauggugggacccuguuggggggaaaaaaaucugaggucauccuuguacaucuggcacauacccagaguuugaggucugccuuggcuacaugagaccuuuuccccaaaaaacuaaagaaauaaaaguaaccaauaacaacaaaagggaaaggaauaaaacaaaaugcaucagguaacaucagaagugcucuacuguauuccucaacucauagacacauuggaugucauaacucauaggcgguuagaaucagcuggauuuuucaguccuuguacucggggcugaguuggcucuccugaggugccugcccucuggcgccugaggagcgcuucacugcagagcucaggcugcucugcuccggagguaagguucauuuugaagguguccucauacccacugaaggauagauaugucuuauguuccauccuagguagccauguucaaagaccuagcaagcuaggcugugaagccaugucuuuuuuuuuuuuuuuuuuuuuuuuuaaagauuuauuuauuuauuggauguaaguacacuguagcugucuucagacacaccagaagagggcgucagaucucguuacagaugguugugagccaccaugugguugcugggauuugaacuccggaccuuuggaagagcagucgggugcucuuacccacugagccaucucaccaguccaugaagccaugucuuaaguugcucuggcuaagugucuucauggguaucaccuaacacucuggacaucugccucugacagcugucugcgagacaguuagaaucggcuggauuucuuuucaauguuguucuaacucuugauucuguguauagagaccagcuggaaauuacagaauuguauauuuuucucacuucuaaaggccuggaaugcagugagguaugggcauagcauguucccacugccuggugcugcacuggguuagucuuucaucuccuuccauugucauuuuuaugagcccuacauaaugcuaggggguagagaucuucuagucaguauuccgggucuucaccagcccucuacuauuaagguguuuugagcgauaucuaagaugaacaaacaaacaaaaaaaaugacaagaaugguaagcaaguuacaagugaugagcaagcuggaugugguggcacacacauggaaucucagcuuucagggggcugaggcaggaggauuagcuucuguuugaggucagccuggacuauauaguaaguucuaagacaucuugagcuacagagacuugguacucggaaaauggaaagagaaaaguaggguggaugggaaggaugcagacaccgcuuuccuugaaguaauuaagacguaauguuaaaaugucagaccccgcacucuggcugcguaggcgggagcauccuaaguucaaggccaaccugggcaagacucaaagagagagagagaccuggagccagagcaccagugagugacagccugguuugcaggaggcagggcagggccguuuggagaugcugcucagaaagaagauggucuuuggaaccccacucacgaggcaagcagcaagcaagcccugcaaagaagcauccugaaaugucaucaggaauguacuucaggacaaccugcuuugcagagaaccccacaaugacucuguaguagucucaacucccaacucggcagccauguuuucuguacccugaagggacuuuaagacagucucagccaggcccacgcuuaugaucccaguguuaggaaaucuaagacaggaggauauuccaaguucaagaccaggcuaagcuacauacugacacugucucaaaacaaaccaaaaaaaaagcccaaaugaguauuugcauuuccugaauacaaggcauaguucaguacaguucacuuggaagguuuugauggccaauggaaaagguccaaggaacaagaggaagaaguauguuucaucuagccaccaggggccgcugugacccaggccugucucuguuguagaccugaaggcugaaauugacaaguuggccacugaauauaugaguagcgcccgcagccugagcuccgaggagaagcuggcccuucucagacagauccaggaggccuauggcaagugcaaggaauuuggugacgacaaggugcagcuggccaugcagaccuaugagaugguauggcccuguucaugguuucccaccuagcucucagcuaauucucagggucuuagacccccuccuucagcuguguugggucuuagcuguuuuccuugaucggagccaggcuuggaccucuucccuuccuucccucacagguagacaaacacauucggcggcuggacacagaccuggcccguuuugaggcugaucugaaggagaaacagaucgaguccagugacuaugacagcucuucuagcaaaggcaaaaagagugaggaggggcggggcugugagaugcgggcaaggagucagagggagaagaggccaacuccagcuaggagggagcggcacugccuggaccaggagcaaagagaacuuaacccaucuuuuugucucugccucccggcuuacccuuucuuccuagaaggccggacccaaaaggagaaaaaagcugccagagcccguuccaaagggaaaaacucagaugaagaagcccccaaggcugcccagaagaaguuaaaacuugugcgcacgugaguauaccagaggacgcccgccucccagccagccucgugccacuuucccugucuucugugccaguaacucugucacuguggugucugcuggacggagaggaagccacacaucacuugccucaccacgaucuucuaccaccucagagcgcagguuguagcuucccuuccugcggaugacauuugucuuccucuuggcauacagaaguccugaguaugggaugcccucagugaccuuuggcaguguccaccccucugauguguuggauaugccuguggaucccaacgaacccacauauugccuuugucaccaggucuccuauggagagaugauuggcugugacaacccggaugugagaaccguuuccucgggguugggggaggagcucugaggggcaugaguaagaggaggaggugacucgggugaagagaaggaugcagaaugggauggugguuggacuggguugcugagacuugaaguuucuaaacuggaguagagggccccuaccucucaggagccgcugguggcccucccuccacccugcuccagucccucccugaugucugugauccaucugccuucuccaguguuccaucgagugguuccacuucgccuguguggggcugacaaccaaaccucgagggaaauggugagugacagcugaaguguggcaggagcuggcaggccgucccaugucccaacgcccagugugagagagcacacaggcuucucucacuuucagcucaccucacucuucucuccuucauguuggguuuuagguuuugcccacgcugcucccaagaacggaagaagaaauagguuucccuggauuccauuacagacuucugcaucccccugaccugggcuaguggacagaguggaaggccugugcuggggacggggggcccagggagauguggacagugcgguaccgucaucccucucccuccuccccacucggugcugaggcugcauccaaaccccaguagggagggugcugcagccagugacgguaugugcucuccucccgccucucccagagggaaguaaucucacucacuguccuuuugccuccuuggugagguuggugcuguauuucagagggaggguccucuucauuccccuugcuuugacuuaaggacuggggcaguggaguggggcacuuucccaguccccucacuccuccuucccccauugggagcuaggcaggacagacugccuucucugcacucuuccuguucuccauggggaggggucuucuaggucauuugggcaguggccuaguuaagugguuacuccaaccucuauggcccggggauuuaugcugacucugaaugggagaggggcaagguagaccgcagguuacucacauguaaaaggaguugggguagguaaauaaaagcuauccaugcuagccugcuguguuuauuguagagacuguuuaaguauaugugguaagcauucuuuucgcauccucuggauuggaugagaggcaggaagauggcuugccagaaauaggacaagacauaaaacccaaaaugguccuguccugugguguccacagcuucuccaccuggaggagugccuugcaucgggggacucagaauuuuguaauuacgaaucuccucuccgugaaacaccuuuaacccaauuccaauaaaucauguauuugcuuuauaugugugugcggugauaguauuagcuugauuucuucuaaauacaaaauagauacaaacagguauuuucuccccaucucccuaugaguuguguugguccccucccucuugaaacgguaucccuuggaccacugaaccauccuuucaugugugcucgccuuggucagcccugcuucauuuuaacuuugggccuguuuccuacggaagagguguccucccuaguuccuaccccucccugccuuccuuucagacauccagcucugcugcccacagugcugccuauacucaacagccaggucuccacaaaaccgcggauguugcuucgcaaaacccaccaucuuuaucugaagaaggggucauaguacacaccuccugggucuagggguuaaguggcaggaaguagcgcgcagacccgggguuacagcuaggagaaauuaggagcaggauuuuagguucacuucccggcaacacaaaaauaaauucgaaaaaagugguaccgagcaauagagguccuacgcuguugaagaccgacuggaagggcugcuguagccuguggcuccugacauggcccccuuguccuuggucugcua

SEQ ID NO: 3386 - RNA, 1173 nt, Mus musculus
ucagaaacaugucagcuuuaauuaauaacauggugagcaucauaagaaaaggaaagaacaaaagcucugucggcucccucguuccuugcacaaagggauuugagaccaaacaguuugaggacugacguuugacugcaaaaaugguaaaggucagaggaggagagggaagagaagagggagggggagggaggagaggaucgagggaagggagggagagggaggaggcccaggaugggggauagagagaaugaguuaagagacagagaagcaaagugugguggccauguagagagagcgguuuucaaaagauacaaauuucauaaaauacugacugcagcugggcuuguaaccccagcauguaugaaaugcugaaaccggaggcucaccagcaugcugggcgcaccucuacucucagcacucaggaggcagaggcagaggcagguggaccucugugaguuugaagccagccuggucuacaccagugaguuucuggauaaccagguuauuacacagacaaaucccaacccagucuugaaaaaacaaaaacaaaacaaaaagacaacaaaaagaccaaagucugucuuaguggcagacagcuuuaaucccagcauuuaggaggcagaggccagcagaucucuguguguuaguucaaggccagccuaguguacagaaugaguuccaggacaucaagaacuacauagugggacucuugccuugaaaacagaacaaaacaaaaagaguucaaggccagacucugcuauguacuauauaagggggcggggugaggagaaggaacggggugggaaagagagggaagugagacugaauauuaaagauccaggauggaagaggccccgagagcugcagaagggaaaaggaugacuuagaaaaggaaccaagaacuagcaagugagagggacuccaagcauggcucugcccugccccagccaccacaugccaggugucaagucgaaauuguuacaaguugggaaaugggucagaacuauuugguccauagcaaauaaaccuuuguguuauaccucccaucugaacagggaagccagggcuggugacacaguggccaucacccuugaguaaacacaaaagccagcagguaaggcugggauacaauacagugggaauguacuggcccagcaugugcgggcugugggu

SEQ ID NO: 3387 - RNA, 20382 nt, Mus musculus
cacuggucuccuucucccggcagaaggcgcagccaugaauccguuauuuggucccaaccucuuccuccuacagcaggagcagcaaggcuuggccgggccgcugggggacccucugggaggugaccacuuugccgggggaggggacuuagccucggcuccgcuugccucggccggccccucugccuauucgccuccggggccugguccggcgccccccgcagccauggcucuccgcaacgaccuaggcuccaacaucaacguacugaagacccugaaccuccgguuucgcugcuuccuagccaaggugcacgagcuagagcgccgaaaucggcugcuggagaaacagcugcagcaggcucuagaggaggguaagcagggcaggcggggccuggcccgccgugaccaggcgguacagaccggcuucaucagcccgauccggccccuggggcugccccugagcucccggccggccgccgugugccccccaucagcgcgggugcugggcucgcccucccgcucgccagcuggacccuuagcauccucugccgccugccacacaucauccuccacuuccacauccacugccuucuccucgucgacccgcuucaugccuggcaccaucugguccuucucucacgcccgccggcuuggaccaggacuggaacccacgcuggugcaagggccuggccugucguggguacacccugacggggugggcguccagaucgacaccaucaccccugagauccgugcccuguacaacgugcuggccaaagugaagcgggagcgggacgaguacaagcgaagguagggacaggguucaagacaugccccacacagacacgacaggggcagggaguuaguuagugaggguuccuagaacggagaaguggggggcgggggguggggggcggagggcaagaaucguguuaacaagaguugaacuuccugugaugaugaaaagugaggagcagggaaagauuugguugcagggaccccagaauccacagacaguucucaagucagacugguggcucgaagccuucuagaacacugggaacugaugcuuucuucuggcaugucucccugucuuaugcaggcugcagugucugcgugacucugcuaacugugggguguugugugguaugaaagggagacauccgagagagcucugcaucugugggucuugguugucgggccagcuucagaccuugggggcaauuucaggacauaaacuccacauauggggugaaggaugcggcuuuaauucuggaggcaaauuaagugaaguuggaaggagguagugaagggcgacugugccugcccagggccuccucuaaggcauguccccagaagccaggucucacccugguuccauacaagaggcucaaggacuccggaagcuaaagauauugcuuggaacagucaaaacacacaggaaaagagagaaaggguauggggucuccuaggacaaggagaagggauggcugucauaaagcuggugggggcgcucuaucagaagaaucuccaaccagaaccaaguaaaaaaaaaaaguugggacaugggcacgcccuacagagauacagaucggcuaucucaggaccagcacuguguguucugagggugaagguuuggcuuucugagaggaacccuguccccagcagguuaacauaagaguuaagaggaagggaugucacauuggagugcuggcuguuuaccaggaggacucccuggauggcugguaaccaggcaacaggacagggccacaggcagagagaguuuucucaaggcugaccaggcccugguugaggaggaaguugguggcggucagaggggaagcccagauuuggaggcuccagugucuuaccuaaugugacccuuugggggauagccuggucugugugugcaggccaagguggcagggaucgcuaucugguuauagccgugugugaggacuauuuggaggcccuggaaacacuuuguaggcucugggugaccuucaaggguuggugaucucuuagcaucccccagaucgcaugcaucagcaggcuuccugaaguucaauccucacccuggcuuccaugacuguggcccaugucuuuggguuuuuaguuaucccagccucuaggcaccgcccagggccugcccgcaccugccuucuccccugaagggcuuaacagccaguggagcauggacaguucuggaguucugcucuaguccuaggaacagcugcuccucuccaagccaucuuuuaaaacagagacuguuuguccuuggugcagcugucuugggcagcaaagaguuauccuuggggacugguuagcucaucacugcagcacagggucgugcagagggcccgcggcuaggauugcaugguacacgacacucgcccuuccaccccagugcccccucccuccuucugagcuccucacaccgugcccccacaccccacuccguuagccuggauggcaugcagagcuugauuauuaaacugggcgggauggaggccccgccacccccuagcuccugucuuuagcuccuuugccugggugauauuuuucuuggggcucaguuuuuccaguaauaaggaugcuccuugcucuuucccuucaacucaaauauaggauuuauuugcaggcgaagccuuugguaaauguaguaauuaugaaauuugcccagauucuacccaaguuaugggaaccuugcaaaaaaaacaaacaaacugagauuugaaugcaggccacacugcacccaucgguaccuggcuggagaccacugcgggcaucuagauaauucagauuucuuucccuguaugagccaucucauuaagcaucaucuugccuuaaacuugcucguguuucacugggauuuaucaaguucaucccugacgcgucuuggccagggucguaaccucuugucuauccuaugggcuuuuccucuagagacucacagacucuaggcacacaggaugccacaucccauacuuguagaggaagaaaccagagccuagcaaagacaaaggucucauguaagaaaacguguaacgugagguuaucagacucugucacugcuggaacagagggagaagcaggcgagggggagugcagggcuggcaggaaacaggauaagagggugugagggagggccacagcugagcugcauggucagcugcagggugguggcuaggcuggcugccucuuccccuggcugccuggaguuauuauuaggaacacugcagugcggcuguaggugcuggacaugggagagucauagaacccgagagggcgagggaggggcaggagcaaggagagaaggggcccgagagcuuaguccuccugacugcagaggcuguccucggcugccuccucuccaugggucucauuucgagucuucuucuucagcuccguugcccuccuuucugaggccagaagaagccugugcaggcagagugcaggcggaagugaugagaucacgcacacaggcauugccuugggugcugaaccugcauggucaagcagcaccccagcuuccaucuccaugacgauggaaugugcaccuagcccuggguagcgagcgccccauagucacugcuccauagcaagugccuucggccugcugacagugugggucugagcucugggugagagaugcuguacagcuuggccgugccuucucacccacucacgguucccuuuccccugcgugcgguuauucagcaauagcuagcuucccgugcccacuuuuuucacgcugcuggggggacaucacgccagcccugugaccuucuuagagcucacuucaaggggcuggguggggaaggacuuugcucccagccaggcugcugagcagcucuugacccagccuguguccugcagaugcuuucacaggaggcagggcacagccuaacaagcucuggucugugcgggcaggagcgggagaccggaucugugccacugaaggugggagacugggucauaggggggacaugguggauuggugugugggcaggaggugggggaugagaccagccagacagcuggcggaaccgggccgguguggggauggguacugcagaggcccaagugguagcaguuguuuuuaaauauaguucuugguacgugguccggagguucugggcaggcaguuggugagcucagcccuugccaggaaguguggagccauucaacagcugcagcugcccccuggccggccgccuguaaauucuugcuucaaccaguucccaucuagggaaccagaccugaggucugaagccugggccugagacggagggagggacaggagcugucacugucacggcaggagggacucuaggcuguguucucuccccuucccaaugucugucaggugggaagaggaauacacgguucggauacagcuacaagagcgagugacugagcuccaggaggugagggcagccaccccacagccccugcaucccuguccccaccccauggcuuuucccacacugacaucauguccccgucuccuggcuguaggaggcccaagaggccgaugccugccaagaggagcuagccaugaagguugagcagcugaaggcagagcugguggucuucaaggggcucaugaguaaugugaguuccugcccuccucccccugguccucgccccuucccuuccucccugggcuuugcucuuccccacggucuccauuguugcccuguuguaaaggaggaggcucagccucaugguugguccaagccauuagcggaagcagacucucuggcagcucacaccuuaaucccagcccucgggagguggagccagaaccaucagaaagcugagggguucaaguccagcaucagcuauguuuaaaaaaauaaaaugggggcuggugagauggcucagcagguaagagcacugacugcucuuccaaagauccugaguucaaaucccagcaaccacaugguggcucacaaccauccauaaugagaucugaugcccucuucuggugugucugaagacagcuacaguguacuuaugaauaauaauaauaaauaaaucuuaaaaaaaauaaaaaauaaaauaaaaaaauaaaacaaaaugggaacgugcacagcucuggagccggcugccuaggcccaggugugaauucugccacucaauagcugucuggccuuaaagcucuuccuuccccaccaaaccucuuugcuucaucuguggaauguggaaaagcgcaggaggaaggacaucucaaggucgccuugaagcagaugaugccccuggcugguguguacugcuagacagugagacaagugucauuuauuaucucuccccaaccccaaacccccugguucuucuuuuucuuuucuuuucuuucuuuuuuuuuuuucuagacaggauuucucuguguagcccuggcuguccaggaacucacuuuguagacuaggcuggccucaaacucagacagaaauccaccugccucugccucucaagugcugggauuaaaagcguacgccaccacugcccggcacccccuaguuuuucaaagcagucuuacucuguauaacagcccuggcugucuugaacuugcucuauagcgcaggcuggccuugaacucuuguuuuguuuuguuuuuguucguuuuuuucgagacaggguuucucuguguagcccuggcaguccuggaacucacuuuguagaccaggcuggccucgaacucagaaauccaccugccucuuccucccaagugcugggauuaaaggcguccgccaccaccgccgggcuagccuugaacucuuagagcggccccugccugcuacccuagugcugggauggaaggcauguaccaccacucccuggcugucucuuucaucucuggagauuuacauucaggaggauauaaagaacuguuguugguuuaauggaggcccugcucgucccagacuaggcggagcccucccaggucuauguggcugggugugaguuucaugaggcuccugauggaugcgccaauguggucggaugggccccugagaaaagggaugcuucauccagcaggucagggcuucguggaggaggugacagugguguacuuggaaggaugaggauuuugcugugguuuuauugguuccagcggggguacugggugucuccucacugcuccugauguucccgguacagaaucugacagagcuggacaccaagauccaggaaaaggccaugaaagucgacauggacaucugccgccgcauugacaucacggccaagcucugugacuuggcccagcagcgcaacugugaggauaugauccagauguuccaggugagaggccugcuggccgcccccucgggcggggcugggcaagggagagacgcuccuaucauggcuggccuggaucucaggucccgcugcccuucacccugggacacaucucgucaccuggggcccuuggugggacuaggcugggaggcaaggaacagccucaggagagagguuuuggaagccaugucuaacuccaucucccccuccccccucucugucugcuucucuucucucuguuccucucaucuuuucucuugcuuucuccguagaagaagcugguuagugugaccucacgcaagcuuauugucccagucccugugucuaagccaccccgcucucagucuugagccacugggcccuuccaaagagaugccuucuuccuuucuguuucuuguccccuuucgcccccaccuccccgcccccacccccguuuuagucucuuccuucagcggccuuccagaucuggaugugauucuagcucucccauaguaaagacacgccucucaucuuccucgcagcuagaauuggguucaguugaguccucuaaugagaaagacuucaaaacuaaagcaaacccaguucuuccguaguugauaaacacaacuuuuugcuuuuccuaaagauuuauuuuauguguauggauauuuugcuuccauucugucugugcaccgcaugagugccuucugcccaaggauaccagaagaggccauuggauucccuuggaacuggaguuauggagggcacugagccgccacguggcugcugggaauugaaccaggguccucuggaagagcauccagugcccuuaacagcucucuggcccuuguuaaacacagcauccuguggucaccacaagccguuucucuccuuaucuuacuggucuacuuccguuucucuuucuccuuucuucgcccgcagccuugcccuguccacgugugucugccuguuucuguuccugucauguaacugugucucuucugucugucccccuuccugcuggcccugccucacccugcggccucccugcccacccuuuccucaugcacccggccucgccucuguagucucuacacuugucucccauuaaggucccguccaugggggggcggaagcgggagcgcaaggcugcuguggaggaggacaccucccugucggagagugaugggccccgccagccugagggugccgaggaggagagcacagcccucagcaucaacgaggagaugcagcgcaugcucagccagcugugaguccugcagcuccaucccagcugcucucaccagacacacccugacuccuugccaggucccugaggccaacccccagcuccaucccagcuguccccaaccagacacacccuaacugacuuuuuaucaggucccuuaggccagcccccagcuccauccaagcugcccccaccagaugugccccauucccccgaggccggaguuccuauagugcccuaagccugugcagaggccccagcgcccuugacacauggguucccugucucuaggagggaguaugauuuugaggacgacugugacagccugacuugggaggagacugaggagaccuugcuacuuugggaggauuucucaggcuaugccauggcagccgcagaggcccagggagagguaaccuccccuccuggccuuaggccccucaggcucugccccuguguccuccacaccccgcccccucccaugcuccguccccaguguggcuuccauccucccuggcuucuccccacuccugcuuguggaccuccuccauucuguuuccacuaaccacacuuucucucucuucccaccuuggccuguggaaugcccuuaaccugucucucccuggucggcugccccucgguuccccuuucuccagcagcaggaggacagccuggagaaggugaucaaagacacggagucccuguucaaaacccgggagaaggaguaccaggagaccauugaccagauagagguaagggugccggccucaggagccacgcuguagguccagggcucaggagccacgcuguagguguguugcuggccuccuccucgcugaaccccagggcccgagcuuccaucuguugucaguagugauccucucaguugugguagcuguagcagguccuugagacuucaggaucuggaggcacauagauguggguucaaaucccggcucugucaccacauggaacaaaucuuuugcugucccucccuccuuccuuuuuauuuauuuuacacacacacacacacacacauacacacacacacacacacuggauggauggauggauggauggauggauggauggauggagugucagagagcaugcgcaguccaugcacauguguagaggucagagaacaacgugugggaggaaguucucuuuuaccaugggggugacagcaaucaaguuuaggucuuuggacuugguggcucaugccuuuacccggugaaucauuucccaccagacuaucuuuuucuuuucugucccccccuuucuuuuuuuuuucuuuucccccugacagacagggcuucucuguagcccuggcuguccuggaacucacucuggagaaguuacugugccucuccugggauuaaaagugugcaucacaacugcaagcucucucgcacuugugaguguccuuccugccccugccucucuguuucuuuucaagaucuugucuuguagucuagguuggccucaagcuccuggugcuucugcccacgccuccugugcgauaggauuacggcaggagcuuuaagccagcuuugacugaccagcuuuuuauccuuccuugggucuuccuccuuuccucugugugugugugugugugugugugugugugugugugugugugcgugcacgcgcacauguguacacauacaaguguggaggccagaagacaaaccuggguaguguucuuugagugugguuaaggguuuuuuguuuuuuuuuuuuaauugagacagggucuuucacuggucugaaacuugcugaguaggccgagcuggccagggagcccuaggcaucuuuugucugucugucugucugucugucugucuguacauucuuagcuuugggauugcaaguguguucuacuauggcuaguuuauuuuauuuuuuuaagauuuauuuauuuauuuauuuauuuaauauaugaguguucuaucuguauguacaccugcaugccagaagagggcaucaggucccagguugugagcuaccaugugguugcugggaauugcaagagcaaacacagugcucuuaacugcugagccaucucuucagcccuagcuuauuuucuagauggguucuaagaucaaacucaggucuucaugcugugcaguaagccucccacugaugagguguuccucagcuagcuccuucauuccuuuuuauucuuuuguuguaggcucucacacacauucaucuugccugccugccuuccucgcagauccacgcccccaucucuccucucucuuucucucucucucucuuucucucucucucccucccucccucccucccucccucccucccucccuccuuccuucccucccucccucccccucucuccuuggaggucagaggugggcaucagguuuccaggagcuggcgcucacagguguuugugaaccugaugugggcgcuggaaaauaaacuuggguccucugcaagaacagggcaugcucuuaacuacugagccauccuaagcccccacccagaccagauuucuguguagccagucaaacuugaggcaauccuccugccucagccuguuaggguuagagaugguuucuacccugcuaagggugggccugucucuuuauuuguccaauagagauguucauaaucucucccgacaggcugguaggcaggcaggguuauuaagaugaucagauagagugaggcgcgcguggcucuuaggacaggaucuggcagguugacaugcgguagugugcgcauuuauuacugggaacacccuaagugccguagcacccagagggacuccugucuccuuggcucagccuuggagcuccuggaggugucucccucuuuuguuuuuugagccuuggggcaucggguaugaauggugguggggcugggguuuagauuguccugcuggacugcaggcagggacugcaggaagggggucgccauuggacagugaacagggcucuaugucuuagacacugaugcagggaugaggcaggagacuaaugccauugggcucccugcgagcccuguggugcauucccgugcccaugggggucacucuguuugcauuuugaaagggaacuuuggaaguaacucuucugcaguggccagcacaugucagauggccgugcuacucugaggaaaaccagugcuuuugguuuuuaacccagaauucccacccagccaguguucugccaccaguuaagcuuugccuggggacaaaugaucucccaucuccuccuguccgcuccucuuacugcuccuuccuccuuccugucccccucccuggguuguguccaccucuuacagacgguagauuuaaggcuugguccuuuuuucccuaccgucagccagguaggagucuuagcacagugaucaggagcugcugcccuucugugguucaucccuuaggccacaaauaacuaaguguaaacaugaugugguaggacagagaagagcacccugggcugggacugugcucucaugguagaaugccugccuaccuucaugcgugaagcccuagguuugauaccaguaccuauaaaauggagugugguggugccaccuuuaguccugguagugggaaaacaggcaggaggaucucugugaguucgaggacagccuggggaacagaacuacuuccaggauggccagggcugcacagagaagcccugcuucaaaccucuacucucccccugcccucccaaaaaaauugggaacauguuugaagcuguuccuaaguuguaugacuucuguucucuccugggagaaugaguugaggagaaagccaaaggaugcucacuugguagcguugguagcagaguagcuccugggucucccuggagcaucuguaggaccuuuaucuccaugacccuugaucucaggguuauuggcauagagauagaccagcccccauuauugaauggugaugcagagugguggguggaguuuucuuccauggccccgccccuucaucgcuccuaucuaccucuaccccugccucucccacacugagucugaaauuugggggugauuuguugaaggcaucuucuagaaugugcaucuuccccuucaguguguaaaucagggugacauaugacacuuagagacauggcugguaguacugccuuaugcuuugagagacuauaauggaggugggguaggggagggagugagggguaugcuuguauuuaugggugacagcugcucucgaccuguaauaguguguguguguguguguguguguugguaugaaugggugacagcugcucucugaccuguaauaguguguguguguguguguguguguguguguugguauguaugggugacagcugcucucugaccuguaauaguguguguguguguugguauguaugggugacagcugcucucugaccuguaauagugugugugugugugcguguugauguacauggguggcagcugaucucugaccuggaaugcugugugcauuugucugugggggguggcagcugagcucugauccucagugucauguuuuucucacaaauggugcagucugcugugggaacaagcaugccuuucaagccaucuccucuguggcuuaccacccagcuguucagcagaugacccaaaaugccaguguccuggcugucuccuuugucugcuccuggggcccacucccacccgguccaguucacauuuguuucgggugacuucccacagcugauccacaugcuucaaggccacucggccuccuugucuuugcccucaggcagccaagcaaaucuccccaccgcagucugauucucccuaucuggccccuggccuuuguaucacaaacaaagagaggccgcaguuugucucuggccuagauacuuuuccgccucagccuacuuuuuuugcugccuucaaaccuggcugcagagucagcucuggaagggagacuuuucuugauacagagacuccccccccccauuucuuuuguuggggauuuacccuguaaucacucaggaggaaggucucucucuuaugugggcgagcaggauauaagggagaagaugauguggaaugaaaugcuauaaacagaagcagccagguucccuccauugcagcgaggcuuuggaauauuucacagugaauuagcuucaguugaggggaggcucaguggcaaagauggacagaugaguggcccugucuguccuuaaagcaguggugcucagccuuccagacgcugugacccuuaacacagugcuucacgcugugguggccccaggcauaaacuauuucauugcugcuucauaacuaauuuugcuacuguuacgaauuauaacauaaauacagacaugcagagugucugauagucaacccccaaggggauugagacucacagguuaagaacugcugccuugccgggagugguggugcacaccuuuaaucccaacacucgggaggcagaggcaggcgcauuucugaguuccaggccagccuggucuauagagugaguuccaggacagccagggcuacauggagagacccuguuucgaaaaacaaacaaacaaaauacuaaauuuuuuuuuuuuuuuuuaagauuuauuuauuuauuauauguaaguacacuguagcugucuucagacacaccagaagagggcgucagaucucguuacggaugguugugagccaccaugugguugcugggauuugaacucuggaccuuuggaagagcagucgggugcucuuacccacugagccaucucaccagcccccaaaauacuaaauuuuauuauuauuguuauuagugugugugugucucucucucuccacaugccacggugcauguguggagguuagagaacaaauucacauugccagaugcgcaggagccuuauccacugagccgccugguguggccuccuuaccccuuuuugagaccggguuuuauauuuagguuugccuucgggacccugcugccugagccgaguaagcgcuggagggaugcgugcuccccgcaccgcaccgcaccgcaccauccuuacuguguugugugcucuugcuguucuuacagagaacucagacaucagcugauugauucuuggguggcaguaggaguggauuggcaggacagggccgagcggggagcacuguccugagcccuugccuagccacagugagggccugaagucagaucgccaguugccccaccccuccuccauauccugggggaaacaggcaguuguagcuuacuugucuccugagcugcuuggcccccagggccuugccuggguuugcuaaccgugguccucccugaccccaccuuacugcagcuggagcuggccacagccaagaacgacaugaaccgacaccugcaugaguacauggagaugugcagcaugaagcggggccuggacgugcagauggagaccugccgccggcucaucacacaguccggggaccgguaagggccugccccgagcgggcugggucucucucccagggaggaaggcuggaauaggccccgauggucugugggcagggaccaggucacaucuuuauguccagcuguccuugggagucgccuguagguguggcccagaaugaagcuuccucucccugccuuggccaucagaugaaacugaccagugucccaacucugagugucuuagaaccuaaaccaggcaaggaccaaagauacggggacaggaucuuauccaaaucacggguuuauguguuugaccuuguguaagaguaaaucugggguuucggaguauagcuuagugguagaggacuugccuagccuguguggggcccuguguacacacacacacacacacagagacagacaggcagacagucagacacacagacacacacacagauacaaacacacacacacagauacacacacagacagacacagacacacagauacacacagacauacacacagacagauacaggcacacagauaaacacacacagacagauacacacacagacacacacauacacacacagacacacagacagauacacauacacagacacacacacauuaaaaauuuuuuuuaaaauuuacugcaaaccaggcagagugguacaugucugcaguuucagucuuggaaggcagaggcagaaggauugucaugaguuuuaggcuguccuggacgacagcagcaaaaauuugucccaaacaaaccaaauagcaacaacaaacaaaauccaagaaacuacaguaagucaggugugcuagcgcauaucugucauucaaaugcauagaagcaacaggcagguacuccaaguaccaggccagccucaccucuguauagaguuccaggccagacaggaaugcguacaggcccugucucaaagacaacaaaaaacccaacccaaucucccaaauuacaucaagcugaguauagugugcaugcuuacaagagaucuguggcuccaccccagccacuuuggaggcaagaggauugcuugcacccaggaguuuugggguccagcagcccccacccccauaccagauuacugcuggacaagaagcuaaggccccagcguggcucagggggcaucuccgugcugugacuucgcacuuuucugaucucugagccucucagagccccccaagauaagagaggcacugcuccccaucaaguugaaaagggaagugucuucuucccuccccagcccuugccuggcacccccuguaccucagaaggccaugagaaagcaagcuuagaagucugcagccuuccugcuugguccaaggugacagcugguguuuuuuucuagaaagucuccugcuuucacugcggucccgcuuagcgacccgccgccaccgccgagugagacugaggacuccgaucgagacgucucaucugauagcuccaugagauagaaaccagugucuggcaccccagagcucacuggggcaggggugugggucugcaggggugugggucuucugugccacugcaugaagccuggcccugggcugucccuccccagguucuggggugucuggagcuaggcucagccccacccucccuguacaacgcccaugacauugggacacuccuuccugccuuccucacauguggguaucugcuacuucuccaucuucggaaugcugccaggacacuugugagccucccuuuuccacuuuguaaggaaugugaucacgggaccugccuguauuccuuggguaucuuggauuuuguacuggugcuaacuugccuaggcacucgugugaagcagauucaucauguaccuugggauagggcuuugcucccuaguaaggcuuuggaggguguggggugcucuguccacaugcucccagcuguucacuugccucuugcagugaacauggccgugcaggcucgccuuugggaaguccugugcugggcccaggucgcggcugaggaggugaagcugcugcccgcacauggguguggccugcagguuacuggugcucggggccuguuucuccagugagcagcugaggguaugccgccauggcugucacugacaaaaccaaaagguuaagaugucccugaccuagggagucagucacgaccucccaggagacgcuauguugaacuauuggaauggaaccuuuaaaagcaaugacgguguggaauacuucccaagcacugagucacugugugacgcacgaaccaaagcaucgaccagugcuacagccccucuucauggauaccacuagguuuuacuguacugggcgcccuuccaauuuuaucuaauuuuacgucugucugcaggagggcuggguacaauuaaccuuuguuugcagauaaaaggacaccgaucuuucucaagagcagugagcucuggaagucagugcuguccaacaagugagucucagacugcauuuccugucccauugucaagccccacccuccgcauugccagacauaucagcuguucaggacaggcgcccugggcugggacuuggauagaauguagcccuggacuuccggcacccagcuggaugucagagccaauaaagauacaugcacaaaaguugauugagccugcuucaccuccccauacacacccucccucccccaacaccgcauuaaaaccaaggagaggugggugcagcgaacuuuauugaugguauucaagagaguagggagggcucccuaggccccuccuguuauuaugggggucugggauggaaauugugagggagaugcucaguguugggggccgaguugggauagggccucucuugcucaguguccuugcuggggugggugguccaggguuucuuacuccuuggaggccauguaggccaugagguccaccacccuguugcuguagccguauucauugucauaccuagaacaaauugggacaacuguuaguuuggguuucuuuucugagcuagccaccagagggcaccaaacccccaguugcucuuaaaagucagguuucccauccccacauaccaggaaaugagcuugacaaaguugucauugagagcaaugccagccccggcaucgaagguggaagagugggaguugcuguugaagucgcaggagacaaccugguccucaguguagcccaagaugcccuucagugggcccucagaugccugcuucaccaccuucuugaugucaucauacuuggccugauaagaacaaaccccaaaaugacuauccuugucccaagucacugucacaccagagacaagcccagcucuccccauacauacagguuucuccaggcggcacgucagauccacgacggacacauuggggguaggaacacggaaggccaugccagugagcuucccguucagcucugggaugaccuugcccacagccuuggcagcaccaguggaugcagggaugauguucugggcagccccacggccaucacgccacagcuuuccagaggggccauccacagucuucuggguggcagugauggcauggacuguggucuagaaaacacgggggcaaugagugagguccugcacggcaccccucuacccaaaagggacaccuacaaagaaggguccacucauggcaggguaagauaagaaaugcaugagcugucuccccacugccuacauaccaugagcccuuccacaaugccaaaguugucauggaugaccuuggccaggggggcuaagcaguugguggugcaggaugcauugcugacaaucuugagugaguugucauauuucucgugguucacacccaucacaaacaugggggcaucggcagaaggggcggagaugaugacccuuuuggcuccacccuucaagugggccuguuuaagggaaagaaguugauuucagacucaguucuugguuuucagguugcaccauaucaagggugcccgucaccuucagcuuuccggccacuuaccccggccuucuccaugguggugaagacaccaguagacuccacgacauacucagcaccggccucaccccauuugauguuaguggggucucgcuccuggaagauggugaugggcuucccguugaugacaagcuucccauucucggccuugacugugccguugaauuugccgugaguggagucauacuggaacauguagaccauguaguugaggucaaugaaggggucguugauggcaacaaucuccacuuugccacugcaaauggcagcccuggugaccaggcgcccaauacggccaaaucugaaagacaagaaacaggggagcugagaucagaacuccucaugggucuguagugagccccaggcuaucucauguucuucagaguggaauacuguugcaccauagguguggagaaccugcagccaucagcuaugcacguaccacaacaaagguacaagccuuuaugcagacacaguacauuagaaauguaugcaucaggaaguucauguuuuguucagaauucccuuuaauaaagcuaguugaaugcuuggauguacaacccaaauauagacuguucccacccuagaaaguccaaagagaucuaauuuuauauucuuugagcagccgaggccuggcagggcuuuuauagcacgguuauaaaguggagguuucuuuccuguccaagaggugauugcuugcccagcaaaccuccuccaagucauucuaagucucuuaagaaguggcaguuugccccagucuggguacaagcuuggcacaucacccccaucacucaugcccugggaaguuuguuccagcauggcuggacuucaggcuacacccccuggacagggcagaccugugaacucauucaucagcaagcucaaagggcaaggcuaaaggucagcgugagcagcacagggcgggcccaccuguguccuccaagucccucgaacuaaggggaaagacugagaaaacaugugggggguuuccaacccuaaucccagggcucguucgcgaaacaccuguucuucucgggcaaaaaugagagccggagcaacagauguguguagggggagcaggguggagagcccgcucagaccccagauccagaaaggucacacggcuaaauuuaaccucagaucagggcggaguggagagaucugguuucuggaggauggaacggggagaagggcaggauucugaggcgcagggacacccaauccucuuaaugaccuuuacauccuggccuauagggccugggucagugcgaggcugugaugggaagugcaggggauggaaggggcugcuacuacaggagccauuuugugguggaaaauuucuuuucagaaccaccaugacucagcuccccaucccacggcucugcacuacgccauaacuaccucugggguugggaggucaagcggaccucuguaaguccgcuuugauuuucagagaauaaucuagaauacgcauuaugcccgaggacaauaaggcucaagggcuuuuaaggcuaauaaggugagacagauugugagguagaacucucucgagagcacggaagccuugcaucaccuggccuacaggauaaaggacacuccacccagccgagaggaaugagguuagucacaagcuaggaagaaggaaggccuaagcaagauuucauaacggcgguucauucauuuccuucccguuugcaacauggcggcggccaguuacccuaaaggaagcccaagccugggagaugaugcgcaaagguaugcaccucacaacgccaugccaccgaccccgaggaagggggagaugggggaggggcuucccuccuggcacgugacuccucagggcgcgaaaguaaagaaagaagccccggacuggggauuacgggaugggucugaacgggcgcgugggguuguuccuaauacuuaagacuccgggccgcucauccccgcaaaggcggaguuaccagaggugcagcagcugggggccgcaagugcgagccaucgccagguccgagcgcugaccuugaggucuccuugggcgcuucggccaccucauccaccuccccacaguacugcagagcccccgggucagcaagaccugcguaggcaacggagcagggccccgcccuggaacucacccguucacaccgaccuucaccauuuugucuacgggacgaggcugcaggagaagaaaaugagauuagcguggcccgaaggacaccaggcaguccccucccccaccccgccuccauucccgccgugcgccccaucacguccuccaucauccccccccugcaaugcggagccuggguccggcuugcacacuucgcaccagcaucccuagacccguacagugcccacuccccuucccaguuuccgacuguccccggccuccugcggcccacuccgcgauuuucaccuggcacugcacaagaagaugcggccgucucuggaacagggaggagcagagag

SEQ ID NO: 3388 - RNA, 4624 nt, Mus musculus
aggagaggugggugcagcgaacuuuauugaugguauucaagagaguagggagggcucccuaggccccuccuguuauuaugggggucugggauggaaauugugagggagaugcucaguguugggggccgaguugggauagggccucucuugcucaguguccuugcuggggugggugguccaggguuucuuacuccuuggaggccauguaggccaugagguccaccacccuguugcuguagccguauucauugucauaccuagaacaaauugggacaacuguuaguuuggguuucuuuucugagcuagccaccagagggcaccaaacccccaguugcucuuaaaagucagguuucccauccccacauaccaggaaaugagcuugacaaaguugucauugagagcaaugccagccccggcaucgaagguggaagagugggaguugcuguugaagucgcaggagacaaccugguccucaguguagcccaagaugcccuucagugggcccucagaugccugcuucaccaccuucuugaugucaucauacuuggccugauaagaacaaaccccaaaaugacuauccuugucccaagucacugucacaccagagacaagcccagcucuccccauacauacagguuucuccaggcggcacgucagauccacgacggacacauuggggguaggaacacggaaggccaugccagugagcuucccguucagcucugggaugaccuugcccacagccuuggcagcaccaguggaugcagggaugauguucugggcagccccacggccaucacgccacagcuuuccagaggggccauccacagucuucuggguggcagugauggcauggacuguggucuagaaaacacgggggcaaugagugagguccugcacggcaccccucuacccaaaagggacaccuacaaagaaggguccacucauggcaggguaagauaagaaaugcaugagcugucuccccacugccuacauaccaugagcccuuccacaaugccaaaguugucauggaugaccuuggccaggggggcuaagcaguugguggugcaggaugcauugcugacaaucuugagugaguugucauauuucucgugguucacacccaucacaaacaugggggcaucggcagaaggggcggagaugaugacccuuuuggcuccacccuucaagugggccuguuuaagggaaagaaguugauuucagacucaguucuugguuuucagguugcaccauaucaagggugcccgucaccuucagcuuuccggccacuuaccccggccuucuccaugguggugaagacaccaguagacuccacgacauacucagcaccggccucaccccauuugauguuaguggggucucgcuccuggaagauggugaugggcuucccguugaugacaagcuucccauucucggccuugacugugccguugaauuugccgugaguggagucauacuggaacauguagaccauguaguugaggucaaugaaggggucguugauggcaacaaucuccacuuugccacugcaaauggcagcccuggugaccaggcgcccaauacggccaaaucugaaagacaagaaacaggggagcugagaucagaacuccucaugggucuguagugagccccaggcuaucucauguucuucagaguggaauacuguugcaccauagguguggagaaccugcagccaucagcuaugcacguaccacaacaaagguacaagccuuuaugcagacacaguacauuagaaauguaugcaucaggaaguucauguuuuguucagaauucccuuuaauaaagcuaguugaaugcuuggauguacaacccaaauauagacuguucccacccuagaaaguccaaagagaucuaauuuuauauucuuugagcagccgaggccuggcagggcuuuuauagcacgguuauaaaguggagguuucuuuccuguccaagaggugauugcuugcccagcaaaccuccuccaagucauucuaagucucuuaagaaguggcaguuugccccagucuggguacaagcuuggcacaucacccccaucacucaugcccugggaaguuuguuccagcauggcuggacuucaggcuacacccccuggacagggcagaccugugaacucauucaucagcaagcucaaagggcaaggcuaaaggucagcgugagcagcacagggcgggcccaccuguguccuccaagucccucgaacuaaggggaaagacugagaaaacaugugggggguuuccaacccuaaucccagggcucguucgcgaaacaccuguucuucucgggcaaaaaugagagccggagcaacagauguguguagggggagcaggguggagagcccgcucagaccccagauccagaaaggucacacggcuaaauuuaaccucagaucagggcggaguggagagaucugguuucuggaggauggaacggggagaagggcaggauucugaggcgcagggacacccaauccucuuaaugaccuuuacauccuggccuauagggccugggucagugcgaggcugugaugggaagugcaggggauggaaggggcugcuacuacaggagccauuuugugguggaaaauuucuuuucagaaccaccaugacucagcuccccaucccacggcucugcacuacgccauaacuaccucugggguugggaggucaagcggaccucuguaaguccgcuuugauuuucagagaauaaucuagaauacgcauuaugcccgaggacaauaaggcucaagggcuuuuaaggcuaauaaggugagacagauugugagguagaacucucucgagagcacggaagccuugcaucaccuggccuacaggauaaaggacacuccacccagccgagaggaaugagguuagucacaagcuaggaagaaggaaggccuaagcaagauuucauaacggcgguucauucauuuccuucccguuugcaacauggcggcggccaguuacccuaaaggaagcccaagccugggagaugaugcgcaaagguaugcaccucacaacgccaugccaccgaccccgaggaagggggagaugggggaggggcuucccuccuggcacgugacuccucagggcgcgaaaguaaagaaagaagccccggacuggggauuacgggaugggucugaacgggcgcgugggguuguuccuaauacuuaagacuccgggccgcucauccccgcaaaggcggaguuaccagaggugcagcagcugggggccgcaagugcgagccaucgccagguccgagcgcugaccuugaggucuccuugggcgcuucggccaccucauccaccuccccacaguacugcagagcccccgggucagcaagaccugcguaggcaacggagcagggccccgcccuggaacucacccguucacaccgaccuucaccauuuugucuacgggacgaggcugcaggagaagaaaaugagauuagcguggcccgaaggacaccaggcaguccccucccccaccccgccuccauucccgccgugcgccccaucacguccuccaucauccccccccugcaaugcggagccuggguccggcuugcacacuucgcaccagcaucccuagacccguacagugcccacuccccuucccaguuuccgacuguccccggccuccugcggcccacuccgcgauuuucaccuggcacugcacaagaagaugcggccgucucuggaacagggaggagcagagagcaccagggagggcugcaguccguauuuauaggaacccggauggugggggggagcugaugacgcgcgccccgccucccgcccugcuuauccaguccuagcucaagggcgcagaggccugagcuacgugcacccguaaagccgcgaguagcugggccucucucauuuccccuccucccucucuuuggacccgccucauuuuugaaaugugcacgcaccaagcgugugggcuccgaacugauagggggaggggagcugagauugccccgcucaggaggugaccgggugaugguucccaggauaggacucagggaauacagacuaugaacuuaaggacgaggaguccuuggagugugcaccaaggacauccaggacccagagaccugaaugcugcuucccgaguaaaaugggagaacaggggaaauggagaagugugggucucccugccacugcaucaucgaaccucuccccauuauugaaaaggcugcggaaaaguugaggaucuucuccucguuguucuucgguagugacacagcaacccccccccccgaaaaaaaaaagaguggaagaaaaugccagggugggggcacuuuuccucccgcgggagcccucaggagccccauuucccuaucugccccccccccccuccuggcuucugucuuuggccagaggccuggcuuguguaccgcgcugugagggcaaggggguggccaggaagacgcuugaaaaggagauugcuacgccauaggucaggaugcccugcagccuggaaaccugauaauugagacuuacaaacacucuccugaguuuaccugaugaaccuaagcugggaccccgggguaagggcagcaucccucuuaaggguug

SEQ ID NO: 3389 - RNA, 4624 nt, Mus musculus
caacccuuaagagggaugcugcccuuaccccggggucccagcuuagguucaucagguaaacucaggagaguguuuguaagucucaauuaucagguuuccaggcugcagggcauccugaccuauggcguagcaaucuccuuuucaagcgucuuccuggccacccccuugcccucacagcgcgguacacaagccaggccucuggccaaagacagaagccaggaggggggggggggcagauagggaaauggggcuccugagggcucccgcgggaggaaaagugcccccacccuggcauuuucuuccacucuuuuuuuuuucggggggggggguugcugugucacuaccgaagaacaacgaggagaagauccucaacuuuuccgcagccuuuucaauaauggggagagguucgaugaugcaguggcagggagacccacacuucuccauuuccccuguucucccauuuuacucgggaagcagcauucaggucucuggguccuggauguccuuggugcacacuccaaggacuccucguccuuaaguucauagucuguauucccugaguccuauccugggaaccaucacccggucaccuccugagcggggcaaucucagcuccccucccccuaucaguucggagcccacacgcuuggugcgugcacauuucaaaaaugaggcggguccaaagagagggaggaggggaaaugagagaggcccagcuacucgcggcuuuacgggugcacguagcucaggccucugcgcccuugagcuaggacuggauaagcagggcgggaggcggggcgcgcgucaucagcucccccccaccauccggguuccuauaaauacggacugcagcccucccuggugcucucugcuccucccuguuccagagacggccgcaucuucuugugcagugccaggugaaaaucgcggagugggccgcaggaggccggggacagucggaaacugggaaggggagugggcacuguacgggucuagggaugcuggugcgaagugugcaagccggacccaggcuccgcauugcaggggggggaugauggaggacgugauggggcgcacggcgggaauggaggcggggugggggaggggacugccugguguccuucgggccacgcuaaucucauuuucuucuccugcagccucgucccguagacaaaauggugaaggucggugugaacgggugaguuccagggcggggcccugcuccguugccuacgcaggucuugcugacccgggggcucugcaguacuguggggagguggaugagguggccgaagcgcccaaggagaccucaaggucagcgcucggaccuggcgauggcucgcacuugcggcccccagcugcugcaccucugguaacuccgccuuugcggggaugagcggcccggagucuuaaguauuaggaacaaccccacgcgcccguucagacccaucccguaauccccaguccggggcuucuuucuuuacuuucgcgcccugaggagucacgugccaggagggaagccccucccccaucucccccuuccucggggucgguggcauggcguugugaggugcauaccuuugcgcaucaucucccaggcuugggcuuccuuuaggguaacuggccgccgccauguugcaaacgggaaggaaaugaaugaaccgccguuaugaaaucuugcuuaggccuuccuucuuccuagcuugugacuaaccucauuccucucggcuggguggaguguccuuuauccuguaggccaggugaugcaaggcuuccgugcucucgagagaguucuaccucacaaucugucucaccuuauuagccuuaaaagcccuugagccuuauuguccucgggcauaaugcguauucuagauuauucucugaaaaucaaagcggacuuacagagguccgcuugaccucccaaccccagagguaguuauggcguagugcagagccgugggauggggagcugagucauggugguucugaaaagaaauuuuccaccacaaaauggcuccuguaguagcagccccuuccauccccugcacuucccaucacagccucgcacugacccaggcccuauaggccaggauguaaaggucauuaagaggauugggugucccugcgccucagaauccugcccuucuccccguuccauccuccagaaaccagaucucuccacuccgcccugaucugagguuaaauuuagccgugugaccuuucuggaucuggggucugagcgggcucuccacccugcucccccuacacacaucuguugcuccggcucucauuuuugcccgagaagaacagguguuucgcgaacgagcccugggauuaggguuggaaaccccccacauguuuucucagucuuuccccuuaguucgagggacuuggaggacacaggugggcccgcccugugcugcucacgcugaccuuuagccuugcccuuugagcuugcugaugaaugaguucacaggucugcccuguccaggggguguagccugaaguccagccaugcuggaacaaacuucccagggcaugagugaugggggugaugugccaagcuuguacccagacuggggcaaacugccacuucuuaagagacuuagaaugacuuggaggagguuugcugggcaagcaaucaccucuuggacaggaaagaaaccuccacuuuauaaccgugcuauaaaagcccugccaggccucggcugcucaaagaauauaaaauuagaucucuuuggacuuucuagggugggaacagucuauauuuggguuguacauccaagcauucaacuagcuuuauuaaagggaauucugaacaaaacaugaacuuccugaugcauacauuucuaauguacugugucugcauaaaggcuuguaccuuuguugugguacgugcauagcugauggcugcagguucuccacaccuauggugcaacaguauuccacucugaagaacaugagauagccuggggcucacuacagacccaugaggaguucugaucucagcuccccuguuucuugucuuucagauuuggccguauugggcgccuggucaccagggcugccauuugcaguggcaaaguggagauuguugccaucaacgaccccuucauugaccucaacuacauggucuacauguuccaguaugacuccacucacggcaaauucaacggcacagucaaggccgagaaugggaagcuugucaucaacgggaagcccaucaccaucuuccaggagcgagaccccacuaacaucaaauggggugaggccggugcugaguaugucguggagucuacuggugucuucaccaccauggagaaggccgggguaaguggccggaaagcugaaggugacgggcacccuugauauggugcaaccugaaaaccaagaacugagucugaaaucaacuucuuucccuuaaacaggcccacuugaaggguggagccaaaagggucaucaucuccgccccuucugccgaugcccccauguuugugaugggugugaaccacgagaaauaugacaacucacucaagauugucagcaaugcauccugcaccaccaacugcuuagccccccuggccaaggucauccaugacaacuuuggcauuguggaagggcucaugguauguaggcaguggggagacagcucaugcauuucuuaucuuacccugccaugaguggacccuucuuuguaggugucccuuuuggguagaggggugccgugcaggaccucacucauugcccccguguuuucuagaccacaguccaugccaucacugccacccagaagacuguggauggccccucuggaaagcuguggcgugauggccguggggcugcccagaacaucaucccugcauccacuggugcugccaaggcugugggcaaggucaucccagagcugaacgggaagcucacuggcauggccuuccguguuccuacccccaauguguccgucguggaucugacgugccgccuggagaaaccuguauguauggggagagcugggcuugucucuggugugacagugacuugggacaaggauagucauuuugggguuuguucuuaucaggccaaguaugaugacaucaagaagguggugaagcaggcaucugagggcccacugaagggcaucuugggcuacacugaggaccagguugucuccugcgacuucaacagcaacucccacucuuccaccuucgaugccggggcuggcauugcucucaaugacaacuuugucaagcucauuuccugguauguggggaugggaaaccugacuuuuaagagcaacuggggguuuggugcccucugguggcuagcucagaaaagaaacccaaacuaacaguugucccaauuuguucuagguaugacaaugaauacggcuacagcaacagggugguggaccucauggccuacauggccuccaaggaguaagaaacccuggaccacccaccccagcaaggacacugagcaagagaggcccuaucccaacucggcccccaacacugagcaucucccucacaauuuccaucccagacccccauaauaacaggaggggccuagggagcccucccuacucucuugaauaccaucaauaaaguucgcugcacccaccucuccu

SEQ ID NO: 3390 - RNA, 24113 nt, Mus musculus
ugcuuaaaagucuauaaaaacauuuauucauuagaaaacagcaauuggcacaggcucggagaaagggaaaguggcagcagggcucuaagagaaagaccucaaugcaaaggccauuuccauguuaaaaccacagacaacaagcacuucuacaagggggggggggcacugaauccaagaucauccaguaagauacccugcacggcagggacgggaguaggcaaaggcagcuccuaggaccugugucuucgcccagaugcucugcggaugggggugguucucuugggugucucuucuucugucaucucugcugaaaguucuauucaaagaauuauaggaacaaaagcugagucauaaagauggggcaaaauggaucucaaaguaaacacaugcgcgcgugcgcacgcgcacacgugugcacacacacacacaaacacacacacaaacacacacgcacacggcacacugugaaagucagccgagcugcauagugaggaagacauggccaggaagaaugaauccacagcuaggcaagccccacuggaagaccccacacaggcagcugaucuguugggaggguguaucauaccguccucacuggacucgucacucaagaagacaacuuuggcuuuccucugggacuucuugcgcugcugaguuuguggacgaccagguuugguacgucgcggcuuaggugugacaaagucauugucugagucuacagaagucagaggcuguagccuugagacuagaaaagaaaggcaaggggaccauuucaaaaccaaaaacaaaccacaaaggaacaaaaaaaggguggggaccacucauaggagccccaugugggcuugcaucccucucauaccagcggaggguuucuuggcagacagggcucgcuggcugccucccuggccaguuucaaacuccucuauuccauccaugccucuggugugacaggcacgaagcuucugcucaaauucaucuauuauagccuggaggacagaaaguuaaagacagggcuggaaacauuaucucccugcuuaaaaagaaauagccaugaaaagagagaaaacuaaagaaaccaaucugaaacugugauuccaacuaacugaugccaccacaggggugggggguaaggugaccucaaaguccugaaaaugcccaguaugacacaagugguaaguaugugccacuguguccagugaguggacuuuggaugcugaucugucaaucacguuccuucauccaggaccacguauaccaggacaagaaggucaugggguggaggccaugcgggugugggacagagcauaugggagcucuacuuacugacuuuugcuuuaaacaugaaacuacucuaaagaagcaguccagugcaaacaugugcggcauaccucuacuaccaggagacagaggcaggggaaucucuguuagucugaggcagcugggucuacauagcaagacccuaucucaaggccuucacuggggcugggaagguggcauagugguuaggagcacuggcugcucuuacaaaagaccuguguucaguucucagggcccacaacagucuaacuccaauuccaaggggacuuggcaccuucaugcaaacauauacacaggcaaaauaccaaugcauguuaacaaaaaaggaaaugaauggccuuuaaaaaagggaccaggaauuaagaucuggucuuagucacucugguuccauagcuguagugaggcuagcaaggcagaaaguucagacaggagucucagagcacuuagggaggcagaugaaguuuacugcaccggaaccuaacaggaccacucaccuugcccucaggcuuggccccgcgacgcaguuugcccacaacugacaagaaagcacugaagacagacucaucuaagagcuuaucgccaaagcacucaaaguugucuagcaucuucuggagaccucgcucugugaggggcagcugggacauacaguaggcuaggucucgguacugacgcucaguucuacagggagggagagacucugugaggcacacacauccucccccuucagucuccuuuggucccacggaugccaccagggacucucucuucugaaaggucccucuuagcacaaagaugucccaaaauggagcauaccgggcugugcggaaccgcugacacagcuuuucuaccaagcucucagucuguuuguccuuggugauguaggagaggagcugccugugaggagagaguguacgauuggccaggaaaccccuuucucagcuccuacacugaagccaccaccccaaccccagcauggccucuucuguccuugcuuuagaagagaguucuuugcauggccuucuaccgccuguccucuggucuccuucccuuuauugagaaagcaaauaacagcugccaccuagugacugcuacuaugugccucacccucacccucaagcagcacccuacccuauguaagagccuccacaacuaugcagcaaguccugucaaccucauacgguuaagacgggcaaacaggucaaguaacuuguggagaaaguacggcuaaaauguccaucuagagcugaagacagcggcagagugcuugccuagcacaugcaagacccuguguucauucuucuucauucuuugcauuccauccauccauccauccauccauccauccauccauccauccuaagucugugugcccccccccccacuacucuagaucuaaagagccauacuucaugaugguguggaagggcuccucuuccacuccgcccucugggucugacaggcgacugaugauaucggggaguagauuauagauagcauugcccuguaggaggaaaaggaugagaugaggcggggagcagccggcagaagugggaccuauccaucuccccgacaaagccccaagcugcuucucucaccuugugggagagcucauugaagaaauucuuggccagagcagcgaucugaggcacagggucgaugagcagcacggccaucucgcucaccugccccuucaccuucaccauguccuucaggaucaggugcgucaucaccagccccgcugucuuccgcacuuguugagcugggucucggaggcuaggaauaaaaacucuagucacuaagaucaagaacucguguuuguaccuugagaacaauaggaaggccuuaagaacaaggaucuauuguuccacaguacgccaguuuagaagcagcuccaaggcuggagucagggaccacgagaucuguaggcaagauuuuagagggaagcuucagcucccagugcccauuucgggccugcuuguacagggugaacagccagcagguaccgaagucagugccacgggugggggaggagcccgugaacucuuagugggucucagguggcccagggaucucuuaccgggcauacagaugaggaguccagggauccaccagguuagggaagcggauagccagauccccuguggcaaccaugagguuagaucgcacaguggggagugaagacuuuuccagcauggugaauagaagacgaagcugggagucgcagaaaggggcacugagggcaaagagagacccaucaggaaagcaagagggcuguaccaucucauguuccuugagaugaagccaacuaggccuaccugaucaugcagaacuugccaagggccagcgacgcagccgcacagagcucuggguugcuguauaagccaggguuguuacagacuuuaaguagcaguggaacaaaggcagcuaguaccugguugccugacaaaagaacauguccagguuagggacagauugauucaacugggggagggcacauagcgaucuuucuuaccguccaacagcuccuucucacagaugcuucggaugagcuccgccucugugucgucagcaguggccccccccaccagccccaguucuuccuccauuguaguuucagagcuugcagucugcaggaagagaagccagggauguugggugaccacuuuucuuuuuugagacaggugcuuacauggcccaguccuuccuaaaacuuuuauguagauugggcuagccacaaauucacagagaucugccugccucugucucuuaagagauggcauuagggaguggcaggaggaaagagagagaggcgggggcgggcauuaaaggcgugcaccgcuucacccugcuuuaagacagacuuuaaacuuuuguuguuuuaugagucucucucccggcauguaugcaaucguacaugugugcacugcacacggaggccagaagaggacacuggguuucccuggaguuggaguuacagaugguuaggagacaccauguauguucugggaucugaacucagguucucuucaagcgcgcuuaaccucuugagccaucucucuccccguaagacaucauuuauaaaaccguccacaggaaugacaaauaaguccauaaagagaaagaauuucugaauggagaagggaaugacuaggucucuuuuguaaguuuuuaaguuugcuaaggcaggucucuacaccucuuccucugaagacacaauugacuguggucaauuuacaaugguaaacaaauccuguucagccuggcagugguucaaggucacagaagucaggcuuugucccacugcugcaagccucugguuuauuuaucagaaagacaaauacuccuccaacagagaggacucaggaucccaccaggugacaggccaguaucacaggcugguaagagggguguguuguguguguucagauaacucaaacagaggccuccucagcagggcccgugucuuacacuaaacgaacagucaguccauauguccuaacaccuugcugggugagcauggguagacugggacaucuuuguugacacuaaccuucccaggggagagagaccgauucuucauuacagaaggacagaagcagaggucccuggaaagguguguccggagcugagggcauggaaagaaggaagugccccuggccacucacgcaccuucuccuugggcuccuuggcccugugcuccugcuccucucgcagaacucgccgccgacccagcucuccacucacugcuuguuccaaaugcaccagcugcuguagagccacauccccagccagggacagcagguucaucagcaggaauguggggagccuaggggcuguuuccucuaaagaagagagaaggaaaagagccaagucccauuaaacuuccagacccacuccucacucauggagaaggugagacgcggcaaagaauggcccaacaucaaccugaacaaacugagaugccgugggccgagguuugggguggacagaggcuggcuguccaccccaccccugagcaaugacgccccugcccacuuacuggggucugccucaguggcguucuucucaaguuucuccaagacuugcuuggcacagccuugcaacaucugggcacagagcacaucagggcucucugccaacugguaggucagggucacugcuacuucuuugaaugggauccagaggggaucugggugugcaaagccuagagagaaaggagaaggugaucucucugggaaagggaccaagcagaccugcguuacaccuccuggauagcuuacccuuugugaccauauccugaagucgcucaaacaaccugugcuccugaggcagccggaagggagggugacgcucacccagggaaggcugaggagaagagaacagaaugccagggugcggaaggccagcaggaagcucuucacucuccucagcugagccacagccacccgccaugaccuaccuuccuccuguccgagauguuagcaauggcaaggcacaccugcugggccagccuguaguccuggggagacuucucauccagccccacccucaccagggcgucuaaguugcucccuacaauuucugguuuuccucuagggaaaggaaaacagaguuaaaggcagcccuggaaggguucugagggagacaacagcaauggaggacgguaucggugcccacuguguggcgggugucuagagcccugaagcacucacuacagaaagcuccgggccuacaaccaccuccuggauguccuugagcuagugaccacagaagacaggugggcagguacccucuucaugcaggcagccaaccccaagaaaccucaccucggcucacugcuauuacugaaguuuggaaagggcuugccugccccacucugcuugcauucugggugugagccucaccgugccaucaugccaagaagcauaacagaggagcagcgcuccagaggagagcuuggcaccuucuccguugcccguucccauagcagcuggaucaccgcuggcuuuaccucauccuucugcacaaacucacaaagcugaggagagaagacaaaugagucugcuucaaagcaucagucccuuggucuaccugucugaagccaacacugagagcccugacggaagcagcgccuggcuacuguggaaggggaaggggaagggggcucagcugugaacagugugaggagguauuccuugcuccguucucuauuagccugcuucauggcuuucuucaaagcugcacuuccuaaggucacacauucaaacggacauucugaguucuacagggagcauagcucuaacugcauucuggauauuuucuuucucucucucucucucucucucucucucucucucucucucucucucucucucucucuuuuucuuucucucuuuuuuuuuccugagacaggguuucucuguguagcucuggcuguccuggaacucacuuuguagaccaggcuggccucaaauuuagaaauccaccugucucugccucccgaguguugggauuaaaggcgugcuccaccaugcccagcucuggauauuucuuacuaugagcacaagucaauauaucugugacaaggccauuguccuuucugccuuuucauuuucccagcaaugcggacaccuguuggucacauguuguccacccacagcugcuucugcagguccugccuguccucaccacuguaucccuacaggagccucuggcagcccuucuacucuguugauggucuuuccccagccagcuuguaugugacaggcaggucaucucagcaugugucuccaguccgucucuggcuacugugggaguccugaguagcagccagccugggaaauaccaagucacuuaccaccaccagguccucuuuccccagaaaggaacaaaaguagccaucaguagucaggcccagcagccagugccacucucuacugccccgcaagacagggaaugccccuacaggaauucaccucaaucaaacccugggucccucugaugugaaggcauucggcagccuccacaauuuagucucagcccaugcucccaauuggauuaucuucugcggauaaugaccuugagucggaacacaaaguuccagcugggacaggguacuuucuuuacuuuuuaucagaaauucucuccucuucagccacccccccccccaucugacugaacuuccaggacccaugcugacuugucccaccuuguugggguaaggccugaccucuacccuuaagcagcucuguggccuccuuuacccagaggcugagcaucuuuucuggagcuccuaugcuguguguguaaggcaaaaccggcugcagccagucaccuucccagaccucucccggagccgcccucacagguccucacccuccuuacacaaggggcaagcaagcacaguaaacagcacguguuagccuucugguaccaugcuugccugugcacugacuccggagcccaacacuuacugaccucccacaauuuucuaaagguguuugguggguguuuuuuuuuuuuuguuuuuuguuuuuuguuucacuaaaaccaaaccacuggucucuuuaaauuuggguauuguagcacacaccugaaugugaacaaugaggaagcugugacaggacuaugaguuugaggccagccugggcuacgcagugagacaacugccucaaaccaacagcaaacaaacaaggaaacaaagagcugggaaugggaaaguaaugacucuccaacgucuuuguggagcugagcagaucuccccacacaggaaacagccucuaacuguagcuguggaauacgaagaagaccaaguggacuuacaauuuccucaagacacugaauggucccgacggaggcauccacuaacaacagcgagagguugugaaucaaagucugcgccuuggcucuguaggaacaacagccaucaguggucacuaggacugggacucucaacuuggcaaauaggcugcuagguuaaaugagugcuuagagcagaccccagcacaagugcaccccaagccugguauagacccauccaugaguucagaacgccccuagaacuccucaucagaagacuaggaaauccugugagaagcugaccuuagaaaaguuaacaaaggccgggcgugguggcgcacgccuuugaucccagcacuggggaggcagaggcaggcggauuucugaguucgaggccagccugaucuacaaagugagcuccaggacagccagggcuauacagagaaacccugucucaaaaaaauaaccaaaccaaaccaaaccaaacaaacaaacaaaaagaaaaguuaacaaagacaaggaaccccauguaccuggcugaguccccuuucggguugagguagaguuggcgguacgcauuaagcacggcuucccggacaccaggcuccuuagaccagaugaguggcagcaugcggcguaccccaaacagggccugagguaccccaaauuggaauaccaucacgaagaacucaaucaccuccugcaccacugagaacagauacaaauaucacccaucuacuuggcaaauguccuaauacccauagacagaacccuugguaacacauggcuggagcggucacugucccagucccugagaacgacgcuagaaugccuucucaugacacaguuaaucaaaguaacuauacaaugugaacagugguaagcacccucugccuuuuaaugaugcaggcaucagggacuggaugauauugcaguguucuucacucacuguucacucacugcucuuccagaagucccagguuugauucccaguacccacaugguagcucacaacaauuccuaauuccagcuucagacaaccugacucccucuucugcucucuacaggcaccaaaccugcauguaguacacacgugcaaaacacucauacacauagaaauaaguaaagucugaugaugaugaugauacgggugugggcaucaauaacauugagcaggcaggacuguguuccgaucagcacccggccuaccuguaguuguguucucauacaucaucuugcugaugaugccaauggcuucuguaaucuucugggagaagccguaggcauccugcagauacugcaccagcaucuccugcuucaccagcucaucguugcucugggaucccucuggcucgggcacacugggagagucuuuacugccugucagcccugggucuguguccccaugagagcccuguguggaagcuucggggccuaggaauuagagguacaggacaguuuugcacaaguguaccgggaguccaguggcuaccaacaucccugcacaucucuuucaacaacgugaauguaugaaauuacaaugugcucugaagcaccuugguuccuuucucaauuccugcagaccucccuaguuugcaaaggugcccuacgacugacugggcugcuccccuuccagagcaaguguccacuccuucagcccaaggcugugcuugcugacugaaaggauuaccuuugaagaugagucccaagagauucaggaagcuguucuccucuggcucugugugacugaaggguucagacuccuggaagugacugguagcuucccgagugagaacaauagccugucuaagaagaacagcagcagccugucaccaauuuagcucuagagccaugucccugaaggccuuguaagggaucugacaacuucauccagcccuacaugcaguacccuauagaaaaggcaugucucaugcuuaaaaagacaagcaguuccuacuaagcagucaaauacaaaaccccugagccuuuacugugguccucaaagaacuugaauaagcuuuuaaaaucauaaacccagagcuagccagauggcucaguaggaaagagugccuaccacagggcuuaaugacuucaaugcuagaacccacagagagggaacugauuuccaaaauuguccucugaccuuuacaaaugcuguaaauguaaaaacaagccaaagcaaaauaaaaaccuacugcaaacaccuguguaaaaccugcuauggauggaagcaccagacuuucaauaauuuguuacuuuuauggcuuaacuguuguaaacaaacaguuuuacagugaggucagauggccaugaacucacuagguaucccaggcugcccuucaacucccaauccucccacuucauacuucccaggccugggauuacaaacaagugcugcugccccacagugacagugaggagccacaaaacacaucacagagugggcauggcuaggugucguggcugguuggugugggccagcgcagcagcagaacauaugcuuagcaagcuccuggguuucacgucaagcaagaaaaacaaaaagauggcagguggcacagcgacuggucuaugcuaugccagggcuucguaucugaggugagcccucuaacaaccgagcaaucgccaucccuugucaccuuuuggagacaaagucuugcuacaaaggccuggcugugaggaagacuugcuguuuagaccuugcuggacuugaacuugcaucacccccggcuucugccuccugagcacuggggucacagguacacaccaucacacuagguccauuuaguuucaugaaguucuaggaaccaaaucuagggccuuggaauuacaggcuauaucacagacuaagcuccugaguaguuucuaaaacauuuccaaguagaaaagcaguuguggaauacgcauuuggucagacauuacuacagcaaaaacaccugucacuucccgcagcagcggacauaaguucaaaucgucuuuaagggcccccaagucucuccaagguuaacuaaaccuacacaccaucagagcaccguguucugucacauacuacacacugucagagugcccugcucuuucacauacuacacgccgucggagcaccguguucugucacauacuuguaacuugcuuuggcaagcaguuggcggaugcguccuuucaccuccucugcagucucugcaucagcaauuugaugaucucccucuuccuggggaaguuucaggagcugcugcagggucgacuucaauucuggcaacauggcaucccacuccuccuccgggucuagugcugcagcugaaugugggggggggggggggagucucaguucgucuuuccugaugguugugaccacaucgagaaaguaaggcagccuccccaggcagggacuacucacucgcugcugcacuucgccucugggcucgcauuucuuguaauuucugaaucuccuucugcagugguccagcaaggucaauaucacuaagcuguugagguagaacgcauaucacgucacuaggugaaagaacucuaucccuguuuccauuccgucccucuucugcacacaccacgguuccuuaccuugcaggaaaagggauuauuggcuagaaagcuggccagcagcugaauggcauuuuuacacacuagcacugacuugucugccagccgucccacugccaaggccaccacugccuggaaacgggucagagggagugccuagaugagcagagagagaaucaauucaaaucuacagcauccaacugcagccuauuggggggaagauucaguagaggauauccacguaugcagcucaacauaaaaucuuagcccuacuuagagguuggacccacugugagucuaaacucagccacccacucacucuaaagcguuucuguggaauuaucaaauauuucagcaccacacacucuaguucuuaacuggagcagacaccucuguccuuggaaaggaagaauuacuacugcucauaagaucucaaguuuagggauuggagagauggccuaaugguuacgagcacugacucuucuuccagagguccugaguucaaaucccagcaaccacaugguggcucacaaccauccauaaugagacagguccaucauaaugagaccugacuuccucuucuggugugucugaagacagcuacaguguacuuagauauaacaauaaaucuuaaaaaaaaaaaaaaaaaucauguuuagacucuucuuuggggcaguuacuagauucugcaucuauuuuuaaacaacaacaaaacuuucuucaggggcuggagagagggcucagugguuaagagcacugacugcucuuccaaagguccugaguucaaaucccagcaaccacauggugacucacaaccauccguaaugagaucugacgcccucuucuggugcaucugaagacagcuacaguguacuuagauauaauaaauaaaucuuuaaaaaaaaaaaaaaacuggcugcucuuccagaggaccuggguucaauucccagcacccacauaauggcuagcaaccaccuguaacuccaauccuagggaauaaaauaccuucgucuggccuccaccgguacugcaugcauguagcacauggacaccagcuagcaaaacacucauacccauacaauaaaaauaaaaaaauuuuuaauugaggcaaggucuauuauagccccgcaugucuucaaccuuccuguguggcugaggaugaccuuaaacuacugacccuccugccacugcugcuaucuaucaggcguggucugguucagguaugacacagugcucagccagucucucuucacuuuggcaaguacacagaggacuuuaagaguuucagcagagaagguuguucaccuucuguuggacaauucgggcaaagagcugcaaaacacggcuccgaacaaaagaguucacaucauggccaugagcuugcaagauguccaagaacugaucucugguuucucgagcugauucuucgagcuggucaccauuuagaaccugcaguaccaucucggcuauagcugcuaacacagcauugcgcaucauguaauucugagagagagagagaggagaaacauuggaacacaucucucaacuucuauauauacauuuccuucccuaaacacuucugguuuagauuucuuaugcuaagcugugaucuggucaacugucuaggccuauguccccaagaucaaagaagaugcugagacccaaguggauuuguuugaucagaaaaugucagaagaaaaauaaaagcuaaaaucaaagaguggggauucauagucugaaaugcuuggaacacaguauuuuggauuuuguauaucuguauauacauuuuaucuuagggauggaaccuaaaucuaaaugcaaaauauaucuauguuucaaauauuucauacacauagccuaaggguaaucacugauaauuaaacauuuauuuuauguguaugaguguucagcuugcaaguuuaucuugccugugugcccuguauucaguaaauccagggucaguguaaacuguggacuuuggguacugaucuaucaaccauucagaagaggacaccagauguucugcaacuggguguuaggaauugaacccagcuccuccccccccgccgcccccccaccaagugcuuuuaaccuccaagccaucucaucagcccauuagacaauauuuuuaguaauuauauauaugaaauaguuuuacaguauagaauuuuccaccugugauaucuacuuggauaucaggauaucugauuauguuucagaaucaggauuucuguugcuuaaacuauacgugaauaccaucuggcacuggucagacgguucagcaggucaggugcuugccacuaagcuugauagucggaguuugauccccagggccagugaagggagagagccaacuuccacauguauguacacauuauacacauacacgcuaaguagcccugucuggccuacaaguaugacaagcaggcuggccucagagagagccaccugccucugcauucuggguacagggauuuaagaugagugucaccaugccuggcaaauaacaauuaaaaaccuaaaucaggucuauccaucaaugcacauuugaggaacauuucuucucauccuuuauaugaggccacaaaacguuugagccuuaugaauaaacauuugcuuuccuucuuacuccuuagggacacagaagagcagaaagcggccucagugccaagaaguguauuauguaauccgggagagacuaggacaggggauuuuucccccugccucggccaagagccagagaacaguugcacacagaaguuaaagaaaauuagaucaaugaguagacugucuuugacauuuaccuaggaacccccagcgcuagccugggaagaggccagguaagcauccaggaaagagaaguaaaaagaacagcagaguuugguugagacagcucauugucuguagaaagugaggcuagccagaugggggcgagaggcuccaggccaaggagugcauggacugggcaccaaagcuaagucauucucauuagacaggcugugggauggcuaucucgucuaccaguacugcacaaauccagaaauaccacuuauaaagggcuccuccugugcuuccccauaggaaugucacagugguaaaucuagacaaccuugucuauuuuaugcaaaauucuauuuuggggacaguuuugcuuuauaaccucagcuggguccuccuuccucucagcccucugggucucagacucuaggcgcacacuuccagccuaacugaaagcuacuuucucaaaaaacaaccuagaagccagguguggguaugcaaaagaaaaaaaaaaaaaaggcuggaauuccagcacuugggaaaugagaguuugaaauucaaguccagccuuggcuacacaggaaguuugaggcaagccuaggcuauguaagacacugcgaugggagagggcaagggagagauagaagaugguugugaaccuucccuaggcauggcagcacaucuacacuucuggaacucgggagacagccaaggcuacauggcaagccccccuucuuucuuuuucuuuuuauuuauuuauuuauuuauuuauuauauguaaguacaccguagcuguccucagacacaccagacgagggcaucagaucucauuucgggugguugugagccaccaugugguugcugggaucugaacucuggaccuucggaagagcagucgggugcuccuacccacugagccauuucaccagcccccaagccccccuucuuucuuauucuuuuguauauacauguuugagacacgugcuuguguggagcacgcaugcaccauggagcauuugcagaauucaaaggacaacccugagugucagugugccuaucuccucugcagacuuacacacaagucaaacacucacacacauaaaaaaaaacaagaaagaaaaaaaaguuuggguuuuuuuuugacacaggguuucucuguguagcccuggcuguccuggaacuuacucuguagaccaggcuggccucgaacucagaaauccgccugccucugccucccaaguccugggauuaaagacgugugccaccacuggccagcacauaaaauuuauuuaaaaaaaaaaaguuuaaaggaaaggaaaaacuucugacuuuuagagcaugcuuauuauuaauacgaauaaauuccugggcugauucccagaaccacauuaaagugaagaaagaaagagugauuucaacacuaaaaccccucuacaaaucugagcuuccccagauagacuaccucuccauccagauggucuagcagaaugcacauguuggccaucaggacagcugggauucgcucugcuagcucagugaggaaagccgcaaagcccuuugccccugcugugucucgacucagcuccuguggacacuucuguccaaucucucugcaggggagaaagcagauacaguaagaaagcucagcuacugaguucccaguaagggaagccaacaggcuucagggcugaaggaauccaacgucacauggagaaaggaccccuaacuuccuuucucccccaacgccccaggaacacagacacucugggaggauuaccuuacaaucucucccacuaugcucuucaucccguagucuguugcccacagacucacggcugucaccaacacagggggcaggugcucaaagugcugcaacaucuggaugaucuucacaguggcaccugggagauggaacguuagccauucagggagagcugcagagcagggggcggaagcgagcaagcgaaguggaaggcaacucacugagcauaugguuguagcggaccaaggccaccccaagcaggugugcuauggccuccuugguggagcgguucuucuggugacuaauggugggauucuccaaaaggcgguagcaacagccaguaaccaaacuaaacaaaaaaagaaugaacaggaagaaaugagcugucugaagucgagauaccaggcagcugccguuacucaauccugucccuacuauguccaucucaaaguuucuaguucuccgcucuuucagucuaaucguauucuacaccaaggauucuuuccuucaggauuuaguaaauugcagccaguuaccaugacaacaaaaagccagacuauaagaugaagaugguaaggcaagguuagcgaagacuucucauuguuaaaaauggcaaguuagaucuuuacagaccuuuaaauuacaucugcuguagcuaacugaccauuuacuuucacuuugguuuuagugugugugugugucugcgcauguggaaaucagaggucaaccuuggguuucauuucucaggagcuguuugccuuguuuuuugagacagggccucuagcugggauauggggcuggccggccaggcauccagacaucugcccgucucaaccuccuuaacacugcgcuccauuuggcuuuugaugugaguacugaggaucaaacucaagcccucaugauugcaugguaggugcuuuacugacagcuaccuccccgaccuuuacuuauuuggagauagaaccucaccacuauacagcccuggauggcccagaagucuuuauguugaccaggcuagucucaaacucucaagagauuggcuugccucugccucccaagugcuaggauuaaaggugugcaccaugcaccagcuucaccuaggggauuuucaguaaacacaucuucaugaauguauggguauuaacaugagaauuucauugugguggcacaugccuuuaaucccaguacuuggaaggcaaaggcaggugaacuucugugaguucaaacccaguuuggucuacauagacuuccaggccgaccaaggcugcagugagacauugucucucaaaaaggggggaggggacaagagagaaacgcacauuccauucaguauguauuauauguaugcauguaauagacacuccuauguacuacugcaaacagcacuaagggaugacggauuuaaaaggcuuaucuagcaccagaaccgcauuuugcacggcucaagaucaucugcucaaguugcguccuaacuccccaccugacaaauucuucuucaauugcugagugguuccauaggugacggauguccagcuggagcagcuguguuaaaagcugaagaacugguugccucucuuccucccagucaaagccaaggguugcuuuggcccgggcucucuuacccuaaagugaagguggagaucagucagagagagcagcggucaucgagucccugugcccgcacucaguaucaaggcaaggccaggcaguaccauggaggauaagcucuagaaugcacaggaacuacuugacagggaaggagagcuggaccuuaagugcucccuccuaaaccccaagcaagaacaauaagcaugcuaaaaucauugguuccuuucccaucaauuccuuucccccucacauaaaauaggucagggauauccaauuaccuucccaccgauguccaggucaaugaggcuugucuggcuggucauauucucaaaggacuccaaaaggcguaucagggcauagcaguucauuuugagggcauucaggugggcgcuucuaucugauccacucagagcugcaucauccaggauggacgacaguuccugggaguggcgggauaccacugugaggggcagaaucuggggguuggucucauuggcuuucuucacauaacccaacuuccaaacacuuagcgcuuauagccaucagauuaccaaagaucugugugucaucucucaguggccaugacacagcuaaguccuuugagaccacugacccuggcaccucgaauauaagacuguuccuacuuucauuccaguuaccacaauuccucccuggcagcuggagaaucaccccgacuggagugagguaauuuaaagaguaggaaauuuuuugucgguccgcccuuacagugaacgcacauuacucuguaucgaccaccaagauuacagaccugaauaggucagaggucccuggacuuagcuaaaccaacugaaucacaacagccuugauaucaucacauggcugagaaaauguaggaacugcuaaacauaauaaccaacaccucccagccccugcccccggaccccagacaccuuucuucaggaauuccagagugucuuccuugaggccagguucuauacuucgaaagugacuaugagggaaagaaagugugggggugagacaggagccuacagagcccauucucaaagaucagcucuaaggacucuaacgugaaaauacuugggaaauugucaaguaaacacgguggcaagcuggauaaaugcucacuauggaugucaguacccagaaccaaguaucagugaacccauaauuuguaauuucaaaacucacaugcaaaaauuaagagaaaaagccaccaguucuuuccagagcacuggcugugaauuucacuuacuguaaaaugcuguagacuguaucgaagugcuccaguauggcgaggggccccugagcucggaaggcagacugaaaugcuggaaaaugaaggaggaaagacaggauuucuugguaucuauuuuucuccagaaggcacuuauaucaaaaagcggaugagucugacgucauggcacauagccauagccucagcaacucaggaggcuacagcuaagaguugcuaccacagagagacccggucuuuaaacaaaagcaaacccacaggucaagcaaaguggcagggccuuagcaccggcacuaacugagcacucggcagugucucugcacugcuccacacaacugcuuccuacacuucagucaacaaaggauggcacacaugacaaagucagugacacagcaacaaucuacacaauaacaaaacugcccgaugacacaggacuuagaaggcaucccguuaaaugacgugugaaaucaugcaucagucacauuuuugguaaggcaaacaccuguggacacagauauuaauuacugugguauuucccagauuguuguuuucuauuuucauuacuguuucuauaacugcuaaugugaauccuagguaagaauggauugaggcuagguggguguggugguguguuccuuuaaucccagcaucgaggaggcagaagcagggucacacagugagacugccucaaaaaacggaggggaaagagggaagcugagaugaccagguacaggaucccaaaugucccguacgguugcucugcccuaccucaaaagacagggucucuuucccucuuaauuauuaauuaaacuguuuaccugucuguguuagaacaggcuucugcaacccgccuguuacugcgguuggguccagacccccaugcuuguccacagggcccuccucaccuuggccucacucuggacgcuuccccucuccucccuuucucucaguucucucuuacauuaaagcuuuauaagcacacacucauuguauaaaguagguuuuguuacauuuucuuuuuauggaaaggguuaagacaaggcuucccuaugucaaucaggcuggccuugaacccacagaggucugccugccucuggcuuuccaagagcuggcuuuaaaggcauggaccaccacaccuggcucauuacauuuucauacacaaauaucaugcacuuuagucauauucacaauucucucauaaaaauauggaauguuucaucagguggugguggcgcacaccuuuaaucacagcacucuagaggcagaggcauguggaucucugugaguucaaggccuggucuacagagugaguuccaggacagccagggauacauggaggaaccguugucucagaaaaaacaaaaaacaaaaccaaaccaccaaaaacuauggacuguuucugggccguucuucuuccugucuccuuccaaccuaggaaucggugccccagaaaugagcuuuacuuccucacacuauagcauggcccagcacuaccuucuauuuuccuggccaaguccuggagucaacaauucuuggugcguucuggcucauguuagaggagaaggauuuguaaaaacugaagcucuaggcaccagacagagucacuguugcucccagauacuaagagaggcugaggcaggaggacugaaaacuccaaagccucacuuuguacacacuagguaagcaugguaccaguugagcuacauccccagcccuucucuugcucuugauucaaucccauguuauuuuacucaccaggcccuagaagcaauaggcuuuaauauacauaccaaacauuaagcauguaguaagcuauaccaugaaaacgugugcacccguacucuuaaugauguuuccauauuaaugaaucaucuagcaacaggccucucaaacgugucuccccacacggcauguuuaagugacaagcgacuauguugugugcuguugcagcuauguuucuccuucacugaacauccuggaaacauaauguaguuucuaaacagugcucucugagaauaggcaaggcaaacccuggcaccgcccacaggacuucuaaacuucaugcauuuauuguaugugugcugguguucuguucugguguagugugcacacacacaccucuaucugucugucuugucuauccauucauccauccacguaccacaugcacaaguuacagacaguagugagcugccuugugaauagugggacucaaaccuggguccucuggaagaauaggcaguacccuuaaccucuaaaccaccucuccaaccccuagucuacaauuaccaggacuauacauugacacaugguaagagguaaaaauacaaaaaccggagccgggcagugguggcgcacaccuuuaaucccagcacuugggaggcagaggcaggcggauuucugaguucgaggccagccuggucuacagagugaguuccaggccagccagggcuacacagagaaacccugucucgaaaaaaaaacaaaaaccaccuuuuucucaaaaauggcccaggacauuuuaugccaugaauuccauguggugauacaaauaaaccaaccaaccaaccaacuaugggacaacaaacaacuaaaggcagggacuaggaaagaccucccuggcccagauggagugucccggggcuguagaacagaaaggauaacaucauugcauggagucucucaccucuaagcugggaugagaggugcuugacgggcagcaccucccggacaacguacugauucacaccuccacuuuucagcagcuccucuggagauaagggcaaguggaauucaaaguuguggggagacaucuuucucccccugguucaccuagaaaccaaacagcaaaaaaaaaaaaggcaugguguaaaucuaccagugugucaucuuuugauuaugugacaagaacauuucuacugagucuaccccagguucaguucaauauaaauaaaauauauauuuuuucaaauguuuuucagucuuauaacagcuauaugaaucgucuuauaaaauauaagaucagagccgcacaaaguaacacaugcuuauaucuaugucccaaguccacgggaaucaguaggauggaguucaaggcuagucucggcuacguggugugggcugcaagagaucuugucauaaaacacccuccccugcaaacccucacccucaauauaaaagcaacucuagaggagaauaauuuuuuccuuuaaguuuuauugcauucugaugagaaaagauacauaauuucaauuuaccugaauuuguuacauauuuugaguaaauagacuuacaucacauucuucuuucccuuuuguaccccaacuccucccagagaguccccccuuucaaaaccugcaauaccuuuuguuuuuuaucauauucuuuaaaauuuauaaaauaagcugggcgugguagcacacgccuuuaaucccagcacucgggaggcagaggcaguuccaggacagccagggcuauacagagaaacccuaacucaaaaaaaaacaaaacaaacaaacaaaaauauauauacauauaauauuguaacaauaacaaugaguauuauaaaaguugugugauauaacacaacaaucaauugaacagucuuaugcagauguuugucuacagcaauacugaaaauacauauguuuuucucgguauaaauuuuaaauaacuccaaauauauuaacuguaugauauuuuaaaauaauauaucacuauuaguuuuuuaaaaaucaacacaaauagaucaagugagcauaauucuuauuauucugacacuaagucauugagucucauggucucuguaaaaugguguugcucuggggaucaaaagaaucaagggauaaaaacuagucaauagccaggggugguggaacauguguauaaaggcaacauuagaaggcugaggcaggaggacugcugaguuugaugucagccaggacugcagugaggcugcaaggaguacaucucaacaacaacaacaacaacaacaacaacaacacaacaacacaagacaauacuaaugaacuauuaagugacaaucaguguauacauacagacuuauugcuuccauuuuaaagugaaaaaaauccuuaagaaauauuuuacugagcauugggguuccagcccaaucaauggaauggaaggacauuaacuucuacuuauccugugccugauuucagucucauggggugcagaacgaaacaaccaaauuuacacauuggguaguaaggcuaugcgauuuugcccacaccacacauucagauucugaucugucagacacacagccauacuggaucucaagggcaucccuaccagaccgucgcucccgaccgcacuccggcaaaggcugcgucacguccuggaccugcuuuuucucaaccuuucccuucccaaccuuucgcacugccacaucucaccuggaccccgcgacaccccucacccgccgcuucuucaaccggagagcccccugcugaaaaggaaggaagaaaacaauagggcaggauacgcgccaaacaacgagaugguuuucaagcuagcggaggaaccggccaauccgcggcaggcugagacggagacccgccucagcgccaggcgucgcgcucgcggagcccgcaauucccuguucaaaccucaacggcugccaggaggccaaucgcgacagaggcuggagaagccaaccaaucacagccccgggggcggggcaagcgggcgaggggcguggccccgagucugcgcuuucccggcaucucuaccguagucggcuaagcauggucacccguugucucuccgcgggccgccuaaagcaguccagcuuuuaaccauguggcgcccggcccuguacacuccgggaauauacugccccagcaaaacucagcuugccguagcgccaggcucccguccuccacuucccucacaguugaggacgcgcaagggacaggagagagcuuauuuuaacggaauuucgguuugggggcguccuuuccugcgacaacaaacaccgcagcgguuccauucuuccaggggcuaaaccggaag

SEQ ID NO: 3391 - RNA, 3788 nt, Mus musculus
uuuuguuuuguuuuguuuuuuucaagacaggguuucucuguguagcucuggcuguccuggaacucacucuguagaccaggcuggccucaaacucagaaauccuccugccucugucucccaagugcugguuuuaaaggcgugcgucaccaccgcccggcaauacuuuuuuauaaaaagaaguagguauuauauagccuuggacauggccacuaaauaugaggauuaaacaguaguuugaagcuggauacaaggacucacacauauaaucuugucacucuggagguagaggcaggaggaugggucccaguuugagcuauaagaguuccaggccagccugagccugacuuugagagacuauagguuuuugguguuuguuuguuuguuuuuguuuuuauguuuguuuuguuuuuucgagacaggauuucucuguauagccgaacucagaaauccaccugcuucugccuccugagugcugggauuaaaggugugcaccaccaccgcccggcuuauuauuauuauuucauguuuuacaugcaauaauacaugcagcuaugccugugcacaugugcaugccugucuccaugggaagcccagaaacuggaaguauagucagccuugagucaccaugugugagcugggaauuaaccugggcaaccugcaagagcaucccugggagauggcuggaaucaucucuccagccccaagacuguuuaaaaaaaaaaaaaaaaugcaagaaaaauucccuggauuaccuuucugucaucuccagacuucucacugaauugauuucaauugaaacauaaauucaaaaaccuguggaaaaugugguggcuuaagccuuagauccaacacuaagguauuaucuccaugaguucaaggcuagccuggucuacauacugaguuccaggauagccaaggcuacauagagaaaacccuaucucaaaaaaccaaaagaaguaaaugaagaaugucauagcaaaaccuauuauuuuuguaauauauacuaacaaaagcaaagugcagcagagggucuauagcucacuauaaaguacuugguauauccaagacgccagcacuaugccauauagaagagucucucagggaagcccacacucaugcucucaaguguuuuaccucugaacaccucucucauagcccugaugcucaaaccuguauuaaaauaucuuucuuuuuaaaaaaagauuuauuuaauguaugugaguacacuguagcuguacagaugguugugaggcuucaugugguuguugggaauugaauuuaggaccucugcugccucaguugaccuugcucucucuggucaacuccacuugcucugguccaaugaucaaagacuuuuuuauuauuaaaaauaaguacacugugacugacuucagaugcaccagaagagggcgucagaucucauuaugggugguugugagccaccauguggcugcugggauuugaacucaggaccuucagaagagcagucagugccaucucaccagcccuaaaauaucuuucuuaaaugacauuuuuuuccccuaaaaaaaaaaaaaaagcaaacaggguagcacacacagggguaauacugggugugaucuuuaacacuucauaaaacugggcaugacucaaggucagccuccacaaaacugcccuauucaagaggaugggaaaugcugugguacucagacaaguucccuaacuuauaacugauaagagcaguacaaaguguaauuucacuuuccuaguucauuuugggguggcagagucuuuagaaauagcagcuacacuuccaagggccugggcggcuaguggcagaguucccuagaaugagcaagucccuggguuucagcuccaagauuacaaaaaaauaagauaaaauaaauaaaaauaaauucuuuaaaaacuuacacgaggugccagugucagaaagugccagcaauaaaugauuguuauaaaggccacaagcauaacugggcuguaaguaauaguaacaaaagaucaugugacuuaggaacgaggcagacgucagagugcaugaguaaauguagcacugggcauaucagauuccaaaggagccccauuuuuuuauuacaucgagcacacaaagcucucuccuugcugggauaaguccuguuccccuucuccagggugacacauuucccguccuaucuguacuucccaugucgguuaaaguguuuguagagauagcugauccguuuguuaagguuaugcagguccucaaugaacauccuguuucccacaaauuucuucuuucggacacaacgcugcaauucauuuccucuccagccucgaagccauacugggcccuugaucaguucuuuugggugcuucucgaaauucccuguaacgugacagaauauauacuaguuucaagagaagagaagucagccuagcccaacuaggccuucaacacaguuucaucucccugaucagaacuacugacagacaaggcacacaccagucuaguacaagggacagagucuuuguaacacuugcucuuccaaaggauuccccagcacucucaacugaagguucacgacugccugaaagggaaguucuaggaagucacccugaaccugcaggcauugcuugagcaguacacgguacacauucagaaaacacaaaaaucuuauuuaaaaaagaagaaagaaagaaaggaguaaagacuuugcagccagaaaugucuggguucaaauacugacacucccauuuacucgcuuuggcccucagaccugcccacuacuguguuagugagacugagucccgcacuccucacuauucuccgcaucucagacuggucuugccuggcuucaucucccguguaacagguuugugcccccaggcuugccccgggcacauuacuauucucuccacaaauaaaaccgaaagagucaagagagcauacuaauccuucagaaaccaggaaucgcguccuacccaggauuccaauguugucguagacgccaaacagagcccucuucucguuccagcgaucaaccacuuugggagguggaagagugagccuuacgaaggccaaccgugggacgccuagggaaggacagaagcaugaaucagcacugcccagugacaagccguuagccggccguccuacuacacuuaagccacuuacccagagagaagcuucggcaugccgagggcacccagccccacagucuccuacuugccgcccaagggacacucccugccauuacucuagccuguccgccucaguaggggcagcaaaccagccggaaaaauggggagcgggugugaauuccaaagccaagacacagauuacagucccaggcgggacucacacgguagugacaguaagaggagccauuuugggccuuacccagguagcuuagggagucaucccaagguggcucgcacagccacaagccccgcccuccaaguuccggccugugaggcgcguccagucaaauacuuccgguuuagccccuggaagaauggaaccgcugcgguguuuguugucgcaggaaaggacgcccccaaaccgaaauuccguuaaaauaagcucucuccugucccuugcgcguccucaacugugagggaaguggaggacgggagccuggcgcuacggcaagcugaguuuugcuggggcaguauauucccggaguguacagggccgggcgccacaugguuaaaagcuggacugcuuuaggcggcccgcggagagacaacgggugaccaugcuuagccgacuacgguagagaugccgggaaagcgcagacucggggcca

SEQ ID NO: 3392 - RNA, 30584 nt, Mus musculus
ucccauccauccacaacuccaguuccaggagauugacacucucuucugacauucaaacacgcagggcacacguggugcacagacauagaugcaagcgaagcauucauacaaauaaaauaaacagucgagcagcacuugggaggcagaggcaggcagacuucuaaguucgaggccagccuggucuacagagugaguuccaggacagccagggauaugcagagaaacccugucucaaaaaaccaaaaaccaaaaaaaaaaaaaaagccagccccuguaggcucaaauauuuaagaauuagaagguuuagaaggugggccuuguuugagugggguuggucuuauuggaggaaguuugucacuaggagugagcuuuaaaguuucaaauuguaaacgaacccccaauuaaauccauauauauauacauauacauaugcauaugcauacacacacgcauacauacauacauacauacauacauacauggauaugcuggggcacacacgugaaggaguguuuuccugaaguagacauacgugaaagacuaaggcagaccugugaagcuagaacuuguguaacuagaacucgaugggcagugacaggcugagcuaggcuugcuggcacagcuagcugugcaaugccugugggucucgagucuuugcucaucuucaauuuccugagagaggcacagccaagaacuucuccugguguuccuccuggucccuccugcuaacugguaccaaggcugaggccuggcugucucugccaccacuguugacucguguuugcuauccugacucuaaugaauuggacugcugguguauccgugaaguguuugcaaguaggucaagcuauggcugccugcugaucugugaacugaacugcugauuuccagacagcacagaugggaguugcuccaaagaaccuuucuagacagguccaccucccccuuauccuuucuuuccuacuaccucugguggguggugggcuaaaagguaguuaaagcauuuaagaaccaucacugaaaauagguuuugaaaaacuuaauuuacacacacauacacaucuauccuuggccauagaaauagcaauagaccaguaacuaagacaccauguauagaagaagacaguacuucacacccuccucucuccccguccuccagcucuuacacuuccugccccucccccauaaugcucccugagccucugugggaagggugauguagcugucucauuuagagcugaacucucaacugucacucauucucuacacucugaccucuuaccagucucuguaauaacugcugcccacugcaggcugagaacagcaguaauucauggguguaauuauaguuagcaguuuaacagcauguaguagucuaugaucucccaagccaugggcuuuugaucuuuuauauuuuaguuuaguuuaauuauuugugugaguguguguaugugugcacacgcacaugcgugcgcauaggugugcaugugaucugugugagugcaggcacacaagagcacaacuuuuagaaguggcuucucuuccaccauggauucuagaaauugaacucaggucuuuaggcuuguucuacaagcaccuuuaccagcuaagccgucucacuaguccuggcuuguucuuccacuacaucucucuuaauuuuauaguuuuccauauguuuacuacuugauuuguauugugguuuuccuaauggcauauggggacccaaguuuagagcucccugacuguccagacaucccaggaagcagacaguuagcaacagacaguacaguaagacagacgacagagugcaccuagcaaaggaagcaggaaagaggcagcagacccucagggaccaccagaacggauggacagacaucaacagcagagacagacucuuacaccucauuguaaacuuucagcaacuuuggggcugggucagguucucccuucuuuaucauaguugacuaccccuuccacaacugguucuaguuuucaccauauuuucauguccacauucaaccuaucagggcacccuuaaaucuaagcagagugcauguuugaauaugcuuggcccauggaaaaugcuauuaggauguguggccuuggccuuguuggaggaagugcaucacugugggggugaacuuugauguucuaugcccaagcuuccuccaauagagaagagagccuccuccuaguugacugcagaagugaggagucagucuucuggcugccuuaggaucaagauguagaacucucagcauuuccagcaccgugccugccuggaugcugccaugcuuccugccaugaugauaauagacugaaccuuggaaacuguuagccaaccccaaucaaaugucggucuuuauaauaggcuugccuugaucaugaugucucuucauggaaaccccaacuaagacagugcauuagaauuugaaggaggagaaagcccuuagcuugcccagcuauccuaccggccugaacucccccucuauacucccaagggcuggacaagaauccagucauaacuaacugccccgauauaugaugugggaggcagagguaagugguucucugggaguuuaaagccagaccuggucuguuuagugccauucagggcuacauggugagaccuggucuaaaguuuuaaaauuaauaaauauaaaugaauauauguacagcuauacacuuagaaaugguaaauauggugagcauuaugcauauuuuaaacacagccagugguucagauaccuuaaauaagggacaaccccucuuuccaguucugcuaauugaggauccuuaucugcucaggccaggaagacaagagcuucccaugggcacuuucagccaggagaggccuggcauacagauagaagagaacaccgucucucuaugaucaaaugaagaagggugacacuucucacccuugccagugggggauaggagcagggggccaguguuuaacagcuggcuccaccugcccaucauaauuuacguguagcaucugcugauuuucacuguccaucacagcauccccccauggccaguuugccgguuugaugcacagcacagcacaucacuguaacauuccugaaaacggaacaaucuggcuuuggcugcagagagcgguucuuugcaguuuaccccugcuucggaugacacucacaggcagagugggaaauggaggcaugagguagcugguaggaccugcaguacuuuagucucagagcugaggggcaaggcagggacuagaccugcuguguguugccuacuuucaccuguuagcaagaggaaucacucagacacagguguaaguaggagcucugugaaugaggcagcccuaccccuucuucagaucccucucugcauugugaggaaugaagagagcgcacacagggcccgaaugcugcgcaugugaagcauguucaacgcagugagccaccucugcugccuccauccaccgaugcaaugcaucgguccagcgcccagguaaacugcugccccuucaucuccacuccuugcgacuugcagacucaaguaccagugaaggggaaaaggcacaaguauccucugagccccucaacaaaguauuuuaguuaggguuuuacugcugugaaaagucaccaugaccccagcaacucguuuuugguugguugguugguuugguugguugguugguugguuugguugguugguugguugguuugguugguugguugguugguugguuugguugguugguuggcugguugguuugguugguugguugguugguugguuugguugguugguuguuuggucgguugguugguugguuaguuugguugguugguuaguuugguugguugguuugguugguuguuugguugguugguuugguugguugauuugguugguugguugguugguuugguugguugguugguugguuugguugguugauugguugguugguuugguugguugguugguugguugguuguuuauugcuuucccagacaaugguccccucccuggcaucuuugaggauuugcuuuacuaggcugaucuucccagaccaaaacccucaggacgcagcauuaaagcggcacacaccaauucacgugacaucugcuuuccuaaaucagccucacuuccugucaggauugccucccuacaccgugggcacaugcaacccugaguguuagcaggcccuacgacaaaaacagagagagaaaggaaaccacaaaggaggcacccggaaccugugaccucagcucccacaacaaacaccugaaacacugcaccacgcuuucacauuaggguucagcucaccagaaagaaaugggcaaaaggguggacauguggcucacuuaguagauuguucucucaaauagacucagugcuaagggcgggggggggguuauuuuuggguuuuuuugagacaggauuucucuguguagcccuggcuguucucucuguagaccagacuggugucaaagucagagaucugccugccucugccuuccaaaugcugggauuaaaggugugagccaccucugccugacugauguuagguuuaacauuuagcacugcauaaacuaggugugguggugcauggcucucauccuuaucauacauauauacauacacacacauacacacacauauauauaugacauauauauuauguauauaucauauauaugauaaagaugagggacauauauauauauguauguauaugaaugauaagaauguauauguguguguguguguaucacuaacaucagaaaggaaugucaaguaccauggcuggggacagcacugaauccagaggcagcugccaaggcgcugucagcaagcacuguccagagcuucgcuuacccagagucugagaaagaaaaccguuagagcuaccagacaggacacuggacaauaaauccuccuaaauaaaguagaagccuuaagggaaucuaaacaaagagccggaaccuacucaacaauucagaagcucagccauuugucugcuccaaaaaaugucuucccagagggccucaaaacagcaccugcuguagccuugcuccugcugucaccacagucagaugugaagacccuauugcugaaaacguaacacagugugggcaguguggucgcuagagagauaguucuggguuauauagaaagcagguugagcaagccaguaagugcugucccccugugaucucugcuucaguuccugccuccagguucuguaagucagaagucuaaaggaggccucagccagggaugcagcucacggccuggccucagcccccaacucauugcccucaucuuccuuccgucuugcaaaucagcaaugaguccucauaugacugcuuguuuguucuucugcuuccacuugagaccacuuaauaugcccagcagagcugugcaccucuuuaaucccaagcauucagguggcagaggcagguggaucucagaguuugagaccagcauggucuacagauguaaacaacaccgagagacaggguccuccuggcuggcacaggcuucggccuuuucuuucucccagcaugagauuccuggggaaauuccaguuucuugggggaccauuuuugcagucauuucuguagccaaaggauaucuucauuccuaccagggcaggagaauaaaaacauucaaacacauaaaauaaacaaacccuuugaaauuauuuuaaaauauuuucaaaaacauauuucuaauaagagauuaguaucugaaacaguaacuaaaaucaagaugauuagaacagaagcaaaagaccuaauaaacauuucuucagagaagagguacaauucucgauaagcaugugaaaggcuaaggagaggagaauugggaucucacgguuuagcagguauggaguuugggguuauauugcuuguucauguaugagggggagggcguuggucucacugcuucuggccaggauggucuccuggacuuaaaugaccccucccacucaagcucccgaggaccaagaaccucagacaggcacaugucaucauguccagcuuaagaguuccaauuuuauaguauaaagagaauauacagaugaaaggugaugcguuggcugucaugguuacagcgaaacuacuucagaagacaacuuggaaggagaaaggaguugacuucgguucacagugucagagaugucaaccucugacugacuagugccauugcuucugggccuguggugaagcagaacuuuauggugaaaaggguguggcagaguccucucacuucacagcaucuagaaagcagagacaccgagggagacggagagaggaaggaaggccaugaggauaagacacaccauucaaaggcuugauucuagugagccacuaauucuaacuuggccccacugccuauuuagccauguagucaucaagggaguacuucguggaugaagccugcuuaccuccccauggcacugcugcuccagccaugagcccucugcgguacacuucauaucuaccuuguuaggguuuccauugcugugaagagacaccauggccagggcaacucuuauaaaggaaagcauuucauuggggcuggcuuacaguuucagagguuuaguccauuaucaucauggcaggaagcauggcagugugaagaaggcacggugcgggaggagaugagagaucuacaucuugauccuaaggcagccaggagacuuucauccacacuggguagagccugagcauuggaggaaaccuuaaagccacaacuauacacuucuuccagcaaagccauacucuaaccaggccacaccuccuaaaaaugccacucccugggccaagcauucaagcacaugagucuauggggcccaaaucuauucaaaccaccacauuaggcaaaccuaacaccaguguuacuucaggagagccaggcaggcccugucccuguccugagccuguggaggaagauagacuuugaaccuagagguggaggcuuuagaugaggacacaacucauggucuggccaagauguuaaguucucugugcacucaaagccucuuuuuagcaacuuucuuucuacaguucuucaacgccagguccuauucauuccuacagggucagccgucagcuccccgcacccaugacaucugucuucagauuuaugacuaacggugaagauguuggagccugggaaugaggaaggaaauuccuuccguuguaaaguugucgcggccucugcugggcaugugguggagggugguuuccuuuaaacagaacaugcugcagcuccuggcucgaguggacccuugaagagcuguagugggggcuggggaaagggaggaggguggaaaaaaugaagagacaggaagcugaagcaugagauagaaagaacagaucuaacaucccccaggugcgaccacagggcugugacauuucaccaacacuauggaaacaacugugaagcccccaaaugagacauauccuugagauaagucagcaggggaaagaguggaggggguucaauggcccgugcuucuccaguguagcaacuccagcauccucaaaucagaauucccagaggagcaugaggcuuaagaugauggcccacguaggugcccaccuucaaucccaugugcccagggccaugaagagagauggcucagguaccugaagauacuagugaccaagccagccagaagcaggaaggauaaaaaugggauuaggucaagaaggaaguuuggcaaaaguucccccaggcagugggucacaucugugucacaggcuggcauuaagaagaaauaaaaccaggcuggagugguagcucagucaggaaaguacaagggccugagucugaucgccaaaacccaguuuuugaguucauuucuuuguuuguuuguuuugcuaaaggaucccaggguuugauggucauccagccuccucuacuaggcaaguugcaggccagugagaaauaauaaucuccaucuucuuuaucaucaccaccaccaucaucaucaucaucgaugucccugaggaaugaaaccaagguuguccccugaccuccauacgcaugaacaccuacacacacacacacacacacacacacacacacacacacacacacacacacaugugcacacaaggauuaaagggacuugauaucacagaacagaaaaagacacagggaacacagggcuaacucuugcccucaauuguaugcaauguucaagagcuuguauagccagaaacucaaaccucaguuauauaaggcugguugucaugacuccuccccuuuauacaugcaauagcuuugcugcgugugcuguguccaagcugggaauauagcucagacagcaguguuugccuaggaugcaaaaagcccuggguuucauccccaguaccacauaaacgggaugcggcagcacagcgcuauggcaccagcagcaguggcuugguagcaaacccugcaacaccaggaacacucaggagagggaggcagaaagaucagaagucccaagucauccucagcuaccaagcaaccuugaggcuaccuuggcauauauaagaccgucuuccaaacuguugugcuuagccgugucaccccaccucuaaugggguguuuugugguacuaguuuuaggcaaaaucugaaaaugucaugauuuuaaaacuaaccugccccuaggagcuucagaaauaaucuguaaucugcuccuaucuggucaccucuggaagggcugggcuaugagagaggacacuugccagggacagaugagggcacccagcguccaucccuaucaacagguccggcggcuguggguauucauuacugagagaggugcccaaggggggcacaugucugugaagcucagcagagcuggguuuaccccuucauagucucuccggagugcggaaaagagaaggggguggaggcugcugagagagagacaaagaaaaccaaaacagccacaacugccuucaaaggucgguuuaccacccaaguggagucgcaguggcugcugcccagagcacauaggagccaccagugacucgguacaagcaguuggggcucagaaaagaucucccugggcaggagcuauggcauggccaccucccuacuggcucugcaugcuggggaccuugguaggacucucagcuacccuagccccaaacagcuguccagacaaacacuacuggacugggggaggacucugcugccggaugugugagccagguaagagugggccucagcaggguuggggggagacugauauuuaagaugacggagguacucagaauaaggcugagcucaagcaaagucaggcagccugcagagccuagagccagcgccuugccuggacuuccaccuggccccucugcucucagguacauucuuugugaaggacugugaacaagacagaacagcugcucagugugaucccuguauaccaggcaccuccuucucuccagacuaccacacccggccccacugcgagagcugcaggcauuguaacucuggugagaggggcaguggugcggaaggcagcacugagaaaagaguccggggggcaaggccagaggggcuggcuguggagucagagagcuucagcugcuucaaggcccauggaaaguggagcccaugcugaaacccggugugccuugggcgaggcauguggggagaggucuaguguuucaugggagauaugcagaauucgagggauggcuaaaaagggcuccauggauaggacucagacaacagaagaaugagggcccgugcagucacgcacguccauaaucccaacuacaaggcaggcugaggcaggaggaucacuggaugauaggaguucaaggccaggaugaacaacauagcaagacccugucucacaaaaaaaaaaaaaaaaaaaaaaaaaagccaaggagauggcacaguaaguggcaacaguacuuuugccaccaccacgccugaguuuacucucugggccacaugguagaaggaaagaaucaacuggcaaguuguccucagaucguccuauguguccaugaguacacacgaaaaaugaaaaauauauaacucagagugcaggggaggggcaagguaguuccagaaacccaguuuccagaaaagcaacguccagccaaugagcagucuauguucccacaguguacauguguaggucagcucuuauuuggaguuggggaauaacaccagaaaccagggcauagcaaccuuuuuguacaaaagccuuuugggaggaaagcaaguagaucuaucauuucucuuaauuuauacauuucuacuuuuugcaaaggaagagguaggauaucugcagucucuuuucaaacuccccuguugccuccccaccuaugccagggauuugggaggccuguguuaccguacacuagaauagcauaauuuaaagaggccccuuuaacagugagcaggcacuuuguguguaggggaaaaaaaaaaacucuuuaauugcuguugcaaaaaaaccccauauauauauacacauacauacacacacauauauacacacacacacacauauauauauauauauauacacacacacacauacauaacugauuuuaauaacauuaauagagaauauguucuggaauguggaggcaauuggcugguaaguucuaguaacagaaccauccaaaugguuagucugagacaaacaccuaacaagaaaagucuucuuuugugggacuuucagauaaguccuacagaaauauuacacugugccuaaaccaaacuugaauuauuuuccaaguguuaaaaguuucauauaaguaagggcaggugugguggugcacaacuuuaauccccacauucaggaggcagaggcaaacagguuucugaguucaaggccaaccuggucuacagagugaguucagggacagccaggacuguuguuacccagagaaaaccugucuugagagguggguaguauaugauugccaauaauuaaaagcuuuaaaguaguagugaguaggaaagaaaaucauauaaucuuuuucuacuuucaguuucugugucugagccugggaaagguagcaggcagagaggggcaggugacagcaggggaggggcaggugacagcaggggaggggcaggugggggugagggaggggcagaggggaaauagguaaggcgcggggaguggaagaaauucauacccugugagugagucucgggggucucaggagagucaggggcaaguagacaccccaggucucuaaagaucugugguguccuguuucuccuggcucuccucucucccaagguuuucuuauccgcaacugcacagucacugccaaugcugagugcagcuguuccaagaacuggcagugcagggaccaggaauguacagagugugacccuccucuaaacccugcacugaccagacagccaucugagaccccgagcccacagccaccacccacccacuuaccucauggcacagguaugcagcaggcugcuccuuacccagucgggacaaggcagaaggcugccuacccagcacugcccagucuguguuuaccccuagcuagguucugggccagcaugucuuccuccugucugacuccugcaaaaucacaggaaagccugggacauccugggagguuuccugcuugugacucgcucugucuguuucuuccagagaagccauccuggccccuacacaggcagcuucccaacucgacugucuauagccagcggucaugugaguugucuuccuaauccccacuccacagagaaagcacagaggaaagaggccaaaagaacagccaugggaaaccccuaggugcugggugagggagagggguacagaguuggggagaaaguucgguggauaacuugcuauacaagggugacauaauacccagggccacagggaaaaccaagcagaguauggaagcucguaucuguagcccucacauucagaggcagaggcagagccagcagagcucaaaccagcaagcuuccaggucagggaggaauccugucucaagggacuaaacuagacuccgagaaagacacagagacagacagagcuggaggcaaaggagggggaagcagacucuaguuagagauuaggagagaaaggacugguccaacaggggcaggguuacucaggaaaaggacagacagacagggcuaaggguccagggugagaugccccuccaaagccucggugugcucuugcccgucacagcccauagaccccugugcagcucggacugcauccggaucuuugugaccuucuccagcauguuucuuaucuucguccugggugcaaucuuguucuuccaucaaagaagaaaccacgggccaaguaagacacaggccuucccuccugucucucagcugugcuacccacaccuaaagcccccacaccuacuccacccaccuacucuggcuccucaaguguccuucccccagacuccccaagccccccagcucucagcccuccacuugggcuuuucuccucuuuucuccccuucaccuuucuucucuccacugcugaccgauuguguuugcacagaugaagaccggcaggcagugccugaagagccuuguccuuacagcugccccagggaagaggagggcagugcuaucccuauccaggaggacuaccggaaacccgagccugcuuucuacccuugaccgggugcugguggggcccuuucugacgaggggccauccacagagaccucaaugguggccugcuccccugucauggucaucagaacccuuuccugugaauacucaacaaacugcccuucugagaccaacagggacaagagcaggaucccaguguguggcccagcaagcuggggagacucaggcucuagcuauaaagcacacuuacucuaagugaaaccguccagcugacaaaacuacaugccagggguggaaauggcucaccaagggcuccagagggggcuuggcagugaggagcacgaaguguuccuccagaggaccagaguuugauucccagcacugucaaauggaucgaaaccagcuguaacucuacuuucagagggucugacaccuuugaccuccucuggcaucuacaaacacaggacggacacacacacacacacacacacacacacacacacacacacgauuaaaaauaauaauuuuuuuuaaaaaaauggaaugagccaccggcaggugcccugguaccagaaggacugacugccgugagagacacuaucuacagacacacagacuuccuggccuugguucugucuucucuguaaguugugacagugcugugggaaagcugaggcugagacuuucucucaguugagcuaaaacuauaaauaaauucauuugucuacuucuauacacauugucccuucucucugugcaggcaaacacuggaacccggagccaagccuuacggcccagggacucuaguaacaagccagcuauggacacucuccaugugcuauuccccuuccuacagaaugaggguaggggaacaagaggaggaggaggaagaagaaaaaaaagaagggacagugaacuaggaagaaggauaguguaaaugcuaacuucaaauacgcacaccuacaacugaaacaaacaaacaaacaaucccucaguguggcccugagcuuguaauucaagggguuaaguggugugacaagggcggggcuuggaguagagacagcaggagaucacugcugugcuuguuggcuaccaaacaauuccagguucagaaagagacccugucucugaagaauaaggugggguaauagagcaagacacccagugcccucaccgagccuccacacacaggcagggcugggcauacucacccacacaaguguauacaccgcauauacacaaauacaaguuaaaagugagacuucacauagcuguccagccuccuaaaauuccaauccuagaacuaggccacaccccaucucgucuguucgaucacagaucugaacagggaguugucaccagggcagacccaaaggauuuaacauggacugaaaggaagaaggguccagaguaccggggaaucuaucuucuggcuccacccccucuccagcccucucauaguuggggcugaugggaaagcugauguggugauaccagguuuugaaaucaccuggggauuucuugggugcgggguggaccuuagggagaacagaaagcagagcuggcugcagccauuacuggccucgggcgggcggccacagaggcaguugaagugaaagugaaagagaaacgauaagagaacggagaccacaggugcuaagugagggugcucacagaacccccucuucagccagagaucacuagcaggggaacuguggagaaggcagccagcaaggaagagccugagaguagccuccaugggcuuggagcccagcugguaucugcugcucuguuuggcugucucuggggcagcagggacuggugagugcggagaccaggcuggggccugggggacugggggggaggaagcgccaagcuaaaggagccccaggaagccaccuucucagaacagcaccagcuugucugcuaagcccagcaaaugagugcggcacucacaacaugcggaaccaguuuggagagggguacggcagagaacucacagaaaaggggggcuuccucgaugggaaggcaggguguuagcauucugugggacagcucacugcccugaguugaauccuuagaagaggaaggggcuccccaggcuaagaaaucauuggguuggugacuccuggugggcguggcuauggcagaaagcagaggccucugggaaaguugggugaugagaaaaagguugucaaugucccuaggaacagcagugucuuggcuccucuccccuguggcaguauuucuuauuccuuuuuuuuuuuuuuuuuuuuaaccugagaauuccuuuccagaaauucccuugcaucccacagcugagacucagaaauacaaagcauaaaccccucuggcuuugaucaggacagaucuaggacuugaaauaacucacagagccgcugccugaguagcaggugccucagcagaagcuggguuuauagaugacaccaggacagcggggcucagaaggcaccuuuaccugcugcucagcccggggcuuggugaaggggugggaagaguguggaggacgagggugcuuguuccacuuucccugcagacccucccacagcgcccaccacagcagaaagacagcggcagcccacggacaucaucuuagacugcuucuuggugacagaagacaggcaccgcggggcuuuugccagcaguggggacagggagagggccuugcuugugcugaagcagguaccagugcuggaugauggcucccuggaaggcaucacagauuuccaggggagcacugagaccaaacaggauucaccuguuaucuuugaggccucagguaaaaucuccccauccuaggcuuccuccacaggaacagccccguucccaguucuaucuacccacgccugcccccccccccccccggucuggcguuguccauccaacauuacuucuguaugcugcccuucuccccaguggacuugguacagauuccccaggcagaggcguugcuccaugcugacugcagcgggaaggcagugaccugcgagaucuccaaguauuuccuccaggccagacaagaggccacuuuugagaaagcacauugguucaucagcaacaugcagguuucuagagguggccccagugucuccauggugaugaagacucuaagagaugcugaaguuggagcuguccggcacccuacacugaaccuaccucugagugcccagggcacagugaagacucaaggugagaaaacaaaaugcaguggcacaggaacauuuuguauuauugugugugugugugugugugcgcguccaugcgcacauacgugugcacaugccacagcacauagguagagaucagaggacagcuuauagaaccuaccaugugguuuccagggauugaacuaguucacuaugcuuggcagcaagcacuuuaugcacuaugccaucucaauagccccaagauaguuuuuugguuuuuugguuuugguuuuuuuuuuuuuuugggggggggguuguuguuuuuuuaauuuguuuuuuguuuguuugguugguuuguugguugguauuuuguuuucuuuugugguuagagaugggauagaaggaagaaaacaaauaucccacagguccuccugagguacccauagagcuucaucuuuucuuucuaaaauauccugagucaagaagaggggaugcuaggagauccuuauucgagcaagcaucaaaacauaauaaucaucagguauuuucuccaaaguggggaagcaacacaugaggacacuguagcuacacaugucacuacacucuuauuuagccaaacucauguuuccucccagggagagggagucuggucuggugcuucauggcaauuacagcagagcacagggagaaagaagugcucaguagcucuuacuagugagcccauuccucauucucucccacuuaguaccuccuaccagguucaaaaccaagaggaaacauauugacaggcaccuggagaguccaguucauuauuuugccuccaaaaaggagaaaaucaaguccacagaagaugacgaugagggggccccucuccuaucccugcaaaccccuaaaacauuagccuuuaguauuauguugucccauacugaggauagaaccuagagccuugugcuaaacacgagcucuacuacuaaacuacagcuucaauuccuuuuucaguuuuauugugaaacaggggucucacccagaugcccuggcaggccuggaaacuugugauucugucaugccuccuuaguagcugaugguacaggcauauacuaccacacccuccggcucuacaguccuuucugaaugugccuugccacaucagaaaagauguucagcaucuccuauccuuggccauggguaguuuagugcuucucccuuuuugaacuuauucagaucuacaaauaaaugaaacaacauacccccacccagccgugacuuauuucugaccuauuucgucagcugucauaguuccucucuacccgacuaacauagauauccuccccuggacugacuaggcuguagggaccacaacacuucacccccaaaugcucccaugugcaguuagggcugauagcugaaagucaaggccacucugcuucacaauaaccaaggaucccaaaagccuaucaaggcuggggagugcucuacucacaguaacaaggguccagugcacacaggacuuaacaguauuucauucauggaaagacgugacuauugaagcuggacguacuguccacaucugcaguccuugcacuuggagggacugaaccacgaagauuguggguuuaggcucucaugugugccuugcugcaccauuaauuuauggcuccacuggacaggaaaugaacucaguaccacuguccagggaagggagccggagcugucuguccauggcucagaggccaggugaccuuaaggaagaaacagucuguaagucacccuuucuuucucucuacaguggaguuccaggugacaucagagacccaaacccugaaccaccugcugggguccucugucucccugcacugcaguuucuccauggcaccaggccuggaccucacuggcguggaguggcggcugcagcauaaaggcagcggccagcugguguacagcuggaagacagggcaggggcaggccaagcgcaagggcgcuacacuggagccugaggagcuacucagggcuggaaacgccucucucaccuuacccaaccucacucuaaaggaugaggggaacuacaucugccagaucuccaccucucuguaucaagcucaacagaucaugccacuuaacauccuggguaaggacaggccuuggguuuucugggauaagggagagggagaugccuaugggaauguuucccagacuagaauccaaccccagagaaaauuuccucagagaaggaaugcauucccacaacccaaacaccaucuucauucuggaggugugggugaucagauaaggcgucucacugaaugccaagauaauacccccaggaaauaacuacaucagaauaaaaacccugggcuagcugucuguaauuucaguccccuggaccauuuccuugagagggacccugcagguguccaggcaaggaagucaaucacagggagaaagaaaccuugguucagauuaacuucuucaaccuggauccgacuugggaagucugauacaaggcgauuuauccccaacaaacuuaaacgcaguauaacugggggaaaaguuaugcugguauaauacagucccuuguaauuacaucaaaacuggacuuagaguccaugucauuucuuucaagaaaauggguucuaaagauaggaagccuguauuagcuuuagggcuuuagggaaggcucugagauguucucagucauacagauaguguagaggucauuugggcuaucagccaccucugguccugguuuugggagcuugggggagcccccugguuauacagauaauauaagggucauuuagaucaccagccaccucugguccugguuggaggagcuugguauggccuggaccaacagauaacacagauccaggcuauuaaucacuuccaauuuucagcuuuguggauggaagaacagguuuuuggggguuuuuguuucuuugauugauuuuagaacagguuuuuuaaaaacaucuuucccacuguaaagacaguccugcgugcuucauuccuaguugcucuggagaccugcggccacaagggccuucaucuuauguuccuagcacuuccuaauggcggcaacagccaauuaaggacaggcagaaagcaguucucaacucaaugagcaaucacuggcuugcagaggugauaaaagagaaaaccaaacgguaggguauguggcucagugguauagcacuugcuaguacuuauaaggcccuagguugaauucccagccuuuuaagaucuguguccaggaagagcccucaccccaacaucuugaaacacugaggaguuuccgucucuauaacauaccuucacgcuuaaagaggcugcaggcuccucugagggcucuggucggauaccucuaaaaucuuacuccuuguucuuucuccagcuccccccaaaauacaacugcacuuggcaaacaaggauccucugccuucccucgucugcagcauugccggcuacuauccucuggaugugggagugacguggauucgagaggagcuggguggaauuccagcccaagucucuggugccuccuucuccagccucaggcagagcacgaugggaaccuacagcauuucuuccacggugauggcugacccaggccccacaggugccacuuacaccugccaagucgcccacgucucccuggaggagccccuuacaaccagcaugaggguuuugccaaauccagguacuggggguguccucucuccuccccugucuguauucaggcugggacuccccugcuuacaggucaucuuuggcugugugcuauucucaugcguuuccucaguuccaccuucugcacacucuuuaucuuaucuuuaucuuucccagaguggcauccucuaccacuaugaauccccagccuccaaauaaugagaugaguaagcuugggcuggguaucagagguaaaggagugcugcuccuucccauaggagcuagagagacaaauugaggcagacagggaaaaagacccaaaacagaccuuugagcccagcccaaguucagcaggaagcccuuaagacuggaagcacaguccauaugaaaaccaaacgacacaagagucuacagaaaaccuaggggccugagggugugugcaaaaaagggcacgaggcaaugauacuuaagacgauuacaucugcacacccauaugaccaagcauuggaaagucagcuucuacacuaacuuuaauauuuuauguguuugcgugguuugccugcuguagugcaccaugggcaagcaaugcccauggagaccugaagagggcaucagauccccuagcacuggagguacagaugcuugucagccacuauguggcugcuaagacuggaacccagguccuuugcaagagcaacaagaacucuugacuucuuagccaacucuccacccccaauauacucaagagcuucugagggugaucucacauauuacaccucccauuuauuuuuggaaaccggucuuccugagcaggcuggccucaaacuccucugccaagcagcccuccuacucagccucccaaauagcugggacuacagacaccaucgccauguccagaauucaucuuacagaugaguaagcuggcauuugcagacacugagcaguuugccccagguucucuaccaauauacaauaaaggagacacuauaaccaaaaggcaagcugcaagcccuuacguguuuacacccuauaucuacacacacuucaucccaaaggccacagaaugcugcaguuucaggcaggaaaggaugugcaccucacaaugaaauauccaagagcuccagaccuauuugguugcucgcuagacuaugagcuuccccaaagcuugccuuuuguuuuggcucacaucauuccccagcuauuugcugguagucacugagauagccucauucucuucuguaaaacauuuucaaauguccugagauagaauagggucuaguggggugugccuauaaacacagcacuagaaggcuguggcaggacuccuaaguucaaagccagcuuggacaucaugaggcccugucucagaauaacaaagccccgauggaguaagaggcagaacagcaacacacaaacuugagagucuugaacaagugcagugcugcugcgugggcaggcucccguccuuccgugaggauucacagcacccaggccagagcuccccuccuaaggggagggguacuggagggugagggcucagcauguggucuuguguucauucucacccacagagcagagaggaaccuugggagucaucuuugccagcaucaucuuccuuucugcgcuguuguuguuucugggacuucacagacagcaaggugaguuuguagaucaaccuacucucagguaucugcccacccaaaccagggaugaaguccagugugcugaguuccagauguuucuaccauacccccaacaucugcuuuuggaauuaucccuauugaaaacaaucuuguuccguuuuucucucagcuucuucaucaagguccaccaggccuaugaggcauucuggguagccgccugccugccuccgaauacaaaguaaaguacuccacauccuggcuacuuaaaggaccccgugugagguguggggcugagcugggccugaaggugccagcacauugggagugcaguacuggcccuggacuguacaagucucugcuuucugugcuauugagaagagagcccugggcugaugaaaagggacaggacaagaggauggcagaauuaucaaaguggaagcuaacaccaucuaugugagguauuaagaaaucgggggugggggcuggugagauggcucaguggguaagagcacccgacugcucuuccgaagaucuggaguucaaaucccagcaaccacaugguggcucacaaccaucuguaacgagaucugacucccucuucuggagugucugaagacagcuacaguguacuuacauauaauaaauaaauaaaucuaauaaaaaagaaaaaaaaagaaaucggggguggggggacacacaggggaggguuaccuaaaaagggcuuuccuucucaaaggagaaagggaaggaggaaugggggugggucuucaugcagagguacuagaaggagagagggaacugauauuggaauguaaaaugaguaaaugaaaaaaaagucagauguaaaaaaauucucuuagaaaaaggaucaaagugagggaagcgggagaggcugugaccacucaugaaugccaacacugucaaaauaaaaacaugcugugacuacagcgcacuuucuucucucucucccuguugguuccaaaacauuccuagcugcuccaacucccaacucguuguuucaagguacgaagcagaggcccugggcuacaucugcaccguuacaucaucagauauuaggguucugacccuucagacagcugccaggaguuuugggagaguuauacaacacucccucagcugcacgagagcuuccuugugcucacugcuaugaaauaccuuauggauacagugcauccgagccuauaaagaccaugaauuaugaugucuguuaucaaaaguaaaguggggggcuagagagauagcaacccguggauaggagcgcugguagauuuucuacacaaccuggauuugguucccagaaccacaugguagcucacaaccaucuguaacuaauuccaggagucuaacgcccucuucugucuuccuaaagcaccagacaugcauguaguacucacacauacaugcuagaaaaacagguauaugcauaaaauaaaaacaaaugcaucuuuaaaaauaucugugcaugagugugccuguguguauguguaccacacgcacccagaugccugcagaggucagacggggcccuggauccccuggaacuguagcuaccuacagguguuaguggccaugugggugcugcaaacgagaccuagguccucugagaguucucuuuaguagaucuauuuaucuuaccauuuuauguguguugaguguuuugugugcaaguguguauguacaccaccugugugccugguaccaggagagagugucagauccccggggacacacagagggcuggggucggggugggagguugugauccuccauauagcugcuauaaauuggacccagguccucugcagaaguaacaagugcucuucacugcugaaccaacucuccagcccuaaauuaagauuuuaaaaauuaaguugugaaugauggugcaugcuuuaaucccagcacucaggcagcagaggcagggggaucucucugaguuugaugacagccuggucuacagaguacauuccaaggcagccagggcaacaaagagaaaccuugucucguggguggggggaagguuuucuggguuuagaagcuaguuuuugcagacauuaggaacagaccaaugucuuaaaaggaggugggggaagggcugcagagauggccccguggcuggggcacugguugcucuggggaggaucuggaugccaggcacacacauguuguaaauacauacaugcaaacacucacacgcauacaauaaacagaacuagaucuugaagugaacuugcuauuucagaagaauuaguauggagaaucuacuuacaaggcaagcacaauggggcacacuggaaacccugucuugaaaaacuaaagaaaauagaaaugaagcugaagaggggaacaaaucaugcaugaggaccaaggagguacgggcuggaagccucccccaagaggugacaagcagguggagaggccugggaggggcugagaaagccugcagcugucugcuagcauuuggugcccacucagcuuccugucagcacuuccucucaccagcaccugcaagccuggcuguuucagguaugaaggcuaagacacagaccacuuccgcugccaacacagagacuuuaaucuccaggaagaacaaagaauacacacaucagcccuucuggccuagagccaacauaggacaccaccuuccucucccccuccccagcacagcccaaacaacaaucaagucaauguugugguaggaauuuguauuuuucgccuuuguugagaauacaugagauugguaaauaugucacaugccuuugguggaaguacaacucuuacuacuauacauaaacugugagacuggguuaggaaagagacagagguaaugacagacacgauggaagccccacaucaucccauggcaaacaaagaggagaugugggaagcuuggcuucaacugacugcaaagucccaggguuagcugcauauuugcucaugcacauggguggugggagggagagaagacugcagagacacagaaggggguucagggugaggugagauagaaaguagaaggacuaacacccccagaagaacgaaugccaacuacaccuaagccuuagauggacagaaacccaggaaauaauucccgugcuggggcugggugggccaacagggaacauacgcuccaggcuugggacacaccaaggacaguguugcuucuucuccagagauggcucccugcacuaggcaaagggaagcccagagcagaguggagaccuucgggggacauugggaggcuacacugacugcuuucuuccagcucuucagcccugcccugaggcagcacgaagggaagguggaaaaugggccaagggaaaggaaggaucgauggcucugcagaacgaaaggcugcugcgugggaaguggacccccggccuagcacggcccugccuccuccaguuuguggaccagagcacagaaggaauagaggucugagaacauugcccuccucuucccacccugcccuccacccgccgggcaccuggcuuugucccaugcgggauccuaucaugacacuagaagaagcccccgagacagacugugcagcuccuauccucggcuccaacaaacacagcaugcaaagggagugaaagacaggaggcaaugcagaauggaugggcacagcggcugcagggagaacuaacggaagaguggcaggcagcugcggaugcgaggcccaugccgcacagcagcgcaacggcacaccaacacagccuggacccuccuauccaaaacugagcugcgggaucaguggacuucucuaacucuggaaaggcccuccugccuccccccguguuacauacaggguaguguggaggaaaguguucuguggcagccugggagucuugccaugcagcucucauuucucgugaucaacaacaagggagggacaggccuuucauuagugagauggcaagaagcacacuccugaaagcuuguuauuuuccaagccccugauucccugaaauuauuuggugccuucaugaauaacaucaaaugcuucaggugacaugaagagaagcaugugggauggcuucuaggagaagguaagaguguccugguguuuuuacaaccagaaaguacgccuuuccuaggccuacagagaacaaagcgagcgaaaggcuguaaaguuccccacagacacagaaaauccuguacugacauguaaagaguagcuacaaaauacaagucugacuuuuucuaaaagggauuugaaguuggucuuuaaacagaccucugggaccaaaggcaggccugguaugggagaaaaguuucaaauaaggacaacaguucccaacuaauauauacauauacaugugcauguacauauacaugugcauauacacaugcacuggcagcaagcuacuacuucccaacuauucuugcuccccuccugccaaaggccagccuuucuuggagacaccauggacacaaauacccuucuccuccccucagcuaugcuaacuucucagacacuucaccucugccauucccggcccccuccuucccuuuggccacaacucuuuuaagcuccaggcacacgauaaauggguaaggaggaggugccagccguugucuucggguagugacuucaggacuggaccacgagcagcauuucuaguuuugaggaagggugcaaaugaacgcaacaguaaaggaagggucauggagaagccugggccaggauggagaacggaggauggaggaguuuguugagaaagcaaacagaggggaagagacaugagcuuggguggcaauggagaacagggaagggauggcacauucucaaguaaaaaaguagacuggacacaggaaccagcaagucccagacggagaaggaaaaaagagacaggagagaacaagagggcaaguuacagcacaucaccagacauucaggucucucaguaacaggcaccccagccccaaggucucccuuggacccaagcuaguggcaaacagcucaacccaccuccucagcagaaggggcaaucucccacaauccuuugcaggggggcggcuuguccaucaaggaauguccuuguuuuugcccuuccucccucccaaaccagacgacgaucccccaguagccgucuccauaccucugcagagcggccccacuccccaggcaggcaggcaggcaggcaggcagggcugggagaagucuccaggaccuucccaccucuucaccccaucagcgaccucagcgauacuuacuuacaaucacuaccacgaugauggcacagauagcucccagcaugaucaucaucugaggagacagauggggacagagcaugagcccuugcacucagagaugggaccacccacaggccucugccucuuguacggucacaaccucaggagcauaggaccugcagccucauguuguuuacuuccuguugccuguuuguuuuuuucucuuggaauuccaauggaugggcaaacuuugugaaguaccugcucaggcuacagaaguuguggauguuuaaauacauauacugagccaguguauggcugcugggugucugaggaaagagccaggugagacuuucugcagaagauacuaaaugagaaagagcuaccucacuagucuaaauucugaguuccucuaccuagggcuuucuuagugguucuguuacucuagccuacccugguggccaacacagguacuacauaucaaggaggcuuccagauuucagaggaaagaaaaugagaaguuaauggcucucuugccuccugagaggggagcgaggcaggaaaagcuggagggggcagggaaucucaccuugcaguuuuuccaccaguacuuccuuuuuagcuuggcagcacugcucucaaauugugaugcuccggccugcaaggcgucagcccggucauccagcucugacaacuucuggucccucuccaagaccuuguccacauucacacgcaugauguccaccaccuaaggagauugcagaaauaaagacgcugagauuuccccccuagagaccgagaaaaugaauaaugccugggagaucacaagccaaggccuuuggauccauggcacgcuuugccccaccccacccccugagccucuccccuauaaaaaagaggaagauggguaaaccgauccuugacuuagacacucucacggagggugccaggcgccuaccuccuccacuugugccugggucugcuguaaccgccuguuacuggucauguugggaggaggaccaggaggacccccaccaggggcagcuccuucugucccuucagcaggcgguugagcuggagcagaccuguggagagaggcaaacaguacacaacguaacugagacaagaaaagaauccuaugcauccucaccucacaccaccaaagcaaaugcugauugaaaacggaaggcauuuuagcuccucagccacccccaaguacugagaggcaaacucagacacauccucuggcacaauggccauagggacaaauaugccagccuugaccuagauggaauuugccuggccacuacaagcuccucacaugaaauaagaugggacaacccaauccaggggaagagaaauuuguagaaaacauuaaaucguaaggccacgugaaucugaagugugaauaugaaaggggcaagucgacgguccugcuuggggcagggucugguucccgguugggcuucacacuguaguuggaacaucacggcugcugcaaagacaguuuggagaaucaccaaaagcaaagucuguauagguggagugaauccaagccgguuguucuguucuuggcagagaagccaggaguuucauuuaaaaugaaucugagaccuaaaacaauuauacuagucguuccgaaaagcacagaccagaaauaaaaaugcuagaaacaguccucaguguacacacagcagacacucuguccauucaucuucagacugggcgaugucucaggauaguuacccagucccgugucagauaaggaagcuugaacuacacugcugugaguucaagucucuccaccagcaccgcugagggcaaagcguucccacggccuuagaagggaauaauccagaguggguuugguuugguuugguuuguguuucggguguuuuguuuugagaugaggucucacgaagcccuggguguccuggaacucucuauguagaccaggcuagccugaaauacagaucuaucugccucugccuccccaucugcugggguuaaagcaacgguggggccugaagaugaacuccucucugacagucaccagcuaacgaguucccagaguuaaacccacagaagcaagguaaagagagaaagcuaaaauuugauggggaauagaaauuucuuaagugcuaaaaaaaaaaaaaaucuuugcuagaaaaguccaagaauaaguacaguaaagguuaagccaccagaaaguugcuaaaaaaaaaguaaauuccuugauuaauuacaacagaaccaagaugcagaaucucuuuuuccauaacuaagggaaauguucuagacacgauguaauaaccccaaccgcuucucggccuuuuggcuaagaucaagauguagaagccccucagaaagacucuauuagcagauuacaccagcuucuuccacuuaaagggccgcuuucccauuuccuuccuaaacauagaggaaucugcaaagccaugggagccacaggaucugcacugcuacugagcuagcuaagcaaucuaguucuagaccagagggagggauuucaaugaguugguagcagcuaguguuggaagguguccaggaugguggcaccaaugacaagauuaaggucagagaccucgugauucccugcuagccaccaugcuuucucaaccuccuuccaaacaucacacaugaaacuaccugcagccagucaacuaagaaggaccccuccccuccccuaaacaucuagaucuaugggcuuguaaaaacugcacagaauguuaaugcagagaacggauaaaauggcugugaagcuuuggagaacucacuuuauuuacuauuuguggcagguagaaacacuccacccuaaccuauucagggaguuauaacccuuauguaauacaaaauccugccccccuuuugccaauagaggcaacacaagcagaguguaguggugcacaccuuuaaucccagcacuuggaagccaggggcagguggaucucugaguucaaggccagccuugucuauagagggaauucugagacagccagggguacacagagaaacccuauauggaaaagccaaacaaagaagggggauagagagagcgaggaagagggagagagagaggaagagggagagagagaggaagagggaacaaacacaaauaaaucuagcaccaggcaagagauucagauaauaaaugaaaagaaagaaaauucuucauuguguguaugugauccuaaagggaaguucuuaauuuaucuggccacagaaggggaugaugccaaaaagagcuaaaggcuaaacuauguguuuuggauaaaaugaagaauucacuguucucccuauuucuccuccaauauuuauuuggcuaggacuugaucacuggaaaucgccuuagcauaaacagcugcauuaagauuucauaccacuguccccugagacuuucugagcuacucgcaaggcgccacagaacuagcaaguuaaguuucugcagcuuugcucacagccaugaggcagguacaucacacucugggugaggggcaugcauaacgcagagacugcgggcacuccaagucaagaauggacaggaacaccuauaagucuucccagaggcuuuaagagucugucaaacaagaaagggucuccgaguuuccugucugaaucuauaccucccccacuuuuuccccuuugggguuccacgauacaaagacaagaggggagggugcgguguacgugggacccccgcgcccucgcccugccauggagugccagcugcaguuggugcgggauggagcgcugcccgcaguccgggguggcccggucugggggcggcgcgagcuggugguucccggcgucgccgcagcugcugcaaugcgccauuucccgucccgcagagucggacacugcgggggagagucgguaaagaggugucgaggacccuagagcagagucaacucacauuuuucugaaagaggaaguggagguccguccccucucuggagaaugcaacgagacgggcagggagacacugcggcugaagcagacggaacugucgagcgccgccucacacgaaacacccggaacucuaacugcgguggaacuuacugcaggugcagggccggcucucggcuuuauuagacaugaccacgccucucggaugaugucaaaaccuccagguccaauccucgugagaaauggccugcuagucccgcccccacaacuacagcaauuaccauuguccucuuauuucuauuucuucacugaccaauacaaaaguggcuugcuuaaaguccagcucaaacucu

SEQ ID NO: 3393 - RNA, 8463 nt, Mus musculus
aguacuacaugcaugucuggugcuuuaggaagacagaagagggcguuagacuccuggaauuaguuacagaugguugugagcuaccaugugguucugggaaccaaauccagguuguguagaaaaucuaccagcgcuccuauccacggguugcuaucucucuagccccccacuuuacuuuugauaacagacaucauaauucauggucuuuauaggcucggaugcacuguauccauaagguauuucauagcagugagcacaaggaagcucucgugcagcugagggaguguuguauaacucucccaaaacuccuggcagcugucugaagggucagaacccuaauaucugaugauguaacggugcagauguagcccagggccucugcuucguaccuugaaacaacgaguugggaguuggagcagcuaggaauguuuuggaaccaacagggagagagagaagaaagugcgcuguagucacagcauguuuuuauuuugacaguguuggcauucaugaguggucacagccucucccgcuucccucacuuugauccuuuuucuaagagaauuuuuuuacaucugacuuuuuuuucauuuacucauuuuacauuccaauaucaguucccucucuccuucuaguaccucugcaugaagacccacccccauuccuccuucccuuucuccuuugagaaggaaagcccuuuuuagguaacccuccccuguguguccccccacccccgauuucuuuuuuuuucuuuuuuauuagauuuauuuauuuauuauauguaaguacacuguagcugucuucagacacuccagaagagggagucagaucucguuacagaugguugugagccaccaugugguugcugggauuugaacuccagaucuucggaagagcagucgggugcucuuacccacugagccaucucaccagcccccacccccgauuucuuaauaccucacauagaugguguuagcuuccacuuugauaauucugccauccucuuguccugucccuuuucaucagcccagggcucucuucucaauagcacagaaagcagagacuuguacaguccagggccaguacugcacucccaaugugcuggcaccuucaggcccagcucagccccacaccucacacgggguccuuuaaguagccaggauguggaguacuuuacuuuguauucggaggcaggcaggcggcuacccagaaugccucauaggccugguggaccuugaugaagaagcugagagaaaaacggaacaagauuguuuucaauagggauaauuccaaaagcagauguuggggguaugguagaaacaucuggaacucagcacacuggacuucaucccugguuugggugggcagauaccugagaguagguugaucuacaaacucaccuugcugucugugaagucccagaaacaacaacagcgcagaaaggaagaugaugcuggcaaagaugacucccaagguuccucucugcucugugggugagaaugaacacaagaccacaugcugagcccucacccuccaguaccccuccccuuaggaggggagcucuggccugggugcugugaauccucacggaaggacgggagccugcccacgcagcagcacugcacuuguucaagacucucaaguuuguguguugcuguucugccucuuacuccaucggggcuuuguuauucugagacagggccucaugauguccaagcuggcuuugaacuuaggaguccugccacagccuucuagugcuguguuuauaggcacaccccacuagacccuauucuaucucaggacauuugaaaauguuuuacagaagagaaugaggcuaucucagugacuaccagcaaauagcuggggaaugaugugagccaaaacaaaaggcaagcuuuggggaagcucauagucuagcgagcaaccaaauaggucuggagcucuuggauauuucauugugaggugcacauccuuuccugccugaaacugcagcauucuguggccuuugggaugaaguguguguagauauaggguguaaacacguaagggcuugcagcuugccuuuugguuauagugucuccuuuauuguauauugguagagaaccuggggcaaacugcucagugucugcaaaugccagcuuacucaucuguaagaugaauucuggacauggcgauggugucuguagucccagcuauuugggaggcugaguaggagggcugcuuggcagaggaguuugaggccagccugcucaggaagaccgguuuccaaaaauaaaugggagguguaauaugugagaucacccucagaagcucuugaguauauuggggguggagaguuggcuaagaagucaagaguucuuguugcucuugcaaaggaccuggguuccagucuuagcagccacauaguggcugacaagcaucuguaccuccagugcuaggggaucugaugcccucuucaggucuccaugggcauugcuugcccauggugcacuacagcaggcaaaccacgcaaacacauaaaauauuaaaguuaguguagaagcugacuuuccaaugcuuggucauaugggugugcagauguaaucgucuuaaguaucauugccucgugcccuuuuuugcacacacccucaggccccuagguuuucuguagacucuugugucguuugguuuucauauggacugugcuuccagucuuaagggcuuccugcugaacuugggcugggcucaaaggucuguuuugggucuuuuucccugucugccucaauuugucucucuagcuccuaugggaaggagcagcacuccuuuaccucugauacccagcccaagcuuacucaucucauuauuuggaggcuggggauucauagugguagaggaugccacucugggaaagauaaagauaagauaaagagugugcagaagguggaacugaggaaacgcaugagaauagcacacagccaaagaugaccuguaagcaggggagucccagccugaauacagacaggggaggagagaggacacccccaguaccuggauuuggcaaaacccucaugcugguuguaaggggcuccuccagggagacgugggcgacuuggcagguguaaguggcaccuguggggccugggucagccaucaccguggaagaaaugcuguagguucccaucgugcucugccugaggcuggagaaggaggcaccagagacuugggcuggaauuccacccagcuccucucgaauccacgucacucccacauccagaggauaguagccggcaaugcugcagacgagggaaggcagaggauccuuguuugccaagugcaguuguauuuuggggggagcuggagaaagaacaaggaguaagauuuuagagguauccgaccagagcccucagaggagccugcagccucuuuaagcgugaagguauguuauagagacggaaacuccucaguguuucaagauguuggggugagggcucuuccuggacacagaucuuaaaaggcugggaauucaaccuagggccuuauaaguacuagcaagugcuauaccacugagccacauacccuaccguuugguuuucucuuuuaucaccucugcaagccagugauugcucauugaguugagaacugcuuucugccuguccuuaauuggcuguugccgccauuaggaagugcuaggaacauaagaugaaggcccuuguggccgcaggucuccagagcaacuaggaaugaagcacgcaggacugucuuuacagugggaaagauguuuuuaaaaaaccuguucuaaaaucaaucaaagaaacaaaaacccccaaaaaccuguucuuccauccacaaagcugaaaauuggaagugauuaauagccuggaucuguguuaucuguugguccaggccauaccaagcuccuccaaccaggaccagagguggcuggugaucuaaaugacccuuauauuaucuguauaaccagggggcucccccaagcucccaaaaccaggaccagagguggcugauagcccaaaugaccucuacacuaucuguaugacugagaacaucucagagccuucccuaaagcccuaaagcuaauacaggcuuccuaucuuuagaacccauuuucuugaaagaaaugacauggacucuaaguccaguuuugauguaauuacaagggacuguauuauaccagcauaacuuuucccccaguuauacugcguuuaaguuuguuggggauaaaucgccuuguaucagacuucccaagucggauccagguugaagaaguuaaucugaaccaagguuucuuucucccugugauugacuuccuugccuggacaccugcagggucccucucaaggaaaugguccaggggacugaaauuacagacagcuagcccaggguuuuuauucugauguaguuauuuccuggggguauuaucuuggcauucagugagacgccuuaucugaucacccacaccuccagaaugaagaugguguuuggguugugggaaugcauuccuucucugaggaaauuuucucugggguuggauucuagucugggaaacauucccauaggcaucucccucucccuuaucccagaaaacccaaggccuguccuuacccaggauguuaaguggcaugaucuguugagcuugauacagagagguggagaucuggcagauguaguuccccucauccuuuagagugagguuggguaaggugagagaggcguuuccagcccugaguagcuccucaggcuccaguguagcgcccuugcgcuuggccugccccugcccugucuuccagcuguacaccagcuggccgcugccuuuaugcugcagccgccacuccacgccagugagguccaggccuggugccauggagaaacugcagugcagggagacagaggaccccagcaggugguucaggguuugggucucugaugucaccuggaacuccacuguagagagaaagaaagggugacuuacagacuguuucuuccuuaaggucaccuggccucugagccauggacagacagcuccggcucccuucccuggacagugguacugaguucauuuccuguccaguggagccauaaauuaauggugcagcaaggcacacaugagagccuaaacccacaaucuucgugguucagucccuccaagugcaaggacugcagauguggacaguacguccagcuucaauagucacgucuuuccaugaaugaaauacuguuaaguccugugugcacuggacccuuguuacugugaguagagcacuccccagccuugauaggcuuuugggauccuugguuauugugaagcagaguggccuugacuuucagcuaucagcccuaacugcacaugggagcauuugggggugaaguguuguggucccuacagccuagucaguccaggggaggauaucuauguuagucggguagagaggaacuaugacagcugacgaaauaggucagaaauaagucacggcuggguggggguauguuguuucauuuauuuguagaucugaauaaguucaaaaagggagaagcacuaaacuacccauggccaaggauaggagaugcugaacaucuuuucugauguggcaaggcacauucagaaaggacuguagagccggagggugugguaguauaugccuguaccaucagcuacuaaggaggcaugacagaaucacaaguuuccaggccugccagggcaucugggugagaccccuguuucacaauaaaacugaaaaaggaauugaagcuguaguuuaguaguagagcucguguuuagcacaaggcucuagguucuauccucaguaugggacaacauaauacuaaaggcuaauguuuuagggguuugcagggauaggagaggggcccccucaucgucaucuucuguggacuugauuuucuccuuuuuggaggcaaaauaaugaacuggacucuccaggugccugucaauauguuuccucuugguuuugaaccugguaggagguacuaagugggagagaaugaggaaugggcucacuaguaagagcuacugagcacuucuuucucccugugcucugcuguaauugccaugaagcaccagaccagacucccucucccugggaggaaacaugaguuuggcuaaauaagaguguagugacauguguagcuacaguguccucauguguugcuuccccacuuuggagaaaauaccugaugauuauuauguuuugaugcuugcucgaauaaggaucuccuagcauccccucuucuugacucaggauauuuuagaaagaaaagaugaagcucuauggguaccucaggaggaccugugggauauuuguuuucuuccuucuaucccaucucuaaccacaaaagaaaacaaaauaccaaccaacaaaccaaccaaacaaacaaaaaacaaauuaaaaaaacaacaaccccccccccaaaaaaaaaaaaaaaccaaaaccaaaaaaccaaaaaacuaucuuggggcuauugagauggcauagugcauaaagugcuugcugccaagcauagugaacuaguucaaucccuggaaaccacaugguagguucuauaagcuguccucugaucucuaccuaugugcuguggcaugugcacacguaugugcgcauggacgcgcacacacacacacacacacaauaauacaaaauguuccugugccacugcauuuuguuuucucaccuugagucuucacugugcccugggcacucagagguagguucaguguagggugccggacagcuccaacuucagcaucucuuagagucuucaucaccauggagacacuggggccaccucuagaaaccugcauguugcugaugaaccaaugugcuuucucaaaaguggccucuugucuggccuggaggaaauacuuggagaucucgcaggucacugccuucccgcugcagucagcauggagcaacgccucugccuggggaaucuguaccaaguccacuggggagaagggcagcauacagaaguaauguuggauggacaacgccagaccgggggggggggggggcaggcguggguagauagaacugggaacggggcuguuccuguggaggaagccuaggauggggagauuuuaccugaggccucaaagauaacaggugaauccuguuuggucucagugcuccccuggaaaucugugaugccuuccagggagccaucauccagcacugguaccugcuucagcacaagcaaggcccucucccuguccccacugcuggcaaaagccccgcggugccugucuucugucaccaagaagcagucuaagaugauguccgugggcugccgcugucuuucugcuguggugggcgcugugggagggucugcagggaaaguggaacaagcacccucguccuccacacucuucccaccccuucaccaagccccgggcugagcagcagguaaaggugccuucugagccccgcuguccuggugucaucuauaaacccagcuucugcugaggcaccugcuacucaggcagcggcucugugaguuauuucaaguccuagaucuguccugaucaaagccagagggguuuaugcuuuguauuucugagucucagcugugggaugcaagggaauuucuggaaaggaauucucagguuaaaaaaaaaaaaaaaaaaaaggaauaagaaauacugccacaggggagaggagccaagacacugcuguuccuagggacauugacaaccuuuuucucaucacccaacuuucccagaggccucugcuuucugccauagccacgcccaccaggagucaccaacccaaugauuucuuagccuggggagccccuuccucuucuaaggauucaacucagggcagugagcugucccacagaaugcuaacacccugccuucccaucgaggaagccccccuuuucugugaguucucugccguaccccucuccaaacugguuccgcauguugugagugccgcacucauuugcugggcuuagcagacaagcuggugcuguucugagaagguggcuuccuggggcuccuuuagcuuggcgcuuccucccccccagucccccaggccccagccuggucuccgcacucaccagucccugcugccccagagacagccaaacagagcagcagauaccagcugggcuccaagcccauggaggcuacucucaggcucuuccuugcuggcugccuucuccacaguuccccugcuagugaucucuggcugaagaggggguucugugagcacccucacuuagcaccuguggucuccguucucuuaucguuucucuuucacuuucacuucaacugccucuguggccgcccgcccgaggccaguaauggcugcagccagcucugcuuucuguucucccuaagguccaccccgcacccaagaaauccccaggugauuucaaaaccugguaucaccacaucagcuuucccaucagccccaacuaugagagggcuggagaggggguggagccagaaga

SEQ ID NO: 3394 - RNA, 8463 nt, Mus musculus
ucuucuggcuccacccccucuccagcccucucauaguuggggcugaugggaaagcugauguggugauaccagguuuugaaaucaccuggggauuucuugggugcgggguggaccuuagggagaacagaaagcagagcuggcugcagccauuacuggccucgggcgggcggccacagaggcaguugaagugaaagugaaagagaaacgauaagagaacggagaccacaggugcuaagugagggugcucacagaacccccucuucagccagagaucacuagcaggggaacuguggagaaggcagccagcaaggaagagccugagaguagccuccaugggcuuggagcccagcugguaucugcugcucuguuuggcugucucuggggcagcagggacuggugagugcggagaccaggcuggggccugggggacugggggggaggaagcgccaagcuaaaggagccccaggaagccaccuucucagaacagcaccagcuugucugcuaagcccagcaaaugagugcggcacucacaacaugcggaaccaguuuggagagggguacggcagagaacucacagaaaaggggggcuuccucgaugggaaggcaggguguuagcauucugugggacagcucacugcccugaguugaauccuuagaagaggaaggggcuccccaggcuaagaaaucauuggguuggugacuccuggugggcguggcuauggcagaaagcagaggccucugggaaaguugggugaugagaaaaagguugucaaugucccuaggaacagcagugucuuggcuccucuccccuguggcaguauuucuuauuccuuuuuuuuuuuuuuuuuuuuaaccugagaauuccuuuccagaaauucccuugcaucccacagcugagacucagaaauacaaagcauaaaccccucuggcuuugaucaggacagaucuaggacuugaaauaacucacagagccgcugccugaguagcaggugccucagcagaagcuggguuuauagaugacaccaggacagcggggcucagaaggcaccuuuaccugcugcucagcccggggcuuggugaaggggugggaagaguguggaggacgagggugcuuguuccacuuucccugcagacccucccacagcgcccaccacagcagaaagacagcggcagcccacggacaucaucuuagacugcuucuuggugacagaagacaggcaccgcggggcuuuugccagcaguggggacagggagagggccuugcuugugcugaagcagguaccagugcuggaugauggcucccuggaaggcaucacagauuuccaggggagcacugagaccaaacaggauucaccuguuaucuuugaggccucagguaaaaucuccccauccuaggcuuccuccacaggaacagccccguucccaguucuaucuacccacgccugcccccccccccccccggucuggcguuguccauccaacauuacuucuguaugcugcccuucuccccaguggacuugguacagauuccccaggcagaggcguugcuccaugcugacugcagcgggaaggcagugaccugcgagaucuccaaguauuuccuccaggccagacaagaggccacuuuugagaaagcacauugguucaucagcaacaugcagguuucuagagguggccccagugucuccauggugaugaagacucuaagagaugcugaaguuggagcuguccggcacccuacacugaaccuaccucugagugcccagggcacagugaagacucaaggugagaaaacaaaaugcaguggcacaggaacauuuuguauuauugugugugugugugugugugcgcguccaugcgcacauacgugugcacaugccacagcacauagguagagaucagaggacagcuuauagaaccuaccaugugguuuccagggauugaacuaguucacuaugcuuggcagcaagcacuuuaugcacuaugccaucucaauagccccaagauaguuuuuugguuuuuugguuuugguuuuuuuuuuuuuuugggggggggguuguuguuuuuuuaauuuguuuuuuguuuguuugguugguuuguugguugguauuuuguuuucuuuugugguuagagaugggauagaaggaagaaaacaaauaucccacagguccuccugagguacccauagagcuucaucuuuucuuucuaaaauauccugagucaagaagaggggaugcuaggagauccuuauucgagcaagcaucaaaacauaauaaucaucagguauuuucuccaaaguggggaagcaacacaugaggacacuguagcuacacaugucacuacacucuuauuuagccaaacucauguuuccucccagggagagggagucuggucuggugcuucauggcaauuacagcagagcacagggagaaagaagugcucaguagcucuuacuagugagcccauuccucauucucucccacuuaguaccuccuaccagguucaaaaccaagaggaaacauauugacaggcaccuggagaguccaguucauuauuuugccuccaaaaaggagaaaaucaaguccacagaagaugacgaugagggggccccucuccuaucccugcaaaccccuaaaacauuagccuuuaguauuauguugucccauacugaggauagaaccuagagccuugugcuaaacacgagcucuacuacuaaacuacagcuucaauuccuuuuucaguuuuauugugaaacaggggucucacccagaugcccuggcaggccuggaaacuugugauucugucaugccuccuuaguagcugaugguacaggcauauacuaccacacccuccggcucuacaguccuuucugaaugugccuugccacaucagaaaagauguucagcaucuccuauccuuggccauggguaguuuagugcuucucccuuuuugaacuuauucagaucuacaaauaaaugaaacaacauacccccacccagccgugacuuauuucugaccuauuucgucagcugucauaguuccucucuacccgacuaacauagauauccuccccuggacugacuaggcuguagggaccacaacacuucacccccaaaugcucccaugugcaguuagggcugauagcugaaagucaaggccacucugcuucacaauaaccaaggaucccaaaagccuaucaaggcuggggagugcucuacucacaguaacaaggguccagugcacacaggacuuaacaguauuucauucauggaaagacgugacuauugaagcuggacguacuguccacaucugcaguccuugcacuuggagggacugaaccacgaagauuguggguuuaggcucucaugugugccuugcugcaccauuaauuuauggcuccacuggacaggaaaugaacucaguaccacuguccagggaagggagccggagcugucuguccauggcucagaggccaggugaccuuaaggaagaaacagucuguaagucacccuuucuuucucucuacaguggaguuccaggugacaucagagacccaaacccugaaccaccugcugggguccucugucucccugcacugcaguuucuccauggcaccaggccuggaccucacuggcguggaguggcggcugcagcauaaaggcagcggccagcugguguacagcuggaagacagggcaggggcaggccaagcgcaagggcgcuacacuggagccugaggagcuacucagggcuggaaacgccucucucaccuuacccaaccucacucuaaaggaugaggggaacuacaucugccagaucuccaccucucuguaucaagcucaacagaucaugccacuuaacauccuggguaaggacaggccuuggguuuucugggauaagggagagggagaugccuaugggaauguuucccagacuagaauccaaccccagagaaaauuuccucagagaaggaaugcauucccacaacccaaacaccaucuucauucuggaggugugggugaucagauaaggcgucucacugaaugccaagauaauacccccaggaaauaacuacaucagaauaaaaacccugggcuagcugucuguaauuucaguccccuggaccauuuccuugagagggacccugcagguguccaggcaaggaagucaaucacagggagaaagaaaccuugguucagauuaacuucuucaaccuggauccgacuugggaagucugauacaaggcgauuuauccccaacaaacuuaaacgcaguauaacugggggaaaaguuaugcugguauaauacagucccuuguaauuacaucaaaacuggacuuagaguccaugucauuucuuucaagaaaauggguucuaaagauaggaagccuguauuagcuuuagggcuuuagggaaggcucugagauguucucagucauacagauaguguagaggucauuugggcuaucagccaccucugguccugguuuugggagcuugggggagcccccugguuauacagauaauauaagggucauuuagaucaccagccaccucugguccugguuggaggagcuugguauggccuggaccaacagauaacacagauccaggcuauuaaucacuuccaauuuucagcuuuguggauggaagaacagguuuuuggggguuuuuguuucuuugauugauuuuagaacagguuuuuuaaaaacaucuuucccacuguaaagacaguccugcgugcuucauuccuaguugcucuggagaccugcggccacaagggccuucaucuuauguuccuagcacuuccuaauggcggcaacagccaauuaaggacaggcagaaagcaguucucaacucaaugagcaaucacuggcuugcagaggugauaaaagagaaaaccaaacgguaggguauguggcucagugguauagcacuugcuaguacuuauaaggcccuagguugaauucccagccuuuuaagaucuguguccaggaagagcccucaccccaacaucuugaaacacugaggaguuuccgucucuauaacauaccuucacgcuuaaagaggcugcaggcuccucugagggcucuggucggauaccucuaaaaucuuacuccuuguucuuucuccagcuccccccaaaauacaacugcacuuggcaaacaaggauccucugccuucccucgucugcagcauugccggcuacuauccucuggaugugggagugacguggauucgagaggagcuggguggaauuccagcccaagucucuggugccuccuucuccagccucaggcagagcacgaugggaaccuacagcauuucuuccacggugauggcugacccaggccccacaggugccacuuacaccugccaagucgcccacgucucccuggaggagccccuuacaaccagcaugaggguuuugccaaauccagguacuggggguguccucucuccuccccugucuguauucaggcugggacuccccugcuuacaggucaucuuuggcugugugcuauucucaugcguuuccucaguuccaccuucugcacacucuuuaucuuaucuuuaucuuucccagaguggcauccucuaccacuaugaauccccagccuccaaauaaugagaugaguaagcuugggcuggguaucagagguaaaggagugcugcuccuucccauaggagcuagagagacaaauugaggcagacagggaaaaagacccaaaacagaccuuugagcccagcccaaguucagcaggaagcccuuaagacuggaagcacaguccauaugaaaaccaaacgacacaagagucuacagaaaaccuaggggccugagggugugugcaaaaaagggcacgaggcaaugauacuuaagacgauuacaucugcacacccauaugaccaagcauuggaaagucagcuucuacacuaacuuuaauauuuuauguguuugcgugguuugccugcuguagugcaccaugggcaagcaaugcccauggagaccugaagagggcaucagauccccuagcacuggagguacagaugcuugucagccacuauguggcugcuaagacuggaacccagguccuuugcaagagcaacaagaacucuugacuucuuagccaacucuccacccccaauauacucaagagcuucugagggugaucucacauauuacaccucccauuuauuuuuggaaaccggucuuccugagcaggcuggccucaaacuccucugccaagcagcccuccuacucagccucccaaauagcugggacuacagacaccaucgccauguccagaauucaucuuacagaugaguaagcuggcauuugcagacacugagcaguuugccccagguucucuaccaauauacaauaaaggagacacuauaaccaaaaggcaagcugcaagcccuuacguguuuacacccuauaucuacacacacuucaucccaaaggccacagaaugcugcaguuucaggcaggaaaggaugugcaccucacaaugaaauauccaagagcuccagaccuauuugguugcucgcuagacuaugagcuuccccaaagcuugccuuuuguuuuggcucacaucauuccccagcuauuugcugguagucacugagauagccucauucucuucuguaaaacauuuucaaauguccugagauagaauagggucuaguggggugugccuauaaacacagcacuagaaggcuguggcaggacuccuaaguucaaagccagcuuggacaucaugaggcccugucucagaauaacaaagccccgauggaguaagaggcagaacagcaacacacaaacuugagagucuugaacaagugcagugcugcugcgugggcaggcucccguccuuccgugaggauucacagcacccaggccagagcuccccuccuaaggggagggguacuggagggugagggcucagcauguggucuuguguucauucucacccacagagcagagaggaaccuugggagucaucuuugccagcaucaucuuccuuucugcgcuguuguuguuucugggacuucacagacagcaaggugaguuuguagaucaaccuacucucagguaucugcccacccaaaccagggaugaaguccagugugcugaguuccagauguuucuaccauacccccaacaucugcuuuuggaauuaucccuauugaaaacaaucuuguuccguuuuucucucagcuucuucaucaagguccaccaggccuaugaggcauucuggguagccgccugccugccuccgaauacaaaguaaaguacuccacauccuggcuacuuaaaggaccccgugugagguguggggcugagcugggccugaaggugccagcacauugggagugcaguacuggcccuggacuguacaagucucugcuuucugugcuauugagaagagagcccugggcugaugaaaagggacaggacaagaggauggcagaauuaucaaaguggaagcuaacaccaucuaugugagguauuaagaaaucgggggugggggcuggugagauggcucaguggguaagagcacccgacugcucuuccgaagaucuggaguucaaaucccagcaaccacaugguggcucacaaccaucuguaacgagaucugacucccucuucuggagugucugaagacagcuacaguguacuuacauauaauaaauaaauaaaucuaauaaaaaagaaaaaaaaagaaaucggggguggggggacacacaggggaggguuaccuaaaaagggcuuuccuucucaaaggagaaagggaaggaggaaugggggugggucuucaugcagagguacuagaaggagagagggaacugauauuggaauguaaaaugaguaaaugaaaaaaaagucagauguaaaaaaauucucuuagaaaaaggaucaaagugagggaagcgggagaggcugugaccacucaugaaugccaacacugucaaaauaaaaacaugcugugacuacagcgcacuuucuucucucucucccuguugguuccaaaacauuccuagcugcuccaacucccaacucguuguuucaagguacgaagcagaggcccugggcuacaucugcaccguuacaucaucagauauuaggguucugacccuucagacagcugccaggaguuuugggagaguuauacaacacucccucagcugcacgagagcuuccuugugcucacugcuaugaaauaccuuauggauacagugcauccgagccuauaaagaccaugaauuaugaugucuguuaucaaaaguaaaguggggggcuagagagauagcaacccguggauaggagcgcugguagauuuucuacacaaccuggauuugguucccagaaccacaugguagcucacaaccaucuguaacuaauuccaggagucuaacgcccucuucugucuuccuaaagcaccagacaugcauguaguacu

SEQ ID NO: 3395 - RNA, 4408 nt, Mus musculus
auagaaguagacaaaugaauuuauuuauaguuuuagcucaacugagagaaagucucagccucagcuuucccacagcacugucacaacuuacagagaagacagaaccaaggccaggaagucugugugucuguagauagugucucucacggcagucaguccuucugguaccagggcaccugccgguggcucauuccauuuuuuuaaaaaaaauuauuauuuuuaaucguguguguguguguguguguguguguguguguguguguguccguccuguguuuguagaugccagaggaggucaaaggugucagacccucugaaaguagaguuacagcugguuucgauccauuugacagugcugggaaucaaacucugguccucuggaggaacacuucgugcuccucacugccaagcccccucuggagcccuuggugagccauuuccaccccuggcauguaguuuugucagcuggacgguuucacuuagaguaagugugcuuuauagcuagagccugagucuccccagcuugcugggccacacacugggauccugcucuugucccuguuggucucagaagggcaguuuguugaguauucacaggaaaggguucugaugaccaugacaggggagcaggccaccauugaggucucuguggauggccccucgucagaaagggccccaccagcacccggucaaggguagaaagcaggcucggguuuccgguaguccuccuggauagggauagcacugcccuccucuucccuggggcagcuguaaggacaaggcucuucaggcacugccugccggucuucaucugugcaaacacaaucggucagcaguggagagaagaaaggugaaggggagaaaagaggagaaaagcccaaguggagggcugagagcuggggggcuuggggagucugggggaaggacacuugaggagccagaguagguggguggaguaggugugggggcuuuagguguggguagcacagcugagagacaggagggaaggccugugucuuacuuggcccgugguuucuucuuugauggaagaacaagauugcacccaggacgaagauaagaaacaugcuggagaaggucacaaagauccggaugcaguccgagcugcacaggggucuaugggcugugacgggcaagagcacaccgaggcuuuggaggggcaucucacccuggacccuuagcccugucugucuguccuuuuccugaguaacccugccccuguuggaccaguccuuucucuccuaaucucuaacuagagucugcuucccccuccuuugccuccagcucugucugucucugugucuuucucggagucuaguuuagucccuugagacaggauuccucccugaccuggaagcuugcugguuugagcucugcuggcucugccucugccucugaaugugagggcuacagauacgagcuuccauacucugcuugguuuucccuguggcccuggguauuaugucacccuuguauagcaaguuauccaccgaacuuucuccccaacucuguaccccucucccucacccagcaccuagggguuucccauggcuguucuuuuggccucuuuccucugugcuuucucuguggaguggggauuaggaagacaacucacaugaccgcuggcuauagacagucgaguugggaagcugccuguguaggggccaggauggcuucucuggaagaaacagacagagcgagucacaagcaggaaaccucccaggaugucccaggcuuuccugugauuuugcaggagucagacaggaggaagacaugcuggcccagaaccuagcuagggguaaacacagacugggcagugcuggguaggcagccuucugccuugucccgacuggguaaggagcagccugcugcauaccugugccaugagguaagugggugggugguggcugugggcucggggucucagauggcugucuggucagugcaggguuuagaggagggucacacucuguacauuccuggucccugcacugccaguucuuggaacagcugcacucagcauuggcagugacugugcaguugcggauaagaaaaccuugggagagaggagagccaggagaaacaggacaccacagaucuuuagagaccuggggugucuacuugccccugacucuccugagacccccgagacucacucacaggguaugaauuucuuccacuccccgcgccuuaccuauuuccccucugccccucccucacccccaccugccccuccccugcugucaccugccccuccccugcugucaccugccccucucugccugcuaccuuucccaggcucagacacagaaacugaaaguagaaaaagauuauaugauuuucuuuccuacucacuacuacuuuaaagcuuuuaauuauuggcaaucauauacuacccaccucucaagacagguuuucucuggguaacaacaguccuggcugucccugaacucacucuguagaccagguuggccuugaacucagaaaccuguuugccucugccuccugaauguggggauuaaaguugugcaccaccacaccugcccuuacuuauaugaaacuuuuaacacuuggaaaauaauucaaguuugguuuaggcacaguguaauauuucuguaggacuuaucugaaagucccacaaaagaagacuuuucuuguuagguguuugucucagacuaaccauuuggaugguucuguuacuagaacuuaccagccaauugccuccacauuccagaacauauucucuauuaauguuauuaaaaucaguuauguauguguguguguguauauauauauauauauauguguguguguguguauauauguguguguauguauguguauauauauaugggguuuuuuugcaacagcaauuaaagaguuuuuuuuuuuccccuacacacaaagugccugcucacuguuaaaggggccucuuuaaauuaugcuauucuaguguacgguaacacaggccucccaaaucccuggcauagguggggaggcaacaggggaguuugaaaagagacugcagauauccuaccucuuccuuugcaaaaaguagaaauguauaaauuaagagaaaugauagaucuacuugcuuuccucccaaaaggcuuuuguacaaaaagguugcuaugcccugguuucugguguuauuccccaacuccaaauaagagcugaccuacacauguacacugugggaacauagacugcucauuggcuggacguugcuuuucuggaaacuggguuucuggaacuaccuugccccuccccugcacucugaguuauauauuuuucauuuuucguguguacucauggacacauaggacgaucugaggacaacuugccaguugauucuuuccuucuaccauguggcccagagaguaaacucaggcguggugguggcaaaaguacuguugccacuuacugugccaucuccuuggcuuuuuuuuuuuuuuuuuuuuuuuuuugugagacagggucuugcuauguuguucauccuggccuugaacuccuaucauccagugauccuccugccucagccugccuuguaguugggauuauggacgugcgugacugcacgggcccucauucuucuguugucugaguccuauccauggagcccuuuuuagccaucccucgaauucugcauaucucccaugaaacacuagaccucuccccacaugccucgcccaaggcacaccggguuucagcaugggcuccacuuuccaugggccuugaagcagcugaagcucucugacuccacagccagccccucuggccuugccccccggacucuuuucucagugcugccuuccgcaccacugccccucucaccagaguuacaaugccugcagcucucgcaguggggccgggugugguagucuggagagaaggaggugccugguauacagggaucacacugagcagcuguucugucuuguucacaguccuucacaaagaauguaccugagagcagaggggccagguggaaguccaggcaaggcgcuggcucuaggcucugcaggcugccugacuuugcuugagcucagccuuauucugaguaccuccgucaucuuaaauaucagucuccccccaacccugcugaggcccacucuuaccuggcucacacauccggcagcagaguccucccccaguccaguaguguuugucuggacagcuguuuggggcuaggguagcugagaguccuaccaagguccccagcaugcagagccaguagggagguggccaugccauagcuccugcccagggagaucuuuucugagccccaacugcuuguaccgagucacugguggcuccuaugugcucugggcagcagccacugcgacuccacuugggugguaaaccgaccuuugaaggcaguuguggcugu

SEQ ID NO: 3396 - RNA, 1071 nt, Mus musculus
ugugugugugugugugugugugugugaaauagaguucaugauacaauaaagcuguaaauuauguuuuaagauuuuugagugaagaaaaaaauuaaaauuuauagauaagacucaauaucuuuauuccuccuuuuuuuucucucucucuuuuuauuuuuccuuucuuugaguuagguaggcucuucuguagcccaggcuggccuugaacucacgauauagucagugccagucaguaccuggagcuccugaucauucuaccugcagcuccuuuaugcugggauuaugggugugugccgccaugccugcugcucguucccuugguuggucuucucugucuccuuccucaguuuugguucucggucugcuucuguagaugcaagcaagcccugacucgggaguacucguccaguguucucuagacacauacauacagaugcauguuuuuagagucuaguguaugcagccaggcaugcagaugugugcuagagugugugcucaggagguagaggcaagaggauaaaucguucaaagucauaauugucuauaaaauaaguucaaagucggccuggcucacaugguaaccugucugccaaaaaaaaaaaaauuauuuuagggauauucuuggcuaaaaauaagggauuggacucagguugucaggcguggcaggagcgccuuuucagcagagccguuccaacagccuguguuuugguucuuugaggcagggucucguguagcccaggcuggcuacaacuugcuguguaacuaagacugaccuugaacucuuguucuucuggccucuaccuuccaaguguucugauuauaagggugugccauccuacagcaccgacuuucccuuccuuauuugaggcaugacagucaccucuguucucugaaggaaacaucaaauaaaguuguuauuacucucugaacacagccagaaauagaaccugaagaagaaauccucugugagucuuuccacuguuuaaaaauuucccucuggaaacaaaacagcuucugucugacagacacaggcucuuugucuucaaauaaacucuuuuuguuauugucuau

SEQ ID NO: 3397 - RNA, 1071 nt, Mus musculus
auagacaauaacaaaaagaguuuauuugaagacaaagagccugugucugucagacagaagcuguuuuguuuccagagggaaauuuuuaaacaguggaaagacucacagaggauuucuucuucagguucuauuucuggcuguguucagagaguaauaacaacuuuauuugauguuuccuucagagaacagaggugacugucaugccucaaauaaggaagggaaagucggugcuguaggauggcacacccuuauaaucagaacacuuggaagguagaggccagaagaacaagaguucaaggucagucuuaguuacacagcaaguuguagccagccugggcuacacgagacccugccucaaagaaccaaaacacaggcuguuggaacggcucugcugaaaaggcgcuccugccacgccugacaaccugaguccaaucccuuauuuuuagccaagaauaucccuaaaauaauuuuuuuuuuuuuggcagacagguuaccaugugagccaggccgacuuugaacuuauuuuauagacaauuaugacuuugaacgauuuauccucuugccucuaccuccugagcacacacucuagcacacaucugcaugccuggcugcauacacuagacucuaaaaacaugcaucuguauguaugugucuagagaacacuggacgaguacucccgagucagggcuugcuugcaucuacagaagcagaccgagaaccaaaacugaggaaggagacagagaagaccaaccaagggaacgagcagcaggcauggcggcacacacccauaaucccagcauaaaggagcugcagguagaaugaucaggagcuccagguacugacuggcacugacuauaucgugaguucaaggccagccugggcuacagaagagccuaccuaacucaaagaaaggaaaaauaaaaagagagagagaaaaaaaaggaggaauaaagauauugagucuuaucuauaaauuuuaauuuuuuucuucacucaaaaaucuuaaaacauaauuuacagcuuuauuguaucaugaacucuauuucacacacacacacacacacacacaca

SEQ ID NO: 3398 - RNA, 1623 nt, Mus musculus
agaaggauccggcguggauucagaacucuucagcuggggaacgguacugaugaagagaaagaagaaggaugaagacugaauaaacugcuguuagaaggacugguggucgugucguucuugcuggucgagaguggacgcgacaauugguggcccguauggggaaccgacucccccaccgaguucagaacuuucagcagucaguguuugccagcaggguaaguucacgguaagugaaacuugcgaccccaggaguuugggaaggaccucggauaaaauagaggcgaauauaaaguugccaggaagcaggcacaagguaaugauagguucacgguuuugggacaagauaagguuccugguuuugggacaaguuaaggaacuaugauaaccucaguguagugaucaauagauccucgcuguguaguuaugcuuuuuucucccauugacccuuuguggguaggucugauaguuuuggucuuguuuguucugauauauggacucuguuacuguuugaaacuguguguagaggcagucaagacaggucagaaaauccuuacaaaucaacaagagaguaugucggaagaggagaagggcuuaaaaagaaaaaagaaaaagaaagacacaguguuaucagguggacagaaaggacaaaauaaaagagccgaggcggaggaggaaggcgaauuagcuucugcucccccucccuaugccuccucggcagccgucuaugggcggaccuucuguccggaggucuggaaagagguuagauucuccuugcugggauguccuauuuucacugaccaagcagggcagagauaucaugagccucuagauuuuaagguaauuaagaauuuggcugaguccaugcagacauacggccugagugccuccuauacuguggcucaaguagaggccuugaauagacacugcaugacgcugucugggcaggcuuggugaaggcaugccuuucaccugggcaguauuuagauuggaaagccuuccuuauugaauuuacaaaugaacaggcaguggcuaacguugcugcaggaaauccagcaugggauagggauaugcugcuuggucaaggucgauuugcacaacaacaaacaggauauccacuauauguguuugagcaggugaaucagauugccauaagggcguggaaaucauugcccaacagaggggaagcuagugaaaacuugacucucauauugacuccccagauggauacacaggugauugagguuauggucucaucacacaagguauuguguccauccccacuggggaucgaccagaucugguguugacaugggcgagagggucuguguguuuccacaggaccagacggaaccucuuuggaugccggagagauuggugagacgcugcaagaaugaggcuccugauccaguugccccuguggaugugguggaugaucccacaagcacaaaggauggagccgagaugggagauccuuccgguguuccagaagcugauaccagcucgacaugacauucaaauuuucccaugccuuuuugaucccugaauuccccuuaaagagauagccccucuggcuaucuaucccuugcuucagggaagaugagcggggaugagagcccugggaug

SEQ ID NO: 3399 - RNA, 18170 nt, Mus musculus
auuuaucccucauuacccuggcgccuggcaggggucuggccgggaagggaggacacgcugguggccugcggguggcacaagguuccagccccuggccccgaccaggugacagauugcugguuaguucaggugcaaaagaaagggaaaggugcgcaccgagaagugagcacuccuggucugggguugguguacggagaguccggcucccuacccucucuguccgggugaccaggaccgcgacgcugcaaggcccgcagggagggggaggugccagcccacgucccgccccucugccuccaccuucaccucccuucccggccccgugcugccuggucccgcgggccgcucgguccuagucccaggcugggacaguggggcugccaucgccaaggaagcugacaacgacccagauuuccacaguauccagcggacgucaaggacagcggaagcucggacaccugcgcucacaggugagcacuugggagggcgagugccgggcggccagggaaccggggaucugggacagggucgcggggccucagaaggaggagggaaggaggcuggguacgagggagggagaaaagcugggccugggaaaagauagaaaagguggacguggggagagauaguaagggggagggagaaggaggggcgggggacugccuucgggggcuggacuguuguugucccggggcgggagacacaaugaacaaucuccucugcgaguaagucagaguaagcuaggagagagaaaugggagguuucuagagcccaguuggugggaaaccaaccccuguauaggguucuugaguccaguucccauuaagggccucuucccuucaggcccugcccacugcaagggaugggucuuccauccaggcuuagaaaggagggguggaguccugcaucugacuuccagcucuaucccugguggugcccucggcggccaggaaaggagcuuagugggagaccagcgggcugccucaacuaggggcaucccuccagacccugucugacagcucuccugacuucgccagauuguacguggacgugugggguuuccagguaaggcauguacagacuucucaguaaagggacagaaaagcuauauuguagagucucuugucuauugagucucaguugcgacuaacugaaaagcagccaaggauggccagccgaccaguaaggguggcuggcuggcugaaccgugauaaaacuagcuguaacucauggagugugaacuggguguauuguucucuuuccccaaauauuauuuuuccuuuuuugcccccccccauuauuuaaaaauguaaacguugcaaagcaugauagaauacaucugugaucauagcacucuagaaacugaggcagggggaugcagaguuggaagguagccuagacuggguuacacugugugucagccugggcuauauuaagagguccuccuaucucaaaucagaaaauaaaauaaaagccguucuuaacccauagucuguuccaacaugagaaacccacuugucugucucuagucagcuuuaccugucccaguucaugguguuugugcaguguugacaaagguaauacaggaaaggagacaucuagguacaagagaccgccuucuaccuggggcuaucuagagugcuagagauuucugugacccuugcucccagcugcucuugagacuacagcauccucugaggcugaagugugaauguauccuaaguauaaagcagauguuccuacccagcaugcaccuggcccugcccucccccuacuagcuuauagauagcacacaccccccaccaucuggcccucuucuuccccacucuguccucuugucuuuccuugcucuccaaccuguggagacguucguucaucacuaauccagccugggcuuucuaucuugcagaaaaggggauaccccccuuucuccuggacauuggugcuaugauccucuggggguaacucaggagagaaacaaugcaagccuuugguccuccaaaugagggcccccuccaaggccugguagcuucccgaauugagacuuacgggggccgucaucagaccucugcccacagcacugcugggaaucuauuucccagaggagguccuggaguggugagugcgccugugccccaaaggugaccuggguggggcaggagggaugacaccaagguuuugaagucuguccccuuuuucacaggcugcucuauucuugucccuuaaccuccuccgcuuuccgggguuacugggaaggagggucagugcccggccaggaugccagcgcuucacacccagccucagacaacagugggggaggcggggagcucagaggagggauugggaggcauuucugaauucccagcgcaguggggaaaggcaucugucagucucuacuugaguugggaggagucaaaagcucccugagucagggcugaagaagagcaaagguucagggugccccugcucucacaggggaggagggggaguggccggaacugucucugccccgccccuggcuccaccuacccggcccacuuccaaagcuaguagaggaaagggguguggaggccaggacuuaggcuguuucugcccucggugcuuccuuaagaacagugccccuucuagcuggggguauucccugccuccuuagaggauuccaccccuggagacgagacuugcccaggcagagggcagaaagggacacuaggaaguauguaaggcaacucaggccaaggcagacaaggaaugugaccaggccugccuugggaggagacuuguggcuucaaccucuagcacagaagaacagcaauucccagugccauaggacacaagcugcaggcccuagggaggaggcugaaccuuugcggucuuucauuuccacaugugagggaacccagcugcccgcaaagggaugagcucagaacacagcguggaccauccucuguuccugagagcccuuggcccagagggcacguguauagccgggcagaggcuggguacccgacgcagagcccaggcaugugugugccuguguacaagcgcugcaggagaccucagccucuaccuccaggcucccuugggaaccaggcaggcaugucccugcccagcagaacuuggcuucccuggcagcagccacugugacucaaagcagcagcgacucacaccaaacugguuugaugagagcagcgagccagcccaacuugcaggagccaagcucggccccuaccaccucucuaguauuucugguacccccagaacuugucuugucuucuccucuaggacccuagucgccgacgccuucagcacuauguccccuuugccaagggcucuggccagacccgaggcaugucuccucuggugcuucgggaaccagacccagagaagaggcauggaagcuauuuuggggucggcccaccucacucccccaaacucaagguaaggauucccuugccuucugccccagugcucacaaucccagucaugauggccucuagagacagucaagcccagaaauuccgugaacugaacgcuggcagggagccucugacagcaggcagaugagaagucaaucagagacagcucucugcagaggcgcucucaggaacagcucugcgcugaugcgcugggucccaugggaguaaaccauuaauauuaaauucccugcauugugggcuggggagauggcucagcaguuaagauuaugggcuacucuuccagaggaccugaauucaauuccuaguacugacaugagagcucacaacaguaacuccaguuccaggggaccugauacccucauacagacauacaugcaggcaaaacaucagugcacauaaaauaaaaauaaccucacagcuuuuggaaauuaccaaauaacaugagauccagggacagucucuucaucccuacucucccaaaguauccuucauccuagccaggagccccgccacuuccucccaugucacaagaagggcagagugagcaaaggaauuguuugucccccauuauuugacaccaaaaccucuuacgaugaacaauuuuaaggcaugcugcuucagaaauaucucuacuuugagccaagcacgaugauugcacauuuauagucucagcacacaggaggcugaggcaggagggcugcaaguucaagguuagccugagcuguauuacaaauccccaucuaaaaaacaacccagaauguaauguguccauuuuaugucacuguguuaccugagaccaugcccuuuuguuuuauuuuguccuuguuuugguuuugguuuuucaagacaggguuacucuguguagcccuggcuguccuggaacucacucuguagaccaggcuggccucaaacucauagugauccacuugucccuuccuccaagagccugggaucaaaggcgugcgccaccaccacccugaaagaccaugcuuucuuaagucuaguccugguucuuacuugaaggccucucagucugggguguaugucucagugguggagggcuugcccagcgugcagaagguccuggguucgauuuacagugcagccaaaaacugagaaguuuuuuucccuuuccuuuccuuuccuuuccuuuccuuuuuuuuuccuuuucuuuucuuuuuucuuaaguaaagaaaaucaauucuuaaggaccacucugagaagucugauucugccccucaccccuauucugaauugggaaacuucuagaaggaauugcucuagucgggaagguccccucaaaccccucuacccugggaucuuuucuuucugcagacaaaacuguaacuucauuuccugggcaauaacaaaccuacucauugcccuaucaggcccguguauguauacaugugugcgcacacagccaguccagagccugggcaccagaugcugaggacaugucaggcuaacuaaccaucgucccugcucuccuaggaagucaccagggcccaugagcuagaaauaaggcugcacacauucagcauguuugggaugccccgccugccaccagaggaccggagacacugggagauaggagagggaggcgauagugcccugaccauggaaaaguccuggaaggagcuggugcuggaacacaagguggguuugaaacgguauaugucccuauaaugcaucagacccuccuacacacacacacacacacacacacacacacacacacacacacacgcauccaugugucuuacuucuguccugaaaaaggcaaagaccgugggauauagcacguagaagggaaaaccuccagagaucuguucaaaucccagcucugccaccaaauagugaaacccugguugugacagaggacguccagagccucacucgcuucauauggaaagugggggacuggcuaagaugaaaaggcccugggucaagggaccagaacugguggugcugauccagcucuugacaaaagauaccugcucucauaagcgguccccaagugaaccagcacugucccccucaggagaugaaccgccagcuuugccaccagcaggaagcacugugggaacuccugaccacugagcugaucuaccugagaaagcucaagaucaugacugaugugagccaccuucaaccccgucuccucccuaccuggguccuuagcacuaucuccauccucccagagcagaagggcuggggugagggcuaggaggaaggaauccaggccaugguuucagaugugcucagauggagaggacacugaagauggcagugcugggaggacccccugagggaggauggucaggagcugagccccugucuuccuccugccucuagcuccuggcagcuggucugcugaauuugcagcggguggggcugcugacugaggugaguggaagcagaggaggaggcagggccacggcgagacccccaggucguacagucugaauucccacagcccugcuuucugggaugccccugguuuuccuauauuucccauuugcauuagacccucagcaaaccacaggccccuggcuccccuggugccacaggguugggguugggggauagagggacucccuaggaucuuccaggccacugucagguucugccccuccuccccagcccugucccuuccugucugugacaaaugucuguuacugaguucugcucacuccuccaggugucggcugagacccuguuuggaaauguccccaaccugauuagagcccaccggagauuuugggaggaggugcugcagcccauccuggaagacacucgcaccucuggccaaccuuuggauccugucagcuuacaaaauggcuuccugacagugagucuggggagacccagaaagagcaggauaaggacagcccaaaagaacccacagggcacggcccagcccaacucuaaagcauaaccacaucuccuucccuccaucccacaagugugaccugucccaaaggcuuuuuggucuucuagggacgcuuaugaaaugcaaauauaucuaggaggugggggaggggugcucucaucagugcuacaguuuguauucacuauuggauuuggggggaagggggacugguuugguuugguuugguuuuuggcuauccgggaacucacucuguagaccaaguuggccucaaauucacagagauccgccagccucugccugccuccugagugcugagauuaaaggcaggcaccaucuccacuguguuuuguuuuguuucguuuuguuuugaagacaauguugcccaggcuagccucaaauucaagcucuuccugccuuagcucuucaagugcucuaauaacaaaugugcaucacuuggcagcuauaaaauauuaacuguaucauugagacccagcagcaaacagaucagggcaagaccucagucuaaagggcagggagguggcucaguaguuaagaaugcuugcuccacuugcagagcaccuggaucugucucccagcaccuacaugguggcucacaaccaucuguaacugguucaaggggaccuggccugaccucuaagagaaccaggaaggcacaugguacacagacccacaugcagaugaaacacucauacacauaaaauaaaauaaauaaauuuaauaaaaugucucuuaaagaugcugcccaaguaaggagaucccagaggcauugaacgugagaaagagcuagccugggcuagucuuucuuccauagugccuccgggucagcaggaaacuuugaggugggguacaaagcuaguuugggcagguuucugggagccccggcaccuuuuuccuucaaggcugggcuucugggcaacuuucaggucauagaaacaggagccccggugucccgaaaacaagucaggcugaauuauugauggugagagagugaauccagaggagcaggcacagccacugccacagagagaaugaacuccagggguggccagggucugccucucgggguguugguuccucucuggagcacagaaugaggggucuggcugugggagaugucuugggagguggaagccggcagagguuucucagagggacuguaugaggcucucuccucagccugcagccauguucuaccugucagaguuuauucauggcccucuccugccugcuuuauauguguuccuccaguuuggccagcgguuccaaccuuacguccaguacugccuucgaguaaagcagaccauggcuuaugcgcgggagcagcaagacacgaacccacuguuccacaccuucgugcagguagggugcgguggagcacaggggcagcggggcagcgggcgcaguuggcacagccaggucccgcuaggcuucagcugcuugcaagguugcggcgguugcaggaggggcccuguagacuccugagcucuaccugguccccugcaguggugugagaaacacaagcgcuccggaagacagacgcugggugacuugcucaucaagccccaccagcgcaucaccaaauacccacugcugcugcaggcugugcgcaagagaagccccgagccccgagcccaagaggcccugaaugccaugguagguauucaggugggguugggcccuuguguggugggggcuggcgggugacggguaagaacugaucucuaguguuccccgaaggucucguucccccuacagugcugaucgacuagaccuauuuuagagugcuguggcuaccauuggguggggaagcugggcucagcuguaccuccuucugcuucucacaccccaagaucgaggcuguggaguccuuccugcgacacauaaauggccagguccgacagggugaagagcaggagaguuugauggcuguggcccagcgcauaggacccuaugaggugcuagagcccuccagcgaggagguggagaaggugaggaaccgcacuggaaaaaugccaagcuccagggaaaggagauggaggagaagccugguggggagaggacagagguaccugaguaccacagcuggguguguccauccuuccuuccugugagaggaacccaaagggcagaugggaagaguaaaaggggggcccugggcaugucugcuguggcuccagcuacagaaaugauggaccgaucacaacacaaggauccaccguggguugggauggagaggcucgccugcacgaugcccugauccccuuucugcuuguucucuguucccuuagaaccugcguccauucuccacccuggaucugaugacuccuguacuagggguugccccugaguauaccaggcagcugcugcuggaaggaccugugcgggugaaggagggacgagaagggaaggugagggugccacgcacagaggugacauguaagggcacggcgacauaagaggcgaacaagcuggaaauggggcugggaaggugacuuggugagggagaucacuugcucuuuaggcgugcagaccuggggguggaacgagagagggcucagcagguaaggucgcuggcuguucuugcagaggacucagguucaguucucagcacccacauggcagcucacaacugucuauaacuccagcucaagggucugacaucucuucuggcuuccccaggcacugccuacaugugcuacaaacaaggcaaaacauccauaggcauaaaaucaaacaagcagcucuuucaaagaaaaacaaaccaaguaguuuaccaaaccggagccaaacaucaaaccaaacaaaacgugagaaccugcguuugaauccucagcaccuucuggaggaacugggccuaggggcuggaaagaaaacuaacucagcagcuaagagugcuugcuggucaccucccauugucgggugacucaucacuuagcuccagaggaugauccaaaacucucuucuggacuccuuggacaccuucacuuacaugcauauaccccccccacacacacagagagagacacaugucacuaaauagaauaaaugcuuguuuguuuguuuuauguauaugaguacacuguagcuguccucagacacaccagaagaagccauuggaucccauuacagaugguugugagccaccauguguucgcugggaauuuaacucaggaccucuggaagagcagucagugcucuaaacugcugagccaucucuccagcccccaaaauaaauguauuuuuaaaaaacaaaacaaaacaaaaacugggcaugguugcuugcaucuguacuccaggauuguugggaagagacaaccagauccagagaguucucuggccaauccgccucauuucagagcaauaacgguaaaaaguaauagcgcaagccacccaggauccugcucucucccgcacaugcgcacacuggagcaaaacauccauacagccacauacauguaaccacacagauacuacacaaccacacaagguagcacugggagaaagugugcugagcuggucaggaggacaggguucugguccugcccgagcucugguuguuuauaugaccuucagccagcccuguucccugcuuguaaaucaagauauggaaccaaguuaacucucucucagcugaucacucugcaggucugaccuuguccuuaggcucacaggcaaagagccagaacccuggagaagccccuccccugacucuggcugacccugccucuuucuccugcaccccuaccuguagauggauguguaccuauuucucuucuccgaugugcuccugguaaccaaaccucaacgcaaggcggacagagccaaggucauccguccuccccucaugcuggagaaacucgugugccgaccacugcgagaccccaguaugucucuucuccagaggaggaaggguugggauuggggucagauaaggcccagcccuuaaagcagagcuucuucucugugcagacagcuuccuguugauccaccucacagaauuccagugugucuccagugcccucacugugcacugucccaguucuacagagcgugcacgguggcuggagaagacccagcaugcucagguagguggugggucaggcuuggaggcgggcgagcaugcaucccuggagcucaggacuggcaucacagaagggugaaggagggccgagaggcuggugcaggggcagaucugaccagcagcaggucggaugccuuccagagucugagaaagccuguggcagcuauugagacaauccaacacgccguacacccgaaugcuuuccccauaccgaaacagugaauuucuaaacuuuaucuucuguucagagacaccuacggagcacuuucuggggacaagcagagcuagugcuacgugccagggagucagaaaagaaugaaaauaccauuccugcccuccaggaaucugugcuucagcucauuagaguaaucaggguacaaauaacagaagcaagcaugccaaagacagcagcagggaacggccaugcugucugucccagcaggcugcuggaaaagcaguggugcuaagggagcuuaggggggagaaaccggugcaucagagcagacaacaaagcaggaagaagggaauuacagugcaaagacccagaaauaggaaacaguccugggugcugagagaggcaccccaucucucacuuuauaggaagggaccaggacuggaucaaggucauacaaaccuuuagagcucaguaggaaccauguucucuuucccucccacugccacugugugugugugugugugugguguaugcauaugauuguguguauguauuaugugugguguaugcauaugacuauguguguuguguguguauaugacguaugcauauaacugcauuguuauauauguguauguauuaugucgugguguaugcauaugacuguguggguguauuauguguaugguuuauguauaugacuguguguauacuauguguguauauauuaugcauauggccguguguguauuaugugugguguaugcacacgauuguguguguguguauuauguguguggguguacggacaugacugugugggugugugcacucaagugugcguguguguagaacugagcagguuguuugcuuggcauuguuagggugagaaguagaaggguggaugcagcagaagcugaguucaggaggugguaccacaggaucaugcccggcucuaagggccacgcaggaacuugaacuuugaccuguagacaacguggagccaguggaggcagacuuaagugauacaaguaggagcuuaaaagagagagagacaucaguaaagcuacaucuguuacuaucaguucagaggcuauagaaaaacagaggcugggcuaggguguagcucagugagcgcgcgugcuuagcuugcacgagacccuggagcugacugagccaugguuccacacaaacaaagcaaagcauccagaaacagggucccucacaaauuuggaggccacaaguucaaaaugcaggauugacagaacugagcuuccugcccagguucuaggggggcaucuguguuucagcuaccaauggcuucuguggcccuuaacuuggagcagcaacuccuggccccucccccgcaucucuggcuuuccccucuguaugcugguguccagauucuccucccuuucuuaugaagaugccagacgccugcuuuagaauccacauggaaugucugaggucuucaccuuagguccuuucacaucuucaaagacccgguucccaacuaaagucacauuuaugguuucuggggauuggguuucggacccggcuuucuccaggcaaacccacggugggagcagaguggcaaagagcuggagauuugccuuagacucuuugucuugcuuguuggcagagccgaggaucaaacccagcaucuuugcuacccugggaaagugcguaucccugcacuccaccccagccccaggaaggaaugugcacacuuauuuacuuguuuauuuauuugugggugggcgcguguaugugcaugggcaucaccacaccuguaaacuuugcuuuuccacaccaaccucucaagugucuccucuuccuuuggcucccagucuuagaacaagccuucugccacauucucacuuggaacuucugagaaccagucaaaccugcuuguguucauaugcaaaauaacagccccugauaggcucugcagcgugacaaauggggagucauuucuccucugugaucaaauuugcagugagguucccagccacucaaagccugaaacacugcaacacacacacacacacacacacacacacacacacacacacacacacgcaugcacaugcucacacagggugagaguuucucuuaguuuuucuucugcccagagcucagacuuuuucuucuuccccuugcagaaauguuagugaggcagcuuccuugagguggcuuaugcuuuaacaaaaaaugagcuugcggguggggguggggagacuuaguggcugggaggaggaaaaggaacugagaacccucagaggaagaggccaaaagaugaaauuggggccaauuaaacaaaagcaagacuugagagcagcccagagccuacgcugugcucuuggcaaguuacuagcccuucuaagccuggcccucaucuggggaaguacagugauagcccacaagccagugaguggcuuggccugaggcucugugcguccugggagcgcuacaagugugggucauugugacacaagggggugagcuaguugaacacuccuauaaucccagcacacagaaagcugaggcagaaggauugugaguucagggcuagccugggcuauacagcaaguucuggaucugagcugcauagaaagacccagucucagagaaacaaagaagagaaaggaggaggaagaaaggagaagagagaagaggaaagagaagaggagaaggaagaggaggaggagggggaggagggggaggagggggaggaagaggaagaggagcccucccucccucccacucuagcuuucuuuccauuacuccucaccuuggcucuccucaccuuggcucuccuccugcuguagcagagaagaucccccugcuguagcuuuugaggcagcuggaagcccugggcucagcugcucaacaucuccccccaccccaggguggguuucccaagcuccugccuuucuuggggagggacaagggcaagcuuagugaagccaauaccagcagagauucuuuaaagaaguccucugcucauccuuucccuccacacuaacccauccucagcagccaucacaaagucaaacuuggggcauggggggggggagagggcaaagggcguggcuucuccucacagcaggcugugcagcccaccacccuucugcuccuaccuuucucaacuucacacugagcagaaagaugaagcccagagaagagaaaagggaggagacacaggaacuggcccccuagugcuaguuuccugcucucaaccucggcucugguucagugacugggaagccagggaaaggagaguuggaacaacuguccacuugauaccauuuuccuaugccugcccaacccuccuccaacaugucugguucugacccagccgcccuugugcuccuaccaaagcuuuggagaagcccaggaagccccagggcugcugguucacacucucccagcuucugagaaaggacaaacauggagccaucagcuaaccuggcaucagucacaagagagcguuguauggggugagggaacacuugaggucucugcucuaugccagaugcagcaccuuagcugccacugugguggggacgccuaggaaggaggugaaagacuccaaccacagccacucuuucuuuuccuuuucucuucucuucucuucucuucucuucucuucucuucucuucucuucucuucucuucucuucucuucucuucucuucucuucuucccuucccuucccuuucccuuccuuccuuccuuucuuccuuccuuuccuuccuucuuucuuucuuuucuuccuuuccuuuuuucuuucuuucuaacagauugguugauuauguacacaguguucugcucacauguaugacuguccaccagaagagggcaccaagaucucauuauagauggucacgggccaccauguggcugcugggaauugaauuugggaccuuuugaagggcagccagagcucuuaaccucugagccaucucuccagccccuccuuuuucuuuuugagguaggaucucacuguauacauucugaugggccuggaacucucuauguagacugggcuggucucaaacucagagauccucuugacucaaguggcuaugccgugauccaaaugcugggaucagccuagccuucagccauuucuuuacccucugggaagcucuuuaguguuucuuagccauaccuaugaauauugcuguccauucugcccauagcagccacuucuguguuccuucaugccaagccuccucuugcuacccaccugcgucuucucaggcucugcugucucccccaacauuaaccuccugugauaacucaaagcccuucaaggcugccagaaagcuugcagucacugagcuaagacuuaaagaguauacacucacccggcucuccucuccuuggcaagcagcugcaucuaagccuagucuuugcaucuguaagaugagcucagguccgugcuugccaugcuggagggugacaaagcgcccguauguauggagguccuugcaugauaucugucagcugccacuuccuuauucuguuugaaaacucagaagggacacagacguguguucucuucucuuccaucuugggacagcuuucuuuucuuuucuuuucuuucuuucuuuuucuuuuccuuuuuuuuuuuuuuucugagacaggguuucucuguauugcccuggcuguccuggaacucacucuguagaccaggcuggccucgaacucagaaaucugccugccucugccucccgagugcugggauuaaaggugugcgccaccacugcccggcuuauuuauuuauuuauuuauuuauuuauuuauuuauuuauuauauguaaguacacugucgcugucuucagacacaccagaagagggcaucagaucccauuacagaugguugugagccaccaugugguugcugggaucugaacucaggaccucuggaagagcagagguuuuucguaaccacugagccaacucuccagccccagcuuuccuuucucaccuggcuaagggacaggagaguccucagccuagggcaagcgugcuccugcuccucccuccuucaaugaaggucaaggugaugagagagcaaugagcccaaaagaggaacccaaggaccuguaugguccagagcccuggcagcaccaucuucugggccagggagagauucuaagagaggagcaucagagggcuggcuucccagguggugugggauacagggccaagagagcagaggaaaggggacguucuguccgccccaauucccuccaccagcagcucugcagcuugcugccaccacuguaucucggcaucauugugcucccucccuguaagaaugacuccuguggugguccccagccuucauugcccuuucucaguaggaaaggaaguguaaaccccugugccucggaagggaguuaggagagccaaagguucuugaucuguaaaugagagcucauaaugaaagucccuccucagaccacucugcagaagcugaagggugagcaguacauucaacagaagagggagcugcuggcccucuaucgcaaccagggcacggagucccccagcaccaggcccuccacaccuucgccuuccccggaggacucccagagcagugccgaggggagguaagacuccaucaccaugcaaggaggggggcgcaguuggggaggagggagguggggaagagggggguaaggaggagggaggagacauuuauaaagcugagcagggugaguaggagccucggggacuugguaugagaacaagagcaugagcugcagcugggaguggaagagguugguaguuaccaugugaagggacccguggcauagggugggcaccgagcaaaggaaacagagacacagcaugugaacucccugugaugagcaggcuccagagugaagguagauagcagaguuuccagaauagcagaguucccagggcacagcaagcuccaaaccccgcaggguaaagagguucguccgggaugcaacagcugcuuagcaacaagcuuuuagagaagaaggacccaccaaugggcccacucagcaaauccgagacaagcugcgugagaugaggucugaaccaggugcugugcacagaguggcucagaagcaaaccugagcucuuguuuguuuucgaggcgaguaacucagacugaccuugaacacaucacaaggcauuccuccugagcaccccacccccagcugaccuccaggucuuuuucuguuucaaauaggacuuugcacacugacugggcuaaucucugugucauuccaguuucaguauaggugcuguauaaaaggaguacccacggucuuuuauagagcauaauccuaagcagugaaguggggaaagccaaucacuguccugcacugagacagggcaguaaguuuggaggagacauuucugaauggauuaauaggagaggcuucucagccuugaaucccauucucagcaugagucugacuuucuacuccucacuguaggacuuuagaguucgccaucaucccccgccugguggugacugaggauacagaugaagacacgcccuccaugccggaugacgccucagacucuggcuacgguaccuugauuccaagcuccccgaaggauucucauuccccccugaacaggcuucgguccaaggcucuucguagagacccucgccucaccuucuccacccuggaacucagagacguccccuugcgcccccagccucccgacccccaagcuccccagcggcgaagcgccccagaguugccagaagggauccuaagaggaggcagucuacccaggagagccccaccaaucuggucggaggaggaagacgagacuuuggcaucagggaauguggugguagaaacccuacacagggcgcaacgucggaguccgcucccccacucucccacucauacugacucugcuggggaaagccccugggaguccucagaugaagaugaggggcuucuauccccugaacuccgcccccgcucccuacgggaggacaugcucagggagaucagggaggagcuggccaaccaaaggaucgauggagccucggaaccggaaccagggaauggcaagccccggaggcugacucuagcccagcugcagagaaugagggucccccacaucauacagcuggacacgccccugucuacaucguaagugcagaaacuacuaugggacagaaggacaguauggaguggggggccguucuaagaggcaggcugugcagagcagggaacaaccaacgcaggggaggguacucugcuuuacccaucagcccacucguugcuugaccuugaccuaaugcauuugucuuccuuccuucacagagaaguauaaggaaugcugaggcccuuugauacaccuccuagagaaauugucucccuaagagugcuggccaccaccucccccggacucuaccucaaggauccaccucaaaccaagccugacccaggcaucaccucugaggacccuggaggucaagaacugaacauuuugucucacagacgaaccccugagcccuauauaaaagugcccagaaacaugg

SEQ ID NO: 3400 - RNA, 34529 nt, Mus musculus
cgcauagcagcuggccgagcgccguaaggaguggcacuuuuuaaaaguggagccucaggccagccccuagccgcagcgugucucagucgguugucgagucccuucugucccagucguucgugccucuugucccacgcaacuccagcuuguaccaugccggucaaaggagguagcaagugcaucaaauaccugcucuucggauuuaacuucaucuucugggugagugagaggcgacugucggcgcgcuccucuccgaggccaccuguucucaggcccgagacggcguccggggcggagagugucccggcggccgagagcgccgggagccgcugguacugcgcgcgccaggcggacuccgggcgaguagagaaaggcgcagcggcugccagcuggccaggcgggacuggcaggugggcgggaggagcaagugggugggagagccgaggguccugguggcuccggcugugcacuucgcucccggguccuucuaccgccgaguauuugagaugggcucugugccugcucccacccggagcacccccgagugugagagaggagugagggaggagcggagcaaccuuuucgaguaacucgaugcccuccccggcccgcaaggcuccuugccagcagggcagucgagcgucucccacuucgguggucccacaagugacaaggggugcuacggagggagaggaaguggguguggggagucuucccugcaccuggaggucggacauuccuuguuuaggaccugaacucucaacugaaaacguccaugccucucucuaagcuaccugaaagacuagauugucuugauucuuuuucaagagcgauaacuaucuuggcuguagagaacucugggagaguuaagagaaaagaaggcggggaaggugccuauuggcgccucuagaugggauaaauccgguguuucugcauuucccagguaaucagguacugcgggcuugaagccucgcucuaaaaauguccagguggggccaaggggaauggccguucaccugcagaggguccagaggcaggugcuaguagacucuacagaugggccucuggguagggcaacaagagaguguccacucucccaaaacucagggacagaagcaaggaaauacacggaagacccuuuuguccugauucugagagggcacacucccaaacacaaauggacggaauuugcucccaggcaaucaggaaagagcuuaacuaggcaacuccugugccaccagagacuuugaacaacaacaacuaaaaaguccacuauucccuuuggagcuggccaccgggaugcucaccaucuuccagcaacuguaagguuuaauacucuccaggguugcuuggaaguguugcacaaccugcagagacugcccuggguuucuaggagccaccacacccauacaacuuaagaggaugucagaggacauucccugcuuguguuuccccaguucugcagacaggcagccagcucccaggcuuggcuugguccacucaucagcuugagcgcuuuguuacaaaacaaagucugaaggcagcuggccccacccaaccccgcccuguccuuuggggaguuuuccucccucuaccuuuuagucucuucccugcuagucugucggucaguccccagacgccugcauagauggugugaaaguuuggugcuaaggggaaaccacauaguugccuacaucucccaucugccccccauggcauauguauguaaggggcugagaggaggugcccauggccacccuaugucuucucauucuguugccugcuggccuacagucugcccaucuugucuccugcugccacuuccgcuccuauccagaacccugacaaguugcugcuggcugacucugccuccugaagcaggacagucucacucuagaaggguuugacuuugggguugggaacugcauuggagauuaugcaccagcuggaggugcuagcucucguguccaccgugaggaaccagggugcccaagaucgcaagccgaguuaguacuguaaccucugggccccuuguuugcucucuuuacucuccugucucuuaccauuagggaggugggcgguuuacuauguuaauuauuguuaccugcccuacccugggcucuaauagggacaguccuguuacaaucucugugcuaaguauuuuacagucuccaaaggccuccccaagcuccaugauauaaccagagaaagaaacauuauucccauuuugaccagaaaucuugcccaugauagguuaagugcuaaaggcagggucaagugauaggguauuaucaagugagguaguuaguauugggcaggagcaaaggaaggcugagaggaaacuccucaaaauaucuuuuacuacaggcggugaucucucucgggggaacccuugggaucauuaugaugucaccucuucaaucucuugagaccagugauuuaugaacuugacauuuggugccuggugugggcuuuggaaagcagaggccaccuuugucuguagaggauacugagcggcuggauggcaggaauccaaagagaagccagccucucguagucgcccugggacaguggaagagagggaggaccggcaaaggggaaucugucuuucuccuaggcccgagcauguccccugugggacaugcucugugacagcugagccugcccagccugccuuucugaaguugggugucuccugcccacaaccaagccagcaaucggucuguuuuccgacaaccucagagccagaccucacaagccuauuuuggugguucccaaauuucucucagaucuccaugucuaucccuccacucccuccaaaagagaaagaaaagaauugagaaagaaaacaucuuccuaaugucugaauggcaggugauuagaaguguuucaggcuauaaugugguggccagccuugagccgggccuggaaugugccucucccauucguuguuuguuuguuuguuuguugaaggcuuuguuauacagccaacuggccuugauccuguugccucugucuggccuuuccccaucccgcacacccauucccccagaucccacauagcgaagucuuuuaugguuuuuagccucggcaaaggaaagcccagauugagagagccagccagauccugcuuccaugcacucugacccucuguuucugcuccuuccccauccggaaggauggaaguaacagagggaucuccuccaccuccagagaugacaucaccuucacggaagcagcuuggaaauguaggcagagagcugacccaggcuucagagccuggcggagggcggauuacuugggaaccacaggcagcucacuuuccugauccgcaccgaaguuuccucaucacaaaacccaugacuugacgcaaaaggucucaaagguccauucaagaucagccuauagaacgagccccggccaccacacaccauugccccaccucuccucugguuaauaagacuucccggcaagccacguaacagagguguaggagucuggaaaucacgguggauagugagacuuguucccuggcuuuuaccugcgaguauaaaccuguuucuuggaucuucccuguuccuuuuaccuucccucacucuuggcgggggggggggggggggucuccuuuucuucugguucuuugguaagugcuccauugccuuggccuuuuuuuuuuuuaauauuuauuuauuauauguaaguacacuguagcugucuucagacacuccagaagagggcgucagaucuccuuaaggaugguugugagccaccaugugguugcugggauuugaacucaggaccuuuggaagagcaguugguggugcucuuaaccacugagccaucucuccagccccgccuuggccuuuuauggucauagauuguaauggucaguguacagcccuggauucagcaucuucagccccugggcagguuagcugcaucucccuguagcucuauugcuucacuaguagaaagugauuugaggucuuuggagagggugggagcaauucccagguaaguauggaugcuuaaaccacagauuaggccacacuccuccuacucaguguggccggacuauguggcugugugugccguguagccuuacggcuuuuccacaucucccugccauacgagccgacguaggagagcuggccucacucuucaaagcagaaccacugccuccauuuuguacacaucugacucagggaggaagguacaccuacuccugagaaaugaagcugaagagacucuagaguguuccaaggcauccggguucgagucggggcagguuguggagggguagguggcuggaacaggagccccuccccacccagauugcuccuugcagaaguuguuugacuuggauguuggguugaacuguggcauaaaauggcuucccacagagccgccugugcuggagcgacacugcccugcuuguacuggagcuggcuggcagguuggggagagggugagccgaggccaagugucugcccagcuauggaaaauaggaacuggccccugccuagagcuuugguuucucccccacccccagccauaguuaccaguaaccaagaucuggaaucccaaucucugggugguggugagaacuggguucaugugagcacacucacacucucuuacacaccacacacacacacucuucacagacacugccccuguuuucagauugccgguggcaacauuccagaccuugcuauugcucccaagacgccuuugcugcccgcugcugguugcugguuacugguuacuucccaaauuuggacaggcuuugauaagcagccguagaggaguggaucugggguggccggucagugcucucuuuccuaagugagccuuuccuggcuccugccugcccuucuuugggugguguuuugggcaugaaccuuucaucuuaacacauaggccuguguguucuggggugguuccgccuaguuuuggguucaguucaguuuuuauaaggagcuguggccucugaaaugggucacacaguuugggaccuaaaaauaccuuggguuuacaagaaacauguuuucuuugguagcacgcacagagguagauggauuugccuggguguuuucuuauuucuggcuugggacagacaggaguggaggcuccgaucucaggguucugguggcuuugcagugcuggugccgucuuguguguucuggguaaacccuuguggcauugagaaaagagaucacacugugauuucugaguuccucccuguucugguugggugagagggacuuuaauaggaccugucaacuuuuuuauucuuuugguuuuuggagcuggggauugaagccaaauccuugugcauggaaggcaagcauucugcccuugagcuguacccccaucccacccccugccccagcccucaaaggguuggguuuugcuuuccagucaaagucuugcagaaauggguuuuacuucuuaaauacagaagagggggagggggggaaaccuccucauuucagaggcuguaaaucucccugacaccgaacugucaggugaaguauauuucaacuaaagaaguuuugguuuuuaaguuagccuuaguaacuuuuuguauguuguguuuucgaagucugacugcaugacacccggcugcuccauucuguaaaagagucaggcugguccagggacauuuuuauuuuccaccaagugguggcaugcagcuguggaaagcaauauccuguccccagaugagacaauuuuauaaaaauuauauccauccggguaauuuucuaccccauccacccaagaaaauacuuaguuauagauucauguggggaggggugcuugucuguugggguuuuuuguuguuguuauuguuuuggguuuuguggaguuuuuucuauuauuauuauuuguuugguuuguuuuuugagacaggguuucucuauguaguccagucuggccucagagauagacccuccugcuucugccucugccucggccucccaaaugcugggauuuaaaaaggcaugggcccccaacaugcccagcuaaguuuuaaguauuguggguauauuguuaccuuguuagggaagcccaugaaauuaguaggacuucguuucgggggugggggggugggggaugguggggaacguuauacaugauuugguuuuguuguuguucuggggcccgugaacuucaggaacggccccauauugauuuguuucccuugguuuccagguaaccucugguuuguccugaaucccauguuucugacaugagugauuuccuggaauugaaugggggaauaauagaagguuuuaaaaaguacuguuagaaauccuaaauugccaggcgugauggugcacgccuuuaaucccagcacuguggaggcagaggcaggcagauuucugaguucaaggccagcccggucuacaaagugaguuccaggacagccaagguuacacagagaaacccugucucgagaaaaaaaaaaaaaaaaagaaagaaagaaauccuaaguuuagcuggguauagggacgugugacuuuaauccuagcauuccagaggcagaggcagguggaucucauggucuauagagugaguuucaaggacagccaagguuacuuauggauacccugucucaaaaacagagauaauuuaagaaagaaaauuacugaaauaaccaagguaaugccaucugacacacacacacacacacacacacacacacacacacacacacucuagucacaucuaucuuagcaaaacauuugaaauuuccaugaccuugacaaugguccauaugucuaaaauaaccauuguguucugccaagaaugaccauuucaagguuacucugaccauucucuauuaucuguguggguuuuaccuuuaaaaacauuguaccccugagcuugggcaccgagagauucuuuagaggcucaagcccgcucuuggucuggucaucaauagaaaaaacuaaaaacuuuuaauuggcuuaaucagcauugacauuagucuaugucucgcagguuauuacaaaaagaaaacaacacaaaagaaacuagccuagauucaagacuggugcugugggaacuggagagauggcuccgugacuaagagcacuugcugcucuuacaggggacucaaguuagguuuccggcaaccacgcggugucucauaaccaccuauaacucaaguucccagggaucccaugccuccuucugaucuccaaaggcaucauguuguaggcaaaacagucuuacacauaaaauaaaucuuaaagacugggguuguugccaggcgugguggcgcacgccuuuaaucccagcacuccggaggcagaagcaggcggauuucugaguuugaggccagccuggucuacaaagugauuuccaggauagccagggcuauacagagaaacccugucucccuccccaaaaaaagacugggguuguagaugcaggaggcccuggcuccaguccccaaucucagaaagaagaggggagcagcggaacccugagcucccaugaugacuuggggcagcccacgcugcagagccaccuccccacccacccucacugacucugcaguuaauccuugcugaaagaguuucuagacacuggcuuaauuuaacuggugcucuguacuucuagaccacacgaggaacccagcaucauaagcuuccaauuggugauuccucuucccaccccacaaguguagaaggcccagcucagccuuaucucuucucuccuuugggggucuuugagaaggggcagggguaggguuugggucuccagagagguaaagagccaccugguuaagugacagaaacagccagaauagucuaacuuggaaauggcccauguuaauugcauuccaaagaagguucuguggguuugggaacuguucacuagaaguaucaccaacucuggcuguuaaguccuugcccagugaguacaaggggcacuguguagauggacagugguggccuucacaucugacccaacgcccaucggggguccugugaacacaccucacaugggcaggucaguggcuggcucccacugacuucccaccuccucuuagcaucagaagacagccccuguucacucacaccuugccuccguuugagcugccaguacauggggaucagaaacaacacagccccuguguggcucacuggagcucuccuaggcuuaggcuaaaaauaccagaaagucaauugaaccauucucuuaaagucagacggauuccugcaguauucuaaucuuuaucccuuuuccacguaccgugagucuauaguauauuuaguauauguauaguauauauguaguauguauguauguguauguauacacacacacacacacacacauauauacauauacacauacacacacacaaacacaccuuuccaguggauuuauuaaaacuaaaugaagauaggcaaagccgcgaauaguugugagcucaccauggcuuuucccguggguggaaauuuagguaucggggugcaugucccaagggugagagcauuggcagagugccaguuugcacauacaucacauguucacaccccaguucugauggguguuuucaggcuggggaacccccacugccuaacccuaaagaggaauguccaccccagaaauggccccuccccacuaaggcggccccuucaagguaugaauaccuuucugaaaccucaggugucagucuaugaccagcaaugcccucaaaugugugguguuggguuggguuugagacaagguugaacuguauggcccaggcugacucagaaugcucuguguagaccacacugggccucacacucuuaauaauccuccugccucccaagugcugggauuguggauaucuccucaccugucagcacucaaauguuaaaccuccuuuuaccagcccgggacaggcuuccacacagcacuccgcuaaucaaaucauuacccugggucuaaggcacauaaccuuuuagugacccagaaaacucguugccaaguagaaauuagauuaauguccagugcugggcuuggagagcccucaguccuuuguaacaggaagcugaccucaaguucaugccacagugaccucuaggaucccauggagugucgcugcagggcaggagcagaggcuccagguugugucucagaacccaguuuuccaagagauaagaagaauagcagcccugaccagugguggaggacaacugcggcuaagggagagcuaagcagagaggaggcguggagucacucaggacucuggaaagcagagcuugcguggaguggaacaagguugugggcaaaguuuagaggaccagcagcuagaggaaggaagccuagacacccacccccccaccccccaccccccccaucccugcucaggcugucgcccguugacugcucauuugagaaaggccagguucaacagcaccucaagccaaacuuaacaguucugggaccgggaugugucuucugugucccuguauccauuucccagcaugggggugggagagacacggcuggacaaaaugauuuugaauucccacuuugccaucagaaucagguucaauacuuuauuugugguauuaccucagaggagcaauuuaacuucuaggcccaguguucucauauaaaaagaugggagaugaaguuugagggauacagcucauuugauaacacacuugccuacccugauaacccaggguucaguucccaagcccauauaaaggaaucaugguggcacuagccugggaucucaguggugggggcaggagaagcaauaguucaaggucuuucuugaugugaggcaagcuugggcugugugacacugggcuucucacacacccauagaaaggaaguugguguuaucuaguagaagguccauugugaaaauagcucaagugaauucauugcguaagguaggguauaggucagaggacagaugugugaaugcuuguccucaaacuaagagaccuaaaacaugaaggaagagauugugugaugggucgggaugcaugauagguaagacacagcacuuugguuuuuuguuuguuuuuuuguuuuuuguuuuuuguuuuuuuuuguuuuuuuuuguuuuuuguuuuuuuuuuugagacaggguuucucuguguagcccuggcuguccuggagcucacuuuguagaccaggcuggccucgaacucagaaauccgccugccucugcuucccaaguacugggauuaaaggcgugcgccaccacgcccggcugacacagcacuuuggaaaccuugucugcuguauagcgcucaaaacaugucgugaugggugaggagauucagccaaguggcucuguaagugccacuggccaacacugcucaugcgcaugccccuguuugaaagcugaacaagaagggucaccucccgccucugggaccaucuucacuucugugggugggaugagagcuucagggccacacaggauauguaggccagcaggagugugcacaucuaaucccuggacaccuuagcgaggugugcgcugugggagaaaagacaguauguggaucagagcaggcucaaaagcaaaacaggcccugcaucgccacaugaucagaacgcccacuuucagcagaaaggguguugcccgggaggggagugggggauguugugugucuggcaagcaggcaguggaaacugcagcugggaugucuccuuuuugagagagguuagccugggccucaagcacaccagaccugcucugcaacugagcagcccaaaggcccugcuuuuuaaaugaugcuaauucugucuacaggagagaggacuucuuaacuccugaacuuguccagaccugguugcuaucucauuacuaggaggauacccugagaaaaaguugauguggucccaguucucaagaugcugcgacucuuuaauacaguuccucauguuaugguggcccucaaccauaaaguuauuuucacugcuacuucauaaccgcaauguugcuaccguuaugaaucauaauguaaauaucucagauuagauaucugauauguaaaagggguuagugcagccccaaaggggccaccccgcagagaaauaaauccgauagaaaucauuucuaccaagagugagacuagauuugagaaauagacuucucucucauggucugugucaugcaggugacaaagagcgcccacagcugagucacucugagcaugcuaugacgugggcaaguuaccucaccucucugggccuguuuccucuucucugacugaccaugacuauggaagccaucugagacagagcucuggucaggucaaggucaccacgcaggucggcuguguucucaggcggccagacacacagaaaagccuagaaagaggccggaccccuucuuuaacuuggguauugaguaucaauuuucucaaaauuuaaauagaaaauagaagggacuggcuucuuaugggugguugggauguuaaaguuguugugcuugcacacgcagcccgugaugcuacaaaagagucuuagggaccugggccaggugucacauaccuguaggaagaucaagaugaagguucuugucagcuacauagugaguuuaagcccagggaugaauacacacacacacacacaaaugcaaaagauagagcaaaggucauuugugaaccagaguaacuugagggagugaguuggucuguuaaaaacagacuccugagagauggcaaguuacuggcuuaagccucaguuuccuuaucuguguaauggaggaguagcacagcauuuaaugcaaggcuaaucgacuuuucccuggcucacaguaagagagagcccaaugguuagguuagcuaacuugagugucuacagccaucccuggaauuagagcacagcuagcuuucuaugcuugucuggagcuuagagcuggucccaacauuucuauccacccagaucucucuccuccagcucuguggaaucacagcgcaggguggcucagagcugaaauuggccuccagcacaugugccacagggcuuaccccuccauccacagaaugcuuggcugucuccccaguuugggaaggguggugaaauuagcccuuggucaaggcucaccucacgaagcuuagcuuggguguuaacucccaguaguucuugagcugcaguacuccgcugcauggaggcaaccucagcacuugaggucagaggcagaagauccagggcauccuccucuguguagcucuuagagaccauccugccuccaaacgacaacaaagaaugaaaggaaaugugggggaagggcggggacagggagaaagugaaagaaacaaucuuauuuacccuaaaccaagagugagaccuuaacacccccgccaccuuuccccuccaauucaccccauauacuucccaaaagagaacugaauuuuuuuuauuuagaacuuucuuggacaacaaggacaccccccccccauacacacccgcccaggaaaccagauccuagagggugucucaagccaaagucaucauagcuucuguacagauggaagaggaagggcacuuggguggaacgcccugaagcacauuuuccagggaccacauccugcccugccucagcagggagaaaaggaggaugagcccaagggaagagcuggcuucugcccucccucccucccaggaggcuggcacuucauccucaagccuggacaagacaggaaauccuugccucaaaguucaagcuagaguauuuuuccaagucugaccuguccagaaccuggggauucccagucguacauggguggguuuucugaaguaagaguuuucaucucugugacuuugguuccauuugagcccuuccuguucuggcugugucauucugagugaauugcuuaacaccucugauaucccuaguuacaaguaaaagaaggaaccuuacgugauaaaccacaucccaccaugggaggcaccaugggaggcgcaagcgcccagugcguggguccucacagauaauagcugcugcuguuauuggcagccucuguuggaaacauuguguauuuccccucaccugccucuggaagaaaaaccugccaaaaguucaguccccacuaaagcuggcuaaccuacagccugacugcagucucuguguuuucuuguuuaaaaauaaaaaggaaaaucucuuacaagagucugggguaguaugaagccagagucugcggcucaugcauaaaagcagcuuggccuugggaaauagggguauaguuuucaggaaagcaacccuggcuggccaugggcgccucuuccaacugcccugagucacuggagaacuaggggaaagagguaaacgcaccuuugggagccagaugcagguuccaacuugagcgcuuugcucuuccuacccuugaucauucaauguggagcugcccagccagggagggggccugccucucggucuucccccgccccccaaccccccacccccacccccacccagccggccucuacuggcucuggccagcaguccaggaggacuuccuguggcuuugugguugaguugguuagagugccagggccccacucccugugucugagaccggugggggaaacagccuugcuccuuucagagacacaaagucaccucccacaaacacagaccgucagcccaggaagucccacgccuaccucccucgauguuuuucagaaaggggagagggagcucucccugccauccuucuuguguaguauuuaaacaaaaguaacccccacccuggcuguuuccagcaggucuaggagggaggcaggcucuagggacuacccuuugcgaacugcuggcuggugaggggguucacuguagcugugaaugcugcccacuugauagaagcugacagauuagaaucugagaguugccccggaccugcuggccaguccuucuguuacucucaaauccauccccuugcucuuuaaacaaagcuaacacuuucgauccucaaggaaaggcaggcaugaacucucuuccguuggaguggaccugaguauuggucauaacugagaggugggaccuccuguguguaagagggccccuuccuucagcacuggcuaugucuucccacagccaacaguuccaggcucaggugggggaggggagacagaagagaaggcugccacuugggauccuguguguucuugcuggcauugcauggcccagccaucucaggcuuggcauuugccagugagaggagguugcuauggggaugggugaggcccagagcccaugggucuggguggccugacuugcuuuugaauguugaagccuguggacacaagagggccuuaucuucgccucgguggcuuucuucaagcuuggcugauauuuuagggccugggaaacagcugauggcgaaauugcauccuggcuauuuggucuuccugggcagagugaacaguggcugcagguacccaagugcacuguguucaaacaaaagcaucaaggagauugaggaacaucugcugaggggggacaguuaguuacagagcugguguccuguccugugccagccuaggacugugucucccucccuccuaccccaggagaaguagauuuaccuauuugcuucccacccaagacacacagccucauauaauagaaacccaauguccuaaguuuugcagcuucugccagccaccuccuuagaucgggagugggguauggguugggggacgacauauaacauccagggagugccugccagcccacccacucaucccucaucuuucucaagguuuguuauuauuguuguuacuucuauuuuucccacuagaccagaguguuuuauguguguacuucucagccuaugcugaaagugaaacaguauuucaguguuguguacacaugcaugguacguccaugugugcgugcaugcaacaaaacaaauaacaaacgaaacccauuguguggcgcaugccuguaaccccagcagcguucaggaggcugaggcaggaggaucaccacaaguuucaggccagccuaaauaugugucacuaagcuacagucagccugucucacagagagaaagcaagccgaggaaaugacugaagacugucaaugguggacgagagugcuugguguugagcuccugagggcaguggcagaauugcguggaguccuucuccacagagaugugcagucacaucaccgggcauccuuggaagagccaggucaagcgccugccuagaauuccccaggugauucuggcgccaccccaugugcagccaggaacuggugacucggucaggcagguggcagguggcagcucuaggacuuccugcuucuugcuugcuacauuucuauuaugccaccauccuucccugaaauagccguuguuuuuccagaacaacagaaaguaggaaagaaagaccucgccccuuucccagaccuccuccacuccccagcacccaccucagucccucuggguuuggcaauugaggcuacuucaaguccauacucuucaaguuccaaaaccgggcuugguggcacaugccuguuugaguuuguuacuguucgaggugcaaacaggaagcacugacgcucagggucauccuuagcuacauagaaagucuauacccuaggcuucaugaaagccucuuuucgauucccacccccacccauucccucccucccccaucccaccuccucauccccacccuugccaaguacaaagaaagcccuaccuggcugaguucaccugcuugcuacgugaaaagcauuuuguccuucagaaaaaaaaaaaaaacacaguauaagacauggccccucccagaacacccaguacacccuaguguguuuuaauugggauaggucucuccuggucacauugccaccucccagcugaaggacccaguacaguuauggcucaguugcuaaucccauccuaguccgucugcccacagacuugaguuucugucaguuccccccuucccccauggguguacaccuccacggguucuggcuggauccaguuuagcaagcuuggccagguaccccuaaguuucauuauuacuauuuagcuuucuuuuuuuuuuuuuuuuaaauugaccuuuggaauuggaaguauuuccauugccuguaggucguguuucagggugagaccgucccuccagugagauuuuccaugugacucacuaaaacccugcucugcacuuucuguggaucagggaaaguagccgugagcuggaauguggugcgaugguggaggcuccugggcuggccucacaaguccaaggccuggguucccggguuaacaccagaaggcagaaagagaagaaggguuugugccucugaaauuggcuuaagccuuacaugaccagguuaccuguguguucaccccgaaaucggaguauguggcuggauuucucgaagggcggaguuacagagaggauugcaaagcaagcacuuugcagaaacuuggcuucucaaaaggcuuuacaagagucggguguggugaugcacgccuguaaucccagcccuugaaaaaaggaggacggagaauuugagaccagcccagcugugcacagagagaucccuugggaagggaguacagacuuccugaggauucgcccacaucucauccagggccuuacuccugggaggcaagugcccuaccauugagcuacucugguuugguuuuaagucaggguuuccuacauagcccaggcuggcuuugaguccaguauguaacccaugcuggccucaaagauccuccugccucagucucccaagugcuaggauuaugggugugaccucccugcacugcaccuuuuguuguuguuguuguuguuguuguuggcagggcguuggaagaugcagggaaggaaacaggaucucgcuguguauccuugacuagcccagaauucacuauauugaccagacuagccucaaacugagacaucugccugccucugccuccugagugcugggauuaaagcccccaggagcugcugugcacagcuucaccugucgugaaauauuaggaaagggcuccagugucucuuuggagcugugguuaggauguuguuugaagcuggguuaaaauggguggggguggggugaauaagaaaaggaaucaagaaguugaucugaccuuaaggugcgucacagagcacacucugaggugcuagagcagucuagguggccaggguggcagaggagggacauggugggcagaggcaggaauucuaggguugaaaaaccgagauuccaaacaaauggggaggagccugggguuccuuggcaucagcugcaguuugggacaguucugugaggauucgggagggagucuggcuuucuguuuugcucuuuuuuagaggggcagggguugaccugccaguguagugcuggcagagacagaaucacagagaagcuaaugaucugagcagcccuggaaggagacugaagcuuuauggggaagagacaggcaggcggcaucgacugccgcuuuuuagaccuacagaggcagugugccaagcuagcuaguggagccuucacuggauucuaaugcacaccacacuuuuccauguuuguuuaggguuuauuugaguuugggggagguuuugugaaguacgguuucauaauagaacccaggguauccuggaacucacugucuuccugccccagccuggaguacaggcuugccccaccacaccucacucugccacacuauuguuaaccuugccacacucacuuccuuuugcccauucuguuccugggucucacccaagaucccacauaacagcaguuguuguccuaaaucucuggucugugacagccucugacuuuccuuguuccucacgauccugacaguuuuauagcugcuacuggucggucaccuggcacuggggaagcugaaggagauggcaaaagaggguucaaggguaggcugggcuccuuaacgaaacuuugugucaaaaccaguaauacagaaaucugugggauuuggggagggggcucaguggguuaagugcuuucccaauaugccugaggaccugaguucuuguucccagaaccccuguaaagcacuagaguuuguagggagguggagguagagcagggaaacccggaagcuaucaggugcuaugcuuacaaagccgcaaauaagacacccugucagaacgugaaugcaggccguccucugaccuccacacgugugccauagcacacacauauaacacacacauagacacacguauaacauacacacacacaacacauacuggcuuuuuguuuuguuuaggaaaaaaggaaaagagagagaaagaaguucugggcugaguucuuuguagacucuaugcaguuuagguuuuucucaguuuuucuuauggucugucuuacacuaauuaaaaaaaaaaauccauaugagccucgaaacaaagcaaaccccagugaaacaaugagggaaacuccuuguuuccuuuacagucacgggacugggccuuuuggggccagauggcaaaggagcuuuucgcagcaaaaccagacuuuccauuuggcuuuuguuaucaacaaaaaagguagcuaggccaacugcaggcggggccucccggcugggagaaccgccucuggaccuacaucuccauccacugcugcuugcaauccaguguugucuaagggcggggcugagcaucugcaucaagcuugcccaugucugaugugacagacgaggacuuggcaguuuuguggcugaugugacuacuuauuguucuuguucuugugauaaguuaucuacaaaaaaaaaaaaaaaaaaaaagaucaagacacaaaaguucauucuggcuccaauuggaagauacagagcaucaagaaagggaaauccuggggccggagcuugggggugggaguggggucagccucucugccucaccgaugcauaugcaguccuccccugcugucuccaagguggacauuccagaaccuccugauccuacccuuacccaagagcccuugcccccaccccaccccaccccaccccaacgucuucagaugccaagauccaaggaugccuuaaguacaauauuacguuuacuuauaacccacacauauccucauucaaguuuacccaccuucagcauacauagccggcgcgagaggcagaacuacccauugcacaggaaccugcagaagcagccccuucaccuuggagggagucccuugggaaaugauugacacaaugcuuuuuuuaaaggcuaaagcugccugguucuuacuacuggucucuuaguuucuccugugauugaaguggcuggagugagagccaggaauggcaacugaagucccccacacacacacaccaccucccaucccugccaccaaaagcaugcuucccugggaaguguucagagcucaaauguugccuaaggaacuagcaagguauucagguuucacagccccaccaccuccagcugaccuagccaacuguagcugucuucccauuacaggaggcugcuaaugacuuccacagcauccucuccagccacuuaagcaccagaggguuuuuuaaaaacaaaacaaaacccggcaguaaguaccagccugcaaccccagcacuuggaaggcaggaggagguugcaagaccagccugguccacacagcaaguuccucacaagccaugcugcaaaugugaaaaauggcucacaacugagcaagagcagagccugcucgugcacacucuuagucccuagccacggaggcaggugacagccugggcuacaaaguaaaauccaaaguagccagagcuaccuagugagaccuugucucaaaaaaucaaaaacaagaaaacuaauuggacaaagccggcagcuggcucacaccugauaaguguucacauacuguuuugucuucccucgcccuuccuguugucugcuuuucuggagccuucguccucccuggugggcuuuaguguccuuuugcacacuucugcagcccucugcauuugcuucuucacucuuaggcagcauuguggugugggcagcccagaauugugacacuaagcuuucggugacgcccacacauaggaccagcuucugaccucauuguggcccaggugagcccugagauuuuuuccuagcugccagguuucugguuucuaacccagauuuauuuuuuauuuuuuauuuuuuugguucucacagacuagaagggacuuccaaagcuguaaaccagggcuucuccauuuuucucuuuucaccagagaaaaaaauugcaugucccaagguagacagguauaccagguauauaugcaaaucacuuccugaucguaaaccagagucuagcccagggcccagcugagcauggucuuccccagccuugaugcugguguucccugucuguagucaggagcauucuguuggaggagaucagucuggcccagcaugagagcacucacccuucuacccccgugaaggcgugcucugcacuauuuggccuaaagaggcucuccccugugucuugcuaaggaagacaacccugacuccugucucuggauucacaguucucagguucaugguaacacugugaugccugcaccaucaagcccagcauucaugaacucuuccaguguccagccagggacacuuggucugggaccuucuuaguggcacuuggcaguguccuuaucuaagagggguacugagagcacugugggaagauggcacagaacggagggugcugcgucauguggccaggcugcuuuccuaaagcccauuaggcgccuccuccuaauguaguucugauguaagcccccuuaguccccggccaaacuggccaggcacaggcaggccacauccacccuucccguuuacagauggaaaggcuaaagcaguagggcucuaagccaggaaacacagcgcacacugugacaggaacucaguuugugugcagugggauggaagcagccuauaccuggguacaggcaaggugguuucuauaggcugacauucuuccugcguggcccuuccuggugucaccacgcacacuugacgcucaaugugcccaauccuauugccacaggucggggagaaagaacggaaaagggcacggguggcgggaggcagggugguuguccauaccacagacuguuacacagcuccucgggcagagaauuaagauuccccaaaagcaagauggugcuucugauaggguggguagaccagcaaaaccaggucugucucccacauccagccagccacuacacuggagggcugugagucacuccuccagcaagcccugguaccagugauaagaggucagcuggaacugggcgggugggggaugggaaggcuuggcagaggccuccccaacaacaucugcaucuccgaggccacuccgaggccagggcagggguugacuggcgaauaagaggcugauaugggcaagcgaggaacaccucuaauacgucaugucacgugcugggcguaucacaugcuguccccaauccccaugucacucaaguaaaaacaaaaucaacagccgggcgugguggcacacgccuuugaucccagcacucgggaggcagaggcaggcagauuucugaguuuaaggccagccuggucuacaaagugaguuccaggacagccaggccuauacagagaaacccugucucgaaaaaccaaaaaaccaaccaaacaaaaaaacaaaaucaacaaaauuaguaguauauaccugguuuuucaggaggcugaggcagggggauagcuaaaacccagacguucgagaccugccaugacaagagaagaauaaaguaucauuuggcauccuauucaacaccccauaugcucacccacccugcucauucucccccuaccuggagcacaucacucacuuggugaucacugguuauguuuguuuuguuuuccguuauuucuucuaugacguauauuuuauauucgugcagcuuaaacagcauccuggcauuuaacuauacagaguccugggaugugaguucaguggugcgugcucuugcugaacaugguaaagcagacuugcagugccgguagcccuugugauuuaucuucacugcucuguagcauucuaugccugccaacugcagcacuuccggcagggaacugugugugaaucccaguuuucuggugauuuuaccgcaaugguugaucacaccauucagagugccuucugccuccagaugcgcuuggaggguagaaagaaagauggugcugaaguccuuugcaggucuccucagcauuuguugagugugcuaucccagguggucagaacuaauggcagccaacgcguugugugucuugcagcucgcuggcauugcagugcuugcuauuggacuauggcuccgauucgacucucagaccaagagcaucuucgagcaagagaauaaccauuccaguuucuacacaggugagagggagggguuggcacuucaacucugggaacuccaugcugaccucgggccuagggacugggggagagaagcuggccacauaagccagcccugucccuuucaaguuagguagcucagugagugugcauagcugugucugugcguuugcaucugacucuuugugguuucuggucuugccugccgaguuuggcaucuugaccauucucugaugugaaguugucuggcaaggaugccaccacuccugaggguuuaagagccucucugcacaugcuuugugucuccaaacuaaauuguaaucuucuuacgucagaaaccauuguccugugugcaucugcagagccaggaagagaaggggcuccccuuccagucucccuccagaccggcuuccugaauagacaaucaaaauugagauuaauggggauggagauggaggaguucacaggaggcucugggagggaugucaaaagagaagcuaagcaagagagccaagagacagaaagagaacagggaagagagaagaaagaaaaagaaagucugggcuggagagcuggcucagcaguuaagagcacugaaagaaaguaugucagucaguggaccugagagaccaucugauccuuugaggaaaacugcuuuugccuuggggaaggguuuccacguucaguaagguggggaucacccaagcaagcuacagccagccagucgcuuucucuacacagguuccuugguccuuccugacucccuucggccccuuucucuuccucugugaggggagaugccucaaggaccgucucauggcugcuugucugccugacuaagcucagccucugguuccaguccgccugauuuagaaguaggaagcccccuauuuuuagggugauccugucaugccaucagacccagcgugaguugucacuuccuuuccacccaccaaaguuauuuuuacaaaagacaagaaagcauucugacaagguuaucaucccgcaggcugcagggaccaagggccacggggccuccagccugucagccuucccuuuccucuccucccuggggccagacugggccagguagacuaggaggagucucuggggggugggggggaaagcaccugagcucucagucuagagcucccguuuuccuguccuuaguuacuguccauuggcaguggaguggggaaggccaggguacguugcccuauuguuaaaaagaaaguggggccggguauggugucgcacgccuuuaaucccagcacuugggaggcagaggcaggcagauuucugagucuaaggccagccuggucuacagagugaguuccaggacagccagggcuacacagagaaacccugucugggggggagaaaguggggaaagaacaggcucgugguuuauaguuggcaagccuuuggguuuuuguuuuuuggguuuuguuuuuuuuuuuuuuuaaacuacaagcagaguuuuuagggaacauguuuccauagugcccugacuuguuuuagcaacaaagcuuugauucuaagcaggaaugccaggagagcaggagagggugggguggggugugcuucccugaguagcuguagcaggagcaaggugaugaggggagcccggcacacuccgugccccagcacacgggagcugugagcucacucccuaaggaccacaggcagaucuacgggcaggaacggguaccuucucaagcugaucuccugaccaagggcccaauagucccugugucuuccaaaagaguucugacucccuaggcaggccuccuuccuguugacugcuccugaucaccugguaguuguucccagcauucaggacucaggcuagccuggcaguggugguggugcacgccuuuaaucccagcacuugggaggcagaggcagguggauuucugaguucgaggccagccuggucuacaaagugaguuccaggacagccagggcuauacagagaaacccugucucgaaaaaccaaaaaaaaaaaaaaaacaguacucaggcuaauucuguauauuuuuagauuaggaaagaaagauuuucacuggugacccuggugaacugggaagaaaccacucccacgccugagccccacccugguguaguucacuggcuccaucccugaaaccccacaaggugcagggaauagcucccaucucacagcccaagcucucgucccuagaacauaaacccuagcuccuucuggaauucucuguacuccauggcaaggagggcuccccuuguaagaagugaccuuuugagucauauuaaguuaaggcucagaauggcccuggugagcuguugguagguaaggaaaccgugcaaggagacggagagccguuaccaccugaguggaggaagaggagccaauuccgggagccuccugggguucuaauucucccgacuguuacagugucaaaguggucuucagugguccucccuacagagaccgaaggaugauugacagcagaguccaagccagcaggcauccucaacuuugucaguacuaagucccuuugcucugggcccuguuagcauuuuaggguagugauuguuguuguuguugaugaugaugaugaugaugaugaugaugaugaugauuugggggagggaggcuccuggagacugaaugcaggcccugcagcagucuagguacccgcucugucauugagcuguaucccgagcccucuuuuucccuuaagacuuugagacaggcucucacuaagcuguucaagcuugcccuugaauuuagguuggccuugaacuuguagucucuccugccucagccucuugagugguuaguauuaaaggccugugccaucaagcuuucuaaggguucugcuuccagggccaaggggcuacugccaaagacucugaaacgucagggaacugggugguaccuagguuuagacccugccuggacaaccauuauauuuugggaaacugugaaguuguugucccugggcaaagggccaagaaggcuuugcccucuggguccucuuucccauuggaccgugagaccagcccuuugugagaaccacaguccucccgacacaugugcuagaaggacugguuauacccacccaggcugauuucucuggcaugauaggguggccaaccucagaccugccaaaguguguagcugacuuuucaggcaaccuuuuuuuuguucagguuuccugacgugagaccacagcucguacagucaagaaaggguguguagugaggcagaaaugcaagacuuagcagaacagcugauaccuuccuuacccauagaagggcuuucucuccaggucagcccugguacauucauccugucagcaggacacagucccaggcuuaccaacaugucagacaugucacagaacuacauuucccagccccggggcccacagcucuuaacuugguguccuucuagaaccauggccagagugaaggaauuuaggggguguggccacaggccaugaguguccaucccaagugcuugggacauucuggguauauguccucaguaagguggccucccugcacuggguacgucugccauggaggauuguccauuucccaccugaauccggcacggcagacgugggacccacacuucucugagggugccaugcucagcauauaccagugacucuucugaaugagaguaaccggccgugggagggagagaaggcaggaaugagcuggggugggggagggaguagagugggggccagguguuuggggauaaugaaccaaauggucggcgggaaaugcuuaugacuuagauagagcugggccuccagggaaggcuuuuguguccucgcuagucggggcucagagcccaauacacaggugggacagagcaccccacuuccugugcaaagggcacccugacauaugcuacgccaccccauuuaaauagaccuauaaugucagcccaagagaaaaaaaaaaacuguauaauaaacagcccuuaagcaauuuagcguggagauccugaugaaggcccucugacgaauauauuuuuccaugagucagacagaaagcuaacauucacuccuuuuauaaaagggaacgcuuugucguuuaacacugccagcccuugcuaacaagggccggguguggggcugugagcugccgcuuucccaaaaggaagcaagagacgguucuuuucuaaagcaggccaagagguggggcggagcuccgagcuggagcucagaagugaagaccagccucaccgucaggaagcccuggguuugagcucuaucuagcccuucuuuacacaucuguaaagauacaauaggaggcucgcauugaguccaugacucacuaggguugggagaccagcuuccagaugagccauuucuauagcuuaccugccaggguugcugucuucuugcuccugacuagagaaggcuaaacagagacacuuccagagcugcagcuaucugaacaagaguuaaagccaacagacauuuaguuuaaaaucuuucugggguugaucugucauaugaaccaagaggcccacuagggaaacauucucucucugugagaacugcccccuccuucaaggcucuugguucccaggcugcccuggccuuaccaggguguccaagcucccauaccgggguguggacuauauuuguuugcauuugacucuaucucauguuuuuaugucuugcccugauccgacagucagaaaccacggcuguacuucugccacagucagugguguccccuuggcagcuggcguuccuccccaggggccgugcacggaacugcacugccucccauguucaggccccacuacguuggcuggccagggagaugacuugaggacaagcugcguuuguccccuugcccagucuaggccaggcaugcacagaaacaauacccauauucaugcacugugggguuuuccaguaaccccacgugacuucacgucacaacggcgauaggaggaggcgagagaggcacaaaugcccacugugugugcucugcucugggcugccuaugagcaucagcugcaggccaaucucacggucucugccugcagagucccgcccuacgcuggaugcugcagaugggggacgacggugaggucacuguggcaccugccaaaaguccuugucacguaaugugcuguguucugugaggaggcauaucucccacucuuguuuuuuucaccuaucugaagaagucucucugacccuagugggagaauagggagagagugucaaguacauaaaaaucacauggguuuuugcagugguuaccuaggccuuauaguguugggauuaauaacaguugccguguguguguguguguguguguguguguguguguguguguguguguuugugaauguguguacuaccucauuacacacgucacaacaguuccaggagacugcacuguugucaucccucuuucugugguacuaaagauugaacccggugccucuaugugugccucaagcccccagucauuuaaaucuauguaugcacaugugggagccagaaggaaugcugggugucucuugugcucuccagaucauugaggcccagucucucacugaaccugaaguucuuuuuuuucagcuaagcugaccagccagccagcuaucuccugggaucugacuggcuccacuucccagggcuggcacacacguauaaccuggcuuuuuuuuuauguggguguggguucugggaucucagacuugggucaucauggaugggugcauagcaaacauucuuagugagccaucucucaaccccaaucacccuguguuuuauuuuaaaaaacaaacaaguugccauuucuucuuuucuuuuucuaagacaggguuacuacguacccuggcugccuuggaacucacuauguaaaacaagcugaccaagaacucacagagauccaucugccucuguguauugggauuaaaguuguguuagcuggccauagugacucacacauuuaaucuuagcauuugggaggcagagagaggcagguggaucucugugagcucuaggacagucagagccauauagugauacccuuucuaucuuggagggaaaaagaggaaggaaggaaaagagaaaguaaaggguauacuaccacaccugggagaggugcacaucuuuuuugguuuuucgagacaggguuucuccauaucgcccuggcuguccuggaacucacucuguagaccuggcuuggccucgaacucaggaaucugccugccuuugccucccgagugcugggauuaaaggcaugugccaccacugcccagcugagguguacauuuuuaagcccagcacuugggaggcagaagcaggcagcucugagcuucuggccaggccauuacacaugguguuucaggccagccagagcuuacuugaagagacagugucucacuaucuauccacccuaaagcaauuuuuuucauaaauacguuucucugggauuacagaacuggcuuucaaagcuaagcuuucugggcuuuaaagcuggggcuccugccaugucacugugcccuucccaagguuggcuagagcaugguagcaagacgggagguacuggggcugaagaaguggccaggggcgagaguguguagugcucaugcagaggacccacguucaagucccagcaccgauggguugggugcucacaacugccuguaacucuagcuccaggggcuguaacgcccucuucuagucuccaagggcaacugcauucauaagcaccuacgucaacagagacauacacauaauauaaaaaauacauuuuuuauuauuaugggaggcacuacaaccucucucaggacagaagggggcuucacaaagguagucucugcucagcagcuguggcuucucaagagugucaccguaggguggacucugggcauagccuggugagcuggaauaaauguagccagggcuauccacucugguuccagauccagggauuugcauuguuuggguguggauaagauuuuaagagucuuugcccuccccugccuccuccccaguaaccacucacauugaagacuuaggcaugacgucauccguugucaccucagcgugaugaguccuuucacccuuagucuagaguaacuucauuccaaccaugagauuuccuaggugggcuuaagggauuucauggcacuuaaagagagaguguguguguguguguguguguguguguguguguauguguguguguguguguguguguaagcaaugagaggccugcaaaggccaagagagagcaucaaucagacccugggagcugaaguuacaggcauuugugaggugccuagucuagguauugggaucucugguccccaugauuaagcaacaaguagcaaggacucuuaaccacugagccaucucuccagccccacauucacagucuaaauaaaagacacucagcaguuagcagcagacaaggcucuucugauuugaugcccacuucugcguccuuugcacuagaacaaggaacuuugccacugugggcacugggugcuagguaacugguggcaugcagaaagaauuucuggggggaucgcauucucaagccccaaacuguaguuugagaggucucaguaaguuagcucaagugaguuguccugcugggaagaaacauacagacugagccagggguuguccccuaagcaucaagggucucuguccuugggugccuucuaggaaaggguccgaggaugagguagaguguugaugugguagagcagaguuggggggcggggggagagggagggagaggaaccuggagccaaggugaggaugcuauuuuguuaagaaaaugucucugucccuagaaucgaggcagucaacaaggagacaggaggcucagaggaagccugggccugcacacuaauguuugcaaccuuguguccuuugccucuguccucccucaggaguguacauucugauuggagccggggcccucaugaugcugguugguuuccugggcugcuguggagcuguacaagagucccagugcaugcugggauugguaaguauuccuucuauagaguagcuagccagccuuaccuuaauccuuucccaaaaugucaccaggcauuugcacagaacagguagaaccgguggagucaggaaggcuccugggccacuggcuguguucagccucucaccauccuuacuucaggcccagucccgucugccuggcucccaccaccaucuugccauggccggcccuguauuccuaaucacuuccuuuaugcaccuaaaugccaggacuguauuuccgccuuucucaaaggccauguuugcuuucucccgagucccuagguccuuuugccuucucuccuuauuuuaaaaauucuuuccgucuugcccagacgccacggagugaaugcgcugccuuuguuuccccgaucucggugguauuugugugugggcaguggugguuuauugcugcccgacucuaaacuaacauccccaaguaccaguguaggggcagcagaucacauuuuccccccagaauucauggcuucucugcuuuuugcuuaaccucuuccugccuguccaucugugccacccgcacgcuaacuguucugcaagccuuugguauugcugacuggcuugcuggagucucucucaccacguccuuugugucuucuaguucuucggguuccucuuggugauauucgccauugagauagccgccgccgucuggggcuauacccacaaggaugagguagguguuuccauaaguacacuuggguccuacagugauuugaguuucugagcugggaagacggagaacaaaggguccaggcuagucacuugcuggguuuuccacugaucacaccuccuuauccaguauguuuccauguaaaagcaagacaaacaguccuugggagugggaacguggagcuuagccugcccuguguggcuagcaccauaguuaccauucagaacguuuuuggaaaccguuugugugugugccugucugugggccugacaaucacagcuagacagcccuuccccacugcuccuagaaagguugcucagaacaacauggcuuucuguaaucagcaaagacucgcuuucucuaaucuguaaauacauacaaguaccacaccagacacuaugcaagguccauccccaaguauccagguuccgggucucacacuuugaggaacuuugccaucuaguguggaagaaggauguuagacaaaugucacacaagucauuuauaaccaaaaauacguugagauuuaaagaaggugagggugggccagagcgucucuuccaguuuauaaggaaguaaguguggaucuagaccuugaaugagauagggcgucuggagggggagaggggggcaggaguggggaacuucugggccaaggaagggugcugaccaugugaguuugaguuucucuggugaacucuuuaaggaguuguaggccaggcuggaacacagugcaacauuuaaaaaagcaggggggcuggagagauggcucagugguuaagaacacugauugcucuuccaaagauccugaguucaaaucccagcaaccacaugguggcucacaaccaucuguaaugagaucugacgcccucuucuggugugucugaagacagcuacaguguacuuacauauaauaaauaaaucuuuaaaaaaaaaaaaaaaaagcagggccgcuuauauucuucagugggagaagaaggaaaggaauugaugugggaucuacauuuucaaaaaacuacccaacugauaagagaauuuacgaagggauagaggcuggggauucccagugucacuccaucaccucaaaagaaacuuagccaggcaagauggcagacuccuguaaccugggcacuuuggaggucgaagcaggaacaguggugagacagaugguacugguggcaguuagccaagcgcuugaaggguauccgugaagcaguuuuugagaaacccaucucugcuccugauuugucugucccucauaggugauuaaagaacuccaggaguuuuacaaggacaccuaccaaaaguuacggagcaaggaugaaccccagcgggaaacacucaaagccauccauauggcgguaggucaccucuguacagaaaucacucgccccuccaguacauccccgcgggguauccgcgaucauaccucuuuuaacuaucucuuuguuuuucucauccucaucccugccuucucucuaaaguuggacugcuguggcauagcugguccuuuggagcaguuuaucucggacaccugccccaagaaacagcuuuuggaaaguuuccagguuaagguaaacugagaagcaacccucuggcaugcugcccugccgcuuagacaaaucccugcaagggcuugggugaauuuagcaacauucuucccaggcggugagaaacaaaggccagaucagagacagaacaaaauccccuagcuccugcagcuacagacaccuggggccgugcacacugcccaagucccaagccuuaaagagcaagcagaucccaaucccguggaggguaugucugcuccuacggcuuuagaaacaguucccggucaguccguucuccuucauccagaaggagaauuauaaagugacucucuacagccacaugggacuggacccagaggggccucuuugaguggcagaaugcuugccugguggaugaggcaccagguuccagccccagaacugccaaaaagagaaaaaaagggugguuguggggcugcuaucacaaguugacucgguggugagagcccuugcucuuccagaggacccagcaucgcaucugcgaaucaccuguaacugcagucccaggggaucgaaugcccucuucugagcuccacagacaccaggcacagaugugcucauacacacaugcagacaacacucaguguaaaaguauauagaaagaaaaagagagaccugaaaccucccgcuucucuguucucaaguuuaggguacccccuauaucucucaguucccccucuggccgugaggccucccagaaugauacaggaaucagcaaaucaccaaagaagaggugcacagcuaacgugagaacuguugcuuacugugugucucguuugccucccuaagcccugcccugaagccaucagugaggucuucaacaacaaguuccacaucauuggagcaguggguaucggcaucgccguggugaugguaagugccggguaguccggggaagaaagccaugccugggcacuguuagaagugcuguagcgucagaagcaacccuggcuauccugggcagguggauaccgucaguauuucuuucuuacuauuaggaagugggagcucuugggcuguggcucagaggcagggcacuuagcuggaaugggcaaggcccuggguuucagucccagcccagcaaagaaaagaggauggagagaguccuaauuugcaugcuguguuggaaacacugaaguuaagacuuaaagcugcauuuuuagggucucacccugaauauucucuaaggaaauaucucggcagcugacugccggaauccgagucccugccauccuuccuguuaucuggccuucauaucuccuacaccaguauccuuccuagaccuugcuguugccuugggcauuugucuuggccugggugaugguccuuccccucaggucaggcagaccacgcccccuuccugucuuuacagaucuucggcaugaucuucagcaugauccugugcugcgccauccgcaggagccgagaaauggucuagagucugcccaaccccgagcaggaacaacggcccugaagacuguccgggccauuuggguuuuuuuugccacuaauauuaguauucauuaugcauuucuaaauaacagucauucuguuugucuuuuuaaugcuuuauucauuauugacauuuguaguugagggauccggggguucaauuuauuuugauuuuuuuuuuugguuguuuauuuuugcuuguuauguuaagcaaaaauccugcaaugaaagguacuauauuugccagacucuagacauaagauauuguacauaaagagaauuuuuuuugccuuuaaauagauaaaaguaucuaucagauaaaaaucagguuguaaguuauauugaagacaauuugauacauaauaaaagauuauaacaguguc

SEQ ID NO: 3401 - RNA, 1626 nt, Mus musculus
ucucugggccuguuuccucuucucugacugaccaugacuauggaagccaucugagacagagcucuggucaggucaaggucaccacgcaggucggcuguguucucaggcggccagacacacagaaaagccuagaaagaggccggaccccuucuuuaacuuggguauugaguaucaauuuucucaaaauuuaaauagaaaauagaagggacuggcuucuuaugggugguugggauguuaaaguuguugugcuugcacacgcagcccgugaugcuacaaaagagucuuagggaccugggccaggugucacauaccuguaggaagaucaagaugaagguucuugucagcuacauagugaguuuaagcccagggaugaauacacacacacacacacaaaugcaaaagauagagcaaaggucauuugugaaccagaguaacuugagggagugaguuggucuguuaaaaacagacuccugagagauggcaaguuacuggcuuaagccucaguuuccuuaucuguguaauggaggaguagcacagcauuuaaugcaaggcuaaucgacuuuucccuggcucacaguaagagagagcccaaugguuagguuagcuaacuugagugucuacagccaucccuggaauuagagcacagcuagcuuucuaugcuugucuggagcuuagagcuggucccaacauuucuauccacccagaucucucuccuccagcucuguggaaucacagcgcaggguggcucagagcugaaauuggccuccagcacaugugccacagggcuuaccccuccauccacagaaugcuuggcugucuccccaguuugggaaggguggugaaauuagcccuuggucaaggcucaccucacgaagcuuagcuuggguguuaacucccaguaguucuugagcugcaguacuccgcugcauggaggcaaccucagcacuugaggucagaggcagaagauccagggcauccuccucuguguagcucuuagagaccauccugccuccaaacgacaacaaagaaugaaaggaaaugugggggaagggcggggacagggagaaagugaaagaaacaaucuuauuuacccuaaaccaagagugagaccuuaacacccccgccaccuuuccccuccaauucaccccauauacuucccaaaagagaacugaauuuuuuuuauuuagaacuuucuuggacaacaaggacaccccccccccauacacacccgcccaggaaaccagauccuagagggugucucaagccaaagucaucauagcuucuguacagauggaagaggaagggcacuuggguggaacgcccugaagcacauuuuccagggaccacauccugcccugccucagcagggagaaaaggaggaugagcccaagggaagagcuggcuucugcccucccucccucccaggaggcuggcacuucauccucaagccuggacaagacaggaaauccuugccucaaaguucaagcuagaguauuuuuccaagucugaccuguccagaaccuggggauucccagucguacauggguggguuuucugaaguaagaguuuucaucucugugacuuugguuccauuugagcccuuccuguucuggcugugucauucug

SEQ ID NO: 3402 - RNA, 27436 nt, Mus musculus
guaggugucuaugugcucauuuauaccaaaugcuucuagauaaccaugcagccugagaucauagcaauauuuccacuuugaggauagggccuugguauaagaauuccaaacccucuaacauuucagagaacaguugugugugucgauauuauauauaguuauuuaauagaaaacaagccucaguucugaauggcugugaguuccucucugaucagucaagaaagacacuugcaauagaccgaauccucggauauuuaauagagugacucuuuuacugcacacaggugaccugggugacacuaauaguugacugucuuggcaggcuugguuuccucgaucucagaagacagccaucgguagguacgaugccgccguagcaccucaauggacuugagcuccaguggugugggcugaacaccaagaucuuccaggccaggcaggucggucggcaucacgucugagauauguaucugugacaaagagacacagagaaugcugagacagagugccaccccucagacccccaagcuggccugaggcucaucacugaggcaagggucgucagagaccccacaacaaucuuugauucuggaacucacaaaagcagaacaaauaagaaaucaucaucaaaggccugaggcaggucucccauaccccagaaccacaggacagagacccugaaagagcagccccacaggcacaugugcgcagagcugagccuagugaacguggcaggagcuaucucuccaccuagagauucagauaagagcuaagguaggagaccucugcacccccauuuucuuaugcuggaucgcugggcuauagcuauuucaguuuuaacuuuuuggucugguuuagggauucugacacagugucucacacuggaacuccuaggaacccacuauguagcccaggcugaccucaaacuuguaguacugcuucugucucagccucccaaguguugggacugcaguuauaacaucaugccuagacccauuagccuuuuuugcuccaauuauacucaacuaugcucaccacaaagccugaagccaaaccagucuuguuuaaggaaggaugaacaaggcagccccgugcaucacaaagcaccaaagcagauuccucugugcauggaccucaagcaggucccauccugugaccuccacaaagagcaacgcagagaggaccccaguguguuuacugccugcucuagggcauucugcaagccaaacccagagccugucugucuauuauauucauacuuucucaguugccaagguaagagcaaguguccgacaacggggcucacggccacggaaaggacaccauggagaugugucugcuuuuaaggcagucuaucagagggaugcuguucccugggacugguagcaauucuuugcuaugcuucggcucuuaggggaugguuuggcugcaucucaccaacagaaagaaaaucuacaguucucaggcugagaugcugucaugugcuuacuuggcaucuucccagugagauuugaguaugcaggaagcagauaaucaaugagucagacaagacuugagaaggaagagccagggcuuuagacucggcauacugcaggcagacaagauuggcagcaagaggcucacugagagaggaaagaggacuguugccuggguaacagcaggcagaggagagauaguuaugcgcucugccuuuaguauguagcaaaguuccaauauuacuagaagcauguuccuaaugaugaacaggaaggcaggaaugaggagugacccgaccuggcaucugcugagggcugcugucccuugaucaucuaacacagaagccauuuagucaagcauaauucaaaucucacuuucagugaaccaaaauuacauauagcucaaaucugaugucugcagucaugguagccauauaucaaguccuucccaucgcacacggcuccuggcaaugugcugggacagacgcagagcacccugagcacugcaggguggggcaaugauggcuuaggaaccaaaacugcaggggaucacuccaugucuuaacacggacagcacagaaagggccgucacugaggcgagaguucaaggacagaacacaagcuugcaacagcaagaaacagcacaggucucuggucccugcaugggagaggcggaguaaaggucagcauacguucccagucagccugggcugcacagugaacacagcgagaccccaucucaaaauaaagcagaaagcaccugguaagaucuaaagaaaaaaaaaucagcuuguaguuccauuuacaacguuacuaugucugcguaguuccacauaaaacaauucaauaugggugcgauggcagcacggccuccagcaguagcagcuggcaacugggaugaauguaauuuauaaacagaagugagaacggcugaggcugugaccccgucaggacagacagcaaccaggaggagagggcagcaggaacagggccuccagcacagcucagugugagaagggaaaggcagagaacaaagccugggccaggcaaaggugcuaagacaccauuucaaaaggaagaaauguggccccucaacaaaugcugcucacagcaggagcgaggugagaucagaaaacugucugagagguggcagcguggggucauggguggccuuggaaagcacaguuucaggacagaggaggauacaaugagauugaaauggauuaaacaaagaaugacgcaagaaucuccugggaucagcuucugaagggaaaaccaggcaugguagcauacaccugcagucccagcacuuagaagcagaggcagacaggcuaggaauccaaggcaccucgccuauagaguggguuuguagccagccuggccuagagacccugucuuaaaacaacaacagaacccagaauaaguuguaagggaacacaacaaauagcaaaauggccagagggaccugggaaggagaguguggccuucagaaaggaaagggcgugggggcuauuaugcauguuugaaugcugacaaggaugaccucacagggagacuauacuaagacggugaaacaguaugaguaugugugagccaaaagcagaacagaagggcuagccucagccaggaggacuucaccacacauagaagccccgcaacuauccaagccagccaaacugaucugacuucuccuccuccacagcgcucugccuggugagaggcuugcuaugccaagacuuacccgcuccaccuuguccuucgucguccagggcucaaauggacucagcccaaagaguuugccaauccagcugcaauggaaguacauacggcgugugugagaggcgucugggcuggguuucagccuacuggacccccaggaaaagaggggcugcuguaagcgagaacuugcuaaguuugucauuguuuucugagaaaauaacaacuuccuggcucuacuaccuguuguggagacagaucuaacucacccucccugccuccuuuuccuggauuuuuaaaucagcgacucaagucacuagguggcugauagugacuuugaacuccuaauccuucugccucucaaaagcuagcaugugccgccaugccuaucagcuacagcuuuggggagaggggaagaugcuaggaaaaacuauagaccucacagagcuaggcaaggacucaaccacugugcagcacugucacagcccuccaccuaaagcuuuguaaaaaagauugauucuuuuuuguuuguuuguuuguuuuuuuguuuuucgagacaggguuucucuguauagcccuggcuguccuggaacucuuuggauaagaggccaagaaucaccuagccugauugcucuguaacaguucuagauacuggauauagggguaugaacaacauguuuacgucuccccuuccuaggcgagaacuauagcucagccauggaaugccugucuaacuuguaagaggcucgaucgcuucucagccuuuuggcuaagaucaaguguaagaggcucggggucugaucuagugccacaaacaaacaaaaucuguaaaaaggucgggugcagugugugguccacacuugugauuucagaacgggcagggaagggggugagggugggggcaggagcauuguuuuaaauucaaagacagcugcgucuacacagcaaguuccaagcuagcaugguacaugcagccaguuccaggccauucagggcuacucagaguaaaacacacaaaacuacuuuuccuuucggcuucucuccagugucuugaaagcccugcacucaguaguccugaucuccggcacacccuugaguggggacagucuuccagggccuuccccgcuguuccucuguccacacuccaccccugucuauuacauaagucacagggaguguuaaacgaguggaagaaaggccacugaaggagaacgcuuucaauaaacaaccuccaucaugucaccauguugugcuguggguuguguuaagguuuuuuguuuuuuguuuguuuuguuuuuuuuggugcuggggauugaagauagggcuuugagugugcuaagcacacacaacugagcuacacaccuacugccuaaaaaccacaagcugugaaauguuugcucugguaucuuaggugccuagagcacugccugaaaaauggaaggcagcugaaaaauggggacugacuaaguucaggacuucacacuucccaggcaaggguuuugcaacugagcuacuaugcccaguagguacaaaauuuuaguccccauagggaagaagugaagugaagugaagugaagugaagugaagugaagugaagugaaggaaggaagugggcuagaaagaugcucuuccagagauccugaguucaaaucccagcaaccacaugguggcucacaaccaucuguaaugagaucugaugcccucuucuggugcgucugaagacagcuacaguguacuuagaaauaauaauaaguaaaucuuuaggccagagugagcagggccaaccagugggagcaaccuucauucccagcaaucacauaaugccucacaaccaucaguacagcuacaguguacucaucuacauaaaacaaacaaagucaaucuuaaaaaaagaaggaagggaggaaggaaaggacacagggccagguagagguuuaggucagcuuucucuuccccaauuacaccgaagacugccuuaaucaaagaagggaaccuugccccauagugagcagcuggaaagaaaggaaaggagagcuggcuguuccucauaccagcuuccaagcaagacacuucuccaaauuaaagcccacgguacuuacuguugcuuauuucuauaagauggugaagacccaacccagagcuucagacugcacaaaugcccugccucuacacagaccccaacugagucuaggguuuuaaauucaaucucagagucaccuaagaaugaccuaagagccgggcgugguggcgcacgccuauuuaaucccagcacuugggaggcagaggcaggcggauuucugaguucgaggccagccuggucuacagagugaguuccaggacagccagggcuacacagaaaaacccugcuuugaaaaacaaaacaacaacaacaaaaagaaugaccuaaggaagaccuaagaagaagguuuguuuaaggucauccuugcucguuaaggccacauacaguuccuuucuuggccagcauuauagcaucaggaguaucgucauuacaagugugaagauggccuucucuaaaggaagcaggauccugcuaacugggaaggaauuagaauaguaucuccaaucagcccucccguggguggguaugcacgaacagcaccguacuuaccuauacacaaauaguggcaaaggguaagggaugaagguccgaugggucaugccaaagauguacuucaccaaguggaagagcagguaccgguuuggccuggaagcccaaacagaguucuucucaucauuugugcccuacauuucuuuuuaaauaauuaacacuuuucuuaugaaaaaggaaacccacuguaacaaacacagauuaacaaagaaaaagcaccuguuaaccaagugccagagaaccuguuuuccauccccuccccucccucuuccaugugcugauaauguacccuguucaucgcucuguuccuuuugggaagggcucucacuguagucccagcuggccucuaacacaggaaucuucuugucucagccugagucaccuggcuuggccaguauuucuuauaugggguuaguuuuucuucaaguguuuuuggucauuuacaacuuucuuuccucugacaguuucugucccuuacaaugacaaacaccaaccccaucaucugaaaugugacccuuucuacuucgacagccuccguuuaucugcaaccaggcuuuaauaauuaaucaucacuuacaugucaacaucuaucauaacugagagcauaaugaagauaauucacuacaaaccucaucuuaccaacaaaaaaacacaacaaaaggcucaccguucaaauagaaauauugguaucagcuggggaaauaucacacaaaccccucaagcugccuuuaacucugcaaaggguuuucaaggaugucugguuuguccuacaggggcaacacuagcccaagcucccugugugugggcgccuccucagaaggcuccacagcaacacaucccaguaagaguggccagacuaagcggagcccuggcucacagagaaagggccacuggagacuucaucuucccagccugcaucucaugguucacugugagaaucauugucaacagacauccucagcgagccugccucugagacuuucuccacuacacuugucagccagaccccuacagagguuaaagugaauaccugccuucucuagagaauaaacaaacaaacaaacaacaacaaggauuuaaaacaaaacaaaacacacguaccagcaagagagaaaccaccugagcuaacugaccuuaccucccuucucuggucagugauuucaaacgauauucucaggucugcuugcccguucuuuuaugcucuuugaauucuccccgggaacugacucaucugucuucucugaccacuguuuuguggcaagccauccuuggugauggcugauacucugcucaugcuccagugaagagacaccuuggugucucauaacugacuacaucuggacauacccucaacucguccauuaagauagaagaaaugcuuguuuguaugguggcuaagcccuccacuugcacuuuuuuacaacuguucuccauucucaaugaccauuccucugacuacgcugucccuggaaacauuaacagucaucccuucacucauugcucagaagaacauccuguuaucaucuaaacccuggugggaccucuccugcuguggaauccucucccagaaccaaccccccuaauauguaucuuaucacaaugcaugucacagugagcauggggggggggguggggguuaggacaaacuacaggagugaaguugacuccuuccaccacacaguuucaggccaaacuccagcagucaggcuuagugccaagugcccuuaccccauaagccauccugccagcucuccgaccaucuccuaaucaccuuuucacugcuucuccuuagagcuggcugcccacugccuccgaguccuaugcuuccagugagauucuaccacaagccaacacuggcccuugucucagagguuacuaagguccagagagagcagaggucaccacgcugucacucuccuuuacagcauccagugucacugucccuuccucuccuccaggcucugcuucacugggccaugcuuuuggggaauuuaugcuauauggcuuuauuacacacaggugucaaaacuaaucuaccagcuccacaaaaacagaaaccuugucuggaucauucaguaucauggaagauuuuacaccguauaaaauccaccuauuucaaauuauaagucagcauuuucauguauaagguuguauacccaucagcauaaucuaaccuuaggaugucuuucuuaaccuccaccuucaugcccauuauguuaaccuggcucuguaaagacugcccuugaacuccugacucucuagagugcuagcauuguaagugcaucacuaugccuaccuuacauucgcaccagcaccaauaugcaagauuuccuguuuuuuccacaucgucacgaucauuuauuaucucucugugauaugcucccucuuugugacuacaaaagacuucaaccaucuuaguauguauuuuaacauucauauugccuuccucacugacaguucuguuuuuaauauaaugucuacuugccggcauguaccucuucacaccacgugcauuucugcugcgaagaggccagaagagggucuggaucccuaggacuggagguacagguggcugggagccaucauaagugcuagaacucaaacucagcucuccgggaggaaugugcucuucgccacugagccaucuagccaggccugcuccuuucacuuuuaaaugguaucauuugaaaugcauaaguuucaaauucaggugagucaagcuuaauuuuuuuuccuuuuauggauuaugcaucugaugacacagcuaaaaacaucuuguuaaacccugaucuagaauuguucuacuccaaguauuuauaacuccaagcuugcauuuauuucuuuucuucacauacagcaggaggcagaaauccaaguccugaguuuccagagagucauuuguugaaaagacugcccuguccccacucaggugccucguuugucaacagucaaucguccagaacuaugguuuggagcugggcauaguggggaguuagagucccagcugggcauaguggggaguuagaaucccagcugggcauaguggggaguuagaaucccagcugggcauaguggggaguuagaaucccagcugagcacaggagcuggaguaaacuagccuugacuacacaguggggccuagagcagccuggcuaccuagguggcaagacccugucacaagcaagcaaagguuuguuucccgacugcugguucugguuaacugaucugccuauaagaucagcacaaauugucuuguuccucagagcuucagagcaggcuuuauaauugggaaagucaggaguuuaggcuauuaccacuuuauauugucuuuguaauaccauuuaaauguaguuuaucaauuccuacaaaaggcugcugggauuuugacaagauucagucuacagaccaauuuaaggacaacugccauuuuaacaauauugguauuuccaauucaugaauuuggaaggucuuguauguauucuuuauuuuccuuucacagugcuuuuauggugcacaucuuacuaaauuucccuaaguauucuauuuuuuaugcuacugugaaaugcuuuccuuugguuuguguacaguguggguggauacacuugccuguggguggagcugcaguacauguguggaggccagaccuccucuauaacucgacaccuaauuuuuugaagcagagucugucacugaaccuggagcucacagacugagcuggcuggcuaaugagccccgggauccuccugacuccccagagcuggggucacgggccugcuuggcuuuuucuuuuucuuuuuacuugugugucuggagaucaacucaggucuugcuucuugcuagcaaacucuuaacgggcugagcuauuuccccggccuguaacaucugcuuaauucuaucuguauauugcuuacuugauaguacauaaaaauugauuuuuauauugaucuacuuugugucuuuacugaacuuguuuauuaacuuucaaucauggauacuugagugagugugcguguguguguguguguguguguguguguguguguguguguguguguuuuauagguccuuaacugauggaugacagaauaaagcaaugugauuaauacuacccgauacuugggaggagcgggagagcuggcucaguugguaaaguguuugccgcacaagcaugaccugaaaucagaucccuagcacccaugucaaauagaagcuggcccagcagaacacacccgcgaugccgggagguagacgagcagauccuggggcuuaucacgcagacagucuagcucaaucagugagcuugucgugcagacagucuagcucaaucccggggcuugucuugcagacagucuagcucaaucccggggcuugucgugcagacagucuagcucaaucaaucagugagcuugucgugcagacagucuagcucaaucccggggcuugucacgcagacagucaagcucaaucagugagcuugggaauuaaaaaggcacauccccagcgcagacaccuuccccuuccgugaguucuguuuuacuguuuugaaggcugggucucacugcaugcucagggugcccucacgcccaugauguaccucaggucggucguaaacaugugcugcuccuucugucucagcuucccaaaugcuagcauuacaggugagagucaccaugccugcauuccuugaacaguucaucaaaaaguggaauccccagacaggagcccacaggccaagugcugacugcuuauagugguguagggcagugguucucagacugcuaacagaaucaugagcacucaggcagguccuggguucccucaacugcugaaugugagugccagaagcuccacuucccugaaugaccuccucaggaagaacuguuguuauaagcuaccaucuucuuuccacaaaagucaacucuaggcacuuacccagugaaggcaaagguuuuuccuacggcaucuggauccuuagucgcauuaacaauccccuuggaaacaucugcaaccuauacaaaucauaagacauguuuaggcaguuccugaacugggacaucagaccuggagaacauggccucuaacaucaguuaccuaggaagaugaggugacaaaauuuaagaaaaggccagcuggguuacacucugaguucaaggcuagcuugaguaacuugguacaaccugucuugauuucuuuaaaucgggguggugguacugaggugagaauguagccuagacagaguguuugccugacauucauguugugcugcguucaaccccaggaccaaacacaaauaggcaaacaaacguuuaaagagagauggaaagggaggaagagaaagagaggaaggaaagcaggugccugucucaggggaugcaacagaaaaaaaaugacauccucucuucuuggacucugugcuaugcaggaguucgcacaaacagguucaaggcucaaucagguacuguccuagucagaagucucaucuaguuaccccaaggccuugaccuggccaggccaucagcuucccaugccaucucuuaggcuuguguccacucuguccuaagccaccagaucuagagacugaaccauacagagcugcucauguucugccauucuggcuuucacaguaggaacugugcacagguuuagaacaagagacacagaauccacaaccaguguuauuuacaguucuagggaacaucuaacaacuguacggaauuuuaguucucauggaggagcagguguggcugucucugguacccacugacuaaaggacagaguggcugcucugucccacaaugaagaacugaagaauuaucuggucccaaacaucaguagugucacuucuagcaaacuguuaguuuuuaugucaacuuggcacaggguagccuugucuggaaagaaggaauuguaauugaaaagugucuccauaaacuggucuguagacaaaucuguaaggcauuuacuugauugaagaugaugugagaagacccagccuacucuggguggugccaccaguggccagguggugcugagguauguguaaaagcaggcuaaggcaagccauagagagcaagcaguaagcagcgcaccuccaugaacugagguacucagcaucagcuccugacuacagacuccugcccucgcuucccugagugaugaacuuauacacuauuaaguaaaauaaacccuuucuugcccaacuuucuuuuggucaugguguucugucacagcaauagaaauccuaacuaagccagaaacacuggucuaacccagccacccaguagagaaccaaaccuccuccuuuaccucugggccccaguauguacaucaccucuaugugaaacagagccccaugccuaucaacugacugugaaucgcccaaagcuggauuucguggccucugauaugaucacuuaaaauucucucccucuccuagaauuuuaucacguugaauaauaacugucauuuaccuaaaaagaacuugaggacaaaaaugucugucuggcugguuauccucuauguauguccaguaacacagugucagaacacuguacaccccgagacgugcuuaagcauuuacugacuuaaggcaucagagcagccgaacaggccgguaaccuugguuaccucagaagaugaggcugagguaucaaguugaagcucugguugggauacacauugaguucaaggcuugcuugggcaacucaguaaaccugccucaauuaagcuuucauaaguggacggacaacugaagacacugagaaaacauccaccucuuagguaaacugaggcaaccaguuaaagcagguugacaaaggaaagaaugaagucugugggugauaacgaauccagccacaccccuuccuaagccugcaugcaagguacuuacauacaccggcugcuucacugucuuaaagcccaaagaaacaagaggcacagcaagaaaccaacgauaaucuggaagaagaaaugagaaccuguucugagaaugucuacauaauguuuacaaugaaaauaauggaacaaauacagcagacucucgggggucuggacucaagaaauaaguaaguaaaaagggagcuggguugaaauggcucauaaaucaacagaagacagacagacagacagacaggcaaaagggacuggguugugaugcucuaaauaaacggauaaauaggggguggguuguaaugacgcacacuuugaucccagcacuugggaagcagagacagaaucucugcguuccaggccagccuaguccacgcaguguuaccucccuguuccagcaaaggguuuggggugcuuccugaguaugaugcaaagugacagcugccucaccuuccauaccuuccccaccacaguggacuguagucccacaaaaugccagccaaacuaaccccucagguccagcuucuuccuguccacaucucuccagugcccuccaagcuccuuuccccugcccacugcacagcccagugcugccucuaccuccuccaguauugggucagcauuugaccucuccagacacaggucugccucagucuguucagccaugugucagcaggccauggugagccccucuuuauggcuuguaauggccaucuucuuccuguguccacagaugccuacuucagugugugcacacgaagacucucucuccuuguaaggccaccaacccaggucaucaacuaguuccuagcccuuacaaggucagggagccucaaugaccuccacaucccuuuguccacacaucaggaguuaaauugucaacauaaaaagaacuagcaggugaaaaacucucuauuauauauuguauaucauaauuuaaaaacaaaguggaaauuaauacagauuucuagauggcacaaucaagagggagauacaaggaaaugccaaaacugcaugaacacauggguacagccaaacaaaggaauacuauucagcuacucuuaggaaauaagucccuaagagucagacaaauccugaaugcauacaagggaaagaagucaauuuggaaaaugauacaauucccaagccaguaaaaagaucagugguuugcagguguccaggauggcauagggaagggcguguagaacucaaggaccuugcuacuaccuugccaaggucacuggcucacugcgguuuaaacuuggaaauccaugcucugggaaaagcaugaccacugccugcagcagcugcagggaagucgaacuucacagucucccccagcccccaaauccccgacacacauuuaacuggaccgucaucgcccagaagcagaaaggacucuugcuggugaugaaaauaaacccugaaguagagaggcaaccgaacaggaauuaggcucugucugggaccuccagggcacugcccacugaugcucagcucacacuggguuaggccgccagcaggucucucuuuccggaagaaagauauugcgggccucccucucuuccaggaagaaagacacagcaggccucccugucuucccggaagaaauauacagcgggccucccucucuuccuugaagaaagauacugcgggccucccucucuuccgggaagaaagacacagcagggccucccugucuucccggaagaaauauacagcgggccucccucucuuccaggaagaaagauacagcgggccucccucucuucccggaagaaauauacguacuugcaaagugauuaaggaaccuguccucccuuccgaaaaugucagacggccguaugaugauggcuucaggaaacacacuucucacuuccuucucucccacugccuaaaccaaaaauaaagcauucucgguuccacagcgagugcacaggacucccugccgccccuccccaucacacacugcucacaucaccaaggcccgaaguucauucgguaaccacaauuucagaagauaaucauauuagucacaaaacacacacacacacacaaacacaagaacaagcaaacaccccacacccagaacuucugcugagguucuuuguugcaggauauuugaucacacuaugaacccgagaucacauacuggaaaaaccugucucuaguugugguguagcucagccuuagcacacaccuuuaaucucagaguguugcugaauauuugauuacauuaugagauucugugcuggaaaaaccuguuucuaggaacgguuuggcucagcccugccacaccuuuaaucuaagaguguucuguugauuguaaacaggauuaaauaaagucaacuauacaagaggaggagcaagcgaccaggugacaggaagugaaacgaccacagagacugagaggaagucaggaggacggcuagagagacucucaggaaguauacuucuggagagacauucgguuugacggguuacuaagacaguguggagaaggggcuuguuccuucugggaugacggcugaggaggagggucauuugagggcuuuuucugccucucuaagcuagcaggcuuucaccccggcaucugucucucccgucuucaguuaguaaaaucacacgacugagauuuuguuuuaaaaacaacaguucuuccuauucuuaugcuagggaacccacaaugacggggaaacuggauuaugguguuuccagccuccacguucuuccuccuauuugcagauucucugcuuugugucaguaagcuagcagccuaccacaggagucaaugagguggcaguggcagcagccuccuucacggucuacgaaaucugccuccuccucuucaccaacuccuucucucaauguaaacaagggagagccuccacccuuuaaaauacaaauucagcuucacuacaagcucuuccugcuccugccuccucucgcccucuccuagaaagcuaaagaaaacuggguccacccugcugcacuaccaccaagcgccagcucacauucacucacuuugacucuggauuauguuucaacaacuacaguaccugaucugaaacucuuuuugguaagaucaacaaugucaacagaucugacacugcgguucucuuggcugugucccgccccgauacugguuucccuaacacugaucucuuucagcuuccugacagauacaccacugcucgguccuggccaacuuuggaaucugcaaguaucccuccucuaccacacuggaagcauuugcaugccucugucacauucagagcucucuucucagucaaccuguuugcucccuaggccguccauaccuuccuguucuuccgauuaacagauucuguugacucucaacuucuaucuccagcacagaucucucuucugaacuccagggucaucaacccuggacaacugggacaauacugaaacccaagaucaacacugggccaccuugcauucucucaaguaaaacagugccucuuacucugugcugaguuuggaaaagccuaaagagagcagagugaacacaacauuggcaaauuaucaugugcucuuaagccugcuaagaagcuggcucuaaagcagggcugaucuccgcccauugagauacgagaagguugaugucaaguuuuuuucaaaaaccccauccagugucaggcuggacccuugguucucuaaugggaaaugcuaaagguguaaaagcauugagucccuaagaacgcuggaggauaaagcauuucccaccuagauacuucugcucuucucaugguauacaaauggccugcagugugaugagcaacuggaagcucaaccacagaguacucucugcucuggcuggaacuccagugggaguuggcaaggacccccagucauuucugcuggagaccacgagagcucaacaaugaugcuaucugcagcuguuuguccuuguacuuaaaagccuccauugagggauaugcuacuccauccggggcucaggggugaucaggaaucccagcugucucggcagggugcccuggcuugauguuccucuugcuucucucuccuuugggcugucccacucucccagcuggacucugugugcacugaucagaugacauuggccucucucuaccugcugcuucccucuguccacuaacugcuauuuacucuuguacuuuuacuucuguaugcuuaauauacucacucauuuaaacaaaaaacacagcuucacauaucauucgauaaaucauacaaaaaaauaauuaaaaaaauacugacacccaaaucccaccuucaaagauucuacuugauuuggucuaggguacagacuaggcuuuggaguucuaaagucucagugauucuaauauguaagaaaagcuaagaaucacuggccuaaggccuagccccacuuaaguauuccuaucuuacccaacgguaucaagacacacacagacacacacacucacagcggcuggccagcauugcucucucuccuccucaacacaauaugccugcccccuuacagcaaccaugacauccaggugacucagugcauucuaaagaagccaugcuggguucacucuuacugucuucuucuccaauauaauaucuggauguguggcuggcuaugcuggaagccaguccugugacucugggaggaaggcaggccugaaaacggucccugaaacaagcuauaugcuugacaaaugaugacaucaaucauagcgaagauucccuagugcugauuuuagauaugugagccuauacauuuucuuuauguuuacauccaauuuuccuuuaaaaaaacuauuauuuuuaaauuucuguguauauguguauguuuauagagucaggguuuaugcaaaugaguacagugcccagggaggccagaagauguuauuagaccccuuuggaacuggaguuacaggcaguggugagccaucuaaugggaacucagauccucugcaaguacaguccacacuuuuaacugccuggcaaucucuacaaccccuuacauucaguucccugauguuggcaauuaaauguuacuagcuacagguacugcucaucugcaccaucccacuaucccugcuccuuugggacauuuugcuccucugcaaugcuucauggagcugggauccuuuuccuugguagacuagaaacuuaacguaggcuagggucaggucuguuugauaaacaauuguaugcucaguauccaacauaauuuauaacauacaacuguugcuuaauaguuuucucaauaaacacaugcaaggggucaaagacccaacgucaucaucaggaacucugcuguccuuaccaggaugacucaagacaacuucacuguggcugaagaaaugcugaugaguagacccagacacuaaugagccuggacaaagauacuuuagguccuagauguacucggagccacaguggucaauuccagacuccaguggaguuugcaggaggaaaagaugaacuaugcaaagagcauugucacuagcucuuucuaucauucccagccuucgcauugccuaggugggucuggcagaaaccugugacuacagaaggcuugggaaggaaagaggguccuguaaucauggugggugacacagacaugucuccucuggcaggaaucaagcucugcauuuccugguguuuccugugcaccucuuaucacaucuccccacaaccuuaaacaucuggaggcaggggauaugaucuauccauauuugaaacccuucaacagaccacucaaacacaauguccgaacaugugugcagaggcuggagccuuggaucagggauaaagcacuugucuaugaaggccaaagcccuguguucagugcccaacaucaaaaacaaaacaaaucaaaaccacaauacuaguacaccuauucuggaaggacaaagaaaaacuauuugacuucucaacacaagguggagaaaaaguccccccaccacccucaccaaucccuggucaaguucuaaagagcuuucccagcccuguggagcacccgugaguccucacacuaaccuugcuucccgcccuguggagcaccugcugagucccugguacuaaccuugcuccucaaggacuuagaagaacucuucauacuggcauucaggugugaaacaugaaugaaucucucaaccccagcuuccuuggaugccugagcuauugcucgaggaauauucacaaaaacauccucaaaaucaaaguuucuggaagaaaaaggggguggggggaaagcaguaaagaauucaggaagauucaugauuucagaguguuuuguguuuucaugacaguacuagaauuuauaacaguuaacuuuuuaaauaguaaugccuuaacucuaagccaaaaguaauuuuuccuaaggcuuccgggccuacucauugucaauacaguuaguuuaaagcuuacuccaaaaaaaaaaaaaaaaaaucaguuacggcagggccugguggcgcagaccuauaaugcugcuuacucgggaagcugagacagggggcucacaaguucaaagccagcauaaaaaguucuuuauguucucaaggaaucgugugaccaagacacuucaagaaaaccugacuauucuggcuagagggaagcagagaaguauuggggcuggaaagggucucauggaacucuguucccugaaagugaaaaaaaaaaaaaaaaucaguuacagcagggccugguggcgcagaucuauaaugcugcuuacuugggaagcugagacagggggcucacaaguucaaagccagccugggcuacagagugagccuaagaccaaaugugcaaaugggcaacuuagugagaccuuagcucaaaauuaagaaaugugggacuaggguuauagcucagugguagaacaacacgccugacaugaguaaggcccuaaguucagucuucaaaaugggaaagaagaaaggagggaggaagggaggcagagagggaggcagggugcaaacgagcuuaaccgcaguuaaagccugacauuagguaaaugauuaagccauuguguuagucccuacaggggacagaaagcugaaaaggaaccuguaagucaucaaagauuuuaaugaaauaggguuacuaaaauaaaucuaaucagacauuuaauaaaugcuaaaggagaaaaagguguaaacaaagggcuguggaaauuuaagcuagacauuacuuauguaggucaguguggcagccauaucugugauuacagcaccugcaagguggaggcaggagaacuguaagucuaauagggccacccugggauacauaagacccgaucucaaaagauaauaaaaaaaaaaccuugaaaauaacaauacaucauuauuaauaauccccauaaaaacuaaacaacacucaaaucaguacuuacaccaucuucaacuauguggagcggcaauucaaaacacuagugaacaguggggcaagcaaauccuacauccuagcuccaccccacaugacagguucaagcagagccaacacuggucacugccaaauccacagccccaaccacacugccaugauguaucauaccgcuaacauccucuacgcugugccaaugaaccuacuuacccacuacugggggcugaccaaaaugacacugaaacuuaaccccuagcaccagaagaucccuguaaaugccgagaacgcuagugcucagcagccaaggcaggagacugggacuuaccugguuucccacucccgcccaauaagauugaugaccacguugcugugcugcacugcuuuccugauagaaucuuugucucgugcaucccauuccuacaacagcagagaccaacagagucaaacagacggcacacacucagcacuuagggcaccuuucacaagagucaccugcucacucucccccacucccccgagacaaggaagucaaagugcaugucacucaugacaccaaaugcuaggaaagaggcaggucauguuuaacggcauacauuaagugggucauccuuggucuucuggggcccaagcucacauccagcucacuaagcagccacugauggaggugcaguaauucuguccccaguguauaaagaagcaagugugacgugggaggugggcaaagcucacaggcaaucaaucaccgguggagacaaccaaaaggaacagaucccacuagggaacucagggcuagcuccugaguucucuucaauucuuucccuuauuuauuuacuuacuuacuuacuuacuuauuaucauuaauuguagcacuaagaaucuaacccaggucuucaagcauguacgacaagcauuuuacugacugcacuacaucuccagccccuaauaaucuacaaugucagcucuguuuuaaagacacaaaaccaagaauugaagaaacgcagagaugaaaacuuccaggucuuguuguuacugcugcuuuccauaggcucucacguagccaggcuaacccugaaugcuuccaccuguccgugugucaccaagccuggcuccuguuuguuaaggcagagccucacuccauccugaauagccuaguaugcacaguguacuccaaguugaccucaaaaucacaagaauccuccugucucagauucccaagugcugggacugcaggaaugagccauuacaucugggacaauuuucauuuuaguacagaaaauucuguucuucucucgcugagauuacuuaauuuauagucacacugcaaaaguuuaugaguugagcugaaauccuacaugauuuauaaucagcucaccauucacuggucaaccaaagggcccauacaauuuaaccaugcccuugcaggcuucucuuuaguucucugggaaccccuggccugagaagccuagaaaaggaagaaaaacaagggggcggggggggggggggacugaugcucucuucuggagugucugaagacagauacaguguacacauaaaauaaauaaauaagaaaaauaagagggacugcugagagaggucugugcacagcuaaguucauaccaacuaagccaaguucuuagacuuccuccuugugauucugucuguaaaaucaccuuagaauccuaccacaaggcacacauauaauccuaaauguacuuuugguaucuuccacuaucuacaauuaaaagaguaaacacaaaaucaagacaaguuuauguucauauuuuauuucucccaauauaucaaaaauauuucaauauauaauaacuauagacaaaaacauuagcauacuaauaugauuuuuuuuuuuuuuuuuuuuuuuugguuuuucugagacaggguuucucuguauagcccuggcuguccuggaacucacuuuguagaccaggcuggcuucgaacucagaaauccgccugccucugccucccgagugcugggauuaaaggcguguaccaccacgccuggccuaauaugauuuuuaaugcagucuuuggaaucaguauuuuuuucuuauaauauaucucaauucagacuagccacaauucaagugcucuacagcuacacauggcuaaugucuaccauuagacaugaugcacaugucuagaggagggguuaguagacuagagcagagccuauguauggccauaucuggccuacaaucuauaaaguacuauuggagcacugccacauccauucccucacauacugucuacgacugcuuuagggccauaggauagagcucagcagcucugacaaagauucuauaaucugaaaauuguaaauaaucauuaucugcugcuuuauaaaaaagguuugccgacaagcagaguaggaccugcaagcuaaaacaagaggaugcacuuggcccacucugggguuaaacuauugcuucauuacaccuccucucauccccaacaaugaccucagaaauuacauuaacaucagaaagucuuaccagaaagguaagcuggcccaggucacccaucagacgaaggugcaugaugucauauacaucacaccgauaugguaugaucacuugugaccccauucguccuaaaagauggagugaaccaagaucaacaucaauauggcuaugucacacaacagugacuuagacaacauuaaauuccaauaugauagauggauuaacuuaaugcuuaaaacaaaguauauucugacacacuaacgaugccauaaccucacauauuauuucccauauacuuauuuauucccaaaauaaacuuauucauucccauaauaauauuauauagaggaagcaugaauguccucacaaugccaaggcagauaaaauuuauauaaaucuaagauagaaguaacuuguaauauccuuaaaacaaaagcacauggcuugcagucucaagucagacaauccuaguccaaggcaugaagcacacugaacuaaaagcacuugacuuaccaaggugguuaacaacguaucgacccaggaauccuguagccccaaacacaguggccacaacuccacugacagaugagcggccuccuuucccgugagguaugacagcauggugaagcuggcgaugggaugagccacagaacacagaaguggcugcugcaguaauggcaggaccuucagggaaacaccagaggcagcaaacauggcacauguuagcauaaaagguuccuaggaacuuguaccuuagggauuuaagucccgacaauauuaaacauaaauuacuauagcauaaaauccagaguaauuauauaaaguuagaaagcaaaucccauguccuaucaagccacauuaucacaagaaagaauuucugaguaaagugucuggguaaaguauuuugagaaagguuuuaaagaggaacaaccaagaguagaaucccacaagacacacagaacaugcacaacuaaauagaaguaagaaugaguaagacuggaguugaguaacagcaagaaaaucuggacaugacugaaguuugauggcaagugaguugagguaaugaugugguuggggcagaagacuauuggcaucucaagaggaaaacaggaagaaaaaaaugcugggagcuggcuuggcugguagggggccugcuaugaaagcaggaagacugagugugaauuccugacacuugcauaaaaagaggaaaaaaaaggaaaaaaaaagaaaagagaaaagaaaaggaagaaaaagaaaagagaaaagaggaaagacaacagaaaagaaaagaaaagaaaagaaaagaaaagaaaagaaaagaaaagaaaagaaaagaaaaggggaggaaggaaaaagaaaaggaaaagccacccaagcacaauggcugccaugccuuuauaaccccaguaacucacuaucuccuauagagaggcugagagaaguggauuccuaaagcuugcugccaagacaacauagccaacucagugacuuccaaguucagugagagauucugucucaaaucgauaaguaauagauagauacacagacagacagauaggguggagagugauuaaggaagaaagcagauauugaccccugaccuucaugugcacacauauucacaugugcccaaacacaaauauguacacaugccaggggccuuccccagcauagggggucauggcuggcagggcugccugcagaagaaagaaggaugggcaaggggugugugugugugugcgcgcacgcgcgcacgcacucgggugcgggcucaaagcuggcuggcugacugacugacugacugacugacugacuugcaaucaagccguuccugcugcucugacugacuaccaaccgggugcuucuuuauuuauacaagucucacagaacaaaggcggacuagugauuaucuaagugguacagaauauguuugacuuuucauuacauguccaggguuacaguuuaguuacaauuagaaaauacugggaugggauaggaggguuccgaaggggaaauggggaaggggauaacauuugaaauguaaaugcacaaaauaucuaauuuuaaaaaaagaaaagaaaaagaaaauacaaacagaacaucuuuuauuguuaucagccccauaacucugacuuaacaaaucuaaagaauguccccaccagggcuggcuagaugacucagugguuaagagcagugacugcucuuccagagguccugaguucaauucccaguaaccacaugguggcucacaaccaccuguaaaggaauccaaugcccucuucuggugugucugaaggcagcuacaguguacucauauggaaggaaggaaggaaggaaggaaggaaggaaggaaggaaggaaggaagggagggagggagggagggagggagggagagagagggagggagagggagagagaaagagagagaagcaaacauguuuauuauaugacagccugcuuuuaggcuagcaauguucguaguuuuaaaauaugccagacaaacagaaaauaccugaaacgaucuuuuugugaauagaaaauacuaauaccuaacgucuauuaguauauguuuuaucaucuaugcuauaaaguaggaaaaguuuauuuuagucuaucuuauuuacuuaguuuuacuccuccagggcuguacccuguacaagccccuaucuuuaaacuacauuuucagagaacucuaagaauauaagaagaagagagcuugagucuguaaacuauucaccuggcccgucaguuuaucaacugucucuguuugcccugcaucaauuacaguuugaguuaucucaggggcagacaccccccaagcagguuccuggaguaauggccucaucuagcuaugugcuuaucugugcuuaaugauccccagggcauaaagaagacuucuaaaugguggccagucuuuuugggauuuuccuaaaaaggcucaggaaaugacauaaaacgaaucucaggaaaaugaaacaugauggagaaaguccccaaggaugcacuaugcagagaucaaaacccaaaaagcuagagauugaaggacagugauuguagcaaucugcucagcuuugcuggaacugugucaaacaacaaugcuggcaucaugagucuugccauuuccaguggauaugguugugccauacacauauauacucucuuacccuaaagaaauauccauacagaaaagaagaagauaaacagaaggaguacaguuuugaugucaaaaaacaacaaacaaaaaaacaccgaaaauggaucuuuagggaggggcuggugagaaugcaaaugaugcacuaagaagcagggcacccuggggcagcccuggccucaucuaaaacuguuaagagagugucguuauguaaucggguuacuccagaacucccuauguagcccuaacugccuuugaacccacaaugauccuccugccucugugucuuaagcacugagguuacaggugugagcuaccaugucuuucugucuuauaaaauccuacucuaaagcuccuuugauguucauuuacaguaaauaaaaaagacugggguacaggaacagcugacucccuaauuagcagcuguuggacuaucucuugcuauucugauuaucugagcagaagacuaucaaucagcccuaauggcagcaccagaaacccugaauaucaaucacauggaugccuuggggaaacuacaugaaccaagcagcccugacuccugaaagccccuccucggccaggucaccucaaacaguuugucccagauuuuuaugcuguuacaacccaauucuagaugacccuguacucauuucugagguuagagaacaugcacagagggccaacugugacugguacuaaagaggauaggcugugauugcuccaaauaucccuucucugccuaucuagcgagucucccgggagacccucuucugugcuguuuuucccuguaguguggcagagggccuaauaaaaaacuucuugggaauggccauguuuugucuacuuucaguagugugggcucaguuggggacaugaagaaagaagcaauggacauggcaaagaaguggugauggcuuuagcaauggcauaaggacaucugaccccagcuuagcgucuguuggaauuuccugcucccacuacccuaagaacaaaagcucuucuacguggucugacaugaagcgauuuugagaaugacuugacauucuguaacgaguuuuuuaaaaacacacuauggaaaacuguaagugaagcgggcauguuuguggcguggagaguggaagggccgugaacuguaacgacugaaugcuuugccucccuugaucugcaggugcaaaugcaugguuucgauuugagggcugugaacacauucaaucacgacagaagaguaaauaaacaacgcugacaaauucuaagcgguccuucacuuuucuuuccacccagcucccgacucuccacaaccaucucucgcugcugcagucccuaccgccacaaccugacaucuguggcgcggauucugauuuccagugcgaucaccaccaugaagucaaucgauguccugccguccaagcccccuuuccccuggauaaguacucucuuggaccgcaaccuuccccacaauccacgcacuaucucgaaccugucaguguccggguucuccucgucccucccagcuccuccagcucuccguccccuugccgagugcaguuucacacaugagccaagaguaugaggaagaaaggucauguucccgucgccgaaugcaaccccaagacccgguccccggugacacuuacgugacauuggaagcgcucuaacaacccgaaagcggacggcggccgccaucuucucccacaaugccucacggccggugcuuccgccaacuacg

SEQ ID NO: 3403 - RNA, 2803 nt, Mus musculus
cagaaccacaggacagagacccugaaagagcagccccacaggcacaugugcgcagagcugagccuagugaacguggcaggagcuaucucuccaccuagagauucagauaagagcuaagguaggagaccucugcacccccauuuucuuaugcuggaucgcugggcuauagcuauuucaguuuuaacuuuuuggucugguuuagggauucugacacagugucucacacuggaacuccuaggaacccacuauguagcccaggcugaccucaaacuuguaguacugcuucugucucagccucccaaguguugggacugcaguuauaacaucaugccuagacccauuagccuuuuuugcuccaauuauacucaacuaugcucaccacaaagccugaagccaaaccagucuuguuuaaggaaggaugaacaaggcagccccgugcaucacaaagcaccaaagcagauuccucugugcauggaccucaagcaggucccauccugugaccuccacaaagagcaacgcagagaggaccccaguguguuuacugccugcucuagggcauucugcaagccaaacccagagccugucugucuauuauauucauacuuucucaguugccaagguaagagcaaguguccgacaacggggcucacggccacggaaaggacaccauggagaugugucugcuuuuaaggcagucuaucagagggaugcuguucccugggacugguagcaauucuuugcuaugcuucggcucuuaggggaugguuuggcugcaucucaccaacagaaagaaaaucuacaguucucaggcugagaugcugucaugugcuuacuuggcaucuucccagugagauuugaguaugcaggaagcagauaaucaaugagucagacaagacuugagaaggaagagccagggcuuuagacucggcauacugcaggcagacaagauuggcagcaagaggcucacugagagaggaaagaggacuguugccuggguaacagcaggcagaggagagauaguuaugcgcucugccuuuaguauguagcaaaguuccaauauuacuagaagcauguuccuaaugaugaacaggaaggcaggaaugaggagugacccgaccuggcaucugcugagggcugcugucccuugaucaucuaacacagaagccauuuagucaagcauaauucaaaucucacuuucagugaaccaaaauuacauauagcucaaaucugaugucugcagucaugguagccauauaucaaguccuucccaucgcacacggcuccuggcaaugugcugggacagacgcagagcacccugagcacugcaggguggggcaaugauggcuuaggaaccaaaacugcaggggaucacuccaugucuuaacacggacagcacagaaagggccgucacugaggcgagaguucaaggacagaacacaagcuugcaacagcaagaaacagcacaggucucuggucccugcaugggagaggcggaguaaaggucagcauacguucccagucagccugggcugcacagugaacacagcgagaccccaucucaaaauaaagcagaaagcaccugguaagaucuaaagaaaaaaaaaucagcuuguaguuccauuuacaacguuacuaugucugcguaguuccacauaaaacaauucaauaugggugcgauggcagcacggccuccagcaguagcagcuggcaacugggaugaauguaauuuauaaacagaagugagaacggcugaggcugugaccccgucaggacagacagcaaccaggaggagagggcagcaggaacagggccuccagcacagcucagugugagaagggaaaggcagagaacaaagccugggccaggcaaaggugcuaagacaccauuucaaaaggaagaaauguggccccucaacaaaugcugcucacagcaggagcgaggugagaucagaaaacugucugagagguggcagcguggggucauggguggccuuggaaagcacaguuucaggacagaggaggauacaaugagauugaaauggauuaaacaaagaaugacgcaagaaucuccugggaucagcuucugaagggaaaaccaggcaugguagcauacaccugcagucccagcacuuagaagcagaggcagacaggcuaggaauccaaggcaccucgccuauagaguggguuuguagccagccuggccuagagacccugucuuaaaacaacaacagaacccagaauaaguuguaagggaacacaacaaauagcaaaauggccagagggaccugggaaggagaguguggccuucagaaaggaaagggcgugggggcuauuaugcauguuugaaugcugacaaggaugaccucacagggagacuauacuaagacggugaaacaguaugaguaugugugagccaaaagcagaacagaagggcuagccucagccaggaggacuucaccacacauagaagccccgcaacuauccaagccagccaaacugaucugacuucuccuccuccacagcgcucugccuggugagaggcuugcuaugccaagacuuacccgcuccaccuuguccuucgucguccagggcucaaauggacucagcccaaagaguuugccaauccagcugcaauggaaguacauacggcgugugugagaggcgucugggcuggguuucagccuacuggacccccaggaaaagaggggcugcuguaagcgagaacuugcuaaguuugucauuguuuucugagaaaauaacaacuuccuggcucuacuaccuguuguggagacagaucuaacuca

SEQ ID NO: 3404 - RNA, 2803 nt, Mus musculus
ugaguuagaucugucuccacaacagguaguagagccaggaaguuguuauuuucucagaaaacaaugacaaacuuagcaaguucucgcuuacagcagccccucuuuuccuggggguccaguaggcugaaacccagcccagacgccucucacacacgccguauguacuuccauugcagcuggauuggcaaacucuuugggcugaguccauuugagcccuggacgacgaaggacaagguggagcggguaagucuuggcauagcaagccucucaccaggcagagcgcuguggaggaggagaagucagaucaguuuggcuggcuuggauaguugcggggcuucuauguguggugaaguccuccuggcugaggcuagcccuucuguucugcuuuuggcucacacauacucauacuguuucaccgucuuaguauagucucccugugaggucauccuugucagcauucaaacaugcauaauagcccccacgcccuuuccuuucugaaggccacacucuccuucccaggucccucuggccauuuugcuauuuguuguguucccuuacaacuuauucuggguucuguuguuguuuuaagacagggucucuaggccaggcuggcuacaaacccacucuauaggcgaggugccuuggauuccuagccugucugccucugcuucuaagugcugggacugcagguguaugcuaccaugccugguuuucccuucagaagcugaucccaggagauucuugcgucauucuuuguuuaauccauuucaaucucauuguauccuccucuguccugaaacugugcuuuccaaggccacccaugaccccacgcugccaccucucagacaguuuucugaucucaccucgcuccugcugugagcagcauuuguugaggggccacauuucuuccuuuugaaauggugucuuagcaccuuugccuggcccaggcuuuguucucugccuuucccuucucacacugagcugugcuggaggcccuguuccugcugcccucuccuccugguugcugucuguccugacggggucacagccucagccguucucacuucuguuuauaaauuacauucaucccaguugccagcugcuacugcuggaggccgugcugccaucgcacccauauugaauuguuuuauguggaacuacgcagacauaguaacguuguaaauggaacuacaagcugauuuuuuuuucuuuagaucuuaccaggugcuuucugcuuuauuuugagauggggucucgcuguguucacugugcagcccaggcugacugggaacguaugcugaccuuuacuccgccucucccaugcagggaccagagaccugugcuguuucuugcuguugcaagcuuguguucuguccuugaacucucgccucagugacggcccuuucugugcuguccguguuaagacauggagugauccccugcaguuuugguuccuaagccaucauugccccacccugcagugcucagggugcucugcgucugucccagcacauugccaggagccgugugcgaugggaaggacuugauauauggcuaccaugacugcagacaucagauuugagcuauauguaauuuugguucacugaaagugagauuugaauuaugcuugacuaaauggcuucuguguuagaugaucaagggacagcagcccucagcagaugccaggucgggucacuccucauuccugccuuccuguucaucauuaggaacaugcuucuaguaauauuggaacuuugcuacauacuaaaggcagagcgcauaacuaucucuccucugccugcuguuacccaggcaacaguccucuuuccucucucagugagccucuugcugccaaucuugucugccugcaguaugccgagucuaaagcccuggcucuuccuucucaagucuugucugacucauugauuaucugcuuccugcauacucaaaucucacugggaagaugccaaguaagcacaugacagcaucucagccugagaacuguagauuuucuuucuguuggugagaugcagccaaaccauccccuaagagccgaagcauagcaaagaauugcuaccagucccagggaacagcaucccucugauagacugccuuaaaagcagacacaucuccaugguguccuuuccguggccgugagccccguugucggacacuugcucuuaccuuggcaacugagaaaguaugaauauaauagacagacaggcucuggguuuggcuugcagaaugcccuagagcaggcaguaaacacacugggguccucucugcguugcucuuuguggaggucacaggaugggaccugcuugagguccaugcacagaggaaucugcuuuggugcuuugugaugcacggggcugccuuguucauccuuccuuaaacaagacugguuuggcuucaggcuuuguggugagcauaguugaguauaauuggagcaaaaaaggcuaaugggucuaggcaugauguuauaacugcagucccaacacuugggaggcugagacagaagcaguacuacaaguuugaggucagccugggcuacauaguggguuccuaggaguuccagugugagacacugugucagaaucccuaaaccagaccaaaaaguuaaaacugaaauagcuauagcccagcgauccagcauaagaaaaugggggugcagaggucuccuaccuuagcucuuaucugaaucucuagguggagagauagcuccugccacguucacuaggcucagcucugcgcacaugugccuguggggcugcucuuucagggucucuguccugugguucug

SEQ ID NO: 3405 - RNA, 16542 nt, Mus musculus
cgucugguuuucggcgggaauugaaaccgccacagcugcuccccagcuccagagcacugcugcucuaggcagggcaccauggugcguccuaucaggugagugguuggugacgucccgcggggcagagaggaaggacggggacgaugggggccacugucaugcaugguugcgggagaggacgagauccgacagagggcagcgcgauugggugggugcucgucgccagucuccggugagagccacccgcugcucagaggagcccgccuggcaucucgcuugccgccccucggccuccuucugcagcugucgccccugagucaccccacuccagagggaccugguaggcuagcauuugagucgcgcuuaacgcgacagcgagcgaccgcguuaaguggcugucauacguugagcgauacagaaaaagcaggugugccuauucccucaaaucccuaggcagagaggcccauuuaacuuccagcucaagccguggugcccugucacaugacccccaguuccuaucugcuuuccuuuagacuguuggaaucucucugugaucacaaccgggaugccaggcuggccauccauuuaguagaaugacugaauauagcugagacuauggcccagugguccagugauugccuagcagaugagaggcccccagcuucaaaccccaguccugcaaaaccaaacaacaauaaacuuagugaauucuccuaggccuguauuguacuaagagcuggaggcuacacucuauuggaagagggguggggagagauaagggggaguaacaaaauaaacaccacaauguaacauaggaggaaggagaaaagccuuacuuuaaaucauaugaacgcguuaccuagguaaaauguaaggggcauucacaugaaauaggagccaaagcccaagguucaccauguuugagaagcagauugaaggugugggaugaacaagcauguggauggauugaggacugagucagauagauuacaaagcaguuguaaucuaucuaaaucuaucuaaagcagcuuguaggucuuaggaguuugaauuuuauuugagacaaaugggaaaucuguaguuucagugguggagggccugagauauucucauuucacuuuuauaaaggccaccggcuguugguuggcucugagggggacuggaguggccagagcgaaagcaggggggaggggggaauugagaugcuaucaguugugugugacuuuggcacugugugugugugugugugugugguguggagauggagcaaguaaguuuaggguuuuuuuuguuuuguuuuaagauuuauuuauaugaguacacuguagcuguucccagauacaccagaagggggcaucagaugguugugagccaccaugugguugcugggaauugaacucaggaccuuuagaagaguggucagugcucuuaaccacugagccaucucuccagcucaaguuuagguacuucugacaagugguuauagaggagagaaaacaaagaaucaagguugacugucucuauggacugagcuacgucucuguauugacugagaugggccccuuugagauaaugagguuuagaagacaggacuagauuucucuugcuuccauggugaaauuggaaggggacaggcaugcagauauugaagacauacugcuguuauuugggauaguaguagucacaguguuauccacaguccccugaauccucagaagccccaugagaucaugacuguggucugguuuuuguuguuauuuugugugguggggggggguuguuuuguaaauuauugugugaauaaaaggggugagaauggugguagacauacauugucuugauucagcagauaacugugggguccuuucucuucuuuccaccuuucauggauccuaggagucacaggagguugucaggguugcacagcgggugacuuuggccacugcaucucacuagcucauuacuuguguuacaguaaagccaaaccaguuguugucuucacucuucugucauuuacacugaauggggauuggcacaaacugaggcuguggugguuguaguccuugcaguuucuauugccgcauacucaaauauuuguuaaaaacagaagcccuugugggcuggcucaauaguuaaaagagugccugguguucuuccagaagacucaaguuccauuccuaaccacgucagacaguuuauagcucuugcagcuccuuccagcuccagggggcccccaguuuccuccccuagccuuugcagauacuguacuugugugcacauacccaaguuuuuaaaguucuuuuuaaaaguaaugguuuccugcguaucucacccuagugagccucuaaaauacaauauguaauuuguguuuaaugaaucgauaagaguccaugucuguuacaacucaaccugagauauacuugucuuuuuaguaggcuuuuggcuuuguuuacuaauuuuucaaucccacaacuucuuaagaugcuuucauauuuuauguagcugucaaauucuuaaacucuggcgaguuggagaguaacaagaacaccuucccauuuaaacugcucucucagggaaacacaggucuggaccaugaucuggacaguagacaagccucuuucacagaacucccauuuuugcuugaaagaaagggcuuguaagcuugggggcacauaauagaugacagaagggaaggagggacagcuuuacguugcucucccagaggaaggagaguaaccuuuguacacugagcauccuuuucuucugcccacuuaguuccuacaaagauguagggacagacuauuauuguaaaguguacauuccauuaagaaagcauuauuugguauuguagagggauuuuuaaaguuuuuuuguuugguuuuggucuuaggugucagugucuguuuggguaugugcaaugucugaggaagccugaagguuuuuaauccuccuggagcuggaguuacaggggauugugggcugccuggcaugggugcugggaaccggauucagguccucugaaagaacagugcauacucuuaaccagugagucauagcucugcucugauagaauuuuugaaauaugguuaaaacuugacccgggcaugguggcgcacgccuuuaaucccagcacuugggaggcagaggcaggcggauuucugaguuugaggccagccuggucuacaaagugaguucaaggacagccagggcuauacagagaaacccugccucgaaaaaaaaaaaaaaaaaaaaaaaaaaacugaacagguacuuucuaauguaagcaaagaacagcacacaguuuauaaauacccagucaccacugaacagaauacaaaguuuaauugcuaauauuuguuuucuucuugcuuuggggguuuccugaauuaauuucucuucccauuauguguauuagguauggguuuggcuuuucaguuaaugccaaguucuuggcuuuggauugaaguacuuuagagagacuccaaacacauuuuccuuuuuucaagauuauuaauaacuuuaaggugaagguaaaaaaauuacuauuuucaguaaugaaaaauuucugucuuauucauagaaauagaaaaccaauaaauuauucacaguuugaagauucuggcaaugacucugaugguaaguagagcuuuuuacuuuucuuuaauaaacugagaaauuuauuuccucagaguuagauauggaaaaaaugaaacccuggaaacuuagguuuaagcuuuguuguacugguuauauguuugauuuguugguagaacuuugauccauguuugagaaacauugcauuagauuauaccgcacgcggugagguaggaacucuuuccucugcauguguauguguauuggggggagaguguucgcuggggcgcagaccucacacaugcuguguaaauacuccaccacugagcuacaggcucauccuagaugucuuacauuuccuucccagaccuccaaaguuuccuuuaagucaaauacuuuagcgguuccucaguucagagaagucucuuuuacccugugucuacaacuugagaaaaaaaacuaguuuggcagauagguuguugcuuuauugcugucaaggguaugugacagguacuucuagauugccaguuguguucaugauccuggguaggguggaaugugcagaaaguuauguuauauuucugauuuuggaugugugaaagaaacagucacacauucuuuuaaaaguacaugaucaguaguaguacacguguccuaaaagugguaguguaugugguuuuugaauaucccuagaagagccacaggacuucugaggauuauaagacagaaaaacccgagaaaagcagcagugccaugguggugcuuccuguuuuccuagacuugguuuuucacugguaaugugccuuugcaaacaugcugggcuacacugugaaguuuaguuaaagaucauuccuuccacuuaguaagguaaaauuuuacaaauuuccuaacaguucuauaguuuuuuuaguaauuguuaggucugacauuuauguacugucauaauguaccuuuguaguuuucaguuaauuggguuuugguaaguugauguucuuaaauagaccaguguucaucaucagugagacaaauugucuuuggguauaggaauuaaacuugauuauauacagaaugugcauacauugugauuaagcugccaagaagaauaauuuugcuuuuuaauuuauuuuuaauuuuuacaaaaauagaugauuuuauuucuucauccacaccuguaaacaagucaaaaacugugccaaagguauuaaagcaagacaaaccaaaaccuaacuugaagaaucuccaaaaagaagaggucuuaccaacagaacccccuaaaaaaaggugagagguaagaccccaaaaacauguggcgucagauuuguucauuuaaaaacuacauggcuucagaaucucaguucagggagggaggguuugagcugacggugagugcugucuggagcacggggaggugccaucaagugcuuucugacuuucuggcuuuggaaauaaauucacauacauaagaacaaaacaaaaaaaucuguuuaaauagucaugcuccugacucugcaccucuucuugcugcuucugaucucacaaaguuacuuuguuaaaaggcugggcaagucuaagggcauuuuaaaauauuuguaaacagucguuugguaccaagagggagaaggcaaucccaagagacccaaaaacuguaguccagaaaggaugugggugggguggguccucugaaaagugugucagcacugagagacauagcaugucaagcuguguacuggguucugguucugagugucauggacgggauuuuaacuauaagacaagcgcagcuccagcgcgugaguggggaacaguguuugcagauacagcuuaaguaacaugcaucaaaguauguaaagagcacuuacgcucuacaguaagagacugacgucuaauuuuaguguacaaaauaucacaauaaguguuuuuccaaaaguacuguugucaaaaaaaaaagacccucacucacaaagagcacagagaccgccaucauugcaaaacgccugaggauuuaacuuauccaacauguuggggaaccccuucucagcacccaggccagaggagagacccagaacaaagaaagaacacacuuuguauaccuuuguaaaggccagauauaggcaccaggguaguuggcuuauugguguagcuaacaaccuuuuuagacauugguugguuuguauagggugacucucaguuugucuguccuugagguuuuuagagugagguggggcaggggaaugguuaaucuuguuuuggaagcuuaguaauuuugacuguuaaagcuacguuucuauauuuguuuagucagccagcuuuuuuuguuuguuuguuuguuuucuggcucuguacuuggccugcuaguacaguuucgaaaguucuuuugaaggggaaagauacuggguagucuugaauuuauuuuggauauuacaguacaaaaauaaucaucaaacacauaaaaaagaugccaagcaugguucgcugucagggaaaccuaaguggaagccacggugugauaacucuuguuaccugcuaaucacuucucaacuaugugauuuuaauacauguuaaugaaaauguggcaaaacuggaaccuucagacauugcuggugggauugggaaauggcacagguacccaaggaaacagauuagcagucuucacaauguuaaacagcuguucugucugugaggaagauagugcccaagggaacugaagauaccgccacgucaugucaguguuuauagcacuggguaguauuaaaaacaggagagcaacuggaugucugucagccaacaguuggauaaauaaaauguguucucugucauggacuguuacccacaaaaaaugaacuccaggugcaugcuguaaugugagugagccagggaaagucauucuguuuucagacacaaagucacauacuauacauuccauuuguaugaaguguccagaguaaacugguccuugccaacagaaaguggauugcugguuguuugggacugagacaagggugaugauguccuugguaggguuucucuugcuguggcaaaacaccauggccauaagcaucauggggaggaaagaauuucagcuuacaguuacacagcaugguccgucacugaaagaagucaagacagagccugaaggcaggagcugaugcagagauuauagaggaaugcugcuuaguggcuugcucuucaggaguugcuuauccugcuugcuugcuugcuuuuccuuccuuccuuucuuucucucucucucucucucucucucucucucucucuuucuuucuuucuuucuuucuuaaauguaaacaauucuauucuggggacaguaacccauuucuggcugcuccaacaguggggagaugaagggacaucuggaacgcaugaguagaaagaucaguccugggaacacgaauacaucaguccuuuucauccuccucagccaggcccgaggccugggggacaagggccugagcagggcuugucugcuggauagaaacaaugccacugagcaaaggccaccauagcugucagcacagagagaaucugaguccggcgccaguguggcuccuccucggucucaaggccugcuggugucgggcauggagguggcaccucagcuccaucccagggaaaguagaaguugaggauguggaugcaguggacacagguuuugcagccccgaaggugggccugcagcuucccacugagcagcagaaccaaauggcuaaaagcaaaggcauccagggagucaggggcaucucuaaagaagaacuucugagagcccagaugcugagagagaaggguuaggcacucccgagccucuugauacagcucuuuuucuaguuccuccucgcucucugauuugugcucaccacacagcagcugcaggugcuccauguacuggcguugcauguggccaggcaggaagaaguugaggggaaagggcauggccucugcauaccacuuuugggucacuuccacauaguucuuggauuagcauaggagguagcuucuccuccagcagagacaugaaggcuaggguaucuguucccugucaagcugacaggucauagccggcauuagaccucucuucacgaagaugggugaugaucuuguauggcucugugaugacuuccccauuacugguucgaagagcaggcagaguuccugaagggcucugccaaggauugcugaucuuguguaacuucaguggagcaccuguaaaucugcucagcaugaccagacuauccugggccaccgcccgcaguccccagccccaugaccagcagaauagcuccacaggcgcugccaucuugcacacucucucagccugcuuucuuauaguacccagagucaccaccccaugaaugacaccacacacagugagcuggcccucccacuucaaucaugaagaugcaucggaggcuuacucacaggucaaucuguugggagcauuuucucaauugaggcucccucuuccaacagugacucuagcaugugucaaguugcuauaagcccugcaaacacaggguaaucaggagugacugcugauggauauggcuuaggaaguguucuaaaacuagauaguggugcugggcaugguggcacaugccuuuaaucccagcacuuaggaagcagaggcaggcggauuucugaguucgaggccacccuggucuacagagugaguuccaggacagccagggcuacacagagaaacccugucucaaaaaaacaaaaacaaaaacaaaauaaaaacaaaaacaauagauaguggugauauuaagauagucuggagauacugaaagcugcugaaaucuaaagaauggaauuuguggggcuauggacauagcuuuaaugguggaguguuugccuuguguucaagaauucuagaacaccagaaguuggcaguuucucuguauagcauaagcuuugcugcaugcauagugaguuuugaggacaucuuagguacuugaugcccuaucucaaggagaagaggaaguugggaauuauuuuauaauacaugaagucuaccucaauaagacuuuuugacaguuuuauacauguauagaauuauugagaccauauuuauccccaccaguaaaacuuacuuuaaaaauaaguucuuaaagguacauuucaguuuucuucccuuguguaauuuuuccucaucugucuuugcgguuuuccuguuauaauaauuacaacuauugguccacuugagcaggcaagcauuacagucugcuuuuuaugggcucauugcugguauggcuuuccccaccucccuccuuacccgguucaccuugaagacuccuugaggauacuuuuuuguuuuuuguuuguuuguuuuucgagacaggguuucucuguguagcccuggcuguccuggaacucacuuuguagaccaggcugaccucagacucagaaauccaccugccucugccucccgagugcagggauuaaaggcgugcaccaccacgcccggcucgaggauacuuuuaauauuccaaccaggaugguaucuuuacacaguacguaguaaaaucuuugugaaaaucuaaauucagagguacggagcuaaaaauacauuucuuguaagaguuauaugugccccagcaguggauaagacugagagaucucuaggugggagugauguuugaucugagucuaaaggaaaaggacaguuacuaggguaguagccggcagcagugaggacgccaccucccugcacuuuaggaaucucagccacuuaaagaugcaugcuuuaggaacauuucgggaaggaagcugcucuuaaguacuaaugcaggaaaaucugaaaguuugcucuuuaguguuaaugguauugcugcacuaauuguaaucaacaccccauuguuauucacacauuuauuuuaggguggcuuuagaugacaaggucuuccaaagaggucuagaaguugcccuggcuuuaucugugaaggaacuuccaacacucaccaaccaaguaaagaaguccaaagagaaaaguaagucuauuuccuguguauucaucuuuaaaagugucuuacuguuuuguaauaauguuuaagauaggccuucacagaggaaagaauacaacuuaaucuauaagaagagcacuugcagugggcauccguggauucaguucuuuaugcagcuguaucaguguccacacguagcacgucugugcuucauacauaaaggagccuaggauuuacccugagcagcggacugcuggacaguauaaugcugcucuguguaagaguccagguuuuuuuggcuugguugguugguugguuuuugguuuuucgagacaggauuuuucuguguagcccuggcuguccuagaacucacucuguagaccaggcuggccuugaacucagaaaucugccugccucugccucccaagcgcugggauuaaaggugaagaguccagucuugcugaaaugaucuguacaauccugacaauucacuuccuuacccauuaaauccugguucuugaacauguccuaacaauaaugugugaaaucuauuaagacuggagguacuagcuggggccuggugucucacgccuuuaauccccagcacuugggaggcagacacagguggaucucugaauuggaggccagccuagucuacagauuugaguuccaggacaucuagggcuacacaguaagacccugucuuguaaagcaaacaacaaaaaggauuagagggaccagccuucauagaagcucagacuucagugugacugugacuucuagguuucucugugauuuuuuuuuucuuuuuuuuuuuaacuguaaccuuguacaugugaugguaugaaugaggcuuuuaauuuuuaaguuaguuuaaccucuuuaaaaauaaaccauuuugauuaggaaggcuauuaaccagaaaaucagaaauuucaugagugcugucauacauuguaucuaaaauaaaaacagaauucaucacagaggauagcaggagucucucuugcaaauggugcuucucgcuggguaaugcucuucauaacauaggaacuuagcguugucaggagcguuauuuaaaagucuccuaagugcucaaaauugguugcgucuuguuuuacagugagugaaauccaaggccgcacaccuaccauacacauauuccagcaguuuaucauuuuugggauguaacgauuggaaagcauuuguaucagcugcaguaauuaaagaagauaguuuguuuugucuugugguuccagagaguuccugugagucuauaaaggcaggggaccauggcaguaggugugagagcagacagcuggcugaucacauuucuguucucauucagggaggaaaaagagcagacuagaagggacugagccuaaacuaggcuagugacuuacugccuucagcagggcuccacaucccaaaagugcucaaauaugugggcuuacagggacagucaagccaccacagagcuuuaguauaacuguggauuuguccacacagagugauaguauuuacuuauuaucuuuaaauuauagaucagggaauuaaaucuagagaagaugagcaaguguacgucuggagucugacugugaaccugagucauuuuagagcucacacucagaauaugugcuggcuccuccaggugaaaccacugggcuggaaugagugugagacgguuuguuccagucuguguuaauacguguuagugcuucaaugaucaccuuccugcuuuuagacaauggcugcuuaggaugcaucugaaguccuuuccuuccuguguuaggcacugacaaacaaggcaaagagaaaacagaaaauacggguaaaccuccucaugucucuaacugcaguguagccagugaugauguagguaaguuuugauauuaauaacaguuuucauucacacugcuauuuuucucacuuaaguuuuuauacucauagcuagaacagccuuccuuguuaacagucuuccuaugauaaggcucucucucaucuccuggccuuuguuucuuuaagcuuucguuuuguucucugacugaggaccugcugucuuccacacuaggcagucaugacuacucaagcccuucaucccacaguaggugcccacuuaagagagggcugcaucuucccaggaacaucugggaaauucuuuggcaaugacucacuggggucucagacuuacccuuaaaaccagagucuguuccugggagacuaauggacucugucccagcauggccugguaguguguuacuaggcgcaaaggagggcagcagagguccuagagucugccuggaguucucagugguguucgugucuccagaagauuuggacaagaucacagaggagggggacgccucgaguguugaaggggagaggaagucaccaucucaagccaaggcuccgcggaggagagcaccuucugaaggcagcgauggcagcagugcuaacgacacggagucggagagcgccacuggugaguuguagcccgcuucaaguuaauucuacgggaauucaguaagacuucuuggagaccaggaugcauacaaggcacuguacugagccuuugaagaacucauagaacaguuaaauugaacuuggccacauagagagaagcugucuagggguaaccuuuaagccauaucuggacaaacagcauuagaaaacaaaaagaagcaagucacauuucugacugagggaaaggugugugcacugaaacagacuagcacgugcgagaacuuaaggaaguuaagacuggagagccaggcuggguuccacuagccauggaacaacucuugaccuguuccaacaggcuucagcuuuuuauauaacuaguagaaacauaugaaguauuuugaguugaaaguaauaugaaacuauuuuauuaucaguuguuuucagacuuaauagaaaugagggcaaagggaaaauauggugaccuugacaaaauuguaauguguuaaaaauuuaaaagaauaagucuguacauuaauaccaaucagauacgguguuuuagauuuuaccaugcugucagcaaauaacaggucuguucacucacugaaauauuugaugcuuaugauguauauuauagucuaggcgcuagggagauaguaaugagaaagcagcucagauucuaaugagagugggucacagauaguaaacacauauguaauguuuuuagagugauggguguacaaacugaagggccucagguagcucagcggaacuuguccagcaaguguggauucugggguuugagcucuaggacaagaaaguaaaccccacugaggaggaggaagugugacgguuauagaaggcugcuggggaugacggggagguguuaggucaggagaggcugacauuugaggccagaaacugcuuucauggaggcaagagcauccuuagugcacugagugacaguggggaccguggcagauggcauaacagaaguuucacguuuuagaaccaagacacaauguguaauuuucuguuuuaggugaagguucagaaagugauccugauuuugaugagaguaaagaaagugaugaagacuuuggugugagaagaaguaaagaaucaaagaagaaaacagugcagaagaaaccugcaggggaaaagaaggaaaggaaaucaaaacccaaaugugaggcaucaggugagccugcucccaaacccauuguucuauaggggcuggguugguuggguuuccagaucuuugccugugcccucuaacauugugcgaaugcacaucucuaauuaaaaggaauuguggcucgggagaaaagcuaagaacacugagccgugguagccauaggaagacugaguauggccccuccaccuccauuagcauguagcccuccuuuuaaacacccugcgccugugucuuaucaucagaacuccuaccuucacaucaucucaagauaugcuagaauuuguacccaucacugagggcccagagcuuagucccagguugucccauugagaggcuggaccauguugucuggauguucagacggugaggccugggugagcuuaaguccuugcuuuccuucaugaccuaaucucuguuuugagggcccaguuguaagcauacuuagugucaguuuuacagugacaauuugugacaacuuggacauggaacaccuguuucuuguguucaaaaguuagacuguuuuugcaccuguauuggauaauagauuacaaaaaaaugcaaauuuauuaacaaaauuuguuuuauuuauucauaaccauuuuuggccuuuguuaauccuccugccucagccuucuagcaggugucuuaucaccauaacccagaaagaagguuuuaacgugcaugucacuucugagaaaauagaucugugaacagccaggcucguuuccauggccuuugagaacauggcagugcccugaucguccucuccuuucccaccuucacauccccgcuccauccagauuaaacaggucgggagcuugugcaugcucuacucucuguaccaagaacaccuccacucaccuuuccccucagccaggauuuggcucagccugugaucucccucuacaccuccuaagcaugcuggagauuccaagguccuuccuaccgugcauuccuggagucucagcacagugcaguagacacagcucuucacuuugcucuccucccacugaagagaagugcagggcagggaauucuagagaacaggaugcccacaucguguguucucuauaacccugggguccucuauaggacucucccugacauacacagaagaggcauuauuuguaaagugccuacaaguaugaccuuagacgucaaacguaguuucuaaucugaguuccaacaguagcugucagacuacaggcaaauugcuucaccucucugcucuuaucauuuuagacuugaacauuaucuuccugcaugacaguuguuuuuauguguuucaaauaagugacuucaguagacccagcuccagcugccaucaagucaggaucuccaucuuuaccccaggcaguuggucuuccuucugaggccacuaggaaaccagcaauaaugugcagcccuucagcugaaagcaagaggcccaaguggguccccccagguaugguaaugugcuaucaaggucaccaacuuaggaagauaucacaggaauuaugugugagcagaucccauauuauuucaaauucuuccaaguuaguauuuuaguguuucaguuuauuaucuugccguuucuuuaucaggcauuuguucucauugcuagaaauaaaacugcaguaaauggagacauccuuacuucaaaaaucuauggucacagccaugauuaucauagagucaagaguauuaacaauuuuguuugcuuggauuuuuuggcaacaagguuugacccuaagaccucguggccuccucaguuuaagagagcacccaggccugagcacugaaacauguaacacaaaugccuuggcaaguuugucuuugucuuuauauguguguuuugcuccacagccagaaaaguugaagacuuugaaggugucggaguugggguuuucagauuaggaugcuuugccugccugugcuuuuccugauugucagugugggucuuucuucugaucuguugcagcucaugaugggcucuguagagccggaccuaacccuuugcuugccuuugguuucuccugcagcugccucugggagcaggaacucuagcagcaaugcauuggcaggaacaccugccaaguccccgagucagagccugcgucugggccucucccgauuagcgccaguuaagcgcuugcauccaagugccacaagcagccaagugcgguagcaggaaaggacugcugggacccuugggacugcaagcaggguugucauauucagcuuccacauaagagaaccuuuaaugggucacaugaaggaccaugucugugugugauucuggucucaucaaagccuuucuguccuucagcaaaggguucugggaccucuccuuguggcacuccugaagaguguguuguguuuucuuguguuuauaagccacugucacucgggcucugcggcacgucuguaaucacaugucucccagcucuggcaugggagcauccuggguccuucaggaggcauugcugaaaucuuucccauacuacauuucuucagguuuauuccaagcuuacucucuuugucuaggucuuuuuaguaagaauucugcuuuuguacauauuaacauguugacucuacugcagcauguguuccuacaugggacaggugguuaguguacagcagauagaaucucaugacgcuguaugaacuuuucaaaaccuuuaauaaacaugaaaagauguaagcuaugcucauugauaccauguauguaccugcauguguacguguugcuaaaaugagucuucuguggucaaaauaagcagggggaggagugucuucaucauugagaugaagcccaagguugaaagcugucaccuccacgccccugucacagcugaugcaucgucucaggaagcucugguuuacugucaguaaaagcaauuauuuuuauaguaagaaaucaacuuguuucugauuacuuuaauaaagucuaauguuuacuguaaaaugugcaugccucgccuaguucucagcuaugagacaucuguguuaccgugaggacaagcagcuuugauuuaagugaccauugcuuuuguacaucuucuuacucauauauaugcuuacacuguauucuccaccuuaccugcuccaccguccuuaaaaucccaaucuucaguuagcaaucugcgugauuuugguucugauuuuugagacagggcuuccuauguagcccaggcuguccuugaaccuaccauccuuccuucugccacggccucccuagugguggugggugcugugacacccaccuaguuaccugguuuugaguuaauuuguaugcuuugagcaauaaccauuguuauaaauauauaauacuca

SEQ ID NO: 3406 - RNA, 37609 nt, Mus musculus
cagcugacuuauuugggcaguucugcguugacagcuccaagugugcuuuggugucugaugagagaggugaguucgagcccacagcgaagaagccccuucaguguggaggacccaaugacgguaucugguacagacuuaaagaacagaaggagucuucuaagggccaucuaaagugcuggagugcagcuugccauugccaguucaguguuuguggucaacuaggcuugucguuuugcauguugcucugacaggguguaggcacacccagagaauucggagacguaaacuggauuacgaugaauuguauccugagagcaacagaccacaggaacaaagaguaacaugaaaacguguguuuuuauugguuuuguucuguuucauguuacaauguauucuaauuacugucucaccuuaugucgcaccugucccuacuaacuugcccaucccucuaaucucugcauuuccaccaguccccuuucuagauucaugucguuggguuuuuuuuguuuugguuugguuuuguuuguuuuugugacccuauaucuuaauuagaccagacuauugaauugcgacuacucauuggagccuggugggggcacccgugggcacacaacugaaaaauaacuucccuuuuccugaaucugcccauagaaaacaguuccuuaaugacacaugggucauucugagucgucuucucucuucccucugcugcugcugaggcuaaucuuaugcagaccucugacacugcagugaguuuacugcuguaauggcagcgucuugucagaagguggcauuuugucuuccucucuaugaucugguuccucuauuuuuccacuuccuauucugcaguguuccuugaaccuucacagaggugguauaaaugccuuguuuagggccgaguccccauccaucacauguucucaccuuguggcaccuggagucuguacauucauuauaguucacuggaaagagacaauucucugauuaagucugggaguagcacuugucguggguauagacauggugguuugacaguguccauuuaacugaacaacaguauuuauguucccccccagggcccaucaucuucccugcuauggguuuccaacaggaaucauagugccaggcagggguaugcuccuauagagcugaccucaaauccagucagagcaaauuggauacccucauaaugguacccuagugcccagaugagcaugucuugccuggcagguuaguagaguucauagaguccacagcuggguuggaccaguaaugaaauuucucuuauagcagccuccuuaguaucuucaaggaccauaaaagauagccagcaaagaggaagcuuccagcagaguuccagcuuggcuuuuuuauaucaucaauugagcugugcagugucuuuaacaacagaguuuaucaucuaguuuuuauggacgaccaagaacaaugacaacaaucucuacuguccugggaguucauauauauauauauauauauauauauauauauauauauauauauaaaugcauacauauauauguacauauauguguguauacauagacugauggcuagcucuuuaagggaccucgacuccuacugucuuuacugcauuuucuuuucucugaguaguguucagugugccuugggcagcauccuguguggucuguucugugcccgugcuuccuacuuggagaucuuucuuguguucccauauccuuuuucugauacaucuccugaccuucaacaucaaacaucuucaagcuaccacugggucuccguuguguuuggccacuuguaugaguuccguaagcuagcuguacacuuacagacccccaacccgucccuccuccagcauuuccucuugccccccccccacucuguaccuucccuuguauuaacuacuuguuauucuucccuaggaguaaaaguacuucuugagcauauuguuugcucugaaauuaacuuuaaaauaacuuuucauuuuaaaaaaaaaggaagaagcagcauuugguuuuugucacgaagaugaaugugcaggaauaagcaggaaacacuauaauagacugguugugguggugcacaccuuuaauaucagcacuuaggguggggugugcugagacaggagaaucaaaugucugacaucauccuaggauacguaguccuaagucaccccaagaugcacagugagacauccucucuaauaaaauggaaggaaaaugaagacuggagucguugguucagcaucgcaugggggcgggguggggugggguacagucucugagggaugggcuguguuuuagagguguccuguggccguuugacucaugguucuuuggcucauccuacagaaacccugcugaagaauaugaagaaaaaccgagaaagguucugcaacaaggaaagggaauuuguguacaaguuccagguaggacgugagcgcuuagagcugagagugccccucagguuuccuguggaggagaaugccagucaucugcauggacgucugaugcugcugcacagcuugccuugcuucauagagaguggugaggacggaccuccuuuuguuucuccauagucucuauuguuagauguuucuugguagagcacagauuuuugaacuugggaugugacccaugagucugcacaacugagugagugucgggcucaugaugaacaugucaaccugaagagguuuucagcacaagugaccaaauguuaauucaaagccagcaguaugguggauugaaggagcucaaagcuugcuuugcaccgcccaugccacugagcugcccacugccagugagugcugcccacugccagugagugcugcccacugccagugagugcugcccacugccacggagcugccuacugccagugagugcugcccacugccagugagugcugcugaagccuccuggagcagacucagacugcuguuugcacugcguuuacugucuggcauggcuuucuguucuuguagaaaugaugguuuccacuccuccuuccucaacacugaagcuucaaauuccuguaucuucagauuguauuguguuggaauguuuuugaguuuaaacauuuuuuuauugcauuuauuuauuguggaggcagagccuauguguguauauaaaaauuugcuuaacaaauuuugacaugaaauuaagacagaauugcuagcaauuucuaaaaaggccuuaaauacguguuuuggcaucuuauacuauguauuuauggaaaauaguauucuugacauuggcaauuauaaaaucaaaaugaaaaaguuaaguguacuuucaguauuaaguauucagccaagauuuaauuacuuguauuaaaaugaucaagcauauucauuucauuaguacucaucuuuuauuuugugugccuggguugaggggguaugugcaugugugacucuaugagguguaucuaucuuuggggaguguaugucuguggggugugugaaugugugugugugugugugugucaggggagguuauaugugggcaugugaguguggaggguucaugugugggcuugugagugugugugugggguuaugugugggcguguguuggggggugguagggaccaaaaguugaugucaggucuuccuugguuguccgccuuucuguucuuuagaguaauggucuuucacugaagccagagcucaccaauccagcaagacuuggugguuagugagcuccggggaucuccucagcccaggcaugauaggcacacacugcuaaccccuguaucuuacaucgguccucaggauugaagucauauuuacacgacaagcccugugcucacugagccucccccagccuuuuagucuuuaauaauuggauuuauauacaccaagguaucauaaguuuccucaugauuuuuaaacagugaguguuugauucuguauacauauuaccgauuuuacauaccuuuugucuuaguugguuuuguauugcugugagaaagaccaugaccaagagcaaauugggggaagggguugcaguugcugucuaucauggggaagucagggcagaaccucagggcaggaauccggaggccggaacuaaagcugaggucauggaggagcacuacguacugugguguucucuguggcuugcccgaccugcuuucuuccgggccucggguccaccagccuaggagugauaccagccacaucaguccugcauccgucaagaucacggcagugccccacaggccugugcacgugcugcucuuaugaaucaucuucucaguugagguucucugugagaugccugacuugggcaaaguugacaaaacaaccaggaaccuguacaucugcguuauguaagacuguauggugagaaggaguccacuuuauuuuuaggacuuguucucucagguucacgccaccaacuagagcaguaaacagguuguaagggaagcuaaaagcauucuagcauguccuaucauauaaaccagggaucaggacacaaacagggcauguccucaccccauugguaguucucagaaggcugccucaucccacacaaacacuauuauugggaauuggucagaaauaugaauucuacauuuuaaauuuaaaaaaauuauauauucauucauuuuguuuauauacaacucuaugugugcaugugcauaccacggcacauguguggcagucagaaaacaauucuuaauucucuucuuccaucaugugggucccagggaccaaacucaggucauuuggauuggagguaaaaugagauuucacaauggaaugcuuuagccuacugugugugcaucuugcugaagauagcauuugucaucccucuuauagacuuaaaagaugcucugagccgguuuauagaagaagaaucccucagagaccaugacagcgaugcagaagcaugcuuggaggccguuaaauccggugaaguagaucugcaccagcuggcaagugcgugggccaaagcuuacgcugagguaagauggaggucagagccacgcccccggacacugcggacuuugugaaggugcuuuaguuguugacgucauaggaagcaaaggagaggauguacaacauauguucuugcuccuguguuucuguucugugucaacaugaaugagcuccuaagacaaaguauuuuuauuacauuuuugggguguguguguguguguguguguguguguguacacauguguauguguugcuugugccaccaagcacuuguggaagaugacuuaagggaaucgucucucaucuuccaccggguaggucccagugaacuguuucuucggcccaagaccaaucuucauuauuuuuuuuuaugaaauauuuuuggaauaauaccuauggaaacaagaagcuacuuuauccugcauaguccuuggaacauguuuacaucaaaaaaaaaaucagucugaauuuccagcugagccgaugucuuggcugcaaucugacagcccacagcagugaucagaauuucuucucagcucugguuaacuucuguccucacuugccuucaugaaguugucaguauuucucuguaggguugugcggcuagugugcccuguuucaugcaauccaagaugccacacacauaauuauuuuauuuacuaacuucugacucuuuuuagaauacauuuugaauaaucaguuguucuucuggcugugaauuacuacauacaaauuauacuuauugugcgggauaguuuuauguuagcuugacacaagcuaacgucugagaggaaggaacuucauuuaagaaaaugcuguccuaaggcaucucagugggcgugccuauaaagcauuuucuuaguuagugauugauggggagggcccagcccgcuguggguguugccaucccugggcuggugguccugaguucuacacgagagcaugcugagcaagccauguggaaaaagccaauaagcagcacucuuccauggccucugccucaguccugcuuccggguuccuguccugcuugagugccuguccucaguucucgugauagugaacugaaacugggaguggaaugaacgcuucccucucccgguuucuuggaucaucauguuucaccauggccguaguaaccccaccuaagacaucugucauaaaacacauucaaaugcaacucaaguuagugguugugagaaguccuacauccgcacauggauggcgacguggaggguguuagcuuuguuguucaucccguugugcaggcacacacaugcaucguguauagauaugaggucacagcacacugacuuucucacuguccugggcacuucugucccuugcucuguaggaguaccucauuccuuucccuagguaauccauaauaacaaguuagauugucucucuccucuccguguucuuuuguuauauuuagacaauucuagaauaacggcuacauguguguaagugcagggccucugugucccugugugaugugcauacuuuucccuguagcguggccagcggugccugcccugacugaaugugugugucaccucacagaccaccuuagagcaugcgagaccugaggagccugacugggacgaagacuuugcagauguguaccaugaccuaauccacuccccggccucugaaacucucuuaaaucuggaacacaacuacuucguuagcaucucagagcugauuggugaaagagacguggagcugaaaaaguuacgagagagguaauacucauugcuuguguuauuauaauuaaaugucacacugugacauaugauaaccuguaggacaggcaguuugcacuuuuauaaaauuacaacacuaugcaaaacgcuucaaaugagcugucuucuuugaucuuuaagccccacacuuagcaucuucauugugcaggugagaaaaccuuggcuuacaugaauccacugauuuauccgaggucaagcuagaauuucaacccagugguugagaaagacuucagaacuauuagcccuuccuccuugcucuguaccugcuucgaaccucuugugggugggcuuccucuaagccacaguaucuuucaguucucuuacaaacaucuugcaucaggaagaaaauaaaaagaacccuagaauccucccagggacuuuugaucagcuuugaauuccuuccauagagucuaccuaagacagcaggcaaagagggcuucgucagaguaaggagaaagcugcggcuccuuugaugugaagugugacuugucaggucccucccuccgguucuguuggugugaugcaaaggccguccugcuagacagacaguccauuugacuuagcagguccuuuauuaguuuaaaagcauuuguuuaagaguauggguauacauaccauugagauggauuuuaauauuacuuguaugauguuuuuguuguggaagcuuguuaagagcaacuaauacuugauuuuuuugugggugaauuaagguuaauaccaaggaagucaacuuagaugagaugccaugugcucuuguuucucauuagccucacauaaaaaaacauuaagacuaacagugugugaauaauuugcuuuauuuuuaaguuauuaugguuaauaaaaauuaaaauauaaaaaaucauagauggauuucauuucuuucaugaugcugaacaaugaacccagaccuugagccuugugucuaaggauucagccaacugucaaucaacaacacgaggggaaaagaguuauaccuacucugaacauucucagccuuucucuccuaguuauugcuaacaaugcaguauaacaacuaguuacaugguugcccuagucaucagaagugcuccagagaucaguuauaacaagcuggaucgugcaaauagguugugugcaaaugcucugccuggaagucccugugagucccaagggcuaccuguguugcucaguuccuuucugccuccuauguguuccuggcuagugcuuccaccaagcccaggacuucuuuaaccccugccugcuccuccugcagagauccugucuggccaccuaugguugggcugcccucuuuucugaaucggaggugauuccuauucgguuuauuuauuauucuuugaaacaguuccuacucuaccacagacaaugaaguaacucacuaauuauucacccucucuggaaccugaugauuuuuuucuccugugguuuuuuggcuuuguuuguuuguuuguuuguuuuaggaaaaguuauaucauuuuaucacuugacguucagguugcagaguuguugugccugguauucugagccaguguguaguuaacauguuauuugaaauagaauaggcucucuuuugaacuuaaucuaggcaauagcuuuaaaaguaauuaugugauuagcugcauuuuagauacauucagaaugauguaaauguucaugaaauuuuauuuguugaauucuuuuugucuuuuuuuagugaaaaauauccugcuuuaaugaaaccacauuuuagauaguucuuuaaacauuagaaggaaugguaauagcauuuuuuauccacuagagggaguacuuguaaaauauuaaugcagauauguagauauuuuuguuucuaaaugacucuuacuuacaagcauccuauucacuggacacuuaguacuuucugaaacauuagugaccagcagugguggugcacagcagugaucccaguucucaugaggcagaaguacaaggccagacgcggcugugucgugaaacccugucucagaaaccaaaucaagcaaaaaagcuuauggggccauugcauuguguauaguacagugggagcuacgucacacagaguguuuacuucagaagaugucaaagugcucauguguaucacucaucacauccauccuacuuaaguguuugaauaaguauaaacucaguuuuaagaacaguuuacuuaacucaauaacaguaaaaccguuccauuuuguuuauuauauauauuuaaauuuauauguuuacuuauuuguguauguguggaauauguauauagucguguggguguuuucauguauguaggugggugguguguguguguguguguguguguguguguguguguguguguaucuaauguaugugaagcccaggucaguacugagugucuuccucagucucuguccaccaucuuuuuugagacagguuuuucagugaacuuggagcuuguguguguguuuggcuugggugucugaacagugcccuccagggcccugccugucucugcuuuuugagacugggguccagaugugcucccacucuuagcuuuccuguaagauccaaccaaacuaucucucagucccucaaaauaucauuuagaauacauuuuggaugcauuuguauuaaaagauacuuuuuaauuugagauuuuaaugaacaaauguauuaaugcacucagaacagacaauauaucauagaaguacggcucaguaaaauuucacagagcaagccaacccuuguagccaccacccaaucaagaaauggauguuuuccagcaauaccgaagccucccuagugcccuccuggucucccuaaaugacuucugucuggacuccaccaucgcugauugacuucuccuguagggaagcccauucuguccaugguuucucugggugaauagaaggaguagccccaggcuacaccaucagguuguaguuuacauugcuucuuaaaguaacugugugacuuacuguguaucuuuucaaccguaaucaguaguuucuggguguaguagacuagcuuccagcauugagcuccugucaguucauauccacucgccugggaaaucugcuugggcugcugacggagcucuuuuugaggaacuagaugagaagggguuggaacuacugaacagccaugaaagcuugcuggauuucaucuguuuccagcuauagaugaagcucagcgugaugaucuggcugcacgugaggcacgcuugguacuugaagucauagcugucagugcucacauacucuuuuaugaggacugggagcauuuucaagauggaguauuaaaucucagauauguuauccuucauaaaauuaaaaauuauguuuucacucguggcuguaugcccuaaacguguggugaauauaucuuauuuguuaauuuguguuuuagacaagguauugaaauggaaaaggugaugcaggagcuggggaaaucgcucacagaucaagaugugaauucacuggcugcccagcacuuugaaucccagcaaguaagugagaugaggugugcggcuuuacauuugcacucacguuuucucuuucucgugaaaaaaugacugcuugguucucccucccccuccccccucccccucccucccucacuuuaggacuuagagaauaaauggucaaaugaacugaaacagucuacagcuauccagaagcaagaauaucaggaaugggugauaaagcuucaucaggaccuaaaaaaccccaacaacagcucccucagguacugacugcgggggugggggagggcgcuccugucacuacugauguuuacucuaaagcugagccuuguuggcuagauauguuuggcaaugaaaauccaagauuuuauauuuuaaaguauaauaaauccaaguauauaaauccaagauuuuauauuuuuaaagauugauuuguguuuccuuggugugcauggguaccuugccugcacguuugucugugaggugcgcuguuggaucugcugaagcuggaguucaggcagguguaagcaacggugugggugcugggaaacugaacucagguccccuggaaggagcagccagugcucuuaaccauugagccaucucuccagcccuuucuuauagguuuuuugagacagagucucauuauauagcacugcggaucucagacuuggcauuuagccuagguuggccuugaaucuggggaaaucccccagccucagcauccuaagugguagaauuacaggcauuuuucuuccauuucauuacagcguauuacucuuggcaugacuggaugaaugccagacacucucuaagcagaaagagaaaaguucuuuaaguacaguaacccuuuuccagaauaugcuagcgcaugucguaagcauugguauacagccaggcuggcuuuuggaugagcauggucucuuaugucgugucagucucccgguagucuugccucgaagaugagaaauauagcucugugcgcucucucucucauucgucuuuuguuucuuuuggaggcugggggacugggggugcuguuuguuuuguacagccuaacagcugcuugccacgcacucuugacacuggccugcccaccuaacauguucaguaagcguugggaugaauggaugcacagaugcaucucuauguagucaggcugguuacuagcucaggugguaaggugaagauccgaguuuguccuccgacuucacgcaugugcacaucacgcaugugcacagacacacgcaccucuguagacaagaaacgagcugguaacaucuucccauggcaguuuucuuaccucuucucugcaugugauggucuuucauuugcuucaccauuuucccaauuguccgucuucuagggacagcccauguccuuuacuucccagccagaauuuugagaacaguggaguucagggguccaagcacaccgugcauugggcuuucugugcaggagugcaugcacugacccaaguguagagcauacacugugaguuguaggcaauggcauucaaagccauggauuuaaggaagcuaaaauguucuugcuauagaaccuugcuaaguugugcuuucuggcucaguguguaggccacuguauaaauucuggccucuagcugccgcuucuuaaaccguuaugcccucgggaaaacuuguacuauuauuaucuuuaguagauauuuccucaagcagcagaaauucuguuuuugacuccuggacaaccaagcuuauugagauaaauaauaugaaguaaaguccaccuguuagagggaccaauaucagcucaggacccugaagaccaaguucucagcauauagauguauuugccccagagggacagggggcagggaauaagagacaacagcaggagauagagggugagggagaaggggaagggaaugagggagggaagaaagaguauuugucccaaagagacaaagggcugccucuggaaagagaggagacacauguggcccauaggaaaacagagauuuauaaagguacaaugggaagccugcuaggaugagguguaggauuuugauugggcauguuaauugagcuaaauggggggauuuugauagcuggaccuugauauucagccucaggaggaagaaguggccaaguacgggaaugacccuggggacuggcuuugggaauauuuucuaauggcuuuuagccaagcagaaggaauggaggagacgggcaaggccugccagagcuauguuugccaugcucagacuggcuagagucccuucagucccaccuuucucuuuuaugcuugggucauugggugcuggguaaguggguguuuccugaugacauuggggcaucauugguaggggacccugguugaguuucuucaccuguccuaauggagcacagauuaaggaaaacgugcucuucuuguagcaugcugucugcucucggcaucccgucagccuccuggagugguagcuccgcugcagccuugaccagugcucccugcucugugcuccauccugacgggugugacugggacuucccauucccuguucacugucugggucccugauggcuaaggugugggacagugucucuccuuguguuuucuucucaccaaucugugagagcucugccugugugcuuacaccgucuggaugugugucuguccucagauguugccugugugcuuacacugucuggguguguuuguccucagagguuuuguccauccuugcuccugcucugcagcuugcuuuuuuauuguuucacuuuuaccuuuuaaaagcagacaucuguugaugcagacuggccuggcuuagcuagcagugaccuuccuuccugugccuucuuggugcugggauccugggugugugcuaccauagccagcccuucccccuccugcuuucuacuguagguauuggauuaagagauuucagcagggaguggcagcccaugucucuaaucccagcacuugagcagugacggauucaucucugaguuugaggccagccugguuuauauaucgaggcacuacaaaguaagaccuugucaaaagaggaauauauuuagccagagagcaauuaugugcagaaguuaaugggccaucgcuauuuagaagauucacauuuugucagcagggcagcagaucuguuaucuauacagucagugcccaaacggcuccauuuuguauaguagcuggaugcugcucugggcuggaacucggguuugcgaguuuuucucugcacgcagccccauccucagcauccagcggucuuugcacacccgugccguggagugagagcucucugugcagcuguccucgcacagcaauggcgucuuguuuucugucauuugcugugggucaagccaucuacuguuuagcuacaccacagcccuggucuaccuguguccaggucgguugccugucaguccagcuccagucuggagcaagccuugugucuggcucggaugucagucauucgagaggcaucucucaucucccgucccguguuuccuuggacacaguuuguggagacugaugagagaguucaggugcaggagucuguggcuccgaccugggcuaaagugacuucuacccugcacaugaccuuuuagaacucuggugagauuuuuggcugauuucuguugacauccuuguaugacaacacccuuugaaaagugugcaccgaugaaagcaggcuguccucaugccccugcccaccuuugggaccauccacuuuccgucauugccuagugccauggguuugaauugagcaguuauguggucauagcuucucuaggauaacuuuaccccagagcaaagaaaacugucuagugagaagagaaugcauccagacagggaagugucaaaggaaccuuucgguucuugauuuaucuggccuuuuaauuaaaagcacuuaaaacugucuuguaaauuacuguuauuauaauggucaucaucauuaucauuauaaucguguguguguuuguguauaugugugugugugugaauauguguauauguguguggguguguguguguaugagugagcagugggaaaauuagaggacacuugcagaaguuuuuuuccucccgcaauccguccuagcaucaaacuuaaugcucugccagccuugugaagcaagggcuuuuaccugcugagccaucacagcagcccaagguuuuaauuuuuaaucuucauugcugucaccucaucuauuuuauaauuuuguuuagaauuugcccugucuugagaauucuuauguaugucugauauggcuuuuaaugauauuacauauuaguuccucagcuaaucccugaaucauuuuuaaaccacuaggaaauacuaaguggagauguguuaguugauauuguaaugacugaagagaaucauccgcauugcuugcucugaggaggaaguagaggacguguggggcuuucgggagccgcugcugcugugcucuugcuugucaccguggauuaacaugacuuuagggagaaauuaagcucugugucagcuguucaguucucucguuucguggcgagcuuacuguucucugacagaacuuguggugacugugcaauggguauaaccguaauuguauuaauuucagugaagagauuaaagugcagccgagucaguucagagagucugcggacgcugcugggaggaucuacgaggaacagaggaagcuggaggagagcuucaccauucaccuggguaugggagcucccucagcagcacaaggagccucgggcggacguccugcagugagcaggaccugcccucuguaucuggccccaacucaccacccgcuccacaaaggcuagaguuuauguucuagcuaacauauuugcagaucaauuauaauggcuauuaacaugggcgacgggagagccacuuuuaguuauuauuugggacauggaucuacccacagucuugucacagacguuugcauccacuauaggauuucuguagcugucucggugucucucugugcuguccaccccuaggagcccaguugaagaccaugcacaaccugcggcugcugagggcagacaugcuggacuucuguaagcauaagagaacucacgggagcggcgugaagcuccaccgucugcagacagcacugucccucuacuccacgucucucuguggccugguuuugcuaguagauaaucgaauuaauucauauagcggcaucaaaagaggugaguagguaccaugcagaucuaucucaccacauuucucucaguaauuccauuuuuguagaggagucucacacuguagcccauccugaucuugaacucaaagcaguccuccugccucugcuuucuaagugguggaguaacagacaaguaaaaauaauaaucuaacuauaaguacauuuuuuauuuuagaacagggccugcugagugaucuuacccagugucccccaugccguccaagucaaacaaaaccagcacuucuuauuguuuacagacacuggggauagauuauaaccauaguguguguuauuuaaagaugacuuggagguguauuagaauguacuucugagaguggaguguugggagaaauuguuguacccacacauucaaaugugcgguuauuacaaacaacaagaaaucauauuuacaaacuucaucucccccuuagaucucauuuucuauaaguaaaugauaaauuuuugaugguuuacacuuagaaugaugcuuuggaucccuuagauuuugccacaguuugccaagaauguacggacuuccacuucccacggauugaggaacaacuggaaguuguccagcagguggcgcuguacgcgagaacccaacgcaagagcaagugcaaagaggcccgcggucagugaugcagcauccuuaaagccccuagacaccaaccacuaaagcacgcagaguucauagcagcggggcuuacaaaaaacccaaaauuuaauaucuucagaagcuagggguuuucccccaaauuuucucuuucuuucuuucccuuuccuuucuuucucucuuucuuucuuccuuuuuuuucucaguugauuuuucuuucaagaucuuuaguaaaaaccaugauaaaauuucauugccauacuuaaguaagagcuuucgaaaaguuugcuuucgaaccacacugucucuaauggcuagaccaugucuauaaagggcauuaaagucacaguuaaaauggaacaaacccgagguuuuccguguucauauuuuugucuggugcuagggauugacugcagccccuucucaugccacgcaugugcugguccacggcgugcaccccagcccugagccaucucuggcuuugugacuuuagggcuguuuuaguuguucuagagagagagagacagagagagagagagagggagagagagagagagagagacuguugugguuaaaagacucuuuuucccuguauuuaucuacaauacaacguccuuucaaauuacuuagaauuuuguuggaaauuuuucaaacguacugaaguauacuuuauaauuacuucuacuucaucuacccugcccuaacuucugaaauucuagaaccuuccaaaagagugccaccaauugggaagcuagcauuuaaaucaugagccaaugaaggaugcuaugucuucaaaucauagccacacuaaucaccccaaacuaagcaaagugucugucgcccgagaggcugcuccuuggcucccuguggugagagcaucagggcugugccuugauaagggucacguauguagugggucauagccauauuuuuaugcaucagcucucugaaacuuauucagccuguagaacaaacuucauaucccuugaccaauaucucuguguuuuccccuuccucaucccauguuagcuguuacuuuguucuguuaguucaacgguuccagacuguccucaguaagucuuccuucuggauggugcuccaggagcaccaggagaugcugcaguccacgggcaguacugaacuugcauccauccuagucuuuauuacauguacauaacuugucaguuuucaccuuucacuuaacgggcuucucuuugucacaucugaaucgucagcaucgcuggucucaagcugugaaacccagcagguagcaaugcacacugugaauccacuggucagagggaugaguuauguccugaauggaacagaauaggguggugugacacuucgucuuguugcuuggauuggcaugcaauugaagacuugugagcuguuaucuuuggaguuguuugauguuucugaaccacagcugaugguggauaacugagaccacagaagggaaaacugagauggaagggggcugcugccccuccuuccuauccugccugccugugccuuccagauauguuuguauguacagaagcaugugugucuaguuguccuucuuacacagugacacuuuguauacauguggcuccguaggcauugcacugagggccugcccuggaggccaggcccucaguccagaagccccuucgugcccuuugcuguuguguaguagugcauugcagguaccuggggcgggucagucccccgugaguagguauuuauucuucaauauuuaauuguaagcaguaguacauaaauaacaauaaauaauuguggcucugcuggagcaccauuacauuucaggaccaggacaccaguauagaggugaucccaacagaggacuguguagaguaguucacggugucuucuuaugcuguuauccucuuccuccaccucccaagcaagugaugauguggucagaaauauguucccauauauguuuuaaaauguuuaaugcauuuuaguuagauaauuuucucacuuuucccuucucuuugcucccucagcuccguccaaggauuuuuaaucucagucguagugacagagugugugaagguggaggucaugggugugggcaagggaggaggauuuuacgucugugagcuauagcgugcaguacacgacagggaguuugaaaaccaccuacauuuaagguggcacguauguggcuugggauuuuguucuugugaaagcaacuguguugugauuugaaugaggcaguagaguaaggcacuuuguaaaagaccaacuuucuuuuuuuguuuguuugguuguuuuaagauggggucucaguauguacccagccuucccagaacucacuguguagccuaggcuagccuugaacuugugauccuccuccuucagccucuuaaaggcacuuguauguuauagaaagucuugggaaaaaacuucugagucuucuucaucugcacacgacuacauuuuuuguucaucacgcuugcauccugauauacaaguaccuguuuauucuaaggucucucauucauuuuuuacugugguuguuauguucauuguauuuucauaguuuaugauaaaacauaugaauaucauauuuuccaucaaaaucaccuccuuuuacugcuaaggaacaugugacucguaaaaaccugggcagaagagugggcugugagcuccucucuuguuucuuuuucucuuuucuguuuauuuugagauuguauuuuaauuacguuucuuccuucucuuuccucccuccacaccuucccaucuacccugcccucuauccuuaaaaugugugcucucuuuucuucaugaguuguuacugcauguagauauuguauuuguauguauauauuuauucccaaauggaaccugcugaguccaugcaacacuauugugugccuguuuggggagcugacuguuugccacucuacagccauuugcugugcucuccccugggucugcuucugauagggaguuuguccauucccuguguaauuagaauuggagaguucgcuccuugaagucugugcuauaacccacugcuuacuugcagucaguugccaggcucugcucugcugcaugaaauacgcauacaaaccacuccgagcuuucuguccacccaucgugcucauaaacuguguguuuagaagacauacugguguaagucacuaggcagcguuacacagcuaguguguucagacagggaguguuacacagcuaguguguucagacagggagcguuacacagcuaguguguucagacagggagccuuacacagcuaguguguucagacagggagcguuacacagcuaguguguucagacaggcagccuuacacagcuaguguguucagacaggcagcguuacacagcuaguguguucagacagggagcguuacacagcuaguguguucagacaggcagcguuacacagcuaguguguucagacaggcagcguuacacagcuaguguguucagacagggagcguuacacagcuaguguguucagaaagggagcguuacacagcuaguguguucagauagggagcguuacacagcuaguguguucagacagggagcguuacacagcuaguguguucagacagggagcguuacacagcuaguguguucagacagggagcguuacacagcuaguguguucagacaggcagcguuacacagcuaguguguucagacaggcagcguuacacagcuaguguguucagacagggagcuuaacacagcuaguguguucagacagggagcguuacacagcuaguguguucagacagggagcguuacacagcuaguguguucagacagggagcguuacacagcuaguguguucagacaggcagcguuacacagcuaguguguucagacaggcagcguuacacagcuaguguguucagacagggagcguuacacagcuaguguguucagacagggagcguuacacagcuaguguguucagacagggagcguuacacagcuaguguguucagacagggagcguuacacagcuaguguguucagacaggcagcauuacacagcuaguguguucagacagggagcguuacacagcuaguguguucagacaggcagcguuacacagcuaguguguucagacaggcagcguuacacagcuaguguguucagacagggagcguuacacagcuaguguguucagacagggagcguuacacagcuaguguguucagacagggagcguuacacagcuaguguguucagacagggagccuuacacagcuaguguguucagacagggagcguuacacagcuaguguguucagacaggcagcguuacacagcuaguguguucagacagggagcguuacacagcuaguguguucagacagggagcguuacacagcuaguguguucagacagggagcguuacacagcuaguguguucagacaggcagcguuacacagcuaguguguucagacaggcagcguuacacagcuaguguguucagacagggagcguuacacagcuaguguguucagacagggagcguuacacagcuaauguguucagaaagggagcguuacacagcuaguguguucagacagggagcguuacacagcuaguguguucagacaggcagcguuacacagcuaguguguucagacagggagcguuacacagcuaguguguucagacagggagcguuacacagcuaguguguucagacagggagcguuacacagcuaguguguucagacagggagcguuacacagcuaguguguucaggcagggagcguuacacagcuaguguguucagauagggagcguuacacagcuaguguguucagacagggagcguuacacagcuaguguguucagacagggagcguuacacagcuaguguguucagacaggcagcguuacacagcuaguguguucagacagggagcguuacacagcuaguguguucagacaggcagcguuacacagcuaguguguucagacagggagcguuacacagcuaguguguucagacagggaguguuacacagcuaguguguucagacaggguuuugaguucuguuuuagugugugcuguuuaauaacuugaaggucuggcuguuuucuaauauggaaugccauuucaaaauagauugcaaaguaguuuuuaacuuaacuggugucaguagauugccucuaaaagauggcuacuuugagaaguaguacucauuuuguauuugugacaagagaaugcuuaugacauggagguauauuuucuauuaaaaaugugcauauauguaaauaauguguuccguuuuaacaauguaugcucacucagaauguuucucauuauccaacacuuauccuuccaagaaaauaucaugccucaaaaacaaaaaaaggaauuauugauuguuggaaaaaguucaguuugaagcgcugucacacaucugcuugaaauccauuguaaauagugucagaugagacagucaauuucaugaaugugcugaauauaaaaugauucuugguguugcuaucuaguucagagcagguuauagcaacaacagugagucagagucuaaaaauaaagauagccgcaccacagcuaucuaaugaaguuauuuuaugugcagcuaacucagugcccugaccucucagaagacaacuagaguguugugaagcgcaauguagccaaaccauguggggucaaggcuggccccaccucuuaccucugaccccugcuuagauagcagcugacugaaaccuuucuucuccaaauaaaaugaagagauguagcuaaauuauacugcccaugcuuaguguuugcagcagaggagggagggagcaagggcgcucgcagcgccugggaaugcguaagccccgugugaagccuggggcagaguggcaggaguggagaggcagcuaguacacuuuggcuaugugguuguuuugaaagaggagggguaagauguuuucauauuucugaaauauuucuuuguguucuauuuucuuuaugacuagauucuggaaaccaaaauggaggaagugaugauaagucuaagaaugcugagagaaacuauuuaaauauuuuaccugguaaguauuauuuuguuuuacauucuuacuuuccuauagucacacacacuaaaauaguggauuugaaacaugaguucuuacgcugcucauuuauaaaguguugaaccauaugugccuuugaaacagcacuugauccauauaauccauauaacacacagauguucuccacugcaaagccccgcuuguauaccaguaaugacuucuggauccacagagaaaacccauagucauaugcaguuuccaugauuuuauauuuuucauuuucucccauacauuguuucuuaguuacuaaggaaugagccaagagguguuuuuacucuaaaauauaagcaguggugcauggaaaugcaugugauuagaccguggcagggccuuuugaugcaagcucacaucucccuucgcagccuucccccugugucuuccccuguugcuaccggacacauuuaaccccaggagcgcgagcucucagucuuccuugugguugcgcucacucgcugguucuuaggcagcaagcagaagcccugggugcucuguagacgugagcucuugaacaguggucggcuuuauaguuucagaaauagcccuuccuugauaguuuucucuucucuuuuauguaguuucucacuuccuuccucagaccuugaacacucgggccacaucacuaacuuaagggaaagucauucccauuucggcccucaucuuagaaggcauagcccguugggcuguggucaucagccuccaagcuuccucccaccuucgcaucuccugccuugguggauaauguuagacucaccacaagccguuuccucccucuguggaacaggagccugucuguuauucuuuguaggcccaugcccugagucaucacacuggcuuucuaggauaggagugugguagccguuacugcuguggaagugccuguaucuccugaucaguucauuuccuuccuuccuugaagaaagccuaucauuauuaccacuaaacaaggaaugauaugccuuuagucugggguaggcaggaguauuaaauugccuaccacauaugcugacagggucugaauuuccauacccagcauauugauaggcgaugaaaaacaucuccaucaaaacuuauuucaagucaugaagaaaaccagguauauuacauacuuuuaaauuuuuuaauuuuuccuuuuaaguuuuuuauacaauauguuuuuauccuauguccuuccccuucacccaggaauaguuguuucuuuaugauggucuugguacccaacagcuuauuccaugcaguucuccagcagccucaucaaacaagcaguuagccugaaucccacauuuucugugcaaagugccaggugagaaaguaaaagugaguccucagucucaccuagccaaagacugcuggagagcagcaggucuccuccacuuccaacccggacccuucucuacgcuaucucaguaauuuguuacuacagccagcaccuggacuggcccccauuuuauuaauggguaaaaugagaccaagaggcaagucauuuaaggacggacaaagcagugccagauuggggauuaggagcaccugaccggcucacggaguugucuucccucacugcuggcccacacccaaggccaguguugggaggcccauccacugagaugaggcagacacaucuggggcccaggaggccacugccucgcgugcucugcuccguugugacaagcccagccccgccacaugaucuccuuucuacuucucucuggcuggcuuauuuuauaccucuaucuaugcccuuuguguucuuuuaauuguuugcccguuuguuuuuaaagaaaacuuuuugcuuagguccccugagaggcaucuuuaacuacagcuuauacacacugguaacuaaagaugcugaagugcgaaagcacuuuauauuuuuauuacauuuguuuagaugcgugcacgcgcgcgcgcgcguguguguguguguguguguguguguguguguguguguguucugucuguguucaugugugugcucauguuaagaccagaggauaauuugugguauuaguucucuccuucccccauggucuuggggaucaaacucauacugucaguguuggcagccaucaccuuuacccaccgagcccucuuaccuagccaaaguacuccuauaaaauauuuuccccagcugggcagugguggugcacgccuuuaaucccagcacuugagaggcagaggcaggcggaucuccgaguucaaggccagccuggucuacagagugagcuccaggacagccagagcuacacagagaaacccugucucaaaaaaacaaaaaacaaaacaaaacaaaaaaaauuccccaaacacauuuacuaucuccuauaaauauugaaaacaagugcaucugucuucucuuucuauauuccugaaauuauuucauuuuaguuuuuguuuuguuuuguuuuuuuuacaaaauacuuuuacugauuauuugggaauuucacacaaugcacuuugaucacacucacaucccaguucuccuagguccacccuuaugaccuucccaaaaauaaaagaaaaggaggggaaaagggaaaaaauaccaaauccaguucgaguugcccauacacucacuggagcaugaucaaacuccaaguggccauccccuuaaaggaagccgaguccuuccccacucgcauucccaccccuaccagaagcagucagcugugaagagcuguaccucagcaucuuuaauggcuuccaguccagacauggggguggggguggggaggagcaucguagaaaccuucuauuucucccuuucucaacugugagucugcagucaucaaagccaugacaaaagacgcuuccuugcccuucacagccaguggcagugugguucauggacucccacuugguaucuggcuauagcacaggccacaggcaucaacaugguuucggcuggcaguccaggccacugauuuuaauaaacaaaauaccaugaguuuuauuaaaggaaaaugaauuuuaaaacaugagguuaguaaguagccagauagaugaaccuauuuuguaauaugaagccacugacuuguaacucuuauaaagauaaauuucaucuauacaaacaaggcaguuuacaacuuguucucaaccguuuuugauaguugaauuuuuacgccccugcaaaauuugaaugagaagcaaauaaaauaugcagauauaaguuuauacuuaaaaaauucugccaaccuccccaguaaauagugagugcucgccaguuuaguguguuagcagcgcugugcuccagcguguacucaccugacagcaccuuauaccaugcuucacagggccucagugacuuccagcgggagucuguaugcagccuguucucagcaacgacagcacaagaccuaugcugccugacaucugcaugugacaaagccagcaagauaguucuccuuuguuugaguguuaggacaauuauaaaguguucaccguucaguggguuauuucccaaggugaaguuauguacugcaagggagaauagcuucaaguugugaauuaagauccuuuucuauugguguccaucugcucaagugucccuguguucucaccaugacugauguugcuucuccuucucuaguacuccagugaaggccccacaugggcuuguuugaccagauggguugcuguagcuguuugucaggccuggaaggcuuggcccguuguuccuuugaggaacuguaaucuaucccuugugcugagcuccagcagcguucccuucuucaguccagagacuuauagcugugccauuguucugcccugggucuuggcagggcccuacuaagacauuccaaauacaaauauauuagguuuaaaaaaauaaaacguuaauucugcauaagaaaaauaaugauuauagaagccugaaucuuacaguuuaagaaacaguuaugcaugcauucaaccaaucuuuauuaagagcuuucuaugcaugugaaauggauuauuacgauagaaaaagcucucauuggcuauaauccauaagcagugcucuuucuagcauaauuuauguaaacguaggaugccucuguuaagaggaaaaugaagcagaaugguagugaagaaugugugagagguggaagaguccuguaucgggauagucaaggaaggccuuucugaggaucugaggugccgugcaaggaucuucaggaaagccuuguaggcaucagucugaauuggggaaaagcugcacggguuuggagaacugagcagaggagagggaggcaagcaagugcugaagagaaaggccuugucugagcuaugcgggcccugugggucaccgugaagcacuggcuucucaacuccugcauguguuucagugaggagugauacccagugugugucagccucuccgggccagugcaggagugcaugggguagacuuggagaaggcuaagugcaguuuccauuucugacuggugaaacugaugagcagagauugaccaaucagcugagaugugagagagcaaucaagacacaggaaggcaggcugccaggucacaucuccacauguuaaaccugauauuuuaagugcuuauguugaauagcaauuauaaacucacuuaccuauaauccaagggucccuucauaccacuuuguaauccucuugacaaacuagcucuuuucucuuauuuuaauugcuuuuuucugagaguaaggaagaguguuugcaguguaguggcuuccugauacgaugucaacacacuccccccucccccgugguuauuuauaaaccuguggaugagagugacucauacacuugagaaucauggccgcauuucuuguucacaggagaauuuuacauuacacgucauucuaaucucucggaaauccauguugcuuuccaccucuguguggaugauaacgugaagucgggaaauaucacugcucgggaucccgcuauuaugggacuccgaaacauucucaaagucugcuguacccaugauaucacaacgauaagcaucccucucuugcuggugcaugauaugucagagguaagcaacaaacacucaccuuuacugaacguguuacauagcaguccuguuaucagccgacaucuuaacgugguccugugcuuuuaacugcuggaccuuuguaucuccuguugggucaguuaaauggagugacauaaaacaacgaaaagugcucagaaaauuauagugcugcuugauaucaguaaacgggacuccagagaaucuuuuacuucgagaagaagugagucucccugccucucuucuacccauuccccaccucugcuuuccuuuccuucuccgguuuuacuuuaagaggcaauagauucaccuucacacuuacuuguggcucuggccaaugcuaagaucaguuuucacuuucugaauguacgcuaguaguucagcucagaguuuucucgaggaugguuuuuuugguuuuugguuuuuaaagauuuauuuauuuauuauauguaaguacacuauagcugucuucagacacuccagaagaggccgucagaucucauuaugggugguugugagccaccaugugguugcugggaauugaacucaggaccuucagaagggcagucagugcugucacccgccgagccaucccuccagccccucgaggaugguuuugauggugcagauggugguuuauacagugagaugcagcgcgcccauucgccuguuuccuuagcugcugggauauacuugaccuuuuaguuacauacaguuucugugcuugcuucccucugcugccuucccucacucaugagaaaacuaaguauagggacuauguuguagaaauuaaugaagucuaaacuucaucuucaaaugagcaaaggaacaaaggagcugcagcccugugucugcagacaaguccuuuccggaaguccccucauacagaaauaagcccuuucucagaacaagcagcuacagaguugccaggaaggccucucacuggacacuuguuuuauuugggggagggguaaaggaagaguguggguauuuauuuauauauuuucauuuauuuauuugagacacguuuagccuuggcuggcugguacucaguauugcccaggcuagccucaaacucaugaggaggccucaaacuugccucugccuccagaguaccaagauuacacaugcgcaccacuacucuaagcgacggccuucauaaaagucaucugcucugcagauuuaaucaggaaggaagcuugguuauugaagacuguucuugucaggguuacuggugcugugguggaacaccauuaccagugcaucuuggggaggaaggugucuuuggcuuauacuucccuaguacuguucaucaucaaaggaagucaggaaaggaucucaaauggggcaggaacuuggaggcaagagcuuaugcagaggcuguggaggggugcugcuuacuggcucacucccccugccuuacucagccuauauuuauagaccccagacccagcaucccagggauggcaccacccgcagugggccggguccucccccauuaaucacuaaguaagaaaaggcccaacagguuuggcuccagccugaucuuauggaggcguauucuuaauugagguucccuccucucaaaugacgucagccugugucacguugacauaaaaccauccagcacaaugaucaaaggucacaccaaaguaaaaauguuugcagugcuguguuauagaaggggguacaaagaacuaaggccccuaccccagacugaugguauacaaaaggccugaauccagccucacagccuguguaaacacuauacuaucaguucauuacgugaggaugaccuagcugauguccagccugcacugaaggcuggggucuuugcucagugagcacgccacugcuauuuuagucaagaggguuguucccauccugugguggcggccccacacuuuccugcaucucaguccucucucaggagaaauggaccaagcuucguagaaucucaguucuguggagaaugcuuuagugauccauacuaacuuacuaguuacuugcuaacuaacuagucaucuauaaaagggucuuuagggagugacaacugugaugaauuucugccacaaagaagcauccagacauuccugcagcuggacucuugguuaaccagcuuauaaaaaugguuauacguaggugggaaacaaccucaaaaacacuauuuccaaaagucacucaguucagauugacuucuagacaucugauacgacaguguucccucucccacgguguuacaaaagcugccuuucaaaucgggacagccagcugcagaacauuaaguuuguuucggaaguguccaauuuaauucacaaaaguagauugggccacaggccucccgucugcuguauuuaaaccuccucaaggucgcaaaguuuauuuaacacacacccaggcuguagagguguggguuguagguuuugugcagggaccccaaaguguuuucaaauucugcuucucccccucaaacaaauagggucucugcauguggcugccccacacuaagguaucaaaguaguaagugaggucagaaauagucucggauaccacgacagaugggaaaguuauggaauuguuuccaacuuaaaaagaaagaggaaaugaaaaagaaaacgggcuuuggguggugggggaggggcccauggcuucuaucugucuguugcuuaaagacacuguccuauuggagucagucagcuggagccccacuaggcuuugugcccacccuuaacuccuggacccuuugagguuguggccuuuguaauugcaauuagaaauaaagagguacauauaccuaguauacacaaacaauccagucagaucuucgcagauugaacacccuguaauucauacccaaaucucagaacaggacguuucuuguaccccagaagaugcccauguacucucagcuacuuaaaccugcuucugcuggaguguaucccugauuuucacuuaaaagugugggcuaugcacuggagggagcucacgggauagaagugcccgcugccaagccugacaacgugagccugaccuccaagacccacagagugggcagaagaacugauucuuguuuauacagaugagacggguagugggagagcaguguaaaaacagguuugaagugugggcuagucggguuguuucuguagugccuuggcuccucugccuuucacucagugugagguuugcgagagcacccuugccuuugaguugugcuuguggacucuucucucucauuuucuauagguaacaugauacggcucaacuacgguuaguuagcuauuuuacuauuuagggacauuugggugguuucuagauuuuccuuuuguuaaauuuaaacauccauucaaggucaagaaguuuauucuacaaacucagauggcauagcccaggauacagaggugugaguugugcaggguccugacucucugguuauuaccaauaaagcuucuaccaacacuuuugaccgucucuuuuggccauucuauuauaaaugaacuuagggauaaagcuauuggauauugggguauguuguugauuaguuuucacggauauggccaaaucauuuuccaaacuaguuauauuagccuacuguuauuuuaauguuaaaaguaagaaacaagcuagauaugauggcucaagacuuuuaaucccggggcuggugagauggcucaguggguaagagcacccgacuguucuuccgaagguccggaguucaaaucccagcaaccacaugguggcucacaaccaucuguaacaagaucugacucccucuucuggagugugugaagacagcuacaguguacuuauauauaauaaauaaauaaaucuuuaaaaaaaaaaaagacuuuuaaucccaacaaucaggaggcaaaggcaguuggaucuuugugaggucaaggccugcugggccuacacagugagaucuugcgccccccauccccaccaaaacgaacaaauaaaugaaacaaaacuaugugcucaaccucuauaauugcuauaaaauuuauuuauaaaaauguuucaaauaucucagaggcacauucaugagaaguaaagaauaaucuuguaaucuuuucuacuggugcauaaacguggaagauauuguaucuaacuuugaagacauggaguggaaaccuaacauggcauacugagguuuaggcuugacuccacacaccuguaaucuuaaccuucaguaagcugagacaggaggauuaccaagagguuugagaccagccuggacuacguagaagauacugucugaagacaucagaaaagaaaauaaacaaacaaaaacuccaggaguucacccuuaacccugauccaaagauguauggacauugcucacagauagauguauuucucauuaaaaucuaaauugagaguuaauuucaguuuuagguuuuuagaaucuauucugagugcaaugcccauuuauaauaauauaguguaauagaaaacccaguuuucuaucuugguuucaaauuucaaagugugcccuuugagccacuuaaguucugaugcaucuccuauacaguacauucauucacuaaggcauguugcccagacaaccacucugcuggucuauaggacuuucccugucccacuagguccauaucccauccguaacaaccgauucugaagcuuguuucugggagugagcgucuuguguaacuacuggccucacgccaugcuaacaagccacgaucaugucuucucauggccuucugaacuucuaagggcuacucuucugggugaagaguuugaggggguauuuaauuuaauuuaauaauuuaauuuuaugugcgugaguguuuugccugugcguguguaucuaccaugugcaugguuaguaccugaagaggucagaggcugucagaucaccuggaacuggaguugcagaugguugugagccgccguguaggugcuggaaguugaaccuggguccuuuguaagaacagcuagugcuccuaacugcugagucaucucuccaacccccuuaggauuuuuaccugguuuaaucaggaaaaauaaauaacagagaaagaaagcuggcaacaucuaacuuauuuaggagaugaaauugcuauguagauauagaaaagacucagggaaauggagagcugucuagcauuucuuuccagacucguacugcugagucaaagauaaauugcauaugacaguguggcucaucugcacauuagacuguugcagacuauagcucccccuuuaugucuugcugggguuaaaugccgaguuggcauuuaguuuaucuucuaaguaucaucaauagcugccaauccacagcauucugagcagcguggaguucuuaauuugucucaggucuuuguucuaggccauauauuaguuacacauaacaaaacaacaagggaacauggcauucguggugcucuuugauugaaaagaucagagaaccauggaacuggaaggagcugguccagagcaggagugggguccagucauguccaucccuggaagucuccucgggagcagggguaggacagcucccuccucugccuuggccugcaucagaguaugucacuguggucacugguuaacuuccccgcuucuaaacuguuucagucaucucccacuaaaauauguucuguuuguauagcagcaugggcuuaucguugcuuuucaaugagauucauauuuuauaccucaguuuuaauuuuaauaaaauaaaugugaaagauauaauccgcauaaacagagguccauagucuggugauuuuuaaaguauaaauauucugaacuccaaaagcuuaagaaacaccauaauaacaaauaagucuuauaguuaugaaaaggcuuacagaauagaaagauaauucuggugacagugcaaagaaauagaaucuaaaguggcaugcucaccgacauggaaaaauuauaaaauguaugggcauaguuugguauauacaugacaugaguguauuggccaaagauuaaaaaccagagugaagacaaugaguauaucugacucaucgggugucugcuguggacgacuuguucauuguccuuacuuuugugauaaugugugauaugguaaauaaagcaucuuguuuuacuugcaguuaauguucaguucaauagaauuaucuaugcuaauaugcaauguuuguuugaaguucuugucacuagacaacuuuaaauuuucacauauauguucauuuuuuuagucugguuugcuaggcucauuaaaucaauuuguauuccauaaauauagucuauuggcuagaguguaugucuaaaagccaagaaaaccccuguugggaugauuagcaugguauccgggacuuaccugaaguggggacauucaacauuccagauaaaugaagaucugaugguauuauaacauuugguuuuaaugauauagguuugguuuuuguuauuuauaugaaauuaggcugaaaacauauuuuuguguguauguguguucuuuuuuuuaggaaaugacuauaccuugguguuuaaggagagcagaacugguauuuaagugugucaaagguaaaucuuucccaguuauugaaaggagagccucccaaagggaaggcaaaguugccucuguuucuggugcuuuggucaaauauuuaaccagucaaauauuucauaauagaguuuauaauauuauuuuuuaccaguuacgaaauaaacauaucucuauccauccugaaacuaggauauuuggauaguaaauuaauuacucuacauggugcugaaacaaaacgccugacaaagucaaauuaaggaagaaaggguugauuuuugcucagacuuugagguuacaguguggcaguagggaggacuuggcagcaggagaguguggucauguugcaucugccgucagggaaccgagaggugaacguuggugcuaggguagcuuucuccuguuuccaugucuaggaccccagccaggggaacagugccacccacacugagggcacugaggaucaggcaucccacuucagccccacagacaugcaaaaucucuauggugacucuagaucuugucaaaucgaugguuaguacaaaccccaccaaugccccguacacugugcugauucuagcugcccuugagugccuuuuauuucagccacaugugaauuuaucuuucauaaucuguuuuaucuaaagccuauaaaggugacguaggccuuuggguauguugacaagaccguuacaccucucugguauagagaauugggaagugugggucuuuaucuguccuaggggcuuagcuuuucuucuaggcaaguagcuaccuaagaggucaaggcaugagacaagaauuucacaaugaaauucccccucauuuuaauaagggaguuuugguauggaaggccagagcucauaacauaucagccuguuguucuuuuguagguuucaugauggagauggcuucaugggacggaggaauuucucggacagugcaauuucugguaccacagguacguuaucugagcagaucccaguccaaacuaaggucuuuaagauuccuugaagacacagccaaguaugccacccugaagucuucuacauaaugauuuagggggagaaguauguuugagugccaugcaggcacuucguguacugucagcaauuugagcaccuaccacuugaagaucuggucugaacucaagagauuugcuuuccugugccuggggcugggggcugggggcugugcugcuacccucgacagcucugaauucuguuuagaacuuagcaguacuaguggaguuuguuucuacucaugcugaugaugacuaaggguuucucuaguaaccaaaaccuuuacuugauaaaaguaauguagguuuucagagaguuggaacuagaaaagcagcuccaauccauacuuacaaaauugaaucccucaggaaagacaauuuucacauauuauacucucuaccuagaaugagagccacguuuuaaaauacuuugagaagcugagaaugccagcgaggaucuaacaagcgcucacuugcccuggucucccucuugcagagcauuucugaagaaauguuuuaucagcugagcaacaugcuuccccagaucuuccgggucuccucaacacucacgcugacauccaagcacuaacucauagacggacacacugacagaagaggauuucugaacucucugagagaacuguccuggaauccuguuaagcaaaaggugcccagugggaucgagccaccuguuaagugaugaaguauguuaucaaacauuccaaaaauguguacacgucacagaccagaagccagcucccaacugaagcauuuacucagucccuuuaugaaauaauagcucuucuuucuacuuauauguccuaucagggaaugauggugguaacacuugaggugucucucaaauauggacacuguauuucguugcacuuccguggagaccucugauuuuuccguggcaugaguucuguaauuaggcauaaaaguacaauuuuuccuuuuacuuuauuuguuaaaucaagauuuaaauauacauuucaaguauaaauuucaugugaaaauguuuuuguagcaaugcaaguauaccagacaaaugugcuuguuguuuuaaauucuccuguuucaaacccuggcucuuacucuucuucucuuucuuuuuuuucuuuuuuuuuuuuuuuuuuuuuuuuuuuuuuuuuuugguuuuucaagacaggguuucucuguguagcccuggcuguccuggaacucacucuguagaccaggcuggccuggaacucagaaauccgccugccucugccucccuagugcugggauuaaaggcaugcaccaccacgccccgccucuucuucucuuucuaagguuguauaaguuagagucagagaaggcuuggaauucuuuaccgccaucucaccuucccucugugaccuugcccaggucuacuaauaacauuucacgggcuggggaaauuguguucuuuucugccgaccugaugugaguuaguguagacccacaccuggcagcauucuggcgcucugcaaugcugacaaccggaucgcugucacuucuccauccccugggcucccugucucacugcucuuccacacccgucuccaggcagaaacaguauucggaucucugucucugaucguugauguuuauccuccuuuguccaaauuggcuuugggauccucuuuccucauaggcucuuagucugccagcaugucagaacuguggcagacacgcucugguacuuucccauggaggaauaucucuugguuuccuacuccaggaagagauggaacaccuaguucacacugaccaucagacacuaaguuuuccaaguucuuuaccaagggguuggcacugcaucuggagagucuccauucccuugaagaaauggucuuucaagcaccauugcucucaucagaauuaauuccaaugcagggcagaugguuaguaaccagagauggacaggucaggaucagagacuauuucuauuaaagugauggguuuagcugggauguagguauagugagcucaacaaaaggcauucagagccagagguguaccaggagugggagcauucaaaagaggccuuaggaucuuucuacagaugcugugggacugacgacauuuaagagugcaccagcagauuuaacugugggguguggaaggaaucucuuaugccuguuuggaagcuucacccgucaaauaaagcugauuggccuguagcugaggcaggaaguagaagcugggaguucugguaggaaguaaggccuccaugacagagggugggugggauuccucuggaaccaugagggacagcagaagcaugggaaccacgcagagguaauuagccacauggcagaacuuagauuagaguagauggcuuauuaaguuaaaaaucuaaucagggagccaaccaaagcucauggccaagguguuuguacauauaauuaauugagucucagagacuuucuuucugggagcaggguugugggcgggaaaacacaucucaacagagcugcagccagcugccaggugcuggagcucucugauccagagaaggaagauaaaguuuucuuuaucaccucagggcuguuuuacugagucacuuguaaauuggggccuucacuuaaugaccacauaaaguacaacuugaccuguaaaaucaaggcaaauauauugaguauccauuuuucaguuugugcuguauuauauaguguacaucaaugauaagauuagaaaaaaaaaaaacauuccuacaauguuauauaccaucgaugaaaacacacccaaaaaugcaucaccauugcaauuaaaauguaauuguauauaguuaaauggugaggauuuuaaucaugcuguaauuaugggaaccuagaauuuuguauuugagucaagaaccaagucuucuaaucuucuccuuggaggggagcacuuucugaaagauguguuacugugacaggauauaugagaaaacguugugagcaucca

SEQ ID NO: 3407 - RNA, 312 nt, Mus musculus
cuuccuacugguguggucuuugugacuuccaccauggcguaccguggccagggccagaggugcagaacgugauggugcagcccaucaaauuuaucuucagauacaugcaaaauagaucucgaauucagguguggcuguaugaacaagugaauauggggauagaggauuguauuauuggcuuugaugaguacaugaaccucguauuagaugaugcagcagagauucauucuaaaacaaagucaagaaaacaauucggucggaucaugccaaaaggagauaauauuacucugcuccaaaguguuuccaacuagc

SEQ ID NO: 3408 - RNA, 3192 nt, Mus musculus
ggugcacaccgcacacauaggcuucucucagugcagacuccaggugguggucaacagcugcggcaugcuuaucuauuuguacgaaauaguguagggaagccccaggagguguuauagcuuccauauaccauguggcuuuugauguuucuggauuuucaacagcacaaaagaguccucgagccggaacaugcgcuacuccgauuuuaaacguggcugggcugugagacccguucuuggcucugguuuuacgaagccaucaauacauacacacccuugauggagcugcagauccguuccuuuuccugcagcccacuugugggggaaaagugccuuacugacuuacaguagccacucaguuucaacaggugccuaucuuugacaaaaaaaaaccacaaaaaacaaaaaaaaaaaaaacaaaaaaaaaaacagaaaagaaaaaaaacguuaaaaugucucuuaauuuucauuggcuguuauucuuauauugaucaucuuguauguucccagcaagucaccgggccaucgaauuaucuccauguuguuguucauuauccuucugccauguaccucagaucuaucaguuauggucucucuugucuuggauuauuuuguuccuuuuuuuuuuuuuuuaauuugcuuuaagagugcgaugccauaucaaaucaauguuguucucucacgguguacucucuaacaggugugggugggguuuaugguugggauacgaggagagucuaaaguagcagauuagugugaauaaaaaagaaaagguuuuuaggaaauccgggggaaguacauuguauugacuacaaugcugaugugauguagccguuaagucuucagugaucuuaaaaacaaaaaaacaaaaaaaaaaucaacccuaauuuguucuucugacugacuaguuugaaguuggauuugaagaugauguugaaaaagguuuugaaugcaauuagguuaugcuauuuggacaauaaacucaccuugaccuacaaugucuggcugucacuaacuucuuucuagacugcuagcccucagaggagaacauacccgucccccaguuuuagaccaugaauauagccagaugugaguggggauaucugcaagugucuucauuagguggcugaggcaacagugucaugccugggcuuucaggauagcccccccacccaucccccgucuuuugccaaauacucacucucuugacugugaguaagugucuccugguaugguugccagaaacccacugugcuaucuccccacccuuagccaggggagcaacaugagccaaguguucggaaagguucccauaaaaugccucuccccccccccccgcacccuuuccuuguaucucucgugugagguguccuagaaugcauaagggucccccuggaacuggaaucacagaugccugugagccaccaugcagaugcuggguguacuggcuaguuuugugucaacuugacacagcuggaguuaucacagagaaaggagcuucaguugaggaaaugccuccaugagauccagcuguaaggcauuuucucaauuagugaucaagagggaaaggccccuugugggugggaccaucucugggcugguagucuugguucuauaagagagcagacugagcacgccaguaaagaacaucccuccauggcuucugcaccagcuccugcuugaguuccaguccugacuuccuuuggugaugaacaacaguauggaaguguaagccgaauaaacccuuuccuucccaacuugcuucuuuuuuuuuuuuuuuuuuuuuuuuuuuuuuuuuuuuuuuuugguuuuucgagacaggguuucucuguauagcccuggcuguccuggaacucacuuuguagaccaggcuggccuggucucaaaaacucagaaaucugccugccucugccucccaagugcuggauuaaaggcgugcgccaccaugccuggccccaacuugcuucuuggucaugauguuugugcaggaauagaaacccugacuaagacacugggcaucaaaccagagaagccagaggucuuaacugcugagccaucucuucagacccauacuuuugcauuucuuguauuucucuuuuuuguucuuguuugcgcgcucucucucucucucucucucucucucugugugugguguguuuugaguuagagugucucaugacuuagcuccgacuguccugaaacuccugucucugccuccccaauacugggauuaaaguucugugcugccacaaagggcuugcuuuuguauuucaaacaaauuuccugagacucaaacauccaugauagcaacaaaaucagaccuuccguuggcuuaucagggacguuccuaacaucccucugugaaccaaguguccagaagcugccagauaguguucggccuugggcuggggaggaggaaaguggcagaaaugcccuugagagagguggagagauggcucagcagcuaagaguguuugcugcucuugcacccaaaucagggggcucacaacugugacucuaguuccuggggauccagcgcccucuuuugccucuuacggcuucugaaggcacugcacacaugacacacauacauacgugaggcacggauguauacauaaauaaagauaagagauguaucuacauauaaugcuuuugacagugaacaugaggguucguggcaccaacgugaugugaggauccagggccuacaucuggucuucaggaaacacaauggaagcaccacagcucuguggcugaagaacuucucugugaggaaaccaagcacacaggcuugugugcaaacgcauggagguggaucagcaacugggguugaauguggcaagagccgguguugagagaggagcagggcuugugcuguggagaauggagagguuugcuccggcacaugaacugaagaaaacacuuguuaggauguccauguucuuuggaaacaguaaaaguggaccuugacuuuuuccaaagauaaagagaugaaaaguguuuuuucagggaaggggugaguacucagauaggcagccugcaaagcacacacagcacaacagacuuuaaacuccacaaauacauguaggaagugggcuaaacucggccacagacacugacccagggcggccaccuaccugauuucuugggaagccugaagguaaggcuggaaauuaccuggugacuggugacuug

SEQ ID NO: 3409 - RNA, 27034 nt, Mus musculus
auuguaggucaaggugaguuuauuguccaaauagcauaaccuaauugcauucaaaaccuuuuucaacaucaucuucaaauccaacuucaaacuagucagucagaagaacaaauuaggguugauuuuuuuuuuguuuuuuuguuuuuaagaucacugaagacuuaacggcuacaucacaucagcauuguagucaauacaauguacuucccccggauuuccuaaaaaccuuuucuuuuuuauucacacuaaucugcuacuuuagacucuccucguaucccaaccauaaaccccacccacaccuguuagagaguacaccgugagagaacaacauugauuugauauggcaucgcacucuuaaagcaaauuaaaaaaaaaaaaaaaggaacaaaauaauccaagacaagagagaccauaacugauagaucugagguacauggcagaaggauaaugaacaacaacauggagauaauucgauggcccggugacuugcugggaacauacaagaugaucaauauaagaauaacagccaaugaaaauuaagagacauuuuaacguuuuuuuucuuuucuguuuuuuuuuuuguuuuuuuuuuuuuuguuuuuugugguuuuuuuuugucaaagauaggcaccuguugaaacugaguggcuacuguaagucaguaaggcacuuuucccccacaagugggcugcaggaaaaggaacggaucugcagcuccaucaaggguguguauguauugauggcuucguaaaaccagagccaagaacgggucucacagcccagccacguuuaaaaucggaguagcgcauguuccggcucgaggacucuuuugugcuguugaaaauccagaaacaucaaaagccacaugguauauggaagcuauaacaccuccuggggcuucccuacacuauuucguacaaauagauaagcaugccgcagcuguugaccaccaccuggagucugcacugagagaagccuaugugugcggugugcaccuauggagggcuugucggcuuaaggggacuucacugucucaguauuaauuccccuuuuuaaagcuauucccaagguuggacugucuaagguaagcaagggggaguccuuugggcuuagaggucagcuggcuuacuuagacuucugauugcuaccuccaguucccacaccacuguccaggacacagggacaagugugguccucccagcccuguccucauggagacaaagcuccucugccuucuuugugaaagccacccugucuuagccuguugcuccuauaauucccaaggcacagucugguggguccccaaagagcuagacuauaggaaagcucuuaagcucccucugaggggucacuuacccugcuagcaacaagaugggauccaggggugcuacauguacccccagccuggcugcuagagaggagucccgugucaguaggcaugcaccuuaaagcuagcaaccuauaugacgggcucugcuuucccgugguguccuggggacaguucaaaccaaagcagccucuacaagcugucccaucuagaagcagcucaccacucacaggcugccugguucuuaggaaccauuaugaaucuccuuaugcuuagcauauuauuuuuggcauacuaggguuucuuuccccuaggauuuggucaaaacagggaaggaucaaaauuuggcaggcugggggaacgacuuagcccccacugauggagaaaaaaaacaagaacaaacaaaaacaaacaacaaugacaaauuagaaacaaagaagagaucauuagcaaggcagaaaaagaccagaaucugcaaccccuucuguaggauacgaaggggcuuggggagagcaagcugaaauccuuggggucguuuauaccccucugagacagaaauacuaccaaggagacccacaucuaagcagaagguauuggucaccaaggaauccaggcucccuuccuuuguguaagugaggagcaggcagaauggccacucuacaggacucguuccacuaggcuccaaggaaggcaaacaggaagagugucuuagguuccagguaagagggauggaggggcagauaguaaccugccucuccccuugugugucagcuuccuucauucaauguuucaguuaagcucaaaggccacucaucagguacccaaguugcccaagaacucaagggagugugucugucaaguucuguggggucccuuaaggaccagaagagugugcugugcagugcgugagcucuggauaaacacuggcuagcugcaggcugcucccguuuucucucucaaacuucccaaaccaucacccaccguccuaccacaaagccccuagaauuuagggucucgcuaacucaccaagucccaauccuuccuaaauacacccgagaccacagaaacagccucucccuucuuucaacuugcauuccagacucauucaacuugggccuccuaccuugccccacucaacgggauccaaacccugaagccauucaaugcuacacacagacaaccuggccacgcacagcacuugccugucacuguagacugcagaggacaagagaaggagaaaggaauaucauccacgugugcuguagacucagcaccaaccagacucaguccuaggaagacuucggaggccauccgaaguugggguauagaugccaagaaggaaacuggucaauguucaugaugaagggaccccaugaagaggaaaguccugugucugaaugggcuacaagauggagggagggucuccuaacugucugccagaauucuucauugcagacccuggugcacgcaugcaaaucaggcugaccuaguccacugucuguguuugaugaguaucugccuuggguagaggagcccuucgucacugucuucuaucauaagaagggagccugcgucaaaggggagccuggcaaucuucaagacagagaagaccccuggccugagacucuggggucagguuucuccugcuuucuaucaaggaggauguccaguuccugucuucugccugcccugugccucgugccagcggccuuccaaacagauccgguauagcugugagguauuaggaaaacgaaaagaaguacauuguuaucacuauugguuuuguuuuguuuuguuuuuguccaguaaaccugagguaaagaauacucucuuugaagaauguggucagaggaggaaagaaaaccugguaaugaagaggcacggaagaaaaggaaccaaacggaaccaaacgcaacgcagcccaucgaugcuaccagaaggacagggacagaggaaaaggcuuuuccaguacagagaacucgucucucgaccaucuaccucgggacuugaaauuuaagcaguaaaauaauauauuauaacaauguuucuaaaauagcagcacaccgugaaacauuacagcuagguacuguuaaugugaaugggggugaacgaucuuagcuucuuagcagcgaaaaauaauaauaauaaacagaacaaaagaaaaaaugaaagauaagagacccuuagauguuucuccaucuucaacccucacacugugaaacaaggcagaaccuguguauaacucuucaaagcagcccuguucugaucuuuucucaaaaaaaaaaaaacaaagcagauauuuuaacaaauagcuucauaaccugucaauuauaauugugcaaaaaaaaaaaaacaaaaaaaaacaaaacaaaaccaaaccaacuguggcucccacuucuguuuacugacugucuccaagaagugggagaggggggucuucaaguacaaugaauacaacuuugcacuaaaauuacaaacaaacaaacaaacaaacaaaaaacggaaaagggaccaaaaugccacacccugauguucagccugugcaucagaaguaaccuuucuuuccauguccaaaggagaaaaacauagacggggauucaauccuucuaagccaucacaaugcuuuagaccucuguugacagguuuuccgaagaaugcugggaugaggauaucagcagagggcuuucucagcccuggcagggacaccagagcuggguaccagaacaucagacuccagaaaugaacaguaacuggacgagggucaggaaggggaggggcaaaggaggaaggcguauucaacaugauuugcauaaaccaucccauaucccaccccacccucccccaaaauuuucaaagugcuuuucuaauggaaugguuuauaacaaaguuaaacaguggaccagacaugcuaaucagcaccaaaaguuagggguaguuucuuuuuuucuuuuucuuaacaaggggauuaaagaucaccucacccucuucccuuacacaaggcagcuuuguuuuagauuccgucuauggucuccaucugcccccauuuagaugcguuuuggucauggcccauagcgaauucccuccaucagauaacaguaaaauacaucuacaaugaaccauguuuggaaguagaagcccaaauucaccaaacaugagacuuaggagccguucaccuguguccaacuggcaaaagacauaucccuuagguagcagcuacuuuagucagcaagaguaugcgacggagagacccggacgcucagucuugggaacacguggugaggcaucaaggcgcuucuuacauccaaaaugguucagucaugugguugggugguuuugcgcaaccuccccggcaugucccuucucguuucugauuccuccuuggguucacugcuuugcaaacuacucaugcgguccuggcacccacgguuccuugcaauucuacuaaagggggcauaugcacuaggucacaagcacaaaagacagucuccucuaauucguucccauguugcagguacgcacacucucuagcuagucugcggguucuccuguaagcaucucacuaugacuuuuacaucaucaaauaauaacgguucgaguguacagggauccccuuaugcaggacuuugaacaggcaccacaugcguuacaacuauacggccuuuuccucucacuucuaaaagaccuuuaaauaggaucuaggugggggcagauuuuguuuuuguuuuuuguuuuuuuuuuuucuuuuuugaaguuucauccuaaaaacacaaagaacaagacauaacuagagagagaaggggcuagcagaugacgaacacgccucucucuugccgcccgaauggcuuccucacaggucaacaucccgcacgucuguaggggugguggcuugguccggaucuuccacagacuuggauccggcguuaugcugcucuugacggaacugcugcaggcuguucagcagcagagcuucgauuugcuccuggcaggcuuugagacaauccuagaggagagagguccagaccggggcuauuagcacaugcaaaugcauagaacgccucucaaaggcagacgcgcgauccaacucacauccugauuuuccugugagguaagaauagaaauguucucaaaugccauggaaacuacucaguauacaaaguggggggccacagcaggcagcaucagcaccaucugggaacuagcuagcagccuaucccagaucaagcuggucagaaccagcgcaucagcggacgccuaaguguuuccuauuccaaacugcauugacuggaaggugauccagcuacaaaaagcccuugccugguuaucaagggaccagcuggaggucucucugucugggaaagguggcacagaaagucugguuccugcaagguguuacacuguaagucaagcaagcaaccguggaacggauagaagggcggugcuuaaacaucucugcauucuuuuaccacccuuggaccccuuucgcaaaaacacaaugcauacuguuuacaaaacucgggacacuugagcuuguccaauuugggaauaagcaagauuuugcaguguugccuuuauuagucuauauuugguagggaaaauccagagugagcugucccaggcagaagauuucuauuugcugggagacauggaaugugagggcaagucauggcugucacugggaugggacuaaggcucaggcuagaagguuggggggaggggagccccuagcagggauuuucacccuaguuucuccgucccaccucccugcacuaggaagcauccugugcguauagaaacggugcuaacucgaaucuccugguaucugcucacaguucaccauaaacuucccucuguuuauuuuucugcuuagaccucaccaccuaggaauugauauuuuuuuuccacaaacauaaaggcauuaucuuuauuuuccagagaccugaaaauaaaguuggcaauaacuacuaaggagcaaaaguuugcauccucuacccccgcccacccuacugcuccucauccccccccccccacaugacaccuccauuuuuauucuuucccaucucucaucugccccccaguucaaacuguagcuugaagaugaggcauggcagcagaucaagagcgaaggucauuggcugaaacguucuccugaaccugggaagggcgggaagcaggauggggaugucuggugcucacucggugcuggcagggcacagcuccauuugcaaaccccgguuucuccaaguauaaaaaugaagagcuaaguagcaaaucaauaaaugauugguguguguguguguguguguguguuuuaauggcuccaucuguccaggaaucugaaagaauccuuuggauuuugagacucauguuucucaggcuggcugaguaguugaaacuuuaaguacacaaacacgcccauccuauauuucugugaacaaagguauagaucaccaacuacuuaagacaaggaugugucgaagguuaauccuagagauagugugguccagcauugggggcgggggucaccgggucaccaggcuaauuuuaacaggaccaaguaaaggacucaugugcccaggcucuaacaucucucauccugauccuugggaccugccacccucauuagcaauuaaaaacucagguccugacagcuucucauuuguuugccauguuuccugcuaggccaaucuggcagcauuuggugauguguaaauagcuuuuuccuggaaggcagagagaaugagugggaacaccccaauaccagagacagcaaccauauccaugccuccaaucauguaccuggccucagaaaucaaauccuaccugaggccuggaagcuucugguauuuuacaacaguaggauuuguagcugaugagggauccuucgugaggcugggucuaugugguggggcuugagaggagaacucggaaccacuccauuugaaaggaagcuggcugaggagaaggcuggaggauuaugccucugaagacagccugggcugcagagugagaccuucuauaaaugaugaggaaucuuuacggugugugugugugugugugggguuacuuggugaauauuuucugauguaauguacacgggagacucugcucuacaguaggaaguuuugugccucuuggccaaguccauacaacccuuuuuuuuuuuuuuuuuuaaacuaguccgcuaucuucugauucccggaaaagaucaucuggguuggcacaucuaccccgucaucacgacccuuguacaucucuauuguauuaaugaugccagauggucuucauaaaucagccugcagaaagcuuaagaacuuggcguuaggaucugcagugucccuacucuuccuacaguaagccuucccuucuagcugcccaagauuuuaaagggauaguugggagaaaccccuacagggaagacaagacaucuggcagucauuucuacugcacguucagagccaagagcucaagaugaugcaagcaugauguaaugguccagccaaggguaugcucaccaaguagucuaagcacuggaggaagauccaaagguuucauguaaacucuaugcucucccuucccaguguuaacugaaauucaaaucauuacugacuggaugaucccugaucuuugcucccucucauuuggagagaggaacaaggacugaugcaguuagccuacgaaacauggcuacagagucaucugccauucaccugggagacugcuaaacccaucaggucugcuuaacugcugucuaucagcuuccacuuccucauaaguggucaguuauuagcucuaccuucaacaagggucccucaguccuggcucggccagguagaaauccucuaucugcaggaaguguagaacauauuccuuccugaggguggagagaccuacaugguauuccuccaacauccaucaaucaucaaucaaucaaucaaucaaucauccaccgaucaaucauccaucaaucaaucccaacaguuacaaccgccccagcuuugcaggagccccucuuggagccauagugcaaauguacuuucuguacuuuucugugagcuggcaaaaagcaaggaagaaaacaccacugcaggggagucugaacauggguuuguguaagcaugccucuguguguguguguguguguguguguguguguaggggugaugauaacaguuugcaggggagucugaacauggguuugugcaagcaugccuguguguguguguguguguguguguguguaggggugaugauaacaguuucccugaucaaaagaugcuacauccaugugacaagcaggaacuccaggaccucagcuuuguggcagccuccgaaagcagcaggcauuguguuaagaugccccaaauuaagcugauuaaaaggaaagccauaaugcuagucugucagcccggacaggugguacuccacugcgcuggaggucgggcaccccuccaacuccucugaugacgggucccucccuguacugcccccccccccccauccucagagcccugacagcagcggcugugaucucuggcucguuacucaggccccccgacuuccuccacuugcuggcucgagcucucugccccgcacccuccacugccuccaugaauggacccacggaacuccaaccauuagccccugguguaacugcauccacccauugucaguacacacgcacugcacucaacagugggacaaagagcugaaugagcugcagacccgccgccaacucaggcagagacaacuuaggaaacuaucucauucuugcuuucuucgcgggcugcuuggcucguuuccuugcauacagaaugagguggacaagaaaugagggagggagggagggagggagggaggcagcccccagcucuacccgccuccccacccccaggcaugcuuuccagaauuccuaccuccccgaagccccccuuaagcacacugaaggugguauuagucagaggcacuuugagaauacaaguuucaagccaaggggggcgggggacagaagagaugauggggacccccucuccccagaaaaguuuggguccaaagugagcaaugcuuacuuaaguuauuuguuuuguaauuacucgcugagaaguuguaucauaaaaugccaagaugacccuaagggaagaauauucuagaaucuauucuaggcaguucuggagaacacggcaagggguccuguuauaaccgaggcagaacugacaguauuacuagagccucuguuuguucuauuauauaucuucuagaaacuuccucaaaucuuuauagcauggacgccucaguucaacuuuuuuuuucccugucuugaacuauuggggauugaaccuugcacgcugagccucauaccagcucuacucuauauugacuuaagugugugacugacagugaaauuaagagguugcuccaagauaaaucuucuguuuaaguuuguacauguagauagacagguagauacagagagaugauaaaucuuuccuaagguccugaaugaaugagaggcacauuugaaagcccugucugccuuucguccuuccauccuucccucccuugcuccaagccuuaguuucuaaugacugcuggaggcuugagauaaaaagccaaguucaagguaggucuuauucaagaggcucuacagucaagugaacagugagguaaacucugaaccacagcaagacuacacuguggaggggauggaaagggaacaggauucugugggggccugggauggucaagcccugcucucaaacuuccucuuggcaacagaagucuggguauguagaaguucccugagagccaagcaggccucccuggcuagugucuguuuuuaguaacucuuaacuuguggcuggaagggaaaaggaccuaaaauacacuguccucugagacuccccucugucccuguaagacugucaggcuucucgcucagacuucucuucggaauggagcuagucaauugauuuuggcaaccauauggaaaacaaagcccguuucucagagccgcgugggucccugcagccccagcuaucagcugccagugagcugggagaugcugucuagcuauggcuggggaguccaggggaccaacuuucaaccuugaccucgggccagccgugagaguagaacucggggcggggggggggggggugggcacucaggaauggcagucagcuaucaguggcuccuggcuucuauuuggauugguuuaacuucuccacaugacagagcaacacacuaacuggcauuucacagggaugaucuguaugagugugguauauuuauaugaauaaaauaucauggcauaggggcuggagagaugcuuuagaaguuaagagcacugguugcucuuccaggaggcgugaguucaauucccagcaaccacgugguggcucauaacuaucuggaacaggaucuggugccuucuucuggccuguaggcaugcauguaggcagaacacuguacauauaaauaaauuaaaaaaaagauacuauggcauaaaauugaucauuuuuggugcauuuuggugcaauguacauucauacuguauguuauggcuaggauguuccacuucccuaccuaccuguuuuccuuccuuccuuccuuucuuccuuccugccuuccuuccaaccuuuugaccaacuuuccuuccguuuuuuguuucuaugaauuugaccucucuagcugcuucaucuaugacuucucuuuugcgucuggcuuauuucacuuagcacaaugucuucaagcuuaaccgugcacuuagugucuauaggaugacauuucuuuuggaaggcuuucugacaucccaucauguggccauaccacauuuuguuucucuuagcccaaagacauauuuugcaauuuuuuuacucugcucaaauuuugcauuaggcauccuaaguucauuugcagacaugcccugccucucuuaaagugccucacgcuagcauuugugaggacccccgccccugcacacuuuucuuuuccuuauugaauuuuaauuaaucuguuuuuauguguauuggugcuuugucugcacguaugcgugcaccacaugugugagguacagaucacugggagcugccacguagguucugggaaucauacccaggugcuagaagagcagucggagcuuuuaaucacugaacuaucuccagcccuuacugucuucgugggcauugugugugucuguguguauauauguuuguauguauguguauauauguguguacguguguuucuacaugugucuuuuuguguuuuuauuagauauuuucauuucuuuuuuuaagauuuauuuauuauuauacauaaguacacuguagcugucuucagaugcaccagaagagggcaucagaucucauuaagggugguugugagccaccauguggucgcugggauuugaacucaggaccuuuggaagagcagucaguacucuuaccugcugagccaucucaccagcccagauauuuucuuuauuuacauuucaaauguuauccccuuuccuaguuuccccucugaaaaccccacaucccuucuccccuccccugcucaccaacacacccacucccgcuuccuggcccuggcaauccccuauacuggggcacagaaccuucacagcaucaugugugucuaugugugcgugugcauguucagaaguugaagaaaaguuuguuacuggcuaacauccuaucuaugaaguaauccuuagcaggacacauuaggaaaagugaagauuagggccuggguugagccccuacacacacacacacacacacacacacacacacacacacacguuggagagucagaaacacauucuccaugcugugcugcggguggagguggggagccucacaauccauguccuagaguccuggcuaaaaagcaugcuuuuuggcaccaacacuucaaauacucuguuuaaaacccgguucagagaaagaaagacccaugguuuagcucuaucaaggccuuuaaggccuucaccucucugagguagugucaaggccaaauacaggugaguugcuggauggcugugagcuuccugaguuuaaacagccugugcuuugcagacuucugcgaggcaccagccccaggccugugcauuacacggcgugacccuugaacccaguaaacucccucauggggcagucugaaugccccugcauauccagaggguaucuugugaaucuccccugcauucccaagccaagccucuccauggugaaacaccagaaccuaagagccaacaauacuccccucucugcuuagccuuuccacugaaugccuuuugcaaaauacaaagcucccaagagccacagagaugagcaaaguuuccaggcuggagacagagcucagaggcuuggguacuggcucugcuguuaccuguccugccucucugcugcauccuuucucugcugccuggggggggcggggggggcugcggggaggagggaugcagguaacugagcucugagaguuaucccagauagaacccucuucaacuguuacauccuagccagugaaaucaggaccuugugcgauccugguccaucucaaaaccucuguguuuaagaucucugaauucuggcagccagcagcagccucggggccauccacacagaauggaaaaagacuaaagcuaauaauaguucucgaauuucuacugcacucgauccuugugugcuuugccauccaccaaaaacuuugaguuaaaagaaagcccgagacaggauggcaagaaggcugacuggcagagauaucacucacaaggccaccucucaaaucugcucccucugucacagcuuuagcuguccccucuuugugcauucccaccucauuggggagugaguagaccuggacucucuccauggcagagcagaggccugacaacgugaacauaaauggacaugaacccuacacugcagaggaaaaucaguugacugcccacccccccccccaucagcuugcugagauucugucuguauuuuaagguacaugcacgcuuucaaacccauaagaggaagcaggcagucuuugugcacaccuguaaucccagcuauagggaagcggaggcaggaggaucaugaauucaaggcaucuuugugagauugucucucaauaaaauuuagagaaggagggcuagagauuaaaagcacugauuaagagcacucccugagguccugaguucaaaucccagcaaccacaugguggcucaccaccaucugugaugggaacagaugcccucuucuggugcaucugaagauagugacaguguacucacagacauaagauaaauaaaucuaaaaacaaaacaaaacaaacccuuaagggcugaugauguaacucaaugguacagugguugccugggauaccgagaacccaaccccuaguaacacacacacacacacacacacacacacacacacacaccucgagggaaggcaucaaucugcuggaguuugaccuuuaaagacaagauaccaagaaaacaguaacgcaaacaaaaagacucugagccaccaucauaaaccaaccauccuuccuggaacuugaggagagacaucggguuucagccaaggggacucagccaaaagagcugguaccuaccacaucagugugggugaucuuggccagcagcucugucagggcaucacacgugaguguguucacuucaucauccugcugaagcccacagauggcugcucccacgcuuccaguugcaaucaucgacggcggguacauggcaaacuugaagucugcaaagaaccagaaacuuaaagucaggcccagaaggaaaacggggcccagugcucgccagacagcugaugcgcagaagcuggaaggcgcagaccugcugccccuagaaccccuggauccacagccacugucucccuugacucccuccuuccacaggaagcccuuauugacuugucaacuguagauauucucaaagacacagaggcaggagagaaagggugccuaucugaguacacagcuagucauccggggcucugagucccagacacucugugcccagacaacuacucaagaagucaacacaugccuggaaccuuuuagugagaugauuaaaacauguuaucuuccauggcugaggaguugacucaguggcuagaguacuuauuccauccucagaggacccagguuugauuuucagcauucacaugaacugucuacaacuccgaucucaaggcaucugauaccuucuuccggucuccacagucaucaggcauaugguaugcauacauacgugcguuuugcauguuugugcauguaagcuaaauguagaagcagaauaaggugaguuggcuuaauucucuugagucucaacuuuuaacccuauuuuaaggaucuucagaacguuagggccgaggacagggcuuuucucaaacacuaaagacuaacaaauucuaaccacacuuguauuuuucuaagaguuaagacaggggauucaccuuaaauaguaggggcaaccugggaccuuaaacucauucaccgcugagugauucucuaaggggauccauggaacugugauccaugaacugcugguuucaaugcagaggagaauccugccaacugcuaacaugcaugcauugcgugugauaucuguuuaacacacaaagccaccauggagggugacguuguggauggaaugaaaccugggaacugucaaguugaucuugucuuugccccugccuuggggcucacagauuaaggaguugacagugucaccaucgaguggcagcugugaaaugggguccacuuuccagugaaugaucucuaguuguaccaagacaccaguaaguccaguggagacugaaggcagagcacagagggacacaugagucacacaucagcucagagugagaauccugggcugaacacggcacgcucagagcaaccuggacucuuccccucucuucgggcaaugcccucuugcagcagagcaucacagagaggcuuuuacaauggagagagagccaguaccucagcauuguaccucagcaucgugauucgacuguucuuagacaccccacaaaucagcgaaccacacacacuccccugcucaccugggcucaaucccaggagccagguaggccuggccaucugucugucuccuuggcuuuguuccuuccaccgcucaucacuuucacuuugagggccauauacuaugggauuucacccaacuccuucuggcugcugaccccugccuaugucuucucuauccuggcugaugugaugaagccaaccucccucccuggcucuugauguguuguaagucuccccgauauggguuacaggagacauucucuaucuaauaaacuuguuagcugcuguguguggcauucauaguguagaugagguagccagcccauggcccugggcccacagaggcccugggugagagcaccugucagugacagggcacugaagugcucucagaguucccccccucgugcuggggcaucagauagggaguucacccaacauuccugcagaacuuugaagucacacugcuaacaaaaccaacucaggguuagcauguggagccagaaggggugugcggcuugaccuggggugcaggugucaggccggggaggggguauuuaccucuucccuuauuaaguacugaaagaaguccuucuugggcagagucugacuggcucuuuauuccaugcuccaguacgcacaucuacuccuuccccaguggaaaaacaggugcucccaagaaguagcaguuucuuauggcuggguagccaguuuacuacccagcaguacaacccaguuuggugugucauacuuggcuucauuuacacucuauggguaucuuugaaaggaauuuuucugaccuacaaauuugcugggugguaguggcacucagggggcagaagcaggaagaucucagaguucaagaccagccuggucuacagagugaguuccaggacagccagggcuauacagagaaacccuaucuugaaaaacaacaucaaaaguacuaauuuaccuuuuuuuuuucccaccgugcuauccugaggauuaguuacaagagccgaugcuauuaacucacgcauagaaccuggcucaggguaaaccuuagaugccagacaucggucacccacgcucccaacccucacccugcuugccaccaguccacauugacucuggugugguucacccagagccuggaagcuccuaugaggagccucaggccugaccuucucccuccuggugggagcaggcaaaggacccaguacagaggaugggaaucuuggggugucagacgacugcucagugccacugcucacucacuaggggugcuggaccucugauuaaagagaccccaauccagucugugcuuagaguaacccucaacguuuucuccuacaugccacgaaaggaaacauaaaagggcuccugcccagaagccaaccacaugggcccuagauucaucugccaccuccucgugguaccaaauauccaggacuccacagaagcagcugggugucugggguggcucccgaaucaggagaagcacucuauaaccaccaacuuggaaucugcacuuuaaaaaaaaaaccaugagauuucacuggccaaacuguucuacacugaugggauuuaaaagugggaugcugugguccugcccaaugagcuuauuaauauggaguaaaagcaggagccaggaguagugcuaacaaaaggcucccggaggcugcuuuacucuuguuguccacuagggggagggagaucgguuugugauggaggaaacccaaccaacaagucugaugucucggcuucuuccucuccuucaaccuguggugaggugcagguuucaagaaccagacagacccggggugcucuuuggacagcaaaggacacccaugaugucacuuagcauccauacaucugacaccccccagaaggguucagcacaaccuauccuuuaugguuuaaggcaauaacuauuaauggcgauuuagcuugguggaagggagagaagagagcuguggcuggagaaaagcucucauucaucucagggccagaugaggcgcaagauagcgauaucaguuacagaacuucagcucgacaagcuacucuuccccccccccccccccgcccagcccuaugacugcccucuaggggcagcucagaggcacuguggaaaugugggucucauucuuccuuccuggccaccagagaggcuuggcuuacauucuagaacaagagucaaguccccagacuuuucagggccaccacugucuggaaaucaaaugaacaccuuuaagagaagacuggcuguacccuaggauuccuacccuaccuuaggguuacacagggaguuggguccagcagccacagcaauacucccaaugcaaaaagaggcaggugugggguaucuguaccaaguuuaaacucaauaccacugaaaucaugugcucaguaugguaagguugaugguagccuccugguuacccccaggggggagggggugcuuuuugcccuguuugcugaccuggagcccuccaggagagagaaguccacuucugccuucuccagagccacacguucugggcuggagcugcaguuacacucucaccccaccuaaaauuccuccaccacaaaggccagcggggagagcagcuccaggcaaucccagaccaccucucucucagaaaccacuguaggcuggaucggaaaggaggacacaccucuuugcccugccaccaaccuuaccccagaaccccauaaaggaagacugcuggucggccacacucuucccucccugggcccccggacugcccacgcucucuuccccuuucacacacacauacgcucagcacgcccccucggagggacugccagcucuuucacaauuggcuuuucccuuaaacuagcaacgucuccccagggcuggcuaccuaccaccucuucagggacugcccccuucccacgccuuugugaacccucaaaacccugggccauccucagguucaggguggaauauucaggacuggaguuaagagacugagggugugaggugauggggcacacaagagcacccucccaucuuugguccuugaguugcucugagccuacuauuauucaagggugcuagugaacuuggguucgcuagaucuuggccccagaagcucaacguccucaagagcagcaggccucuggguuuaggcuguccagccuacugccugucugcuggccccaacacuccccuccaccacccuuccacacccacauaccggcagggcuccaaagcuuauucacaugcaggaccccaaaugcagaccagaagagacaugggggcuuuguggucaggcccacccauuccagccccaggaggccugagcaccuccgccacuuucucaucaguccaugccucuggagcaguacuuggcacaugguucugaccccuucccacucuuuggcuaaagcuaggucaaggcccccaacaggcccaucuuucugacugccccuaccucccacugggccucugccccuagucacugaaucccaggcuccauauuugggccccaaaguuggcagcugccccaaggauuuggacaagauggccaagaaugggggaugggauccccaagaacacagaacggaccuguggucuauacagaauuggaggaauccauccaagcccgaguaauuccaccuaucgcccuacccccaccccagugcaagaucagggaggaagaagugaaagccuccccccaccccccaagaccuguuggucaaaagauaaggucaaagcaggacucuggccacuggcagcugggugaugugggaauuuaugaguccgggggguuagguguccuagggccagagagaaaaggcugacugacccuucccccacccugaaucacugcaagaggaaagagacaguuccuaggaaacaaaacugcaggucagugugggacugaccucuagagcccaggccagucagcaagagaagagcagggagcugaaagugcuguccaaagcguagcaaaggcuggggcuucuuauugucauccucuucccugacuguaggaacagcaggggacuccacgaaggagcugggacaccacaagugugcuacaaggccugaugcagggccccgagggcugcuggaccaacgcaaacugagugcgugcacgcacucgcgugugcgugacacacacacacacacacacacacacacacacacacacacacacaccccucuaaaacagggagauggaauccggcacgccagugagaggcuguauccauuuccgcauccaccuuaacuggagccauucucaacaucagugaacuuucgcaggaagcuccaggcuugcuuuucugugggucaguuucccugcccacuccaccaaggcuagggaaggauacauccaaaggccuguuuugcagaucccagaugaacuucagagaggucaaacagccugagcgaggucacucagugcuaaguaacgaagucugccugaccucugaacuuccaacaaagcacaggcccuauuguucauuauagcaucagcuauacaaacacauaauuaaauguuacaaggaauuaaaauguuacacuccaccuccccccacccccuaucacaucaacacauuucaacaacccuggaugaauugagcugcaccccacucaugaucaauucuuucuuuaccugcuaacccugaggagaugaacuuuugacacuuggcccccgaauucccaagguucuagggcagcgcuucucaaccucaaccuuccuaacgcugugacccguuaauacaguuccucauaccguggugacccccaaccauaaaaccauuccguugcuacuuuguaacuguaauuuugcuauuugugauuucuuauguagauauaugauaugcaggauaucugauaugcaggauaucugauacguaagcccugugggauguaucgacccacagguugagaaauguugugcuagggucuucuacccaggugugaagccaauaaagcuauguaucaaaaauccucuccagagcucagaauaaacggaucuuugcuuaaagguucacucccuugucaacaggaaacagcaagaaggcaauaaaccagcuccacggugaaggaauuccuucccccuuaucagggcgggcaccauguuuaucuugucguugguccuuuaaccuauauuugcccccaccuuccuuaaauucccuuuagggcuuaucuccaagccguccuuuuccucaaaagauuaaagauuuaaacacaaccagagagcaguaucuauaaucuucaaagggcacuuuagacaccauaaacaauauuuuagcaggcaccgacucccuuccccuuaccauacuugcccucauaaagaacuuacgagugaagcagagagagaaaauguucuaguuccgagaaagcacgagcgaggcuccaggcuggcuuacucagacuugccuagacacccaaccccaccucccauggccccguggaagccccgugagcccccucucaccgguagcgcacagagcgaugaaggucugcgcaugcuugcggaucagggacagcuucuccuuuugcuggggcagcuugcgaaggaugugcucaaugaagucgugaggggugacugcggccagguuccacuucagcuuacccaacacuaccaguucccacuccugcaaagggugggaggaagagggcagagcucuaagaauccauagacugacuccaggcccggguugggggcuggguucccggccagcucugaagaugcuccuuaaggcuccacugcagccucaucugucacugugccccucaugcuuugaaguugcuccuggcucuucuugggcuaaaaaaaagucaggcuccacugaaaauaaugagaggccagguaacuacugccaagaccagccuuuacucuaguuuucuuccuaccucaccccuaccccugacuccacaaaauguucuugccugcccacucagaaaggugggccuauaguaagaucuagcuaaggccacuguggugcugcggugagaauuuguuggcuaagucucuuuacuccucauggaaaaaaaugaugcuuacagaugcagaauagcagaagccuccuuggcccaacuccuuggcagccaguucgcuggccuuuccuugugggggaagaguaucauuuucccucucugcugccaacaccuuccccuuugacacaccaugaagaagucuugggauaugacacucacccuuucaccuaaaucuucacuggccuuugucuucauggcuaaagggccugagguggucacuugugacuccauuuugcacacuaugauuuggggcaauguggaggugcuuaaacagggucagcccauguacugggcuguaacggucucuuuuagggggcuccacugcaccccacuaguaggcuacuuugugccucuccuuuuguaaaauaaacauggggaauaauguucaaaugaacuggacuaaauauaauaauaccccaaagagaugcacaccuggaagugcaugucugggauucuaccucuuuaaggcuagaaguuugaggcuagcuugaaauuaugcaaaggucccaauuuuuguuuguuuugguuucguugggggggggggugcaaacaaaaggaaaugauccuggucaaucaguaggauucaaaagcgcaggaugcuacuacugccgggcagugacugacucuucaguucaccuggcuccaucugcuaaacuuggggaccggcuauaaagccccugucagcuggaccagcuaugguguuuccuggagcaagcuccccucacguguaaaauaggaagguucuucuagggugcauaacuuauggaugggaggagaugggaagcuggcacacuuuauuuggagaauugaguuagcuuugccgguccuggaaaaauuagggugucuugaaaaauaccuccaguccuccagcacaccagacacauagaagauucuuuuucauguuuuguuuuguuuuguuuuuuucuuuuugaauagacaagcuggccuccaauucuaaucuuauuuuuuuuuccuccccacaagcuuucaagucugccuggguuuuuugcaggaaguuaggauaaaaaaaaaaaaauuccuuaacuacguaaaaaucagaaauggcuugaaucccaaacccuuccuucuuccagggcaaugugagcacaaacucguccucuggcaccauuauugaaagaagcagaucuuccagaagaaagcaccuuuaggggccucuuacaccaaaccagaagcagcugaaaucuggcaguguuucaaaggugaagucauucaggccccucuuugcguucuaggcaauuccucccccagccuugcacaugucugccacuagguggcagcacagacccagaaaggacggcuccucacaaagggcucaguucaagaagccagucuuugcccaggagauuaagcaggcccaggcaauggcagcaagggggagggagucgauagaggggguggucuucuuucaccagugcaaggugugcaaaccacuguaaaagagagcugcagaaccuucaguguguggcauuaacauggggguagggggaagugcaugagaaaaaaaaagguagaugguugggagaaaaccaagacaggacccccuggggacuguauccaggucacugugccuuuuggagcugaacucucaugcuucagauccaccaauagaaaggcagauguugauuuugcauccaaguuaauauguucauacuuagugcuuuguugguacuuagugaucagcuacuauguuuguccaugagacuuuauuggucuuuaagacauuaccuguuacaccuccagggucuugggaaacaacacaaacuagaaugugagaaaucagaccguguucucaggguucaguggaaaucuggaccuuaauuauaacaucauuaacuagaauauucuauuuaugccccccccccacccacacacacaacagaauuucacccucaugaauuuccaugaggcacugauagcuuugcucacucccugaugugggaagacuagcucucuccuacuaaaggacaucuuuuuuuuuuuucuuacagucuugguuaguguggcggccuuagugugauggggaagggcagagucaggagcagggagggcggcauuaccagcagcuccuggggcuucacagaguugucgguguaaaugcacagcuuuuccgcagucagcgggauggucucuuucagcuuggaagcuaggaacaugcacacugcacccaggagcugaagaugggucuuaggagucgggacuccagccaagaaacgguccagguaauucauggccagaggaaagaccucuucuucacacuuuuguuccucacagaccuacaaucaagagugggguaggguccgagggggauagggaaaaauuaguaucagaaacagagggaaaagaaaaauaaaagcauaaucugagauaacaaaaagaauuuuuuauguguguguggggagggggaggagaguagaaaggauaguaagaauagagaugagaacggugggguaaauccgaagggcuccugggguucggguauucccgcaaagcugaaaaaggugaugaacuaaaaccuccacaaaccccaaggcaaagcccagagccgccgccgccugccguucccucuggcucacuucucagcacaccaacucacucuuuuuuggauuucgucaucuuuucaaaaaaucaauaaaaauauucuggaagcuccgaaagucuacuucuuggucucguucggauccucagauccuauucuaccauucccgacaauugaaaaaaauguccaggguggucucggcgguccaggggccgcuguucgguggguggguggaggagagagggggagggaggaggaggaagcgcgccucggccggccgccgcaguuggagucggagcaggggggagcaguuucaaaaaauuauuaaaaaucgagggaaaauccuagaaacgcucugugggccugaaaaccccagagaggucccaggcucccuggaaaagagguuucggguguccguaaggucgguaucuccaccccaggggcucuagaucucagugggggaaacuugcggaguguucggcugcggcccacaagggcaguagcuaggaaggcugugccugcuggggguugggugagacgaaaccagggaaccccccuccaggaggcaugcgggacucugaccucucauuugggggugcccccuagccugcucuacacaccuccucccccgcuuccuaccccacccaaaucugcgcgcucaagaagcagccaaacuguaaguaaccuuggugaaccgagggcuggggaagagggcacgaucagaaagagggugcccaggaucauggggugcugagagggggugggggcgccggcgaauguugccaguccuuguaaauggaguuugcaaagcaacauggcgaaaccacggcagguccagagcugugcauacgugggcacccugcucucucggcaaagauugcaagcaaggcuaaagcagcgguucuuucagauugcccuaaacgcacguuuuuuucaguaugacuuccggggcucuccugaauucccuguuucucccccacccccaccuccugccaaagugccaacgcggaguccuaaggcucagacgguuugccccaacccugagagucgggggcgggggggggcucuuuauauguugguauggauuguuaggucgcaacacccucuggggccucacugaaggcagccgggguugcuuccacaccacaggucagaaauggagaugggaagacgaggaagccacaugcaggcacacgcgcgggaugccaaccccccgggggggggaggacauccucacucacccaaguuuuccuccacuaguuaaucuagcaagggacagaauuagcgucucgcccaagggugcggggcuaccucgcgcacgagcgggggaggccagcgcagggguaguucucccgcaguuuuuaggaucucugcguguuggagguagggauggagcggcugggcuugccucucccugagagcgucgcccgcacaccuaccucuagcauccagguggccaccauccugcgcauguacgguuggauguccuucugcacgcacuugaaauaggaacacugcgggagguagcgcuccucgauggucaacagguucugcagaacgcggucuuccagcagguugcgguccggcacggcccugcggaccggguccaccucgcagcacagcagcuccauagccagccggccaccacucggucccgacuguaaauuuuuuuuauuauuauuauuuuuuggaggugcgggggggucggggagugcuucccuuaccuccuuccuuuggcugaaugggagauuugggagaggaaagaaauggcaaagagagagagggagagagagagagaagaguggaaggugggcgagcggagccucaagggccgccugacucgcaccgguccuucccuccgaacugcccggcucuccucagcucgcucuccucucucgcucaggcagugacgcaagcuggaagggcaguuagaucuccucccccucucagguuccuccucccccuuuccuccccuccucuagcgucccuccccuccuuucaaucuuucccucccucuccccccccccuucccucuuguuauuaaggagcacagcagcuggccugaccaaacuucaaacacgauccccgcuccccacccccaaccccucucccuacuucuccgaggcccucuccccauccagccccgcaugcuaggggccucggauaggggaacccacaaaccccauggauuccuauugauuauccuuucugacauucuguaggcauaccaugggggcauaaaggguguguacgugugugcucucuaacuucggaggcuugcaaugugaucagaaaaacagcccauuauucaagauucagguagauagauuuaccauguggaugaguucagauaacuuagaaguagaccccuaaaugaggaacaaggaaaggcuuauuugagaaaauugcaaccucgccaaaccagggauaaagguuaugccccucaagcuuagacuccugauaacuuucaagcuguuguccgccccgagccacgugcguggagaggaagaggaggaagggguggauguuggagaaaggggugcuucuuaagccuaguagaauaugacccuccugcagaaaccuuucuguucuugggggcgccauugggcaacgcggccagccucucagagcggccccagaccgggggcagggcuagcagcgguuccuccgcgggccucggccacgcaggaaaaacccgcuuccucgccccugcaucugcugacaagccgcccuaggugucugcgcggagcguggccacauugauacagcuuucuaggaaauggcucgggaggggccagggagggggagagggaggguuuagguuuggcucucccugcgccagcaaggccacccuuccuuuccccgggggcuccugaguccugcaccccucaauccccgaccccguggggucucgcgccucauccuuccgccaggauuuuggggucggcucugacaugugcucuaaagcauccuguggucaaggcuguugguagagggggacacguuggcguuuccucaccuccuuccugcucccacccugccuuuaacuaua

SEQ ID NO: 3410 - RNA, 27034 nt, Mus musculus
uauaguuaaaggcagggugggagcaggaaggaggugaggaaacgccaacgugucccccucuaccaacagccuugaccacaggaugcuuuagagcacaugucagagccgaccccaaaauccuggcggaaggaugaggcgcgagaccccacggggucggggauugaggggugcaggacucaggagcccccggggaaaggaaggguggccuugcuggcgcagggagagccaaaccuaaacccucccucucccccucccuggccccucccgagccauuuccuagaaagcuguaucaauguggccacgcuccgcgcagacaccuagggcggcuugucagcagaugcaggggcgaggaagcggguuuuuccugcguggccgaggcccgcggaggaaccgcugcuagcccugcccccggucuggggccgcucugagaggcuggccgcguugcccaauggcgcccccaagaacagaaagguuucugcaggagggucauauucuacuaggcuuaagaagcaccccuuucuccaacauccaccccuuccuccucuuccucuccacgcacguggcucggggcggacaacagcuugaaaguuaucaggagucuaagcuugaggggcauaaccuuuaucccugguuuggcgagguugcaauuuucucaaauaagccuuuccuuguuccucauuuaggggucuacuucuaaguuaucugaacucauccacaugguaaaucuaucuaccugaaucuugaauaaugggcuguuuuucugaucacauugcaagccuccgaaguuagagagcacacacguacacacccuuuaugcccccaugguaugccuacagaaugucagaaaggauaaucaauaggaauccaugggguuuguggguuccccuauccgaggccccuagcaugcggggcuggauggggagagggccucggagaaguagggagagggguuggggguggggagcggggaucguguuugaaguuuggucaggccagcugcugugcuccuuaauaacaagagggaaggggggggggagagggagggaaagauugaaaggaggggagggacgcuagaggaggggaggaaagggggaggaggaaccugagagggggaggagaucuaacugcccuuccagcuugcgucacugccugagcgagagaggagagcgagcugaggagagccgggcaguucggagggaaggaccggugcgagucaggcggcccuugaggcuccgcucgcccaccuuccacucuucucucucucucucccucucucucuuugccauuucuuuccucucccaaaucucccauucagccaaaggaaggagguaagggaagcacuccccgacccccccgcaccuccaaaaaauaauaauaauaaaaaaaauuuacagucgggaccgagugguggccggcuggcuauggagcugcugugcugcgagguggacccgguccgcagggccgugccggaccgcaaccugcuggaagaccgcguucugcagaaccuguugaccaucgaggagcgcuaccucccgcaguguuccuauuucaagugcgugcagaaggacauccaaccguacaugcgcaggaugguggccaccuggaugcuagagguaggugugcgggcgacgcucucagggagaggcaagcccagccgcuccaucccuaccuccaacacgcagagauccuaaaaacugcgggagaacuaccccugcgcuggccucccccgcucgugcgcgagguagccccgcacccuugggcgagacgcuaauucugucccuugcuagauuaacuaguggaggaaaacuugggugagugaggauguccucccccccccgggggguuggcaucccgcgcgugugccugcauguggcuuccucgucuucccaucuccauuucugaccugugguguggaagcaaccccggcugccuucagugaggccccagaggguguugcgaccuaacaauccauaccaacauauaaagagcccccccccgcccccgacucucaggguuggggcaaaccgucugagccuuaggacuccgcguuggcacuuuggcaggaggugggggugggggagaaacagggaauucaggagagccccggaagucauacugaaaaaaacgugcguuuagggcaaucugaaagaaccgcugcuuuagccuugcuugcaaucuuugccgagagagcagggugcccacguaugcacagcucuggaccugccgugguuucgccauguugcuuugcaaacuccauuuacaaggacuggcaacauucgccggcgcccccacccccucucagcaccccaugauccugggcacccucuuucugaucgugcccucuuccccagcccucgguucaccaagguuacuuacaguuuggcugcuucuugagcgcgcagauuugggugggguaggaagcgggggaggagguguguagagcaggcuagggggcacccccaaaugagaggucagagucccgcaugccuccuggagggggguucccugguuucgucucacccaacccccagcaggcacagccuuccuagcuacugcccuugugggccgcagccgaacacuccgcaaguuucccccacugagaucuagagccccugggguggagauaccgaccuuacggacacccgaaaccucuuuuccagggagccugggaccucucugggguuuucaggcccacagagcguuucuaggauuuucccucgauuuuuaauaauuuuuugaaacugcuccccccugcuccgacuccaacugcggcggccggccgaggcgcgcuuccuccuccucccucccccucucuccuccacccacccaccgaacagcggccccuggaccgccgagaccacccuggacauuuuuuucaauugucgggaaugguagaauaggaucugaggauccgaacgagaccaagaaguagacuuucggagcuuccagaauauuuuuauugauuuuuugaaaagaugacgaaauccaaaaaagagugaguuggugugcugagaagugagccagagggaacggcaggcggcggcggcucugggcuuugccuugggguuuguggagguuuuaguucaucaccuuuuucagcuuugcgggaauacccgaaccccaggagcccuucggauuuaccccaccguucucaucucuauucuuacuauccuuucuacucuccucccccuccccacacacacauaaaaaauucuuuuuguuaucucagauuaugcuuuuauuuuucuuuucccucuguuucugauacuaauuuuucccuaucccccucggacccuaccccacucuugauuguaggucugugaggaacaaaagugugaagaagaggucuuuccucuggccaugaauuaccuggaccguuucuuggcuggagucccgacuccuaagacccaucuucagcuccugggugcagugugcauguuccuagcuuccaagcugaaagagaccaucccgcugacugcggaaaagcugugcauuuacaccgacaacucugugaagccccaggagcugcugguaaugccgcccucccugcuccugacucugcccuuccccaucacacuaaggccgccacacuaaccaagacuguaagaaaaaaaaaaaagauguccuuuaguaggagagagcuagucuucccacaucagggagugagcaaagcuaucagugccucauggaaauucaugagggugaaauucuguuguguguguggguggggggggggcauaaauagaauauucuaguuaaugauguuauaauuaagguccagauuuccacugaacccugagaacacggucugauuucucacauucuaguuuguguuguuucccaagacccuggagguguaacagguaaugucuuaaagaccaauaaagucucauggacaaacauaguagcugaucacuaaguaccaacaaagcacuaaguaugaacauauuaacuuggaugcaaaaucaacaucugccuuucuauugguggaucugaagcaugagaguucagcuccaaaaggcacagugaccuggauacaguccccaggggguccugucuugguuuucucccaaccaucuaccuuuuuuuuucucaugcacuucccccuacccccauguuaaugccacacacugaagguucugcagcucucuuuuacagugguuugcacaccuugcacuggugaaagaagaccacccccucuaucgacucccucccccuugcugccauugccugggccugcuuaaucuccugggcaaagacuggcuucuugaacugagcccuuugugaggagccguccuuucugggucugugcugccaccuaguggcagacaugugcaaggcugggggaggaauugccuagaacgcaaagaggggccugaaugacuucaccuuugaaacacugccagauuucagcugcuucugguuugguguaagaggccccuaaaggugcuuucuucuggaagaucugcuucuuucaauaauggugccagaggacgaguuugugcucacauugcccuggaagaaggaaggguuugggauucaagccauuucugauuuuuacguaguuaaggaauuuuuuuuuuuuuauccuaacuuccugcaaaaaacccaggcagacuugaaagcuuguggggaggaaaaaaaaauaagauuagaauuggaggccagcuugucuauucaaaaagaaaaaaacaaaacaaaacaaaacaugaaaaagaaucuucuaugugucuggugugcuggaggacuggagguauuuuucaagacacccuaauuuuuccaggaccggcaaagcuaacucaauucuccaaauaaagugugccagcuucccaucuccucccauccauaaguuaugcacccuagaagaaccuuccuauuuuacacgugaggggagcuugcuccaggaaacaccauagcugguccagcugacaggggcuuuauagccgguccccaaguuuagcagauggagccaggugaacugaagagucagucacugcccggcaguaguagcauccugcgcuuuugaauccuacugauugaccaggaucauuuccuuuuguuugcacccccccccccaacgaaaccaaaacaaacaaaaauugggaccuuugcauaauuucaagcuagccucaaacuucuagccuuaaagagguagaaucccagacaugcacuuccaggugugcaucucuuugggguauuauuauauuuaguccaguucauuugaacauuauuccccauguuuauuuuacaaaaggagaggcacaaaguagccuacuaguggggugcaguggagcccccuaaaagagaccguuacagcccaguacaugggcugacccuguuuaagcaccuccacauugccccaaaucauagugugcaaaauggagucacaagugaccaccucaggcccuuuagccaugaagacaaaggccagugaagauuuaggugaaagggugagugucauaucccaagacuucuucauggugugucaaaggggaagguguuggcagcagagagggaaaaugauacucuucccccacaaggaaaggccagcgaacuggcugccaaggaguugggccaaggaggcuucugcuauucugcaucuguaagcaucauuuuuuuccaugaggaguaaagagacuuagccaacaaauucucaccgcagcaccacaguggccuuagcuagaucuuacuauaggcccaccuuucugagugggcaggcaagaacauuuuguggagucagggguaggggugagguaggaagaaaacuagaguaaaggcuggucuuggcaguaguuaccuggccucucauuauuuucaguggagccugacuuuuuuuuagcccaagaagagccaggagcaacuucaaagcaugaggggcacagugacagaugaggcugcaguggagccuuaaggagcaucuucagagcuggccgggaacccagcccccaacccgggccuggagucagucuauggauucuuagagcucugcccucuuccucccacccuuugcaggagugggaacugguaguguuggguaagcugaaguggaaccuggccgcagucaccccucacgacuucauugagcacauccuucgcaagcugccccagcaaaaggagaagcugucccugauccgcaagcaugcgcagaccuucaucgcucugugcgcuaccggugagagggggcucacggggcuuccacggggccaugggaggugggguugggugucuaggcaagucugaguaagccagccuggagccucgcucgugcuuucucggaacuagaacauuuucucucucugcuucacucguaaguucuuuaugagggcaaguaugguaaggggaagggagucggugccugcuaaaauauuguuuauggugucuaaagugcccuuugaagauuauagauacugcucucugguuguguuuaaaucuuuaaucuuuugaggaaaaggacggcuuggagauaagcccuaaagggaauuuaaggaaggugggggcaaauauagguuaaaggaccaacgacaagauaaacauggugcccgcccugauaagggggaaggaauuccuucaccguggagcugguuuauugccuucuugcuguuuccuguugacaagggagugaaccuuuaagcaaagauccguuuauucugagcucuggagaggauuuuugauacauagcuuuauuggcuucacaccuggguagaagacccuagcacaacauuucucaaccugugggucgauacaucccacagggcuuacguaucagauauccugcauaucagauauccugcauaucauauaucuacauaagaaaucacaaauagcaaaauuacaguuacaaaguagcaacggaaugguuuuaugguugggggucaccacgguaugaggaacuguauuaacgggucacagcguuaggaagguugagguugagaagcgcugcccuagaaccuugggaauucgggggccaagugucaaaaguucaucuccucaggguuagcagguaaagaaagaauugaucaugaguggggugcagcucaauucauccaggguuguugaaauguguugaugugauaggggguggggggagguggaguguaacauuuuaauuccuuguaacauuuaauuauguguuuguauagcugaugcuauaaugaacaauagggccugugcuuuguuggaaguucagaggucaggcagacuucguuacuuagcacugagugaccucgcucaggcuguuugaccucucugaaguucaucugggaucugcaaaacaggccuuuggauguauccuucccuagccuugguggagugggcagggaaacugacccacagaaaagcaagccuggagcuuccugcgaaaguucacugauguugagaauggcuccaguuaagguggaugcggaaauggauacagccucucacuggcgugccggauuccaucucccuguuuuagaggggugugugugugugugugugugugugugugugugugugugugugugucacgcacacgcgagugcgugcacgcacucaguuugcguugguccagcagcccucggggcccugcaucaggccuuguagcacacuuguggugucccagcuccuucguggaguccccugcuguuccuacagucagggaagaggaugacaauaagaagccccagccuuugcuacgcuuuggacagcacuuucagcucccugcucuucucuugcugacuggccugggcucuagaggucagucccacacugaccugcaguuuuguuuccuaggaacugucucuuuccucuugcagugauucagggugggggaagggucagucagccuuuucucucuggcccuaggacaccuaaccccccggacucauaaauucccacaucacccagcugccaguggccagaguccugcuuugaccuuaucuuuugaccaacaggucuugggggguggggggaggcuuucacuucuuccucccugaucuugcacugggguggggguagggcgauagguggaauuacucgggcuuggauggauuccuccaauucuguauagaccacagguccguucuguguucuuggggaucccaucccccauucuuggccaucuuguccaaauccuuggggcagcugccaacuuuggggcccaaauauggagccugggauucagugacuaggggcagaggcccagugggagguaggggcagucagaaagaugggccuguugggggccuugaccuagcuuuagccaaagagugggaaggggucagaaccaugugccaaguacugcuccagaggcauggacugaugagaaaguggcggaggugcucaggccuccuggggcuggaaugggugggccugaccacaaagcccccaugucucuucuggucugcauuugggguccugcaugugaauaagcuuuggagcccugccgguauguggguguggaagggugguggaggggaguguuggggccagcagacaggcaguaggcuggacagccuaaacccagaggccugcugcucuugaggacguugagcuucuggggccaagaucuagcgaacccaaguucacuagcacccuugaauaauaguaggcucagagcaacucaaggaccaaagaugggagggugcucuugugugccccaucaccucacacccucagucucuuaacuccaguccugaauauuccacccugaaccugaggauggcccaggguuuugaggguucacaaaggcgugggaagggggcagucccugaagaggugguagguagccagcccuggggagacguugcuaguuuaagggaaaagccaauugugaaagagcuggcagucccuccgagggggcgugcugagcguaugugugugugaaaggggaagagagcgugggcaguccgggggcccagggagggaagaguguggccgaccagcagucuuccuuuaugggguucugggguaagguugguggcagggcaaagagguguguccuccuuuccgauccagccuacagugguuucugagagagagguggucugggauugccuggagcugcucuccccgcuggccuuugugguggaggaauuuuagguggggugagaguguaacugcagcuccagcccagaacguguggcucuggagaaggcagaaguggacuucucucuccuggagggcuccaggucagcaaacagggcaaaaagcacccccuccccccuggggguaaccaggaggcuaccaucaaccuuaccauacugagcacaugauuucagugguauugaguuuaaacuugguacagauaccccacaccugccucuuuuugcauugggaguauugcuguggcugcuggacccaacucccuguguaacccuaagguaggguaggaauccuaggguacagccagucuucucuuaaagguguucauuugauuuccagacagugguggcccugaaaagucuggggacuugacucuuguucuagaauguaagccaagccucucugguggccaggaaggaagaaugagacccacauuuccacagugccucugagcugccccuagagggcagucauagggcugggcggggggggggggggggaagaguagcuugucgagcugaaguucuguaacugauaucgcuaucuugcgccucaucuggcccugagaugaaugagagcuuuucuccagccacagcucucuucucucccuuccaccaagcuaaaucgccauuaauaguuauugccuuaaaccauaaaggauagguugugcugaacccuucuggggggugucagauguauggaugcuaagugacaucauggguguccuuugcuguccaaagagcaccccgggucugucugguucuugaaaccugcaccucaccacagguugaaggagaggaagaagccgagacaucagacuuguugguuggguuuccuccaucacaaaccgaucucccucccccuaguggacaacaagaguaaagcagccuccgggagccuuuuguuagcacuacuccuggcuccugcuuuuacuccauauuaauaagcucauugggcaggaccacagcaucccacuuuuaaaucccaucaguguagaacaguuuggccagugaaaucucaugguuuuuuuuuuaaagugcagauuccaaguuggugguuauagagugcuucuccugauucgggagccaccccagacacccagcugcuucuguggaguccuggauauuugguaccacgaggagguggcagaugaaucuagggcccaugugguuggcuucugggcaggagcccuuuuauguuuccuuucguggcauguaggagaaaacguugaggguuacucuaagcacagacuggauuggggucucuuuaaucagagguccagcaccccuagugagugagcaguggcacugagcagucgucugacaccccaagauucccauccucuguacuggguccuuugccugcucccaccaggagggagaaggucaggccugaggcuccucauaggagcuuccaggcucugggugaaccacaccagagucaauguggacugguggcaagcagggugaggguugggagcgugggugaccgaugucuggcaucuaagguuuacccugagccagguucuaugcgugaguuaauagcaucggcucuuguaacuaauccucaggauagcacggugggaaaaaaaaaagguaaauuaguacuuuugauguuguuuuucaagauaggguuucucuguauagcccuggcuguccuggaacucacucuguagaccaggcuggucuugaacucugagaucuuccugcuucugcccccugagugccacuaccacccagcaaauuuguaggucagaaaaauuccuuucaaagauacccauagaguguaaaugaagccaaguaugacacaccaaacuggguuguacugcuggguaguaaacuggcuacccagccauaagaaacugcuacuucuugggagcaccuguuuuuccacuggggaaggaguagaugugcguacuggagcauggaauaaagagccagucagacucugcccaagaaggacuucuuucaguacuuaauaagggaagagguaaauacccccuccccggccugacaccugcaccccaggucaagccgcacaccccuucuggcuccacaugcuaacccugaguugguuuuguuagcagugugacuucaaaguucugcaggaauguugggugaacucccuaucugaugccccagcacgagggggggaacucugagagcacuucagugcccugucacugacaggugcucucacccagggccucugugggcccagggccaugggcuggcuaccucaucuacacuaugaaugccacacacagcagcuaacaaguuuauuagauagagaaugucuccuguaacccauaucggggagacuuacaacacaucaagagccagggagggagguuggcuucaucacaucagccaggauagagaagacauaggcaggggucagcagccagaaggaguugggugaaaucccauaguauauggcccucaaagugaaagugaugagcgguggaaggaacaaagccaaggagacagacagauggccaggccuaccuggcuccugggauugagcccaggugagcaggggagugugugugguucgcugauuuguggggugucuaagaacagucgaaucacgaugcugagguacaaugcugagguacuggcucucucuccauuguaaaagccucucugugaugcucugcugcaagagggcauugcccgaagagaggggaagaguccagguugcucugagcgugccguguucagcccaggauucucacucugagcugaugugugacucaugugucccucugugcucugccuucagucuccacuggacuuacuggugucuugguacaacuagagaucauucacuggaaaguggaccccauuucacagcugccacucgauggugacacugucaacuccuuaaucugugagccccaaggcaggggcaaagacaagaucaacuugacaguucccagguuucauuccauccacaacgucacccuccaugguggcuuuguguguuaaacagauaucacacgcaaugcaugcauguuagcaguuggcaggauucuccucugcauugaaaccagcaguucauggaucacaguuccauggauccccuuagagaaucacucagcggugaaugaguuuaaggucccagguugccccuacuauuuaaggugaauccccugucuuaacucuuagaaaaauacaagugugguuagaauuuguuagucuuuaguguuugagaaaagcccuguccucggcccuaacguucugaagauccuuaaaauaggguuaaaaguugagacucaagagaauuaagccaacucaccuuauucugcuucuacauuuagcuuacaugcacaaacaugcaaaacgcacguauguaugcauaccauaugccugaugacuguggagaccggaagaagguaucagaugccuugagaucggaguuguagacaguucaugugaaugcugaaaaucaaaccuggguccucugaggauggaauaaguacucuagccacugagucaacuccucagccauggaagauaacauguuuuaaucaucucacuaaaagguuccaggcauguguugacuucuugaguaguugucugggcacagagugucugggacucagagccccggaugacuagcuguguacucagauaggcacccuuucucuccugccucugugucuuugagaauaucuacaguugacaagucaauaagggcuuccuguggaaggagggagucaagggagacaguggcuguggauccagggguucuaggggcagcaggucugcgccuuccagcuucugcgcaucagcugucuggcgagcacugggccccguuuuccuucugggccugacuuuaaguuucugguucuuugcagacuucaaguuugccauguacccgccgucgaugauugcaacuggaagcgugggagcagccaucugugggcuucagcaggaugaugaagugaacacacucacgugugaugcccugacagagcugcuggccaagaucacccacacugaugugguagguaccagcucuuuuggcugaguccccuuggcugaaacccgaugucucuccucaaguuccaggaaggaugguugguuuaugaugguggcucagagucuuuuuguuugcguuacuguuuucuugguaucuugucuuuaaaggucaaacuccagcagauugaugccuucccucgagguguguguguguguguguguguguguguguguguguguuacuagggguuggguucucgguaucccaggcaaccacuguaccauugaguuacaucaucagcccuuaaggguuuguuuuguuuuguuuuuagauuuauuuaucuuaugucugugaguacacugucacuaucuucagaugcaccagaagagggcaucuguucccaucacagaugguggugagccaccaugugguugcugggauuugaacucaggaccucagggagugcucuuaaucagugcuuuuaaucucuagcccuccuucucuaaauuuuauugagagacaaucucacaaagaugccuugaauucaugauccuccugccuccgcuucccuauagcugggauuacaggugugcacaaagacugccugcuuccucuuauggguuugaaagcgugcauguaccuuaaaauacagacagaaucucagcaagcugaugggggggggggugggcagucaacugauuuuccucugcaguguaggguucauguccauuuauguucacguugucaggccucugcucugccauggagagaguccaggucuacucacuccccaaugaggugggaaugcacaaagaggggacagcuaaagcugugacagagggagcagauuugagagguggccuugugagugauaucucugccagucagccuucuugccauccugucucgggcuuucuuuuaacucaaaguuuuugguggauggcaaagcacacaaggaucgagugcaguagaaauucgagaacuauuauuagcuuuagucuuuuuccauucuguguggauggccccgaggcugcugcuggcugccagaauucagagaucuuaaacacagagguuuugagauggaccaggaucgcacaagguccugauuucacuggcuaggauguaacaguugaagaggguucuaucugggauaacucucagagcucaguuaccugcaucccuccuccccgcagccccccccgccccccccaggcagcagagaaaggaugcagcagagaggcaggacagguaacagcagagccaguacccaagccucugagcucugucuccagccuggaaacuuugcucaucucuguggcucuugggagcuuuguauuuugcaaaaggcauucaguggaaaggcuaagcagagaggggaguauuguuggcucuuagguucugguguuucaccauggagaggcuuggcuugggaaugcaggggagauucacaagauacccucuggauaugcaggggcauucagacugccccaugagggaguuuacuggguucaagggucacgccguguaaugcacaggccuggggcuggugccucgcagaagucugcaaagcacaggcuguuuaaacucaggaagcucacagccauccagcaacucaccuguauuuggccuugacacuaccucagagaggugaaggccuuaaaggccuugauagagcuaaaccaugggucuuucuuucucugaaccggguuuuaaacagaguauuugaaguguuggugccaaaaagcaugcuuuuuagccaggacucuaggacauggauugugaggcuccccaccuccacccgcagcacagcauggagaauguguuucugacucuccaacguguguguguguguguguguguguguguguguguguguguaggggcucaacccaggcccuaaucuucacuuuuccuaauguguccugcuaaggauuacuucauagauaggauguuagccaguaacaaacuuuucuucaacuucugaacaugcacacgcacacauagacacacaugaugcugugaagguucugugccccaguauaggggauugccagggccaggaagcgggaguggguguguuggugagcaggggaggggagaagggaugugggguuuucagaggggaaacuaggaaaggggauaacauuugaaauguaaauaaagaaaauaucugggcuggugagauggcucagcagguaagaguacugacugcucuuccaaagguccugaguucaaaucccagcgaccacaugguggcucacaaccacccuuaaugagaucugaugcccucuucuggugcaucugaagacagcuacaguguacuuauguauaauaauaaauaaaucuuaaaaaaagaaaugaaaauaucuaauaaaaacacaaaaagacacauguagaaacacacguacacacauauauacacauacauacaaacauauauacacacagacacacacaaugcccacgaagacaguaagggcuggagauaguucagugauuaaaagcuccgacugcucuucuagcaccuggguaugauucccagaaccuacguggcagcucccagugaucuguaccucacacauguggugcacgcauacgugcagacaaagcaccaauacacauaaaaacagauuaauuaaaauucaauaaggaaaagaaaagugugcaggggcggggguccucacaaaugcuagcgugaggcacuuuaagagaggcagggcaugucugcaaaugaacuuaggaugccuaaugcaaaauuugagcagaguaaaaaaauugcaaaauaugucuuugggcuaagagaaacaaaaugugguauggccacaugaugggaugucagaaagccuuccaaaagaaaugucauccuauagacacuaagugcacgguuaagcuugaagacauugugcuaagugaaauaagccagacgcaaaagagaagucauagaugaagcagcuagagaggucaaauucauagaaacaaaaaacggaaggaaaguuggucaaaagguuggaaggaaggcaggaaggaagaaaggaaggaaggaaggaaaacagguagguagggaaguggaacauccuagccauaacauacaguaugaauguacauugcaccaaaaugcaccaaaaaugaucaauuuuaugccauaguaucuuuuuuuuaauuuauuuauauguacaguguucugccuacaugcaugccuacaggccagaagaaggcaccagauccuguuccagauaguuaugagccaccacgugguugcugggaauugaacucacgccuccuggaagagcaaccagugcucuuaacuucuaaagcaucucuccagccccuaugccaugauauuuuauucauauaaauauaccacacucauacagaucaucccugugaaaugccaguuaguguguugcucugucauguggagaaguuaaaccaauccaaauagaagccaggagccacugauagcugacugccauuccugagugcccaccccccccccccccgccccgaguucuacucucacggcuggcccgaggucaagguugaaaguugguccccuggacuccccagccauagcuagacagcaucucccagcucacuggcagcugauagcuggggcugcagggacccacgcggcucugagaaacgggcuuuguuuuccauaugguugccaaaaucaauugacuagcuccauuccgaagagaagucugagcgagaagccugacagucuuacagggacagaggggagucucagaggacaguguauuuuagguccuuuucccuuccagccacaaguuaagaguuacuaaaaacagacacuagccagggaggccugcuuggcucucagggaacuucuacauacccagacuucuguugccaagaggaaguuugagagcagggcuugaccaucccaggcccccacagaauccuguucccuuuccauccccuccacaguguagucuugcugugguucagaguuuaccucacuguucacuugacuguagagccucuugaauaagaccuaccuugaacuuggcuuuuuaucucaagccuccagcagucauuagaaacuaaggcuuggagcaagggagggaaggauggaaggacgaaaggcagacagggcuuucaaaugugccucucauucauucaggaccuuaggaaagauuuaucaucucucuguaucuaccugucuaucuacauguacaaacuuaaacagaagauuuaucuuggagcaaccucuuaauuucacugucagucacacacuuaagucaauauagaguagagcugguaugaggcucagcgugcaagguucaauccccaauaguucaagacagggaaaaaaaaaguugaacugaggcguccaugcuauaaagauuugaggaaguuucuagaagauauauaauagaacaaacagaggcucuaguaauacugucaguucugccucgguuauaacaggaccccuugccguguucuccagaacugccuagaauagauucuagaauauucuucccuuagggucaucuuggcauuuuaugauacaacuucucagcgaguaauuacaaaacaaauaacuuaaguaagcauugcucacuuuggacccaaacuuuucuggggagaggggguccccaucaucucuucugucccccgccccccuuggcuugaaacuuguauucucaaagugccucugacuaauaccaccuucagugugcuuaaggggggcuucggggagguaggaauucuggaaagcaugccuggggguggggaggcggguagagcugggggcugccucccucccucccucccucccucccucauuucuuguccaccucauucuguaugcaaggaaacgagccaagcagcccgcgaagaaagcaagaaugagauaguuuccuaaguugucucugccugaguuggcggcgggucugcagcucauucagcucuuugucccacuguugagugcagugcguguguacugacaauggguggaugcaguuacaccaggggcuaaugguuggaguuccguggguccauucauggaggcaguggagggugcggggcagagagcucgagccagcaaguggaggaagucggggggccugaguaacgagccagagaucacagccgcugcugucagggcucugaggaugggggggggggggcaguacagggagggacccgucaucagaggaguuggaggggugcccgaccuccagcgcaguggaguaccaccuguccgggcugacagacuagcauuauggcuuuccuuuuaaucagcuuaauuuggggcaucuuaacacaaugccugcugcuuucggaggcugccacaaagcugagguccuggaguuccugcuugucacauggauguagcaucuuuugaucagggaaacuguuaucaucaccccuacacacacacacacacacacacacacacaggcaugcuugcacaaacccauguucagacuccccugcaaacuguuaucaucaccccuacacacacacacacacacacacacacacacagaggcaugcuuacacaaacccauguucagacuccccugcagugguguuuucuuccuugcuuuuugccagcucacagaaaaguacagaaaguacauuugcacuauggcuccaagaggggcuccugcaaagcuggggcgguuguaacuguugggauugauugauggaugauugaucgguggaugauugauugauugauugauugaugauugauggauguuggaggaauaccauguaggucucuccacccucaggaaggaauauguucuacacuuccugcagauagaggauuucuaccuggccgagccaggacugagggacccuuguugaagguagagcuaauaacugaccacuuaugaggaaguggaagcugauagacagcaguuaagcagaccugauggguuuagcagucucccaggugaauggcagaugacucuguagccauguuucguaggcuaacugcaucaguccuuguuccucucuccaaaugagagggagcaaagaucagggaucauccagucaguaaugauuugaauuucaguuaacacugggaagggagagcauagaguuuacaugaaaccuuuggaucuuccuccagugcuuagacuacuuggugagcauacccuuggcuggaccauuacaucaugcuugcaucaucuugagcucuuggcucugaacgugcaguagaaaugacugccagaugucuugucuucccuguagggguuucucccaacuaucccuuuaaaaucuugggcagcuagaagggaaggcuuacuguaggaagaguagggacacugcagauccuaacgccaaguucuuaagcuuucugcaggcugauuuaugaagaccaucuggcaucauuaauacaauagagauguacaagggucgugaugacgggguagaugugccaacccagaugaucuuuuccgggaaucagaagauagcggacuaguuuaaaaaaaaaaaaaaaaaaggguuguauggacuuggccaagaggcacaaaacuuccuacuguagagcagagucucccguguacauuacaucagaaaauauucaccaaguaaccccacacacacacacacacaccguaaagauuccucaucauuuauagaaggucucacucugcagcccaggcugucuucagaggcauaauccuccagccuucuccucagccagcuuccuuucaaauggagugguuccgaguucuccucucaagccccaccacauagacccagccucacgaaggaucccucaucagcuacaaauccuacuguuguaaaauaccagaagcuuccaggccucagguaggauuugauuucugaggccagguacaugauuggaggcauggauaugguugcugucucugguauugggguguucccacucauucucucugccuuccaggaaaaagcuauuuacacaucaccaaaugcugccagauuggccuagcaggaaacauggcaaacaaaugagaagcugucaggaccugaguuuuuaauugcuaaugaggguggcaggucccaaggaucaggaugagagauguuagagccugggcacaugaguccuuuacuugguccuguuaaaauuagccuggugacccggugacccccgcccccaaugcuggaccacacuaucucuaggauuaaccuucgacacauccuugucuuaaguaguuggugaucuauaccuuuguucacagaaauauaggaugggcguguuuguguacuuaaaguuucaacuacucagccagccugagaaacaugagucucaaaauccaaaggauucuuucagauuccuggacagauggagccauuaaaacacacacacacacacacacacaccaaucauuuauugauuugcuacuuagcucuucauuuuuauacuuggagaaaccgggguuugcaaauggagcugugcccugccagcaccgagugagcaccagacauccccauccugcuucccgcccuucccagguucaggagaacguuucagccaaugaccuucgcucuugaucugcugccaugccucaucuucaagcuacaguuugaacuggggggcagaugagagaugggaaagaauaaaaauggaggugucauguggggggggggggaugaggagcaguagggugggcggggguagaggaugcaaacuuuugcuccuuaguaguuauugccaacuuuauuuucaggucucuggaaaauaaagauaaugccuuuauguuuguggaaaaaaaauaucaauuccuagguggugaggucuaagcagaaaaauaaacagagggaaguuuauggugaacugugagcagauaccaggagauucgaguuagcaccguuucuauacgcacaggaugcuuccuagugcagggaggugggacggagaaacuagggugaaaaucccugcuaggggcuccccuccccccaaccuucuagccugagccuuagucccaucccagugacagccaugacuugcccucacauuccaugucucccagcaaauagaaaucuucugccugggacagcucacucuggauuuucccuaccaaauauagacuaauaaaggcaacacugcaaaaucuugcuuauucccaaauuggacaagcucaagugucccgaguuuuguaaacaguaugcauuguguuuuugcgaaagggguccaagggugguaaaagaaugcagagauguuuaagcaccgcccuucuauccguuccacgguugcuugcuugacuuacaguguaacaccuugcaggaaccagacuuucugugccaccuuucccagacagagagaccuccagcuggucccuugauaaccaggcaagggcuuuuuguagcuggaucaccuuccagucaaugcaguuuggaauaggaaacacuuaggcguccgcugaugcgcugguucugaccagcuugaucugggauaggcugcuagcuaguucccagauggugcugaugcugccugcuguggccccccacuuuguauacugaguaguuuccauggcauuugagaacauuucuauucuuaccucacaggaaaaucaggaugugaguuggaucgcgcgucugccuuugagaggcguucuaugcauuugcaugugcuaauagccccggucuggaccucucuccucuaggauugucucaaagccugccaggagcaaaucgaagcucugcugcugaacagccugcagcaguuccgucaagagcagcauaacgccggauccaagucuguggaagauccggaccaagccaccaccccuacagacgugcgggauguugaccugugaggaagccauucgggcggcaagagagaggcguguucgucaucugcuagccccuucucucucuaguuaugucuuguucuuuguguuuuuaggaugaaacuucaaaaaagaaaaaaaaaaaacaaaaaacaaaaacaaaaucugcccccaccuagauccuauuuaaaggucuuuuagaagugagaggaaaaggccguauaguuguaacgcauguggugccuguucaaaguccugcauaaggggaucccuguacacucgaaccguuauuauuugaugauguaaaagucauagugagaugcuuacaggagaacccgcagacuagcuagagagugugcguaccugcaacaugggaacgaauuagaggagacugucuuuugugcuugugaccuagugcauaugcccccuuuaguagaauugcaaggaaccgugggugccaggaccgcaugaguaguuugcaaagcagugaacccaaggaggaaucagaaacgagaagggacaugccggggagguugcgcaaaaccacccaaccacaugacugaaccauuuuggauguaagaagcgccuugaugccucaccacguguucccaagacugagcguccgggucucuccgucgcauacucuugcugacuaaaguagcugcuaccuaagggauaugucuuuugccaguuggacacaggugaacggcuccuaagucucauguuuggugaauuugggcuucuacuuccaaacaugguucauuguagauguauuuuacuguuaucugauggagggaauucgcuaugggccaugaccaaaacgcaucuaaaugggggcagauggagaccauagacggaaucuaaaacaaagcugccuuguguaagggaagagggugaggugaucuuuaauccccuuguuaagaaaaagaaaaaaagaaacuaccccuaacuuuuggugcugauuagcaugucugguccacuguuuaacuuuguuauaaaccauuccauuagaaaagcacuuugaaaauuuugggggaggguggggugggauaugggaugguuuaugcaaaucauguugaauacgccuuccuccuuugccccuccccuuccugacccucguccaguuacuguucauuucuggagucugauguucugguacccagcucuggugucccugccagggcugagaaagcccucugcugauauccucaucccagcauucuucggaaaaccugucaacagaggucuaaagcauugugauggcuuagaaggauugaauccccgucuauguuuuucuccuuuggacauggaaagaaagguuacuucugaugcacaggcugaacaucaggguguggcauuuuggucccuuuuccguuuuuuguuuguuuguuuguuuguuuguaauuuuagugcaaaguuguauucauuguacuugaagaccccccucucccacuucuuggagacagucaguaaacagaagugggagccacaguugguuugguuuuguuuuguuuuuuuuuguuuuuuuuuuuuugcacaauuauaauugacagguuaugaagcuauuuguuaaaauaucugcuuuguuuuuuuuuuuuugagaaaagaucagaacagggcugcuuugaagaguuauacacagguucugccuuguuucacagugugaggguugaagauggagaaacaucuaagggucucuuaucuuucauuuuuucuuuuguucuguuuauuauuauuauuuuucgcugcuaagaagcuaagaucguucacccccauucacauuaacaguaccuagcuguaauguuucacggugugcugcuauuuuagaaacauuguuauaauauauuauuuuacugcuuaaauuucaagucccgagguagauggucgagagacgaguucucuguacuggaaaagccuuuuccucugucccuguccuucugguagcaucgaugggcugcguugcguuugguuccguuugguuccuuuucuuccgugccucuucauuaccagguuuucuuuccuccucugaccacauucuucaaagagaguauucuuuaccucagguuuacuggacaaaaacaaaacaaaacaaaaccaauagugauaacaauguacuucuuuucguuuuccuaauaccucacagcuauaccggaucuguuuggaaggccgcuggcacgaggcacagggcaggcagaagacaggaacuggacauccuccuugauagaaagcaggagaaaccugaccccagagucucaggccaggggucuucucugucuugaagauugccaggcuccccuuugacgcaggcucccuucuuaugauagaagacagugacgaagggcuccucuacccaaggcagauacucaucaaacacagacaguggacuaggucagccugauuugcaugcgugcaccagggucugcaaugaagaauucuggcagacaguuaggagacccucccuccaucuuguagcccauucagacacaggacuuuccucuucauggggucccuucaucaugaacauugaccaguuuccuucuuggcaucuauaccccaacuucggauggccuccgaagucuuccuaggacugagucugguuggugcugagucuacagcacacguggaugauauuccuuucuccuucucuuguccucugcagucuacagugacaggcaagugcugugcguggccagguugucuguguguagcauugaauggcuucaggguuuggaucccguugaguggggcaagguaggaggcccaaguugaaugagucuggaaugcaaguugaaagaagggagaggcuguuucuguggucucggguguauuuaggaaggauugggacuuggugaguuagcgagacccuaaauucuaggggcuuugugguaggacggugggugaugguuugggaaguuugagagagaaaacgggagcagccugcagcuagccaguguuuauccagagcucacgcacugcacagcacacucuucugguccuuaagggaccccacagaacuugacagacacacucccuugaguucuugggcaacuuggguaccugaugaguggccuuugagcuuaacugaaacauugaaugaaggaagcugacacacaaggggagaggcagguuacuaucugccccuccaucccucuuaccuggaaccuaagacacucuuccuguuugccuuccuuggagccuaguggaacgaguccuguagaguggccauucugccugcuccucacuuacacaaaggaagggagccuggauuccuuggugaccaauaccuucugcuuagaugugggucuccuugguaguauuucugucucagagggguauaaacgaccccaaggauuucagcuugcucuccccaagccccuucguauccuacagaagggguugcagauucuggucuuuuucugccuugcuaaugaucucuucuuuguuucuaauuugucauuguuguuuguuuuuguuuguucuuguuuuuuuucuccaucagugggggcuaagucguucccccagccugccaaauuuugauccuucccuguuuugaccaaauccuaggggaaagaaacccuaguaugccaaaaauaauaugcuaagcauaaggagauucauaaugguuccuaagaaccaggcagccugugaguggugagcugcuucuagaugggacagcuuguagaggcugcuuugguuugaacuguccccaggacaccacgggaaagcagagcccgucauauagguugcuagcuuuaaggugcaugccuacugacacgggacuccucucuagcagccaggcuggggguacauguagcaccccuggaucccaucuuguugcuagcaggguaagugaccccucagagggagcuuaagagcuuuccuauagucuagcucuuuggggacccaccagacugugccuugggaauuauaggagcaacaggcuaagacaggguggcuuucacaaagaaggcagaggagcuuugucuccaugaggacagggcugggaggaccacacuugucccuguguccuggacaguggugugggaacuggagguagcaaucagaagucuaaguaagccagcugaccucuaagcccaaaggacucccccuugcuuaccuuagacaguccaaccuugggaauagcuuuaaaaaggggaauuaauacugagacagugaaguccccuuaagccgacaagcccuccauaggugcacaccgcacacauaggcuucucucagugcagacuccaggugguggucaacagcugcggcaugcuuaucuauuuguacgaaauaguguagggaagccccaggagguguuauagcuuccauauaccauguggcuuuugauguuucuggauuuucaacagcacaaaagaguccucgagccggaacaugcgcuacuccgauuuuaaacguggcugggcugugagacccguucuuggcucugguuuuacgaagccaucaauacauacacacccuugauggagcugcagauccguuccuuuuccugcagcccacuugugggggaaaagugccuuacugacuuacaguagccacucaguuucaacaggugccuaucuuugacaaaaaaaaaccacaaaaaacaaaaaaaaaaaaaacaaaaaaaaaaacagaaaagaaaaaaaacguuaaaaugucucuuaauuuucauuggcuguuauucuuauauugaucaucuuguauguucccagcaagucaccgggccaucgaauuaucuccauguuguuguucauuauccuucugccauguaccucagaucuaucaguuauggucucucuugucuuggauuauuuuguuccuuuuuuuuuuuuuuuaauuugcuuuaagagugcgaugccauaucaaaucaauguuguucucucacgguguacucucuaacaggugugggugggguuuaugguugggauacgaggagagucuaaaguagcagauuagugugaauaaaaaagaaaagguuuuuaggaaauccgggggaaguacauuguauugacuacaaugcugaugugauguagccguuaagucuucagugaucuuaaaaacaaaaaaacaaaaaaaaaaucaacccuaauuuguucuucugacugacuaguuugaaguuggauuugaagaugauguugaaaaagguuuugaaugcaauuagguuaugcuauuuggacaauaaacucaccuugaccuacaau

SEQ ID NO: 3411 - RNA, 3009 nt, Mus musculus
agagcaucagugugggauuuuccugucauaaaggaggagcuguccaucaaagauccccauccugccacuagcauggucaguucaugcugucaggcucacugaggacagcccuuaguacucaugcauaacuguaugugugagaucugccaggaacuggcugcuggacuuuagccucagaucggccggcugaaggcaagucuggagguuuucauuuccaaccucgggugggaauuucauccgcuguacugagcuucaggaagagcugcggagcagaagcagaagugcagugucuuaacucugagucuuuguuguuuguuuuaguaugcauuuaaacacucacaacccccacucucucccaaaccgccuuuccuaguuccuaguuccuccugucaggggugagggcugaugaaugugagggcaggggagggggagagaggagccaaggaaaaggugucuuggcuggggguagaagagggggaaggagggggguaggcuuggucccucuuaacucaauccaauugcuuccuccauccuaaaaggaugaauagccugcuucuuacaccaaguaccguauuugcuugcauaggugaagccccuggaacaacagagguguguggcuaaacaaccagccucaagggaaacuucagggaggcccuguucccuccucucauucauaacaugggguuagccuucaguuccagucaucugggagccccagaauggcuggaugguuauguauguggaguggaggggacaauagaagugucaguguugccagcuuuacuccaccauggcuuagagaaucugcaucuucuauggcagcauauacgguaacugagacauuccagagggucucagccagccagucaggagucuuucugcuuuuuuuuuccccuguaggaaaaaguuuggguucuccagggagcugcaaaucagccacaguccauccagcagccuuccccucccccagccuccuccaccauccauccguggcaguggccuuggagggugagucaggucaacuguaguccuuguucugccuuagccaccaccccccccacacacacacacccagggacuugggcgagugagugcuaaggaguaaagaccacuuuuuuugggaggggugaggggguugaauuggggaggugaagagagaaggaaggaagaggagaaagaagaggaggaggaagaggagagggcuucaaacaauguaggugagagaggcggagggcaaccuagcauguugucucaaggagacacaaggagagcugaaccggguguccccuccuggccagguuucaaagguccugcacaaucuugucagucacccauuuauuauuauuauuauuauuauuauuauuauuauuauuauuacaugcaugucuauacaggugcaagcauggcgggugcauaugcacacgugcccauguuuaugugaggacaaccuuagguauuauccucaggaacucuguucaucuccuuugaaauggggucauuucuuguuuggauugguuggccaaucccaaggauccuccuguccgugugucuacagugucuggauuacagauaugcaguauguaugccuggcauuuuuaugugaguucucagaauugaguucaacaccccgcucuugcaagacaaagaguuuacugagaccagaagugugccucagcccccuccucugcugaggggagcccugggucuaacugcccugucuucugguucugccucuugguacagcuagucucuccuuucuccuugaagguuuccaaugcugucaacccccugcuuccacuugcucucuuaugucuccuucacuucuucauuucuuaauucucguuuuaguuaaugccagauuguucuaaaagacggcgggagaaccaggaaggagccuggaaggaaggaaggaaggaaggaaggaaggaaggaaggaaggaaggaagggagggagggagggagggagggagggagauaucugucugucuuuggaggacauuucuugauuggaaauauucacugauguucuugaugauggagucucauccagauguaaacagagaugaggauacguaaaauaaagcagcucccagcucaagcacucgcugggugcucaccaagcaccugcugcaggcagggauggucaccaagcaccaggaccagauacccuaaagauaaagauggccaucaugcuggaucugcaaucucugggaucccaaccuacaacaacauuacuuaggaacaucacagaaagccauguucucaggucccaccuuggguuugcucaguuaggaagacugguguggagcccaaagaucugggcugccccugucccaaucucugagaagcuaugcccuacaccaggggccuucaucagucuucccaaugaaugacagcuaagaggcugacaaaaccacuccaggucuauucuguagcuccaagcuuccucuuucgaugcuucugccgggggaggaaguugagaaguuguccucaguagacccgaguguggcuggcuuucaaaaccaguugucccuggcccccuugaccuuuacugugcuucucagaaagaggauggccaauuauaacacauucugcuuucuguucccuuuuuccucuuaaugauuucaagccuuuguguccuccucaccuuuggcauccagaagugguacauucccagccuaggggcacaucaggaagauucucuguagauauuucuguuggguacaaugagccuaacagccuagauguuuuaggguagccccaguuuuacacacugcacccccaaguccacaucaacccagcacugguacuguacuugugaggcaaacuucuaaaauuuuuggauuuugcuauggcuacaaggaaggggauuauaauauuauugcaaaacagcuuguuggauuguggggagacauaccucuaacaacugggggaauugcauccagaacaucgucuuuggagguguagagggaagggucugggugcaguagaggccuuuggggauugagg

SEQ ID NO: 3412 - RNA, 1069 nt, Mus musculus
gcauggacagccauugcaguacauugagcuccauagagacagcgccggggcaagcgcgagcuggaugagcacugggcgacucugugccucgcggaggaaaaucaacuaaacaugggcaaaggagauccuaagaagccgagaggcaaaauguccucauaugcauucuuugugcaaaccugcugggaggaacacaagaagaagcacccggaugcuucugucaacuucucagaguucuccaagaagugcucagagagguggggauaccaugucugcuaaagaaaaggggaaauuugaagauauggcaaaggcugacaaggcucguuaugaaagagaaaugaaaaccuacaucuccccccaaaggggagaccaaaaagaaguucaaggaccccaauguacccaagaggccucuuucggccuucuucuucuucuguucugaguaccgcccccaaaucaaaggcgagcauccuggcuuaucuauuggugauguugcaaagaaacuaggagagauguggaacaacacugcagcagaugacaagcagcccuaugagaagaaggcugccaagcugaaggagaaguaugagaaggauauugcugccuacagagcuaaaggaaaaccugaugcagcaaaaaaggggguggucaaggcugaaaagagcaagaaaaagaaggaagaggaagaugaugaggaggaugaagagaaugaggaagaggaagaggaggaaggggaagaagaagaagauguugaugaauaaguugguucuagcgaaguuuuuuuuucuuguuuauaaagcauuuaagcccccuguacacaacucacuccuuuuaaggaaaaaaauugaaaugugagguuguguaagauuuguuuuuaaacuguacagugucuuuuuuuguauaguuaacacacuaccgaaugugucuuuagauagcccuguccagguggaauuuucaauagucacuaaccuugccugguacagucuggggguuguaaauuggcauggaaauuuaaagcagguuuuuguuggugcacagcacaaauuaguuauauauggggacaguaguuuuuuuuuuu

SEQ ID NO: 3413 - RNA, 2280 nt, Mus musculus
aguuuuuaagaguuuaauucuaguggagugccauguuuaggacaaacauucacagauauuugaggacaggaacuguagauggucucugagguacagaaaagauccuucccaccacaggggcuaccccacuauuggaagaucugccucuagcacacauaccuucauguuuuccuccagugcugaguuccagccagaggaggugcuagaucggcacucuaccacuaagccacagucucagcccuggguuuuugagauagggucucucuaugugguccagaugggcucuuccuuugcuuccauggugcuggaacugcaggcauguucugugaugcugauaccaguacugguucuugagaucuguggagugaaguuguguugaugacuggggugacauguaggauuggaauaaaacccuuggggaaggguaucauaggaaaagacucucuaguguugugagaugccacugaagaagugaccgguaaccagaggagcccuaucuguucccacucuuccuauucuggaacucuauaauucugccugggagcccaugcugggaucccagaaccaaacauuuccuugucuaccuuuccacuacuaccaauccagugagccagcaucaggguacagcuucccuagccuacagaccaggccacuuaggaagauucaggugcaaacucuggucuguucuggcauguaaguucaaaccaugcuauccuccuugucccgucauacauagcuagggagcacacacacugucgugcugcgucuaugucuccucaagaaucaggccacagccauuauccaucaccacauguggcagcuaacccagcagcgagcauuccaaguauugucugggccagauggcguccagccaaggcugcagcagcccagcuaccuggcuaagcuugcaagcaaccgcacaccuggguaguucuccugcauaaaagccucugccugccugucuuucucccugaccuaagccccacuguuuuuuaaaccacauuccaaagaaaaaccugcagaagugccacuagggccugcagaagugccaccagggucugcaaagcaauugcguuuccuuuuuuccuuuuugacauuaaaaccagaguaugacuucuuucuuccccugacagugucugguuuaagucauugugguuugguguugcauguggcacuauuugguuuggaagcuugauauuugggaggcauuuuauuauagcucugcacggauaggguaaucuuuggugcuucgcucucuuaaaaguccagcugcucuggagaugaagugcagcucagggaagaggguaugccuaagcccuggcuccaaucaccaacaccacaaaaauaaaaagaacaaugccagaggcuggugagauggcucacuggauggugccuguuguguaagcauggagaccccagucuggaccucagaaccccauguacaagcugggagcacuggcaggcgucuguagccgcagugccggaagacagaguggagagaaaccggaggauccauggaauuuaguggcaagccagacuagccagcugauaagcucugagcucaaugaaaaacccucucucaaaaaucaagugaggcguggucaaggaagacauuugauauccaccucaggccuccacauacauguagacauucaugcauauccacgcacaugcaggugcccccacgaacaugcacauagaacacaucccaaccacauauacccucugcaaucuaauacccagguuaccuaccuuuccuucuggaugagaaaagcccaaagauacauauucauuuuucucaaugguuuaugguggagucuaaacuucacuggagacacagaagagccugaaggcaccaaaauauuccaacaugcugccacaacagacguggcuuuuucuacuugcugaaaccaugucuucuuuccuuuucaagucauucauauuguuuuacagcaaacccaaccacccccuaucaccaccaauaccagcuggcaaccauuugccacccccggggugaaugcauauuuuucuuaagaaaccugugcaaaaaugacuaugggucacacaugugugaggcccucuggacuaaaugauguaaagcugggcaccuagccugguggcacucuucugggaagacuuggucaaauggccaacucuaguacagucuguguucuaauaggcucuuauacuucuggagucuugugaauuaguucuuauugcuuaaauacagcuaugaucaauggcuuaucagguguugcaaugaacggggagacccuaaaa

SEQ ID NO: 3414 - RNA, 2586 nt, Mus musculus
ugagaaaugugacuuggcccuuuagcucaagccucuccucucagccuuucucagccaucuaucugccuuugacauacacagugaccguuuagacugucaagaggaucuggaagcagggagugauugggggacaugcugcagagaguccuugccacccccccccccccacacacacacggcacucuccgccuuuaugauaccucugggugggcgucagggagaaucccagccauggaagacagcuuagaucuaccuggaaagcguccauuccaggagaagacaguccuuggcuacggcgaacuggagauguacuuggauuccguggauacagguaagcccaagaaacagaauguuguuacucuacuguguggcuuucgaguauccucacauugucgugccguuucuaccguggaauaacuugaacuacuccuaaccaggcugggagugcuggcugagggcuuagcaaggauaguaagccaugucuguuucaccuucaaguaggcuagcuacaggaacacugcuuccagaaaaggaaaucccugcccaacucccuuaccaucagauggcugcuacugggagcaucuuugauggcuuucauuguguacacagggcaauacggaugccucgaugaguuuugaugucaacaaugauugauuggcaaguuaaaaaaaaaaaacaaaaaacagccacaacuuuuauuuuuauguacccagauacuugaaacaaguuaaucuguggauuacuuugugugucaaccugucucaucaggagcuguucuuggguccaauagcccuuccugcagagaaauccuucaguuuucccacugaaucgacucuugaccagccacagggaagcuugguuacugauacuucucguaacacaaaagaaaagccuuuugaccuugggaaaggcuaaggcauggcucacugagaauacacaccuugguuaacaggcggcggggccuccaucagccucugaccacacuggaauuggguuuccuuucuguauugcucccuuucuucucacggcuguaaccaaauaacugacgaaagcaaccgaagagaaagauuuuagcccaaguuuugaggguacauacacaguccaugguggaggggaugucauggugacagcagcuccauggcagugcgacccuguagcugggaagccuugcauuugcagaacauggggcagagaucagauggggagggaguggagcagguggauaggccucaaggccugcugucagugacccacuuccuccaucaaggcucuacugccuagugguccaugaccagcuggcaaacagguguuaagaccccggagccuguaagugcccugacagcugggagggagagagggucucugaucuucaucccucauuuguacuacugggguugacuuggaguguaagaugugucuggucagucuucguggugacuagaacauaugauaagaguugugauugucacagaaggcauaaggugacagcagaaacagaaguguaggcucuucucagggaaaccccuauucucaagagcuggaaauggguucuaaggugucaggcgacuuucccagauucagccagcacacaggccuugcugucaggaugaacugcucuuuccuuuacccucuagaguagauauuaucuucugagaaucaaaaguaggaaggaaacacugcaaggaggaucuguacugcuugcgcaccuuauccugggagcucgcugugccuugcacccucugauugccaaugucugucauuuucccacggcacacgggcacaguugacucacuggccuaagccauaaaacuguuucucaaaggcucuguugaaugucuccuuccucuuaccaucuucuaugccugaccucuuauuuugaggcauagauucaagugagcuuuccuuguauggagaaauaacaggugagucacaccugacagggccacccuaaauacagggaacauugcuccacagagggguggagcacagcucucccggagguagaaagcaguucucaguggugaaguuucuauuagguacaaacacuaguggaagccacuauugaucuagacauugccucagccuagccuggaagaaaaggcagcagggagugccugacugguucuggcuaucuuuugacauaaaagaugaaugccaauuaaaaaaaaaguuuuuauuguuuuucagaucacagaaggacuuggaaagaucaaaaccuguuguccagcauuugggaacacuugggacucuggaaagguggccacugaaaagcaccacaggucuuaauggcuccccggaaucuucuuagcacugagaagcucgagcuauggacacuccuuucagacaggcuugcgacugugaugucauggaucuucugccucuagauccugaucucaguuuugagugcaguguaugcuuuugcauaugacuuuagggcagauagggaugcaagguggaguuuuugucuuuugaggauucaggcuuuaccucuagauauuagugugguuaagauuugaaaaucuauaguaagacaauauuacuuuggggaaaccaucacauggaaauaaaggcucccauucucguggu

SEQ ID NO: 3415 - RNA, 945 nt, Mus musculus
uagagagagaggaccuccguccacguucagucaggacacaccacugugcaacacucacgaggcuggagguagggugagaagugccagccguuuuuccaggacucaccuugagggagagggugaggccaugauacggggcccugccaggccuggagaccauggaugaaggccagaagaggcugguggcauacacagcaugggccaugcuacucuggggugagaggaugcugccugaaccagggagccacaucagcagggcaugcuuaggucaggggacagugaaacgcuuugccgggaggaguggcagucagaacacuguggcauuuccucuuccucccucgguccuccgugggcuuugacccgcgagcauccugcaucccgaauggucacucucacacauuccugcugcugcaaauuccucugguucagaccccgcucuccucacccugauccggagaguggaagcagacauguuccucugcccagacugaaacagagucucaggacaacccaggaagggaggcagaccccaccagacucacucaguugcuuacugcccugcugaggggaaaggaaagggccaugugggucucaggaccauuccuccuuaggauccauugcuguccacacuggggggcagacacuguagcccauguaaccucaaagacaagauacagaaacucugagaagucaggcuuccacugcccccacagcauuggggagaagacccuuguuagaugcccagugcuaggccaagcagucuugccaacacugauacccaacacauguccuuccguaaagacaggggccuguggaacugacugagcaccuaucugggauccagauccucacucucucucgggccuucacgugguagcugcuuuucucgugcuauuuggcucuuuacgcuguuucccaccaggccagguguucucuggucuagca

SEQ ID NO: 3416 - RNA, 13468 nt, Mus musculus
cgugccagcgcuccucucccagcgcucaccgguccuuccagcaguccucagguugcacgcgaccggcagugagcuuccacuggguaggggugggaagccgguggcuccgggcagcggugauaacccagcaaggaagcagagucgcauuucggagcguccacucguaacgcggccucucgcacacggagcucguaguccaggggagaggaggccagggcggcccuggagagguuguaggugcagcggaucggccguagagaccccgucggacucaggaaggcacugucagccgcucggagcggaaccccuuucccagacaguagagucaccccucccccuccggggaccguuacuggucgccuccugaaggaucaaucugggauuguccgcuaaaguggccuuaggcaccguuagucuagggcucgcuggcuuguggccucagaagguaaugcucugggguaccacuuuuauguagggauugugcccggggcuggggcaugggcgggagcuaacguccacaggcagugccagcaauaugccaaaugcaccaagcaccaaggcaaagccacaaggcuguagaugucuucuuucaggcaacccaguuuugugcuaaaccucaauagacuuucuuuugucaggaccauggcaaagaguggaacaccagcuauucaggauguagaugaaagucgcuccccaaaacuaagaguggugugaauuauauuuagucccugccuccaaggguuuauuaagauaauuuaaaaugccuuugagaugacaaaaguuaagacucaucauuuuacuuagauuugccuccuaugguuauaauuuuaggcuccuucauaaauccuacuaacauuuuacuauauauuauuuuuucauucaucaauuucauuucauccuccauucccuucaguaccacaacaggacuacuuaauccuuagaggauguacagccaaacaaggugacuagccaucggccaggagagcuuauuaaaagauuucauuucuugggcauccagguaacuuauccacaaaaacucauugguuuuuuaaaaaaaauuauuuauguguuuugguguuaugacauauauauguauguaugaacccuuggaacccugaaacaggaguuacagacaugagcugccaugugggugaugggaauugaacccagguccucuggaagaaaagccaguguucuugagucauccuguucugggauuauuuuucaagacauuucucaucugugccuuaaagacuaauagaacuguaacuuuuaaguguaucuuaaagggcauuuuuuuuuuccuggaagaaagguuuauugcauaaggaaaucaauagugugaagguaauuaaaauauuuuuaauuuaugcaaaaguguuucaucuguaugaaaguuuuuguuugcugcaucguaguagucaagaaguucuggagaauuucagauuuucaagauuagggacauuuaaucauuuguuuuuuuuuuaauuuuuuguuuucuuuggaaaguuuugguagguuuacuuucuauuacuuccacaucuaggggguggggugugugucucaauauauugccuguaccugucucuaacuccaaggcacaagcaauucuccugcccaaucauaugcuggaauuacaggauugugacuucauaaccuucuaccuauauuuugauaagacauuggauuuacaguuugauagugacaugggauaagaauuuggggacugucaaaaaauauauaugagaacuuagaagccuggagagcagaguguuauggauugaauuagguuccuuaaaaacuuauauguuagccugguacagugccauauauaucuauaauuccagcacuugcaagauagagguaugagaaugacaaauucaaggccauucuugcauauauauauauauauauauauauauauauauauauauauauauagagagagagagagagagagagagaaagagagauggauauagugaguuugaggccuggcuuggcuauaugaaaccuuguuuuauauauauauauacauauauauguauauauacacauauacauauauauauauauauacacacacacauauauauguaucaagaaaaauccccaaugauaucauaugguugcccucccagacuaauauaaccauugucaagaaaguaaaauggcccagguacaggguguaugucugucaucccagaacucaguacagcaggacaagagccuggguuacauaauggcacuaccugaagaagcaaauggaaagacaauacagagggcuggagagauggcuccaugguucagagcucuuauuaugccaggcaugguaucaaccuucuuuaacccuaguacucaggacacagagucaggcugaucucugugcguccaaggccaguauguagagggacuuuuuuaacuccccccccuaaacaacaacaacaacaagcagcucuuguugcuuuugcagaagaccuugguccccagcaccaaaaugguaguuuacaaccucuuauaacuacagacgaaggggaucuaaucccucuucugaccuccaugugcaccaccacaccugugaaaucacauagauacaugcuggcaaaacacuuguacacauuaaaucuuuaaaagguuuucuuuuuuaacgauaauacagauugggaaaacaauuugcaagcucugucucuuacagucugucuugaauauaugaauaacucuaaacucaacaaaagacagcccuauuuaaaaaugagaagcgaugcuaggcaaguggcuaaagucuguauuucuggcuacuagggaaguugaggcaggaagaucacaaguucaagaccugccucagcaacuuagugagacccugucucaaauuuuaaaaaggaaaaugaggacagaggguauagcucuaguagaacacugagcacagagagagagagagagagagagagagagagagagagagagagagagagagagagagagagacagagacagagagagagacagagagagagacagagagagagacagagagagagagaggaaaggaugagaggaaggaguugaagagaucuuucuuuuuauuugcuuuuuuuauuggauuuuuuaaauuuacauuucaaauguuuucuccuuuccaggucuccccuucagaaacccccuaucccauaccucccuuccccugccucuaugaggaugcucauacaccuacccacccacccacuccucucuucccucccuggccuacacuggagcauagaacacccucaggcccaaaggccucuccucccacugauguucaacaaggcuacccuugccacauaugcggccagcaccaugagucccuucauguguauucuuugguuggugguccacucccugggagcucaagggguguuggucuggccuguugacacuguugcucccuccauggggcugugaacccucucagcuccuucagucccuucuccaacuccuccaucugggacuccugugcucaguccaauuaaugguuggcugcaagcaucugccucuguauuugucaggcucugggagagccucuuaggggacagccauaaaaggcuuccaucagcaaggacuucccggcauccacaauaguaucaggguuugguggcuguauaugggguggauccucaggagggagagucucuggauggccuuuccuucaaucucugauccacacuuugucucuguauuuccuucugugaguauuuuguucacccuucuaagaagcacugaagcauucauauuuuggucuuccuuuuuccuaggcuucauauggucugugaauugaaacuuggguauuccaaacuuuugggcuaauauccacuuaucagugaguacauaccauguguguucuuuugugagaguuaccucacucaggauauuuucaagguccauccauuugccugugaauuucaugaagucauuguuuuuaauagcugaguagaauuccauuguguaaauauaccauguuuucuguauccauucaucuguugagggauaucuggguuguuuccagcuucugaauguuauaaauauggcugcuaugaacauaguggaacauguguccuuauuacauguccgagcaucuucugggcauaugcccaggagugguauagcuggguccucagguaguacuauguccaauuuucugaggaacuccagacugauuuccagagggguuguaccagcuuguaaucccaccagcaauggaaaaguguuuuacuuucuccacauccucaccagcaucugcugucaccugaguuuuugaucuuugcuauucugacaggugugagguggaaucucaggguuguuuugguuugcauuucccugaugacuaaggauguuucuuuaggugcuuuucagccauucaaguuuccucaguugagaauucucuguuuagcucuguuccccauuuuuaauaggauuauuggguucucuggagucuaccuucuucuuuguauauguuggaucacaucuaucagaugugagauugguaaagaucuuuccccaaucuguugauuguuguuuuguccuauugacaguguccguugccuuacaaaaguuuugcacuuuuaugaggucccauuuguugauuguugaucuuagagugugagcgauuggugaacuuuccccuuguguccauguguuugagacuuuuucccacuuucuuuucuauuagauuuaguguaucugguuuuauguggagguccuugauccacuuggucuugaucuuuguacagggagauaagaauggaucaauuugcauucuucuacaugaugacugccaguugaaccaguaccuuuuguugaaaaugcugucuuuuuuccacuggaugauuuuagcuccuuugucaaagaucaagugacccuaggcguguggguucauuucugggucuucaauucuuuuccauugaucuaccugccucucucuguaccaguaccaugcaguuuuuaucacuauugcucuguaguacagcuugaggucagggauggugauucccacagaaguucuuuuauuuuugagaaugguuuucacucuccuagguuuuuuuguuauuccacaugaauuugagaauugcucuuucuaacucuaugaagaauugaguugaaauuuugauggggauugcauugaaucuguagauugcuuuuggcaggauagcaauuuuuacuauauuaauccugacaauccacaagcauaggagaucuuuccguccucugaggucuucuucuauuucuuucuuuagagaauuaaaguuuuugucauacagaucuuucacuuguuugguuagagacacaccaagauauuuuauauuguuugugacuauugugaagggugucauuucccuaauuucuuucucagcccauuuauccuuugaguauaggaaggcugcugcuuuguuugaguuaauuuuauauccagucacugcugaaguuguuuaucagauguaugaguuaucugguggaguuucuagggucacuuaaguaaacuaucacaucaucugcaaauagugauauuuugacuucuucauuuacaacuuguaucccuuugaccuccuuuuguugucuaacugcuauagcuagaacuucaaguacuauguugaauagauaaggauaagagaaggcagccuugucuagucccuaauuuuagugggauugcuucaaguugaagagauauuucuuuaauguuauaaaaguagcaguaagaacauggaaaguuuauugcauaaccauuauuuauaaugcauauaaaacacaaaucaaaauuuuacuaagauaccccaugaaacuuuugagguugucugaaagagaaaguuuuacggagguagauauggguucccuuauacacugauauugaaaauguaaaaugauuuuaagaguaguauuacaaagaaagccccuuugaaaaccuauggaauacuucuuugaaaauucaguuaccaugugacacagaaauuccacucccauguguauagcaaggaauaaaaauauauguccacuucaaauuugguacauggguuauuucuagggagcuuucucagugauagagacuguuuucaagccccagaaccaaaaagaaaagauuaaaacaaauugguauggacuagagacacggaucagcaguuaagagcaccgacuacucuuccaaagguccuuaacugaacucccagcauacauggcaguucaagaccaucagacagugacuucugguguacagauguacaauauacaugcagacagcaccauauacauaaaauacagacacaaauggguacaugaguguuauaauagcauuauucaucacuguaaccaucaaaucagagaaaaaaauucaaggccccagugauuagcuccugagaguugcccuuacgacuucacugguguauaaacagcuuacucggguauuuucacuaauuaaaaauuggaagcugaaggaaugagaacuuggcuaccuuagcugcauucuagauacaagucaaauuaaagucaguucuauuuaucuccuaugcagagaccaaggauaaacuagcaguuaucacuagguugugguuuccucauaguggaaagcaagcacacaugaggccaagucacaaaaacucagcuggucuguucacucccugccaggaaccaaacccaaggcccagugcuuuguacacaagcacucugacaccgagcuccugccccaaccccuaggaacucaugggaggccucugacuaaguauguuauauguucuauguagucacuuuaguuaacugaggaagcugugugagugaguuaugugggcaucccacggaguagagaaguaaacgggaaggagaaggcauggucaguaccuuuuggaagacuuccuaauaaugaccuacaccucugauauauugguguuaggcaaaaacuuagaacauguaucaucaggauggcuuagcccaugaagguacuugucaccaagcccaaugaucucaguugaucuccugaacccacagaucaaagcugagaauggauuucuucaaguuguccucugacuuccacacauacacugccaugcgcauguacacacacagacacacacacacagacacacacacagacacacacagacacacacacacacacacagacacacacacaaauauaauuuggaaacuuuaauauguggucacuacuugucugaggacagaauggaaauacauacagccuuuauucucaucagucacccaguuaaaaugaagaaagcuuagcccuaugucauaauacacucuuguaugaggcacaaggaucacgcauuugaacccagcccacucuguguagugagacccagucuccaaaccaaagucuauuagugaaauaaagauuugcugcugagaggaaaacgauuaacuucuauuagauuuucuuaagcuuuauuaaauugugaaccucaauagauaauuuauuuagaugccucuauauagagggugaaauagaagacucaacugaagaaagggucuacagucaguguggagggaaaaggaaaugaaguggauauggaagagguggaggagauuuaaaauggaguuucuaauuguaaauuccacuagaaccccagaagggaaguuaagaauggaugugaguuuguuuuuaaaagauguugaguucuuucuccaaacuaaugaaaauuagauuaauaggucagaaaucacuaagaauacuaaagagcauacauaagaauaaaugcaaccuagguacauuggagucaaacagggaacagaaaccaaagagugggacuuaaaauuaguugcacuggguucuuagggcugccacauccaagugcugcagaccggaaauuuaucaucucagguucugggccugaggauguagcacaguggaggaacacauagauacuuagagucaaugaaguccuaaauucagcaucccuuuuuuuuuuuccagaaaauucauaggauguugacagaaguaugcuaaaacuguacugaguuuaugauaggaauaucuaaaaccuuuauuagggcucccugugccucuucccagcucugaugauuagcugaaaauccuuugccuuuggcuugcagcuguaacccccaaguaucuccuucucuccuucuuucccucuuccuuucucuacuaugcuaguagguuuauuucaggacagggucauauuauguuuccugugugagucuugguugcucucuugaggucaaguaaucuuccuccuucagugugucaagaagcugggcacagguguaugcucugucuaguguuuucaauuuuauggaacaccugccauggucuggagauauagcucaguaguagaguguuuguguaacaugcucaaaguccuaggcuugauguucagcauagauauaaaauaaacaagcaaacaaaugaccacagauaccagcucauguguaauuccagcaguggggggcugaugcagaaauauuugucaggaguuugauacuagacugagcuacacaguaaaguuaggcuagccuggucuagagggagaauagccuaaaacucuagauucuuguguuuccagccucucaagugcuguaauuauagauaugcauauguggcuaguaucaccuccccuuaacuaauuaugucagcaauaacagauguuccuccguuuauggggcuaaaagcccagugggcucauuuuaaauggaaaguaucuuaaucuaaaaggcaguuaagguggauguggugucaguguuuguaacuccagcacuuaggaggcugaggcaggaggaucucaaugaacucaaggccagauuugaacuccauaaugaagcccuuccucaaacaaacaaaccaagcacuuaauacccaagcgccuaaacuuuacaacaugccaauacagugcauuguacaguaucugguauuucccuuucugauugugugacugagagcugaaacuucugucguugcccagcgucacagagaguauaacaggcucagcucugaaugcguuuaaacuguacucugucugcccugcauagggguggcuagucuccuggguuuugaugggauuguagaaggcuguucucaaggcuaccaaggaaccagaggaugaauaauaauaaucaagaggagaaaugauuguuuuuuaaaagaguagccaguauuuucuuguaugguucaaauugucugggugauuuuuccaccagccaguaugaaauagaaaaggcuagaaaguuuugauaaguagaaaaguaauuucuuccaggaugguauucagauauuuauuaauaucuacucauagauauuuaaugcccuauuccugagaguaguacauucuaaggacaaaaugaguccuuauugacuucauuacaccacaaaaggugcauaugaacaccuaaaaaucuuaauggacaagguuguuuguagaagaagucggcuucaucaugccccauugacacagccaguguaacaauagaaaucucaggacacagaauuuuauaaauucauuauaaugaccaaggcaaauagaugccuaccuguguaacugacaguguaccucaggagacaagaugaacaucucaucuggcaguuuuccgggacuaauaaaaaauaauaugcaauaagcuaguuuuggagagaaaagucuauuugaugguaaauuagagaucauacagucuucuaagcaucuucuuaacaagaaaauagaucuaauuaaggagauuuauaucuaauuuaguucuauaccuccuuuccaguuaguacuaggcaaggaaugaacgugugugaccaaaggugacaaacuucauugaaucuaaaaacuuuauaaaucuuauauuacagggaggagucaaaauaaaaacuaauguuacuuugcaaaagaugacaaagcuuuugaaagucaaaauucccaagccggugaccauuggagaagccgggccagcauuuuguugacuauuaugcuaugagucucuaaccugcuacccucugaacugagaccucaagugccggcccugaaaaggaagaaaaaggaugacuuggaagcagggcugcggagaagcaccucagcaggcagaggccagguuuugaucgcaugcugguaacuauuuauaaaugagagaggaauucuauuuuuugccugaaauaggcaagaaaaugggagcugcaggaugguucaggaguuacgaacauuugcuuauguggaggacccagguuugauuccaaaccacaugguggcucacaguguucuguagcuccaguaucaaaggucagcugcuauccucuggccuuugagggcaccaugcaggcaaaaguguagugagcaugcagauacauguaccuaaacacucauguauagaaaugucaccaguuggaacaguagaaauaagcuuuccugucaacaaaagaaguuauguaaaauuuuucagaaagcccaagucauuauguauagccagagguauccagauggaccaccaucaaaggcccauuucuggauccauucuugagaauauggcgacaccacuuggagaaaugagguaccacugaaauggccacucucuugaacuuagugaaaaccuucaccuggcuuccauaacacuagagaagccuuuuuuuuaagggucccuaugaacaauguucuucucugauuugagugccagaaagucucuucucauuguauaaauaucgcuacuuacacacacccauugcuauugauacagccauagccaucccucccagaccacagggagcacaucucccauaaaucauuguuucccccauccauacagcagucauuuucucuccauuaagaaagcuaauacuguuuagaggccacguucaaaauaggaaaaggcauuuguggagcuuguucuuagcagagagagcuucagagacccccaaacauuuccuucuuucuccuacagcucuguguccuggggccuuugcaaaccaacccagcacuacagaaaaacaaguccaguaauggaaugcuuuaaaagcuggauacaaugucucauaccugcgcuugggaagcugaagcaggaggacugcugaaagucugagaccagccugggcuacaagugagacugucucaaaaaacaacccccccccccaaaaugcaaaaccaaaacgagaaagaaaaagaauaacacgauguccuggugucaguggcucuuggaucacucuaguuuucucuacucugacuguaucaacaaacuaauuccuuagaaucaccauguggcgaugugacuugcagaugccccagaaauggcuacugucugggauccgggucgagguuuugcaugauuucuuucauggcugcacaugcuucucuucguaaggcuuuggcuuggccuacuuacuagaagugcucaauagcacaccgaugcuuucucuguacugucuauucucacucggucuaguuccacauuugaugucgcuaucuucuccagacacuaaugccagaguguugacauuagaguucaucuguagaagauccuuucccuagcccgaguguugccaaggcuuuuuuaggaaaagccuuccaaauguuagaggcccagagauuuagcacgagagucuugucaaauaaucucaauaaagagaaucguugucccaaguaguaacgaugauauuccuuccauugccuaucccaacuaucuuaggaaagggaucauagucauuauuuucuuuguguuacuaugagccuaguucuguuuccuagcacaguacagcuuuguauugugcuuaaaugucuuuggguaaaugccuguccacaugaucacucaucauuguaggccuugcaucugugcuggccaugacauccauagucagagcugggugaggcucuucuucaaggagggacauuacaaggauacuacccucugcuuucuccucccuuguggaacuucaugaaaagcuuggcucuucuuucuauuuggcugaauaaagagcaggaugguuucucugaguccugauaggaugagaacuauauccuugcauaguccacagagcuucagguccuuugugugcccuuagagauaugucugcuucuuucccgccacaggucagaagcccagaagcaccggaaggugaagguccuuuuuacagcacauaauucucuuuuucuagugugacuacuuuuguucucugucucucucuccucucuuuuauguuuuagcccgggcugucauagaacuuaucauccuguggccacugccuccugugugaccaaguugcauguguacaccagcaugccugguguuuggguuugugcaugcucaacaaacacuuuaccaauugagcuauaucccaaccuccauuuugcuuucuuuaugaggguccaguuuuucaaauuggcccaguuacaugcuugugugaagagucacagaaugcauuggucaaugccacucugcaauuuucuuucuuaaaaccauauaauagaguugaccauuggcuugcuuuggugagaaaccuaugcagagaagccagguaguccagaaaggagacugagucuguugaagucaaugggaugcucuuuuguuuuuagucugagaagugcaaucuauuggagagaaaguuucaguugcccaacgaucagaaaucugagaaaaggugcuuucauaggugcuggcugguaacucagauggacugcgugugggaaagagaagcuggaggagcaaggcuugcccucuugccaaggggcagugcugaagguagcagccugacagugcccacaucaauuugugugauugauugugcucaguuuucuucucguuugagauaaucuugcacuauuacaaaaaacaaaccaaacaaaaacaaacaaacaaaaaaccgaaacaaaacacugaaacaaaauagcagauuaauagcuacauuuuguuguuccucugaacaaaucuugaaguaggaccauuugggugcaggucugaucaucugaauccgaacagcaccaacuguaaagggcaucuuuucucugcauuguaggaguagcuauaucaagguuuagugcauggaaugauucugggaggacaaauggcugguaaaucaccauugaaaugaccacuggcuuggacauagggaaaggugucuuugauguccuuuaccuguagagagaccuuuguccuuacugcuucauuagugacauuuuucuugcugguguaagugcugguucuacuucugauaaucuccguguuuugggagggcacugcauugcuucuacagcccucagugguaaaaagcccagagagaggaaagcuuugugucuacuguacagcugaugcugggcuccaagcagcgcugauggugcugcagcuuucucggagcugcugcucuagcuugguaccagcagcugaaugugaggcccugagaugguccucccuugacacuugucuuaauguuagagaggcauucacuggcuuggacucagguggcugucucauuugauugucugcaucuuuagaauaauuggagucaguauugcuc

SEQ ID NO: 3417 - RNA, 668 nt, Mus musculus
acuuucuuucucuuuuucuuuuuuucuuuuuucuuuuuuccaaugcuuuuuuuuauuaacaguuaagauccaggguuaguuuuuguagccucugcuggcccuucggccucuggcgcgcucaaacuuccggcccuuggaacggacauaggguuugguauggcugugugggguuccuggggccuugccaaaaugucgguauaccucucggcccuuccgaggaccagacaggagcacagugccccggcccuugggagacuccagggccagcuggucaaaggugaggaucuuacccccagccuugaggaugcgacuccgggcccggcugcucacccgcagugcacacaccuucagcuugggaacuuccagaauccgcacaucaucugugaccguccccacaaccacagcagucuuguucucgcggccaggaagcuucaucuuucggaucaugcgggacagggacagagguggccgguugguucggcucaugaacaaccucuucaacacaaccugauugaagguggaguugguccgucuggccagaaaccuguacagcuugacaagcagccgcagguacauguccuggcucuugggcuccuugcgccgaaccuuucgguccuuguuguggcgaaugucaacacccaugauggcgccuccugcucggcccucuu

SEQ ID NO: 3418 - RNA, 12518 nt, Mus musculus
gacuucugaguguuggguuacaaguacgugcuacuaugcuuggcauaaaaauaacucuuuaaaagaaaauaaagaugugugugaauaccugagucuucauaugugcaccaaugugcagugccuguggggaacacaagagguuacaggauccucuugggacuaauuacauagacuugagcugccugggcuggggccugggaaccaauugaagggcuucuguaagagcaagugucgcuaacuaagaugcugucucuccaggcccagcacccagcuuuugacauggugcugggaaucugaaccaggcccacacuugugcaguaaguagucuagugacugagcuguuucucaagcuuugguuguuucauuuguaaaaugggccaugccuuucuuaggaugguuggaucaacacugacuguaucaugaguccuugguacaggucaaagcuuacacuguuaaucgcuuagcaauuuagcaagggcuugguauuaucacugagagcaaaagcaagaaucaaaguuagaaacuaccuaaaggaaccaaacauaaaacucaagcccaagccuggacuuaacacacccgauagggaaacuagcugauacagugcuagccauguugaagagcugagaucuuuuccauagaaacccauccucuacaaugucaagagcuauagaggaauagacugccccacucucauuuggggagaauggacacagugaccucugaccuguaggauaaucaggagugaauguaauuaacaagcccccccccccuuauaaaggucagaacuuagguugggugugaccaguuaucuucaccagagccuuaauuuaugcaaaagauaucugaccuaacaagagccagcagcacuggaggcuucucuuuuuuuuuuuuuuuugguuugagauaggguucucugugcaacagaucccuggcuggcccggacucauucuguagaccagagagcgaccugaccccaacuccagugugcugguauuaaagaugggugacacaagguccagccuagugcuggaguuuuucuuugacugaggaccuaggugugauuccaggcauccaacuugugacucacaacucuuuuuuuuuuuuuuuuuuuuuuucgagacaggguuucucugucuaucccuggcuguccuggaacucacucuguagaccagguuggccucgaacucagaaaucugccugccucugccucccaagugcugggauuaaaggcgugcaccuucccucuuguuugggggaaaccaccccaguauucugcugggcugcuggagucuacaauggagcucaggguguucgagcagagggacgguuuccugccuugccauagucugcacacgccacacuuagguuggaccaaaauaggaacuuauucauccugccccgcccacauucucugcaugccccaccugagaacucaacauaaaggguugccugacacccagguuuuguuguuuccacuuuauugcucaagcacaggacuugaggugugccuggaccuucagcgugcauuaaagaggcugaggggauagggacaggacagggacaaccuggaugaggaaacugagaggagcggagguacugguaggggcugucuagaggugaucacugugauaccagagggcguuaucaggaauaccaacucaggagagcaagguaagagaggcaauggaugcaacagcgguguacccaugccccuagcaccugcacggagacacaggcuuggaaaaccacagagggaagagaugggaaaauggcuguccaggaguuuucuucuccacccuggcuuaucagaccccaucccuaucacguccccccuucuaccacgugaaaauggagcuaacagagggagcaaaauaaauuaacauucugauguacgugugaaaggauauacacuuguguguaacgggggaagaaaaguaggguugacaccaucuaaaacuaccccccauuucacccucagccuucucuucucccuucucccccaaagccaucauccaaacagauagaaaaauaaaggucuaauucacucaaaauucuucaguuuuuacaaaacuaacaggguggaguaagaagggagcagggagcagcugcagaggugggcagcggaagaggcaggcuacgcuucugucuccacccgagacugguucucggccacauuguuccgcucacccuucaucucagcaucagugggauggucuccugcugccacuucugccuucaccuguaagaugagcaagaggcagaggcugaauuccuaagcaagacacuuuccaacacgagaaauugcauaggcacagcaauccugcaccuguuuacagcagcugcacacacaugcgcguucugaacugacgaguccauucagcacacuacugcuggaugucagagauuucggaaacuauuuucucuuugugcuucugggacugaccugagggucuugagugugcuuggcaagcacucuacuauugugcuauauccuagagcagucaacaauguucuuuaauggugaucccauguuucuucagugguacuaaguccuaaggauauaucagcacaggcccugcccagcaaggacauauaucacagaguuuugagguuuucuguucccauuucuuuauaugcuaacuaaaaucuuuuuuuuuuuuuuuuuuuuuuuuuuuugguuuuuugagacaggguuucucuguguagcccugguuauccuggaacucacucuguagaccaggcuggccucgaacucagaaaucugccugccucugccucccgugugcugggaguaaaggugugcgccaccaccgcccggccaaaaucuuuuucaaaacuauauagaacauauuaaaucacuauucaauuccaccuuuuacauguggcuacaaaguuaguaugcuuuguaaucuauuucucuugggcagcauuagggacacugaagcaauggguacuguggcuuuaggaacacugaagcaauggguacuguaagauaugcucuguaugugaggcgacaacgcacaacaggaagacuuugacagcucucugaaguaguuuguaaaauaaaccucuacgcauuaacacaccggcaaaauguacaacggggugagacagaacuggcaggaucgugugccucugcaugcuaaguauacaaccuuuugguucugaguaugggugagagacaggcagauaucugaguuccaggccagcccggucugcuuugugaauuuuaggcaaguugucuugaacacaacgcacaucagaacugugcccugaugugucggagcacuucucgugaugucagccccauuggugggguagauaccgagaacuuacacuccuuuacuggaagagacuaaccuguggcuuauucaacugccaugggcaagcacaggcaguggccacaccugaugugcucaagagguuaagaaaacccuucuucuguccacugcagccacucccaccaugcaguaguuagaaugagaauggcccgaggcucguauauuuggaugcuugguuccugguugguggaacucuuuggggaaggacuagaggguauggccuuauggaggaggugugucugcuaaggggcuuuggggugccaaaagcccuguguugacucugccuugugcuuacagucccugccaugguggucucguacuccuacccucuagaguggugaucccuccaucaacucucugugagcucuugguuauagugucucuucccacagccauggagaaguagguagggcaccccgcccccgcccccaacccuuaccuugugcuccuccucagccagccucucaaacauguuggcauagagcuucuuuucccgggcgagcugccuacggguccgcugcuggcacacagccagcugggucuuggcggcuuuguugcugggauagagcugcaggaccuuuuggaagucagcucuugccaggucaaagucauucacggccaggugggccucuccccggcgaaacaggcccuucucguuguugcuguccagcuccaaggccuaagagcacagaaaggaagcagcggggacaucaggcucugcagcaucagcuggauucccaagggaccccucaggaggauaaggcucaauggaaauggcugaugccaagucagaaaaaaaguagacagagacauuaaaugggaggggucauggcccaggaagaaauucaugcaaucugagaagaaaaaaggaaauucaggucuucagaugcaggaagaacacgaucucacuuucccagauacaggaaaggacaaaacccaaaccccagcccuucugccucccccaggcaaggccugcucagugucuguaucuaccuuuucccaccaucaaagcauuugcuccuuccaaacucaaggccugcaacucaggguucucaccgauacauccuacuaacuccacccaacaacuccuguaagugcuguuacguccucugagggaucuuaccuuguugcagcuuucgauggcagcugagaaggccugcaguuucaggugacacauggccagauugaggugugaggccagucggagugcauggaccuuuugcauuuccucaccggagaagcuagacucguauucuagccaagacacgaucuucuuguacugcaguaacgccugcuuguacuugccuuccuagaaugggagggaagcugaggcaccagugcagguuccgcagcccaggcugucuuaccugguaggcacgagugacuccuggauagagccucccacuccuucccgucccagagcaaacggacuaagacacacuggguaacaaccucaggggauguccacacuggggcggagcgucaccuggucagcccucccuggggugucagcccucccuggggcgccuugucuguggcucaccuugaaguacgcggugccccucucuuucacuauguugcucugcuccagcuucuccgcggagcucaucucccaagacuccuuggccuguugcaccccaaaggagagacacaguggucaccuuccccagagucacccgcagaccaggcaccaggggaggccugccugaggcagacucaccuucucaaagcucuucagccgcacuucauaccucagcucagcgugcggugggaucuggaaccucuccuuccccacacugccaaaagcauagcugcgggggugaagagcgcacgccuagguuaccucacagcccuccaucugcucuggacugaaaggcuuccuguuuguuuccuggaauguaccuccccaucucgagaccugguucaaauacuucccgucgggcaaacguuucccuagccuuuucauuacacauuuaggugguccuucagcacucacuacuucuggccccuaacccuuaacuauacacuguugagacgaacucaaagagacaaugaagcaagaaccagggggaagcccuagagacuucggcuugcguggcacacaggaggugucucaacaaauguuuacgacugaauaaauuaauggcacaugaaaaucgugauguuggcggguaagggaucugaauaaggcgugaaugcaaggaaauggacaacugcgggccacccuucagauccaaucaagagcucaagaugcucucagcauccuuagggcagugcaggggcguggcucgccguucacuuucagcugugccugugucucaccuagguuugagguacacgauggaaugcucuccuuucuccaugcgcugaauggccuccuccagcccacagggcagaucuagacuuuccccuuccccgacuucaaagcagagcucccgcuggucaaagaggcgguccuugugguagccuuccagggccacugauaugaaagagaaggauugccgggccggcgugagagggcagagcaccgaggaagcugccacagcuccucacaucuccaccccauggcuuagacccaagauaaccacuguggcucagacuaaggaugcuaaggcuguguggucuaacuccucauuuucaggaugggacaaaaggcuuauagaaaggaagugacuugguccacacuacccaaggccguuaaaagucucugagccaggaaucaaaggcaacucuagauuuuucuucccacaccagacuauacuuucucaccuuccaccauagcaccaucauugggccuggcauagccuucaccccgaguccguauucugcggaugaucccgccaucuucuucuucuguaagaucuucuccuuugaacucaaacagcuccaccugcgcgaugagacauaagguaaccaacucccuucugcaucaacuuuuuuuguuuguuuguuuugagacaggguuucucuguguagcccuggcuguccuggaacucacacuguagaccaggcuggccucgaacucagaaaucugccugccucugccucccgagugcugggaguaaaggcgugcgccaccaccgcccgcuauaccaacuuaacaguugaaacugccucuuuuccacucagaaaagucaccaguaaaggccagaccuuaucuagcaagaaggauacauagauuuuacuuggcuucagaaagacgagcuuccuaucauccuguuccauuuaacaaggacacaagauuguuucauuaggcaggcaucagaagugaccuaccaucucaauggccuugugaauagucucccuaugcccacugauuggcuuucugcuuucagacgcaacagccuuaguucuuucccucaguggguucugccucaaccacugacauauaggaagguaucucucccuccugagcuccaggaugccaauauguuacauugcaccuuacaacccagacgauuccugaccccagacccccuucagcggauaaaguacuagucaccccuauuugagaggggcagcuggaaucccucuucuaacccgaagccucuauuccuggucacucugguggcagcagagccaguuaaccuuuccaccuuaccuccuacuaaagcuaggcccucaggcuuggcuacauugucuucaagagacaggaagggcuggagggcagccaagcgcuggggugagauaaggacuggcucucugcccagagaucuguggccagcacucaccucaaauacaaguguggcguugggggggaucuucggagggcugccugcugcgccauaggcauauucuggcuugcaggugauguggcacacuucccccacuuucaugguugccacagcaauaucccaagccuugaugaccuccccuguagauagaggaaaagaagacccacuuagcaggggcgucacucuaggcucaguguccccaaagauagacacugcacuacacccaagcagaaucugaacaccucuagaaagaggaccaggggacaagcagggcgguguuguucuuaggacauuaaaagaucucucaacccugcaacacaguucaagaagcaagggaagcgcuggaucgaugaggcgguuaaggaggaacuggucugucccacaagaggagaaggaaacacaggauggguaacauauggguucuuggccauuccuucuuguuuuguuuuguuuuuuguuuuuuuuuuuuucgaggaaggguuucucucuauagcccuggcuguccuggaacucacucuguagaccaggcugaccucggaacucagaaauccgccugccucugccucccgagugcugggauuaaaggcgugcgccaccacgcccggcuguggccauuccuucuuaagcuuccuucugguggccuuuucuuuugugagggcuaguuugugcuuuuuugccaaggcuggcuugaacuacuacuggcucaaggcuugccucaaucucuggucgcuggaaacauagguaagcagugcugagcccagcuccagcuuggcugggaacgucacuuuuucuugugacagcugcuaucaacuucggagccuaucuauccugccaacccacuaaccaagccuaccuuuucccaggucaaaggagaauuuguccuugcgguccagacuggagucaaacuuugugccaucuagcagccagccaguguaguggacaaagacucgguccccgaucaugggugucucugugccuguacccucucucuugaugaccugggggggaggggaagagaaggugaguaccuaaggaugugggcagaagggccccaacugcccauaagccccccaaagacacauacuggauggacucggcugcacccacugcccccugcuucuuuucagcagguccgagagcuuagucuucaaaugauggauaccagugauuagcuuagauucaacuaaccucccuagccaucucccuccaggucuugcuuuagagaacugcauauaauuuggguucaaguuuugucuaugguuuuggacaaguugcuaaacuauccagaacuuaucggucaggcauugaggacaaccccuauccuccagagguguuugggggaaaacaaaaauaaaaacaaaaaccugauagaaaguaguggaucaccagaucagggucugguuugaauagaaaggaacaggaguaaugaaaagaaaaagauccccucaaaacugggaaaaaggaaggaccagauuacagccgagcacaaaggcucuguaucaggcgcuggaaacuacaugugggaagggaaacuaccugucuggcaagccaaggaguccuuuaucucuccugcguguauaggcaggcgucuauuucugcuuaacauucuuauauauggugaccccauaggagagccaauagguagauauggaacccauccucuaaggcuuccuugauaagaauguacagggccccgcgaaggaauggaggauaaaagaggaacagaccccgucugggaaucagaaccuagcgcaaaggagaaagggccacauguucacggggagcagcaagaguugagguaaaaagccaggagcauuucuggaccaacgaggcucccuaaggucucugguuugcacaagccacacacacuagaaacugagcaaugggacucacggaggagaaacaauggaugcagggagacaugcaaugcagguuaggauuucaccguccuggacugcuggcagaaccugcucugaaacggcguccauugucccgacccgggucagggcgcccucccccucgcuccucgggcuauuugcagucaggcgauuagugagccgcuggcucuaaggcaaugcaccuccccccauggccagcacccaguaccccccaacucagaaagacucaggaggggcaggcgaggaacuacaggucccggcaugcaucgcucucgcucuccccgggccgagaaagggggcacagcauggccgagcccgugaccucgcuggaucucggcgauugcaaaaggggcgcagaaaggcacaaagggcuuugggccaggaaccugcucccgggagccguuucagguccuagcuaauguuuaacuuucaagugggcgagcccuggcgcaccuucguccagguggacggcgcacgcugcggccgagggguucccgggaggcgaggccugagucccucggcgcgcccgagccucgugcaccccgcccgggcccccuggcagcggcucucgcgcuccgcuccgccccucucagccgcacagugcagccggaucgaguuggcguugcagugggggcuucuucccggacccgggccgcacccuccggagcgugcagccgccgugccguuuucagggcugcagccugcgcagggaagacgaaucccccccauccuccggccgcgguacccccaaggcccaugagccugcagccgaggacuccgcggccccucaccuugagcacgcccucguccuguuuggggcugauguccacuccuucgagaggcaggggcgccgacugcgccccguucuccgccgccuucaucuccucggcggucauggccgcugggcgcaccguuggcugcgagaguguggcaagcgcgagcacggcacucuggccgccgaccggagugagcgacggggcggcgugcggcggaaggcggcgcugcccaccucgaaccgcgcuccaggcucgcgcacccggcuauccgcgcgcucgccggcggcggccgaguggggugacgccgaggggcgggccuggcgcggcccggccugcaauugguccccuccgccucgggggcggggcagggaggagcggcacgagcgggcugcaaaggggcgggagcggagaacuuucuagagaagcgguuaaacggguugaggcucuuggacugaggguacuggagugguuugguuuuuuuguuuguuugugucguuuuuguuaagauuugcuuuucugguugauggccccuaggagugcccuccuccuacaccaggaccucugggaucacaaucuucccuaugucguuccgccccacccccacccuuaccccaccccucugcccgcgucuaagcgauuuuuccagauccuucucuauccucaggacuccaaguggcgagccucccaaguccgggccugccucguggccggcccugcucacccaggcccacagcggaauagcuggagacaggcagucagaugugaaguggcaaagaucggccucccgugauugugccacagaugcccaugguuccaggcgugggcaccugagcagugugggaaagagaggucgagggauugaaagugugggccccguagggacaguuucagcccaggugcacagaucggacacaacuuugcccucccugcagccuggcaggcccaccgcaaaaaugccaugagcagauuuauaagagccauagacuuguaaguggagguacguguguuaaaauuccuuuucucccaccauacuaaucagccuuuuuugguuaguacuggcacacaaaaugguuucagcucacgcgaaaaaaaaauuuuuucccccuucccccucuuuacuaaaggugaauaggaaggaagguuuucucaaccugcucgcugcuccuaugagaugccuguggaguucugagucuguguggcuaaaaccaugaaguucugauuaccggaacagugcuggcuugauggaagaucugucuggagagguccugacucugcccagcaguuuaguacccaguuauacagccuggugagugcuaucagaccugccuauuguauuauuggcuuugcgaguuuucauuccaguguaaugaacuuuuugucucugugugcccagcauggugcuguucgugguccaacgcaagugauggcguuuaaguaggcaauaagcuaguuauuauauggugccugcgagauggcucaguggauguuggugcuuuugaaagucuuuagaccuggguuuuaucccuaacacccacaguauugagaaaaccccuucaaaguugucuuuugacauccacacuugugcccuauuaucccucccaaagaagugaaauaauaauaacccuuauuaugaugguuuaaguauauuagguauuuuauuguagucccuucugauggaaccaaacaaauggguuguagaaguaagcuacucuuuccagcaauuuauagucucaugaguuuaaccauggucugauuuguuagguggcuagagacacugccagagaauaugugggguguguguguggcuacucugguagugaaggcucuugguagugaauggagccuuuguauaccacugccuugcacaugguacuuaucuuucuggugcucacauagguaccugcugauuauggucuuuggguguuaucuggcacagcaaguugugauggagaaaguauuagcagugaguuugugucucuucccugagaacagcauuguuggaggccuaacuccuuugaucucaugagcaccucccaguggagcacucagcaccagcacucagugccugcagacugcgggcacaaaguuaccuaagguuaugauagacagcucuuauugguuagcaauaagcaaaggguuggcucaccuugcaguauagcugucaaaacuggggcagguuuugucugugaguccugucaauagggugacccagugguuacaaaggagggaauguuccggugugucuagugcagcacuuggcuuccagugguaaguggauaggugauggccacugcuauaaugugauguguguggggauggcggugagcaugaaacacugcaguaagggcauggagcacuguaguaagggcauggagcacugcaguaggagcauggagcacuacaguaggaacauggagcacugcaguaagggcauggagcacugcagaaggagcauggagcacugcaguaggagcauggagcacuguaguaagggcauggagcacugcaguaggaacauggagcacugcaguaagggcauggagcacugcaguaagggcauggagcacugcaguaggagcauggaguacugcagaaggaacauggagcacugcaguaagggcauggagcacuacaguaggaacauggagcacugcaguaagggcauggaguacugcagaaggaacauggagcacugcaguaagggcauggagcacugcaguaagggcauggagcacugcaguaggagcauggaguacugcagaaggaaca

SEQ ID NO: 3419 - RNA, 1300 nt, Mus musculus
cuuuuuuuuuugcauuaaaaaaaauuccuuuauuuacagucuaaaauuuaaacaggaugauugguucucauuugugauacuuccagguccuggaucgcauacuguggagacagggaagcaaacacagaggccaguccagcuugucagacucgagagagaaugucacaccaaaacagcagaggaccugguuccgucuugucuagauuacauuuccccacacugugagaucaccacuggcaguuugggcuuauuguuggggccugugggaacauucucgaucuuccucaucacuagaaguccgucaaugauuuuuccaaacacuacaugcuuuccauccagccaaucacacuuagaacacgugauaaagaacuggcagccauuuguacugggaccacuauuugccauggaaagcaggccuggagcagagugucuaaguuuaaaauuuucauccgcaaauggaccccgguaaauacuggcgacuccagugccaucgccauuaacaaaaucuccacccugaaucaugaaauccuuuaugacucuguggaaggugcuuccuuuguauccuauuggaacgccaucuuuucugaacucuccggugcagaauugccuaaaguucucugccgucuuaggcaccacgacugcaaagagcucgaucuucaugcgaccaacuuccuggccgccaaugcugacaucgaagaagaccacuggauggacuggacuugaauuugccacugccauggcuuugacccggaaaucggaagacauacuuuuaaucugggccacaccuucuguaggaagccuauauaaggacaaugggaggaggaaguuuuagucuuuggccugcuugcccuaaccuugcuagcacaucccuuucugcgcuggcauuggaaccuacuucuuugggauuucagcagauacaggagaugagcggaaacacccaggcucaugggacugagcaacuauuggauucuuggacuucccauucacagcuaaccauuguuggauuaguuggacuugaguacagcaucccagaagcaacaacaauaugucacucauuugacacgcaaguaucugagugaugaccacugcuguacugucuuccauggggagucuacuuccauucaccgggacuaggugagggagggaggagaaggaggagucaagcagaguccaacccaguucuuaaaggacuugaccuaggaggagucacuaugggaucuagccucccuucuaaccuuauaacugggaguuggauuuugagauauuaggaaaaaguaaauaaaauccaugaagcagcccu

SEQ ID NO: 3420 - RNA, 1300 nt, Mus musculus
agggcugcuucauggauuuuauuuacuuuuuccuaauaucucaaaauccaacucccaguuauaagguuagaagggaggcuagaucccauagugacuccuccuaggucaaguccuuuaagaacuggguuggacucugcuugacuccuccuucuccucccucccucaccuagucccggugaauggaaguagacuccccauggaagacaguacagcaguggucaucacucagauacuugcgugucaaaugagugacauauuguuguugcuucugggaugcuguacucaaguccaacuaauccaacaaugguuagcugugaaugggaaguccaagaauccaauaguugcucagucccaugagccuggguguuuccgcucaucuccuguaucugcugaaaucccaaagaaguagguuccaaugccagcgcagaaagggaugugcuagcaagguuagggcaagcaggccaaagacuaaaacuuccuccucccauuguccuuauauaggcuuccuacagaagguguggcccagauuaaaaguaugucuuccgauuuccgggucaaagccauggcaguggcaaauucaaguccaguccauccaguggucuucuucgaugucagcauuggcggccaggaaguuggucgcaugaagaucgagcucuuugcagucguggugccuaagacggcagagaacuuuaggcaauucugcaccggagaguucagaaaagauggcguuccaauaggauacaaaggaagcaccuuccacagagucauaaaggauuucaugauucaggguggagauuuuguuaauggcgauggcacuggagucgccaguauuuaccgggguccauuugcggaugaaaauuuuaaacuuagacacucugcuccaggccugcuuuccauggcaaauaguggucccaguacaaauggcugccaguucuuuaucacguguucuaagugugauuggcuggauggaaagcauguaguguuuggaaaaaucauugacggacuucuagugaugaggaagaucgagaauguucccacaggccccaacaauaagcccaaacugccaguggugaucucacaguguggggaaauguaaucuagacaagacggaaccagguccucugcuguuuuggugugacauucucucucgagucugacaagcuggacuggccucuguguuugcuucccugucuccacaguaugcgauccaggaccuggaaguaucacaaaugagaaccaaucauccuguuuaaauuuuagacuguaaauaaaggaauuuuuuuuaaugcaaaaaaaaaag

SEQ ID NO: 3421 - RNA, 560 nt, Mus musculus
gccaucuuccaguaacucgccaaaaugaugaacacaaagggaaagaggagaggcacccaguacauguucucuaggccuuuuaggaaacauggcguuguuccuuuggccacauacaugugaaucuacaagaaaggugauauuguagacaucaagggaaugggcacuguucaaaaaggaaugccccauaagugcuaccauggcaaaaccggaagagucuacaaugucacccagcaugccgugggcaucauuguaaacaagcagguuaagggcaaaauucuggccaagaggaucaaugugcggauugagcacaucaagcacucaaagggcagagacagcuuccugaagcgggugaaggagaacgaccagaagaaaaaggaagccaaagagaagggcaccugggugcaccugaagcgccagccugcgccacccaaagaagcauacuuugugaggacuaacggaaaagagccugagcuguuggagcccauuccauaugaauucauggccuaauguacacaaagaaauaaaauaccaggacugcaaaguguuuuccuuaaaaaaaa

SEQ ID NO: 3422 - RNA, 2288 nt, Mus musculus
uuuuuuuuuuuuuuuuuuugguuuucuacuuuuauuuggggauacaaaaggcaccucucccuguaccugaggaccaaucaacaggugagccccagguggguggagcccugcuggagguacagagcaaggauaggggaaaggcaguggaggaacuggggagcucuggguacccagaauccucgaggucucaucuugacaccugggcagugagauguuuccucgaugggugcaguuucguaccaggacagugggcagcucagcaggggccaccauagcccaucccaaaagccacugaagcuuuuuucgggccccacucugcagggggaugggauaggcaaggcugugguaaugucuccucuauugccuagacuguuaguguagagucuggagggcucccgugggauucucuggggaagggaccaggggaauaucacagaagcagccuuacaccaggucaauuagguccuaucaggucagcuugucuggggccccaggucucaguaaaaucauagucguuagcaggaugggaagaaggcaggaccagccaggauuccaguggagggcugacuuauuccuucaguugacccccuugcugcccaggcucugggagaagagaagcgggguaacaaaacacccccaagcagcuuuaauaccaagggagggaggggccccaguggguaugagagugucaggcccugggcugcaggaugccagacccugcauucauaaggcaaacagcaugucaucguccuucuccugggucuuccuccgaggggcuguuccaggagauggucuggggggucccucggcugaagggcuggccagguugggaagucgaucagcagcuuuggcucguucuuccagaaauuugucaaauucuucacuggugacaccagagggcuccucagcacuguuccccacaucuguggacagccacugcucaauguccuccaugaugcgggccugaguggcugggaucgcuccggugcucugcugccgggcaucuagggccccagccaggccaucugugguuuggggagcuucauauuugaccccuuuccguuggucagccagugagcugccccgagucagagcaaacaugucaaagucaucuuccaggugaccugaggucuccagagacugcaggccagcucucacacuucuggagccaagguucauuccugccaguugagaugagagguuguuuguggcugcggggucaggacccaugucaaucaggucaguagcuagcucagcuucacuggaggccuuagcagucuggccuguucggaagcguucaaaccguucauggcgcagaaacacguuguugagguugucguugaucaugagcagcuccuccgucagcugcucauuggagaugcgugggauaagcuccaggauccgcugcugcauggcacggcaggugcgguucaguuccuguaguagcuccaggucugcaggcucuaccugggugggcaccagcucugucagcaucucugacaucacucgcacguuuccgcucaccaucuccagcucacugcgcagcuucccaaucugcucaggagucggugugaugggugagucacccgggagaacagcuggagugggcagagggguggcaugcuggcucaggucuccacgcugacugguguuggaacucacagaguucugucuggauggugucucugaguugaauacaguucucugggguguguggaugggcgacagcauguccaggucagucaugggaaauucuaggcccuuccuucgcagguccucguagacagcaacaacaccugucaaaucaggugagcugcggaacgcgucagcccaggacuggaugagguucaacaccuugucaugcacaaugguggguggauuguucuucggcaggaugguccucaccagcacauucucuacaaaguccugguuggccaccaguacauggaagcggugcccacaguucuuaacacauguuuccaagaccguaagggccagcaugaccucauggaaauucuuauuccccauaauucgcuucuucacugcucggaaggcaucuuuggggccuuccuccgucucguugaugaugucacagauuuccauguugagggcccaguccucgcucugcagggagccaucuguagcuuucucgauccguugucccaccggagagcugaacggauuucccaggagaaaguccauugccgcggcuaccgcugccaccagcucccagaaucaggugacagcaaccgccggcgccgccgacccgccacgucagguggaguccu

SEQ ID NO: 3423 - RNA, 902 nt, Mus musculus
ccauuuuugaacagcacuagcauuuuaaugcuuucacaaagcauugccgaaauucagaacgauacaugguuaauuuuucagaauguaugcuuaauacauccccuccuaccccccuuuagguaacaaaucagcgauggcaaguguuaacugagaaccuugggcuggcuaugaaacaauacaagaacuggauuuuuguccacacucucuacccuuggguggaaggaaacuugcuaacauucuuuaacauuuugcuacagccauguacagauggguggcuauccaggggaacgcacccugggcaaggacuguuaaagcugagggugaggcgguccucccgagcuggugggcaccuugaagggguugucuacgacugaaggugaacguucuggugaucgggggaccagugggcaagaaucagagauguccacgcacuauuuuauuuucaugucgaguuuucuucacacgcugguccgaucuuuccuggagucccgcacguggacaaaaaccaggggcaagcuuccaagugcucccagcaggaugcgggaggauugaguuuugagacgugucagucaucccugaggaggguggccuccgugugcagccuccuugcagucacggaucuuccgcugugaauguggagggcgaaaagguagaggaauagcgaguacagacucauccacgcgcgggcugcggggcagggcgcugggcagcggagacuuacggcugagcgcgcagucgccuugcggugccgggacuguguuacccggcguggcccgcgggggacguggggcgggaaagaccuuccgggauuguugcgggugugguucggugagggcggcgggcgugaggcccgaagagugcgagagcucagcggagaguuuguguaaagccgguggagagcg

SEQ ID NO: 3424 - RNA, 811 nt, Mus musculus
ggcccuuaaaaauugcugcgagauugaaaccugugugaaccuggucgauauucuugaucucuggcuuccuuucucuguaggcuucaccaauaguccagcaccaagaccacuuagaaaaauggaagguaauggauccaucgacauguucucagaaguccuagagaagcaguuccuccaggcugcuaagcuaguggaaaaucacuuggacucugaaauucagaaacuggaucagauuggugaagaugaacuggagcugcucaaagaaaacuggugacgcucaggcaggcucagcagcagaaacaagaguggcauuccaaagggcacugggguguacagagaaaucggcagcgagagagacuucuuuuaagaagucaaggagagugagaaagugguuugccauuucuacagagacaccgcauucagguguaaaauacuagacagacauuugccaauuccggccaaaaaccaucuugaaaccaaguuuuugaagcugaauguggaaaagacaccauuccccugugagagacugcagaucaaggucacccccacacuagcucucuugagagauggcaagacacaagauuauguuguuggauucaccgcccuaagaaauacagauagauggcuucacuacagaaacuuuagaauggagacuugguuguucugauguuaucaauuacaguggaaauuuaauggagccaccauuucagacccccccccccaaaaaaaaaaauuugggacaacuucacaaagcuggaaaagaaaacuauccgaggaaagaaauaugauuccgauucugaugaugauuaga

SEQ ID NO: 3425 - RNA, 1474 nt, Mus musculus
ugcaugcuagguaaguguucuagugcugggcuuuacccuggcccucuuuuuauguuaggacagggucucacuggucuagaauuaauucuguaguccaggcaggccuuacaucuauaaccuguuucagucucccaaguaucugggauuacaggucugagucaccugccugaccuagagguggguuuaacaugaaagcucuccucuuccaugagacauuuaaccacacagugaccaaaauagcugagaugaaauuucaauggguauuaagccuccggacaagccccucuccccagugauucuagcuucugcaggugagaagcuggcaggacuguggguuggucuacugcaugugucucccugggauugcuaauuuucuggaggauucugggccagaugcuguucccauucaacuucaaccaacuuguacagcuccacuguggccugggcuucuucuaccgaggaauguccaccauuuccaaccuggaugucccaacucagcagcuucuuggugagaugcuccaugacaaagugacauuuucugggcagucagccuuccuguugaggagugguaucuggaaagugucucgggugagggacuugggaugaaaguacuauagggcuuuguagucauugugagcggcaugaccuaccacuaccugcccugagaguaucuucaagaucucacuccgagcagucuuaaaggguguagcguuaaccaugcggcacuuaaggaugccacuccaucuggucuggucguccacgauguagcaaaggggugugagggugggggaagacguacucaucauacagcacaucgccauuguaauucacaaugcugcauccagccagggaacuaaggcgccccuugggucuuuugcccaccauuucacagucuauugccaccaucuucccuggcaaguuuugggguacuguagggcacuuaucuucagaacgaguuuggguggaguucuguacagcauuuuucuucaagggcuucuucuuggagccuuuauccuuuggcugagcuuggguggaguucucuguagcaauuuucuuuuucaagggcuucuucuuggagcucuuagucuuuggaagggcacucugaagcuccccuagcaaaucuauuuuagccauaacagaagcagucuucuuugaaggagcaggggucagccaagacaauggugcuuucuugucuuuggacugcucugagucccucuuggaggcaacugugucuuucuucuucuuugggcauggaaggaucuucaaaaugccaucuacucuugaaguuuccccuuucuuuggagguucugaauucaacuuagacaccuugcuaggggauugguucuuuuuauucagaaauacuuucuuuuccaagaaacguugcuucuugacaaaacguugauguuuggcauuuccuccaaaugucuuuuucgaagguugcccaaagucuaaauucaggaguaugguagacaug

SEQ ID NO: 3426 - RNA, 1870 nt, Mus musculus
gguauuaaacuauuuuuaauuugaaaauaaaaacaacaauaaauaaauacaacaauauuauauaccaauucauuugucuucauauguaagaaagauuaccaggagaaaaccaagaagugggcuauguauuucauguucuuguuuugccaguuaaauucaguucacuuuauuuugcccauauuuuauaaccauaucacuaagucauguacauaaaaucaggcaacagggcugcuugccugguaccacuuaguagucauuuuauuuucacagcacaaagcauccuugaacuuuaucuccgauguucccaagauauaggucuggaguuacugccaguagaaucagaagggugaccccgcauccaaagagucuuaagauggaaacccgguaugucagaggggccugggcugacucucucuauacuauugagggucuuccaccagcaugccagucagagcuuuuggugcccaauaaggccuuuucaucaggacaacuacccuacaggugauacccaccccagagcaaaguauuguuggggaaacauagacaccuaaaugauuugaccucuguauuuucaagaacucaacaaccaugcuucugggugaaccuuauaaaaugaauggauucaucucuccuugaacgugagugaagccugguguucaucgcuggcaucgcuucuucuaaccuugaugacuucauguucuucacccuuacacuucuucaaauccaugagucaugcucuguuuauguugucucagaaccaauucuagcacagauccaaacauaaggacaccagucagaaggaggaguuggggcagagaaggcaggccagucgugggugccaggcaaaggucaaaaugcaagcacaggacauuucagcccgggcuacaaaucucgugacgccuggcacuuuuccaacuccagacuccugauuccauugcucuggaaacagcuggauuuucuuccucuguguuuguuuugggcaucaaacaagaaacuugaaggggagggaagacgacauuuguuagagcauucuuugaauuaacaaauuaccuuuaauaucaauccucaaaaauaaaaacccgacuacaugauuuuugcguuucgauggagugguuuaggaaaagcuugggugaaaagaagauacacaaauaaacaaagcuucuguccacccggauccagcagguccuuagcgccgggggcggagcggggguggggcgucgugaugucacagcaccgcccugguguuuuuguguuuccagcucuugggaaaagccacccuauuucuuuaccuggugguccuuuaccuucaggccgcgagaucuccagguccuucucuggacguuuagccacguagugcggcgacuggcgcgugggagcugacgcggguggagcgauugugauaaggcugacauugacuggggguggccagacgcgagacgcagucaucagcgcgcgcagcaggccccguccggggagccccuacauccugagguccaucaugaaguuccaguauaaggaggaccaccccuucgaguaucggaaaaaggaaggugaaaagauuaggaagaaauacccggaccgggugccggugagugggggcggggagggagaaggcaagcuugaggaguuugggagcugguugcccuggagcuaccgagguagccuggcgauggcggguggcccuggcacaggagggucaucggaaucaaguauucuugaccggcuuugacaagcuuguauccccagggccuguagccacuuuuggcaucucgaaagcgcagcgugcgcguggugggugagucagcaggauucagcacccauggagguugggaugugcgcguggcgaggccugugugugcgggggcgacug

SEQ ID NO: 3427 - RNA, 9547 nt, Mus musculus
uggggcgucgugaugucacagcaccgcccugguguuuuuguguuuccagcucuugggaaaagccacccuauuucuuuaccuggugguccuuuaccuucaggccgcgagaucuccagguccuucucuggacguuuagccacguagugcggcgacuggcgcgugggagcugacgcggguggagcgauugugauaaggcugacauugacuggggguggccagacgcgagacgcagucaucagcgcgcgcagcaggccccguccggggagccccuacauccugagguccaucaugaaguuccaguauaaggaggaccaccccuucgaguaucggaaaaaggaaggugaaaagauuaggaagaaauacccggaccgggugccggugagugggggcggggagggagaaggcaagcuugaggaguuugggagcugguugcccuggagcuaccgagguagccuggcgauggcggguggcccuggcacaggagggucaucggaaucaaguauucuugaccggcuuugacaagcuuguauccccagggccuguagccacuuuuggcaucucgaaagcgcagcgugcgcguggugggugagucagcaggauucagcacccauggagguugggaugugcgcguggcgaggccugugugugcgggggcgacugguugggggccgcagauaggauaugcuauagaaaaacgcgucccaacccuguagcagcaggugagaugagccuugugcccauccaugucugcucaauugguucuccaugaaaacgagucuccuucccauuuccuugagcguaggaggaaaaacucgagaagccccuagauucugaccugcguuuuuuuuuuuuuuuuuuuuuuagaauugggggugggguggggugaggggcuucaccaggcgggcccucaaacaaggucaugccugccuccaccucauuauugucuccugggccauguguggaaaaagaagguccgugcucugcacugugauaggugggugggcucuuggaucucaagaaccaguacugagaaccguuuccuccauuaauuauaccccgauuuaagcagcuaauaccuaguucaugcaguggggagaaaaauacuaagggagucuucagcauccggguguuuuccacuuuacccccucccccgcccacuugccuuuuuuuuuuuccuccucuuuugaaggcugcgcagcagaauuggaagcaaaggaugacaucgcuuuuaaauaugguggauagaggaccagggacuuuaaaaaaucguucucuuuauuuguacaggcaaugauguuauauuagguuggcguuccucuaacuuugaaggguaaaagagcugugcuaaccugauaauuuuuuuuuuugaugcauaaguaauaggggggagggacuucuuccuuauucuuuaucucagccagggcuaccagaagaaacggagguccagcaagagaaagcccucagccccauuuucuacccucagccccauuuucuacccucagccccauuuucuaugaggaagaagagagcuaacuauuccaccauucuccagaaauuacauauacauggcucuuccagaacggcugggcacacuccagucaugccuuccuacuacacaguccuucacauguuauuuccuugagcucaggacuguggaggauugcuuucaaaauuucucucaguuugucagccccacuuaauauuuuaaaauuacacauggaccacacagcuggcagcacucugaaugccuugucuguguacucaccgacucucgucacagcauuaaaaucccugugcuagagacaugcucugaagcacagggcagugaagucaccacccacagguuugacauugcugacugguggaggagaauuccagcccuggcugucaugcuucagggcuuccagagcccuugggcuuccagaguuuuguuuuuguuuuuguuuuccaguuuguaguacaguuagaugaacgccuuguaagguugagcccuagaaguagguuaacaccugcugccaucuggaguucaggugguaguuggugccagccaggaaacuuaagugaacaccuacccccauuauucagaacuuuaacagaaauccgagcugugaccugcaacuguuuccaaauucagcuaaaaccuccguccuuccucaagacagagcccccucgcauucaguuguguacagcacucacccacaauauugcaguuucucuguauucuccuguuugugacuugaugcugaauguuuuacuucagugaugauuuguaagccaagacaccuucgcuuagaucucauggaucccuggauuucacacccagaugguaccucccaaucugagagguucucaaccucucaucugguugugacauagaacccugcugagauuugugugggggugggagugggggcaacacuaaaauuggaacccuuugccuggugucuucuccaugacuggauuauaacaggaguucuccugccuuggucacagggccgaaucuuccuauguucagguauuuacaggaaagccgcuaaguuucuaaggcagucugacucacaacuuaagcuuggccucuuaagaggugugcgugggccuugggagaagggaucaugggaucuugagauaaccguguguuggagaccuguaacagcaggaacuguaggacauacuauuuuuaaacauuuguaaacaucccuaugguguaugagccacugcgacagaugcagaaaacaaguccccucuccuuuugguuggaguuccaggacucaagaguuccuguggugaauaccagggcucccuguuuccugugcucuguuuguaaccugccucuuuccuuccucuuuuuuggucuauuucuuuucaaguucuuuucuauuucccuugaagcuuuggauucacgucugucuacccaagcauuuucuuguacuuguuuguaugguaucuggggguggacagguauguggcuugaugaagaagcucgaaaaggucggaaacacacugacagacacucagcuucuagggauacuuguccaguguuguuucugcuucuuugcuuuuguguauuucccauuucuuaucucuaagaugagauuuucaaaacaaagaaucuaauguuaauauucuugucagauauuuucuguucucugagccacucuguaaacaucaccgaagauuuugugucuuuuucuuuguuacaaaaugcagaaucuuuaaaaguguuaugaaaaaacuuaaugucgacauugaaagucccuuaaaauucuaacacgguuacuaaugcugaauaacuuagugugugacucucaaaaagugucccucauuauaaaaauucaaaauagcuuucacucagcaaugaacacuuuucugcaaagauugaaaucugaaccacauuacgugcguguguauguguauguguguguguguguguuagucaucacuguagcagugucugagaaggucaaauucuauagggaaagaaagcuacugacuucagaagucuuuguccaugcucuuagauggccccagucuuuggccugguggugcgucaaacuaucguguuagaagcauagaggcacagaugagggaggauuagucucuggcucaaacaccuaaaaccuccaugaugccccaccccuuaaaguuucuaccacuugcucauagcaccaaggcaggagcacuuuuuuuuuuuuuuuuuaacacaacggccuuugaaaggcagugaaguucuaaauuauaauguugugcuuguaacaaauggcauuucccccucuguguaaguguguacacaggcgagggagcaugugugugauugcguguauguauguggaggccagauguugguaucucacacaauucuugcuuacucuucacauuacucagugugaauccagagcuugccccuuuaguuacuccagccagccagcuugacccagggaucuccaguuucugccuucccagcauggggacugcacauccagugggcacucacauggaguuuggggaucagaacucagucuucacacuuugacagagagcgcuuuugugacugcuucuucuccugggucuguaaaugguauuuuagaggaaaaauaaauaggucaucagacacaucuuagaaacacagaacaucucuucaauucucuaauaaaauaccguagggugaaugacuuuuauagcccuuuauagguaauuuguaguuguuuaaacucaaggaguauuggaaauggggacugaaaaaugagacuggacagcaugggcaaauuucagguauguaaggaaaaagacaaugcuaggcugucugguuuucaucccagucuccuguucuucuaggucaucguggagaaggcuccuaaagccagggucccugaucuggauaagaggaaguaccuugugcccuccgaccucacugguaaccaucuuucucucuucugaccuuucauuccaggcaaagcauucuugaucuuuaagucuaaguuggugacuauauggguugucacugcauguagguggugaccuugcaugguuuccuucagugagcuggccaguacagauaggcauacucugcccuccuguuucuaguucuguuugauauuucccaaugccauacucauguacccuagucauggagacacaggaaagcaguacucugggaguaaagaacaaaaguuugucauuuauaccacuuuaaaaaucagccaugcuauccugagguggaucgauuuauaucagcuccagccgugucuuggguauugucaccaaggaggaucacauuucagagauuuauauccaaauacuuuaucuuuaaaugugcuucugucugggagaugaaaacugcaaaaccuagccuacuuucuguuuugaauuauauguauuuagaguuuaccuuguucuuaaagaaguaccaggugccuucaggaugcccuggaaagauucuuuuagaugcaguguucacgcauuugccugucagccucccagagcuucauuguuugcaggaagaaguugcgugggcucauugucccaacauuugcccccaugguacugggagggccagagugcaguggaucucuuccuauuguuagcucuuagagugcaaaugggaccccaaaggaaucaggaguccauuuagaugggaaugcuuggaucuacauuguacucccccacaauagucgugcuggauagauuugcuaauauugagucugaagauggaugaggaagaagggaggggacagucccaguguggugggucagacacuguacaugccuccuuuucuauuuucccacuaaggcucucggacagcuuuugggucugaaaagcuuguacuuacacaauagauuuuauuuuguuuucugagguuucuccuacuaauccuuuuucauuucucacccugcucucuguuuccuuccuguaguuggccaguucuacuucuuaauccggaagaggauccaccugagaccugaggacgccuuauucuucuuugucaacaacaccaucccucccaccagugcuaccaugggccagcuguaugagguaauggucuugaucacaauacccagcagccuggugucccuucgcucugguuccaggguuuguuaaacaccugggaaguagggcaggagguguuauuuauggggauccucuuacacacagcacugugacgcugggagauuagauacccuuuguccuuuagggacugagcaccuacucgauuuaaucuuuugaaaucucucucuagucuuuccugacuguaguacuuuauugccgguuccagugguucuugguagcaaagcaucaccaugcucacccuucuguuacugucucuggaagcacaguuuguuagugaacugugcacuccauuuccugccugucagccauccacaucuagcaauagauggagaaaagagacaccagcaacccuuggcuccuuuuccgucugaaccuggagcccugucuucccaguuagcucccacauaaacggccaagauucggcuuaggacaggcacaucuggaagcucucuuucuagagcaaaccggaggccacguaagaguuuccauuaucugaguacagggaaugaguuaaagugucaaguuaggaucugauuugggaaaaacuguagugaggacuucauauacaaauaaugugaccuaagauugugacuguacuacuccuuguacgaugucacacaugauacugccuucccauugugcuccaauagucagaugcacaucuaguaaccccuggucuagcccuuauuauuccauagcauauauucccgugaguauguaugccaguagaugcuuugugguuucugugcucuccuugcuagagugaggaguuuuuuuuuuuccuuuuuuuaaaugugugugugugugugugugugugugugugugcuugcaaguguacauggaugugcgcacacagguggacaucgaaggacaguuucaggguguuucaucaagaacacugugugccucucuugagacaagguuucauuauuggcuuagaacacacagauaggcuggccugacaggccggugagccccagggauccuccugaccuccccagagcuggaguuacaagcacacaacaucacacaugccauuuuuaucuggguucugggaauugaacucggggccucuguacggcaaggcaagccuuuacucacugacccaugucucccagcccccggccuaagaguaauuuuuuuuucaagguaagaauuauuuucgcaauguuuuguuugugaaagcucugaaaucaugccaaaaacuugcaagaauuuuacugaugguacuggguggcuuaccaggcagggcucgacagcucacacggugugcuguauuauguuuugacauuuaauucauuuauccauuccuguucaucuuuggagaucuuuuuuguuuuguuuuacuuugggucucugagauagagucuugacaagaagcucaggcuggcuugggauuugccagguagcccaggcugaccucaagcuuuaauguuccuaccucagccucucacaugcuaagauuacagguguacaucauugcacccagccuuuuuuuucccagugucuuuuauuagcauauauucauuauauaaaugggucuuauuuuuuuuuguucucauacuuguacauaacauauuucagucagauuuacccccacaucuuacccugucgcuuuccccucucagucuugcuuuguuaacccaguuauuuaaaggagagcacucagcuuguuuacggaagcauggauggacacuuuucuacaauagaagaugacuccuugucccccucaacuaucaaucaaguauagauucucagaaaggggugaggccugagaaacccgcucccugucaugaugggauguuguugauaggcccaauuuugcggagggccggugcauugcaaaucaaccaaagcugccuaugaguucaggauuacaacagccaucucaugcccagaagccagcauuccacaccucuccgcgcccuuccucagagucugacauucauucuucuuccuugaguguuggugggggcaauuuagaugacucauguguggccaggcacuaaguaauccugaccaauuagguucuguagccacugcagaccacuguggcuaaaguugacuggagaaugguuguuucuaggaguaaggcuuacucugguuauuuuucugcuguuggugagauacauucuuuauuccuuuuguuguucuuuguuuuccuuuuuccugaugcuaaaaauguaaacccagggcuucacacauuugaggcaagguucuaccacugggcugcaccccaaguccuguuccauauuuuaaaugagaauaaugcugacuuccacgccuccuuuauaagauuguucgaggcucagaaucagagauuauaaacaugaauguuuaguauuuucugaauugucgucuugucuccucuucuuaggacaaccacgaggaagacuauuuucuguauguggccuacagugaugaaagugucuauggaaaaugaggcagaagcccagcagaugggagcaccuggacuuggggguaggggaggggugcgcgugggacuuggggaaccagagggagggcucccaaccauggaggagacgcaaggugaagacaucgggaaacaucacaccgcacacgcugucgucuuuuuuucacaagcucaauuguuacuuuucucugcuuccucagcccaggaagaacuuguguugcauuggcugugagagcgggauggggacgacaugaaucacagcuuugcugugagcuuucucucgugcaguuucaucagagguuugggaggagggcaaguggccgcuagagaagaauacaauuuagcagcaacugccggcucuuugggcagagguuugauuuuuggcauuuguacaagccgcacgggcaaagggggaaaagaaugccguaggggaccacaccuaagggaccaaaagauacccacugucacugaagcauuguaccccuaaccucugucuccauaccuuccucuccuaguccuuuucuuccacccaggcuucauagcuccgccccaguuguggcaggagacauucgaacagacguuuagacguuuagaguccucuuggaaaauagggccgugcgggaacgguuaugauugccagcguuuuggauggcauuaaacuggaguucaggguugaacauguccugcuccucaucccauaaguaccuuggacuuucaggagccucaggaucaguccucuagcauuuccuucaccuuucucauguacaggggcagcgugucuguguguggaggguccggguuacaagguaagcuagguugcccacuugcccacucguccucucccugcugcagucucuugggucucacacgcacugcaaaugcuaagcgauggccagcugucucccuccguggcaucugcuauucaaagaagauggagugagaggggcgccagaguuucaugggggcuuuacucauucauuucauuuagggacucuguggggggaggggcaggcauugcauucucacaugacauuucaauucaucucuaccaaugaagagcguccucccuguugggagcaaucuguacgucuguuuugucagcuucagguucugguacuuugaagucaaugcugucaggccagggaaauaaaauaauugcuuaccuuaaaagucuaccuggacucagaauuguggccucuuucuuuuucuuuuccuuuuucuuuuucuuucucuuuuucuuuuucuuuuuuuuucuuuuccuuuuccuuuuucuuucuuucuuuuuuuuuuuuuuugguuugguuugguuuucauuuaggugaagguuauguggacaccugcauuuuuaaggaacuugaaauggguauggaauuggcaguuucgugcuuacaugggucggauguauacaugcuuauuucccuguugcccguggguggaugcuccaguguauuguuccugguguguuucagugugcacaguuuuuuuaccugguuuguaagugccagugacugcuucaucuguuucucaaagcuaaaguccaccugcca

SEQ ID NO: 3428 - RNA, 9547 nt, Mus musculus
uggcagguggacuuuagcuuugagaaacagaugaagcagucacuggcacuuacaaaccagguaaaaaaacugugcacacugaaacacaccaggaacaauacacuggagcauccacccacgggcaacagggaaauaagcauguauacauccgacccauguaagcacgaaacugccaauuccauacccauuucaaguuccuuaaaaaugcagguguccacauaaccuucaccuaaaugaaaaccaaaccaaaccaaaaaaaaaaaaaaagaaagaaagaaaaaggaaaaggaaaagaaaaaaaaagaaaaagaaaaagagaaagaaaaagaaaaaggaaaagaaaaagaaagaggccacaauucugaguccagguagacuuuuaagguaagcaauuauuuuauuucccuggccugacagcauugacuucaaaguaccagaaccugaagcugacaaaacagacguacagauugcucccaacagggaggacgcucuucauugguagagaugaauugaaaugucaugugagaaugcaaugccugccccuccccccacagagucccuaaaugaaaugaaugaguaaagcccccaugaaacucuggcgccccucucacuccaucuucuuugaauagcagaugccacggagggagacagcuggccaucgcuuagcauuugcagugcgugugagacccaagagacugcagcagggagaggacgagugggcaagugggcaaccuagcuuaccuuguaacccggacccuccacacacagacacgcugccccuguacaugagaaaggugaaggaaaugcuagaggacugauccugaggcuccugaaaguccaagguacuuaugggaugaggagcaggacauguucaacccugaacuccaguuuaaugccauccaaaacgcuggcaaucauaaccguucccgcacggcccuauuuuccaagaggacucuaaacgucuaaacgucuguucgaaugucuccugccacaacuggggcggagcuaugaagccuggguggaagaaaaggacuaggagaggaagguauggagacagagguuagggguacaaugcuucagugacaguggguaucuuuuggucccuuaggugugguccccuacggcauucuuuucccccuuugcccgugcggcuuguacaaaugccaaaaaucaaaccucugcccaaagagccggcaguugcugcuaaauuguauucuucucuagcggccacuugcccuccucccaaaccucugaugaaacugcacgagagaaagcucacagcaaagcugugauucaugucguccccaucccgcucucacagccaaugcaacacaaguucuuccugggcugaggaagcagagaaaaguaacaauugagcuugugaaaaaaagacgacagcgugugcggugugauguuucccgaugucuucaccuugcgucuccuccaugguugggagcccucccucugguuccccaagucccacgcgcaccccuccccuacccccaaguccaggugcucccaucugcugggcuucugccucauuuuccauagacacuuucaucacuguaggccacauacagaaaauagucuuccucgugguuguccuaagaagaggagacaagacgacaauucagaaaauacuaaacauucauguuuauaaucucugauucugagccucgaacaaucuuauaaaggaggcguggaagucagcauuauucucauuuaaaauauggaacaggacuuggggugcagcccagugguagaaccuugccucaaaugugugaagcccuggguuuacauuuuuagcaucaggaaaaaggaaaacaaagaacaacaaaaggaauaaagaauguaucucaccaacagcagaaaaauaaccagaguaagccuuacuccuagaaacaaccauucuccagucaacuuuagccacaguggucugcaguggcuacagaaccuaauuggucaggauuacuuagugccuggccacacaugagucaucuaaauugcccccaccaacacucaaggaagaagaaugaaugucagacucugaggaagggcgcggagagguguggaaugcuggcuucugggcaugagauggcuguuguaauccugaacucauaggcagcuuugguugauuugcaaugcaccggcccuccgcaaaauugggccuaucaacaacaucccaucaugacagggagcggguuucucaggccucaccccuuucugagaaucuauacuugauugauaguugagggggacaaggagucaucuucuauuguagaaaaguguccauccaugcuuccguaaacaagcugagugcucuccuuuaaauaacuggguuaacaaagcaagacugagaggggaaagcgacaggguaagauguggggguaaaucugacugaaauauguuauguacaaguaugagaacaaaaaaaaauaagacccauuuauauaaugaauauaugcuaauaaaagacacugggaaaaaaaaggcugggugcaaugauguacaccuguaaucuuagcaugugagaggcugagguaggaacauuaaagcuugaggucagccugggcuaccuggcaaaucccaagccagccugagcuucuugucaagacucuaucucagagacccaaaguaaaacaaaacaaaaaagaucuccaaagaugaacaggaauggauaaaugaauuaaaugucaaaacauaauacagcacaccgugugagcugucgagcccugccugguaagccacccaguaccaucaguaaaauucuugcaaguuuuuggcaugauuucagagcuuucacaaacaaaacauugcgaaaauaauucuuaccuugaaaaaaaaauuacucuuaggccgggggcugggagacaugggucagugaguaaaggcuugccuugccguacagaggccccgaguucaauucccagaacccagauaaaaauggcaugugugauguugugugcuuguaacuccagcucuggggaggucaggaggaucccuggggcucaccggccugucaggccagccuaucuguguguucuaagccaauaaugaaaccuugucucaagagaggcacacaguguucuugaugaaacacccugaaacuguccuucgauguccaccugugugcgcacauccauguacacuugcaagcacacacacacacacacacacacacacacacauuuaaaaaaaggaaaaaaaaaaacuccucacucuagcaaggagagcacagaaaccacaaagcaucuacuggcauacauacucacgggaauauaugcuauggaauaauaagggcuagaccagggguuacuagaugugcaucugacuauuggagcacaaugggaaggcaguaucaugugugacaucguacaaggaguaguacagucacaaucuuaggucacauuauuuguauaugaaguccucacuacaguuuuucccaaaucagauccuaacuugacacuuuaacucauucccuguacucagauaauggaaacucuuacguggccuccgguuugcucuagaaagagagcuuccagaugugccuguccuaagccgaaucuuggccguuuaugugggagcuaacugggaagacagggcuccagguucagacggaaaaggagccaaggguugcuggugucucuuuucuccaucuauugcuagauguggauggcugacaggcaggaaauggagugcacaguucacuaacaaacugugcuuccagagacaguaacagaagggugagcauggugaugcuuugcuaccaagaaccacuggaaccggcaauaaaguacuacagucaggaaagacuagagagagauuucaaaagauuaaaucgaguaggugcucagucccuaaaggacaaaggguaucuaaucucccagcgucacagugcuguguguaagaggauccccauaaauaacaccuccugcccuacuucccagguguuuaacaaacccuggaaccagagcgaagggacaccaggcugcuggguauugugaucaagaccauuaccucauacagcuggcccaugguagcacuggugggagggaugguguuguugacaaagaagaauaaggcguccucaggucucagguggauccucuuccggauuaagaaguagaacuggccaacuacaggaaggaaacagagagcagggugagaaaugaaaaaggauuaguaggagaaaccucagaaaacaaaauaaaaucuauuguguaaguacaagcuuuucagacccaaaagcuguccgagagccuuagugggaaaauagaaaaggaggcauguacagugucugacccaccacacugggacuguccccucccuucuuccucauccaucuucagacucaauauuagcaaaucuauccagcacgacuauugugggggaguacaauguagauccaagcauucccaucuaaauggacuccugauuccuuuggggucccauuugcacucuaagagcuaacaauaggaagagauccacugcacucuggcccucccaguaccaugggggcaaauguugggacaaugagcccacgcaacuucuuccugcaaacaaugaagcucugggaggcugacaggcaaaugcgugaacacugcaucuaaaagaaucuuuccagggcauccugaaggcaccugguacuucuuuaagaacaagguaaacucuaaauacauauaauucaaaacagaaaguaggcuagguuuugcaguuuucaucucccagacagaagcacauuuaaagauaaaguauuuggauauaaaucucugaaaugugauccuccuuggugacaauacccaagacacggcuggagcugauauaaaucgauccaccucaggauagcauggcugauuuuuaaagugguauaaaugacaaacuuuuguucuuuacucccagaguacugcuuuccugugucuccaugacuaggguacaugaguauggcauugggaaauaucaaacagaacuagaaacaggagggcagaguaugccuaucuguacuggccagcucacugaaggaaaccaugcaaggucaccaccuacaugcagugacaacccauauagucaccaacuuagacuuaaagaucaagaaugcuuugccuggaaugaaaggucagaagagagaaagaugguuaccagugaggucggagggcacaagguacuuccucuuauccagaucagggacccuggcuuuaggagccuucuccacgaugaccuagaagaacaggagacugggaugaaaaccagacagccuagcauugucuuuuuccuuacauaccugaaauuugcccaugcuguccagucucauuuuucaguccccauuuccaauacuccuugaguuuaaacaacuacaaauuaccuauaaagggcuauaaaagucauucacccuacgguauuuuauuagagaauugaagagauguucuguguuucuaagaugugucugaugaccuauuuauuuuuccucuaaaauaccauuuacagacccaggagaagaagcagucacaaaagcgcucucugucaaagugugaagacugaguucugauccccaaacuccaugugagugcccacuggaugugcaguccccaugcugggaaggcagaaacuggagaucccugggucaagcuggcuggcuggaguaacuaaaggggcaagcucuggauucacacugaguaaugugaagaguaagcaagaauugugugagauaccaacaucuggccuccacauacauacacgcaaucacacacaugcucccucgccuguguacacacuuacacagagggggaaaugccauuuguuacaagcacaacauuauaauuuagaacuucacugccuuucaaaggccguuguguuaaaaaaaaaaaaaaaaagugcuccugccuuggugcuaugagcaagugguagaaacuuuaagggguggggcaucauggagguuuuagguguuugagccagagacuaauccucccucaucugugccucuaugcuucuaacacgauaguuugacgcaccaccaggccaaagacuggggccaucuaagagcauggacaaagacuucugaagucaguagcuuucuuucccuauagaauuugaccuucucagacacugcuacagugaugacuaacacacacacacacacauacacauacacacgcacguaaugugguucagauuucaaucuuugcagaaaaguguucauugcugagugaaagcuauuuugaauuuuuauaaugagggacacuuuuugagagucacacacuaaguuauucagcauuaguaaccguguuagaauuuuaagggacuuucaaugucgacauuaaguuuuuucauaacacuuuuaaagauucugcauuuuguaacaaagaaaaagacacaaaaucuucggugauguuuacagaguggcucagagaacagaaaauaucugacaagaauauuaacauuagauucuuuguuuugaaaaucucaucuuagagauaagaaaugggaaauacacaaaagcaaagaagcagaaacaacacuggacaaguaucccuagaagcugagugucugucaguguguuuccgaccuuuucgagcuucuucaucaagccacauaccuguccacccccagauaccauacaaacaaguacaagaaaaugcuuggguagacagacgugaauccaaagcuucaagggaaauagaaaagaacuugaaaagaaauagaccaaaaaagaggaaggaaagaggcagguuacaaacagagcacaggaaacagggagcccugguauucaccacaggaacucuugaguccuggaacuccaaccaaaaggagaggggacuuguuuucugcaucugucgcaguggcucauacaccauagggauguuuacaaauguuuaaaaauaguauguccuacaguuccugcuguuacaggucuccaacacacgguuaucucaagaucccaugaucccuucucccaaggcccacgcacaccucuuaagaggccaagcuuaaguugugagucagacugccuuagaaacuuagcggcuuuccuguaaauaccugaacauaggaagauucggcccugugaccaaggcaggagaacuccuguuauaauccagucauggagaagacaccaggcaaaggguuccaauuuuaguguugcccccacucccacccccacacaaaucucagcaggguucuaugucacaaccagaugagagguugagaaccucucagauugggagguaccaucugggugugaaauccagggauccaugagaucuaagcgaaggugucuuggcuuacaaaucaucacugaaguaaaacauucagcaucaagucacaaacaggagaauacagagaaacugcaauauugugggugagugcuguacacaacugaaugcgagggggcucugucuugaggaaggacggagguuuuagcugaauuuggaaacaguugcaggucacagcucggauuucuguuaaaguucugaauaauggggguagguguucacuuaaguuuccuggcuggcaccaacuaccaccugaacuccagauggcagcagguguuaaccuacuucuagggcucaaccuuacaaggcguucaucuaacuguacuacaaacuggaaaacaaaaacaaaaacaaaacucuggaagcccaagggcucuggaagcccugaagcaugacagccagggcuggaauucuccuccaccagucagcaaugucaaaccuguggguggugacuucacugcccugugcuucagagcaugucucuagcacagggauuuuaaugcugugacgagagucggugaguacacagacaaggcauucagagugcugccagcugugugguccauguguaauuuuaaaauauuaaguggggcugacaaacugagagaaauuuugaaagcaauccuccacaguccugagcucaaggaaauaacaugugaaggacuguguaguaggaaggcaugacuggagugugcccagccguucuggaagagccauguauauguaauuucuggagaaugguggaauaguuagcucucuucuuccucauagaaaauggggcugaggguagaaaauggggcugaggguagaaaauggggcugagggcuuucucuugcuggaccuccguuucuucugguagcccuggcugagauaaagaauaaggaagaagucccuccccccuauuacuuaugcaucaaaaaaaaaaauuaucagguuagcacagcucuuuuacccuucaaaguuagaggaacgccaaccuaauauaacaucauugccuguacaaauaaagagaacgauuuuuuaaagucccugguccucuauccaccauauuuaaaagcgaugucauccuuugcuuccaauucugcugcgcagccuucaaaagaggaggaaaaaaaaaaaggcaagugggcgggggaggggguaaaguggaaaacacccggaugcugaagacucccuuaguauuuuucuccccacugcaugaacuagguauuagcugcuuaaaucgggguauaauuaauggaggaaacgguucucaguacugguucuugagauccaagagcccacccaccuaucacagugcagagcacggaccuucuuuuuccacacauggcccaggagacaauaaugagguggaggcaggcaugaccuuguuugagggcccgccuggugaagccccucaccccaccccacccccaauucuaaaaaaaaaaaaaaaaaaaaaacgcaggucagaaucuaggggcuucucgaguuuuuccuccuacgcucaaggaaaugggaaggagacucguuuucauggagaaccaauugagcagacauggaugggcacaaggcucaucucaccugcugcuacaggguugggacgcguuuuucuauagcauauccuaucugcggcccccaaccagucgcccccgcacacacaggccucgccacgcgcacaucccaaccuccaugggugcugaauccugcugacucacccaccacgcgcacgcugcgcuuucgagaugccaaaaguggcuacaggcccuggggauacaagcuugucaaagccggucaagaauacuugauuccgaugacccuccugugccagggccacccgccaucgccaggcuaccucgguagcuccagggcaaccagcucccaaacuccucaagcuugccuucucccuccccgcccccacucaccggcacccgguccggguauuucuuccuaaucuuuucaccuuccuuuuuccgauacucgaaggggugguccuccuuauacuggaacuucaugauggaccucaggauguaggggcuccccggacggggccugcugcgcgcgcugaugacugcgucucgcgucuggccacccccagucaaugucagccuuaucacaaucgcuccacccgcgucagcucccacgcgccagucgccgcacuacguggcuaaacguccagagaaggaccuggagaucucgcggccugaagguaaaggaccaccagguaaagaaauaggguggcuuuucccaagagcuggaaacacaaaaacaccagggcggugcugugacaucacgacgcccca

SEQ ID NO: 3429 - RNA, 23651 nt, Mus musculus
uacacagccuuuccuuugaagguaaaaauuuuauuuuugaggaacuuguuacugcacauuucagagagagcuaugugagaaagcaaaaacguucuccccucauccuaggaauaaauaagggcauaaaauuucuucuuaaaucaugacacuuggaaguuuagcaccagcauccaaaaugaacaacaaaggaaaaagagcauuuacuauauauuucagauuucuuugguuggggcaauccccaugugguauuaauauuucuucuuuuaauucauauuaccaaaacaguaaaaaccaggaaaaaaauagaaagcacuagguugcugaaacuggggaggcugcucuccugcgccugugcagguucccgggauacagcuugauggacacuugcuggcucguucccuuuguaguuguuaguuucguagagaauagcaguaaacauucuaauguccaauucuugguuagucuuccauuuuauugcuuagauguuucuuugguguugguaaggucgugggugugcuuuuuugccuuguuuuugaauggucauuaauucuuuaggucaccuggaagaaauuaaaaucaaauuuuaagagugauauacaaugaccaaaaguuaggacaaacaggcaaaaauuauuuccauacaauucaaaauuacuuacaaggcucuaaaaacuagguauaugucuuacauaggcauaaugggaugaaaauucuuacuuuuuaaugaaauacuucuacaaaguagaagagucaguauauaauuaguauauaaaaagucuugaaugaugaugaacacuguaaaaggcagagcuguaaaagguagaaacaggacuauuggggcuugcuggcuauuagccuaacccuacacacagcugaguggauuaauauagguccugaagggggacuauccagucugccuagagaaacaaggaaugcugcuaucacccagcacagcagugugcccucaccgacagccaacuccaacccacaguacugcccagaaagguucauuauaaaccccaaacugcaccuucaaaaaguggcauggacagaguagguuuuauaacuggagccagaaagaaauacauaaacggguauaggagggugguagguaagauccugggggugaaccaggugcucaagcacaggccuggaaucccaacacccaggcccacggucaagaccacagaaugagcccucuucugucugcccugagcccacccaaagaaaacccaaaaucaaaaucacauaugaauaaagccguuagccuaacccucuggcagcugcaucuccuuggcuaacuucagucuacacagguaaaacugacaacaucuuuagcaagacagauaaggggcugcucuucuccauucccauucgaauaccacaguugagucaagcacguaugacagcaauagucacuaguuugcucuccugauagugggcauggcaugucaaugcuacagaagaugcacugcucaaucucuaauccccaagcaggccagagcuucagaggccuccaucccauaccaaacugcauagccacaaaacgaguaacacuaauuggaaagaagggcaaagaaaaaccauucacauuuaugcuacagguaacacuucccuggaauuuaaaaccaggcucuggucaggaaguuuuaaauuaacaaacugagccuaguaugguggugcaugcuugcaagccuagcacuaacauggaucacugaguucagacaaccuggaauacauagacugucuuuuugucucuucuuugugacagagccucuuuguguagcucuggcuauccugaaacuuguuguguagacuaggcuagccuugaacucacagagauccaacuaccucugccuucuaagugcggaaggugugugcaaccacuccuggcuaaugaaagauugucuuaaacaaaucagugacauugacugguaggugacagaacagcacugcuuuucccaaaugaccuugcugugaaaauggaccaguaagugccugucacacaaaaaugaggacaaguaagauuccaaacacucgcaggaagcuggaggcaacccuagugucccauggaagauagcuuggccagucuagccacugggcucagugagaccuugucucggcaaguaacaugggaaagaacaagacgggggaaaaaaagcaacagccuuugcucaccacaaacacaaaagccaaaugacaagccuggcuugcggcacaagucugucaacccaagcacuugggaaccuugaaacaggauucccucaaguucaaagggaagucccaagucagucaggguuacaaagcaauaugcacuauaaaccaccagcaaacacaugcauaaaaagcaggaacuagguugggacggccagcucagugggguaagaguguuugcugcuugugcagaggacguuuuuuaguuuccaguaccaacacuagguggcuccuuagagccuauuucagcugucgaggaucugauacucuucagaacucagugggaacuggcacucacaugcacauagccccacacagacacaucuacacuagguuuuuuuaaaaaaagcauugucuaaauagauagauaaaacugggccagcgaguuggcucagugaguaaaugugcuacuuguuauccaagccuucuagaucccauguucaaaagaacugacucacaaaaaguggcaaccauuaaaccugucuccauauuuauaccucaacuuagggauugacacuauauaagggucaaucuccaauauacugaacauccaaccauaccccgcuccugcucccccaaccaaccaaccaaccaaccaacccccccccccccccccccggccuccaaccucccaggugcaacagagaccacugcgggcacaguggaaucgcagugugcugcugagagaacaggaaccaggcucacccugcuggugguuacggugccugggagccagggucacucggcacugcucuguucgguagcuggagcgggguucucaguuggugcuucaccugccuuggucugaaacagagcaaaccacaaacuccuucagaggacuguguaguagccuuuaaggguaaauggucucaaaaguuaauuuucuugccuaggaagagaaauaacaacguggguuuugccuuuuaugugugggucagagacuaaguggcuucuacuugcccaauaaauaccuuuccaccuagagcccacagcgugccacggcugugcuaagaguccacagcgugccauggcuguguuacucuguccuuguucaccggcaguucucugcuauuaacuguugcccuucauacuaagcucccaaucccugcuagucuaauuccuccagagacugcuuaacaagcucaagucaaacgcucagcucacguugcaggaagaaaauacugucuacagaugaagccuaaguaagcaauguugugcuugauuaaguguccaguuucacacggagaaagaccauccuuaggacuuuaaaaaagauggcauaacuccucaaggugaucugcguguaucucuccugccugcuggcuuuaccucuuugccaucuugugaaacagcguugaggggacgggaacggcgccuauaguuguagggacgucggaauccacggcgggcagacggcugguuuggaccauuagccgcuugcugguuuucuuugucuucagccucuccaauagcaggggcaggucgugggcgagcagguccccuagagcagggaacagaaguuacauaagagagcuacaugucggaggugggauguguggguugaaggguggggugggcaggaguacucaagggcaugagguuugucuacuauugagucaaaugauuacuugcucaaucacccacagaccagaccagugcaggcaaugcagauggaaugauguuuuggugaaacccguauuucuccauucuguuguucuuuugcuuauuuacaaauuuguaguaaacaaacaauacaguaaaauacauaggguccuacacggcacuaugauaggcaccaaggaaaauggagaaagaagcauggcccaggcugcugccugcacacaagacgaucuggaagaaagcaagauucuuacggagacuccuuagcaaggaaggagucacuaaccauuacugcaaacuggaaacaaccauguaaggaaggcugcagcacaaauucuuucccagucuguuuuguuuuugcuuuaauaaacccuuauugauaaucagcugguauguuuaaccaauaaaacacaugcaaauguuccgaagucugaaggcaggaauaguucucugguaccaguguuuuagacaggggauggacaacauguaagacacaacaucccagaaguaccauuuguuccccucaccucgaaggugacaugguacugacaaaagccucuauuaugaagcuuccacagggugauggcucuugggcaagagcaccugcacccugaacacaugaccggaggaaugguuucuauccugggaacccaugagagaugcguguucugacccaccccccccaauacaugcugaggcgcacacacacaaggaagaaaccuaacaaaaccaccacccaaagggucucagggagucuagcccaaaugaggaauagcaagagacaaagcacauuaaaauguccccacucuucacugaccguaaugccaaugguacugacaugguguacagagggcaucgugguaaacaucagagaccauuuauucauguaaaugucuuaccacagaauaacuccaccccuucuugguuguuuuuuuuuuuuuuuuuuuugagacaggucucacuguuuagcccuagcuggcacaaaauucagagauucacccgccccugccuccagcuuugaugacuuuucaaaauguccaagguacagaccugauggccauagcagaggccagaaacauuccaaaggacacagagcuacuaaacgcuuggauucuucauaggcuauguguucuacagccagcuuucaacagucccaguagacuaccuugaugauuuaaaauguuuaguauuucaacuuacauuuuugacacaauaaggugcccauuaauuaaugcuuauuguuuaguuuaguaaaaauuaggcauuaaaucagauauagugucaaacaccuauaaauuccagacuuuggaggccgagagcugaggcaaaaaggaguucaaauuagaggccagccaaggguacauaauaaauaugaagcaagacuuggcuacacaguuaagauccugugucaaaacaaacaaaauaaagagguuuauuuaugccacuucaaguugcaggucaugaccagucacaguuaaagagagaacagcauucuuucugguuguaaagagaaugaauaucucaaugugugugaagcccugggcuacuccccacuacaaacgaucaggcucaugaccaaagcaaccauaucuucaaauaacaagcauggccauguaacagacccacagugcccucuuucauaccugcggaaccucgggcgguaagucggauuccgaugagccuggagcuguguucccucggggacuccauccuucaucuccccaaucucaccagccuaaagggcaaugacagcuggaaaugagccaggacacagggcaagaagggucaaagcacacaguccugugcaggagacuggcuuuaaaaagcaaaucugaggcaagagcuuuguuaccagccugaagcuccaguaacugagccugcuacucauuggcuauuuuuacaaaugacaggaaagaaaugaaaacucauuccuaccacaacagccuauccccuuccuuagcacagggcaccuagcuuuucacacauuaagaucugacccuuucaaugcugaaaagacuaucugaagggcuugagccuuauucuuagggcucagccggcacugcucucaccuaguaugugagaagaacuaguucccagcaccaaaaagcagacaaaauaacauauuuauauuaaaagaaaauauuguauuucugagcaacugggcauguucaacugcuuuaaacucagaugcacugacccacuaagguacauagguuucaguguucauguuacccauagcuagaagcaguugagggaggugucggacuggcaggagauaaggaaggacuggcuucaacccaguccugacaaagcuuaagcauacccuuaccuauaggucuuccuugaagcuuuuuuauccgcuuaugauaaguuuagcauuuaaaaguauguuuuuggagggaggggagucguuaagacaaaguauuacaauggcgccguggcuacccucuaaugugugauccuucuaucucugucuaccaaggguuagaacuauacauauguguagcuaccacccccccccccagcuuaaaaauuccuaggccggauauaugaucuaggccucuaagacuggugaccugaauuuguaaccagggacccacaugaugaagagagcuucagucagcaaagugcuugccuugcaaguuggaggacuugaauucagaucccuaccacugauguaaagagccaggcaugcaucugcaaucccaaaauugggaggcagaggugggcagaucccuggcgcucacugacuaaccaguuucaaucagagauccugucucaaaaguaagauggaggggccagagagaagguucagguuaagagcacugguuguucuuccagagcaccugaguucaauuuccagcacccacauaguggccggcaaucacuucuaacuccaguucuaaugaaucuaaaguccuguucugaucuucaaagguacgaggaaccauguauauacaauagucauacguucaggcaaaaaauccuccccaccccacuacuguaacauacacacaaaauagcaagagaaauaauaacaacaacaacaagaauagagauaagaggaagacaccugccauggcccugugacacaaacacacauacauucacucacaaaacaacaaccuaucccugccuggcaugguggcccaagccaguaaccccagcacucagaagacugaggcaagaagagaaccaugaguuccagaucaaucuaggcuacauaaugagacccugucgcaacaaacaaacaauaacaacaaaaaacccaucuccuugcuucaccucuucaagagaacgagaacaugagcacuuccagcauucgccaguaugcccacuugcuuccuuauaauucauuucuuuuugaccccgauugagggagggcaucacacucacauccaaacuugucuguuuucaacacacgaagcaaacuaaccccauugaccucuauccuaucacugauuaaggcggguaagcuucuugaagucauagccaucgccuucauuuuauaacaaccacaaaugaaguaccccucacuccucaguuggcauuaugauuuuacuauguuucaaugucccuuauagcaaccaggccuacuuagaauccuguauugaguuuauuuaucuuucucaucauucuuggcuaucagaucugagcaccuaaauuugggauacuuuacauuuaauucaugcaccuggauaagaaagccacaaaguagagugaugaucuauuuuccuuaccuugugaaguggucuaacacuguugacauacaccaguuagugcuuuccaagaucccacuagccugaaaaagcuguuccucaaauguucaguauauucguguauuuaucuccaccuguauggacucguggguuucaauuuucuucagugagccauaaucuguugcuuucauuacuggcuaauaggaacucuacaugcagguuuauagacucuugacaagucuccaacaaucuuuagucuuuauagaguacuuccugccuuuguggcacaggaugcucaaggcuuuuacugguauuuacucugacccagcucagaaaacaaguauuucuagaaaggggcuucuuuccaccaaagaguugcacccagaaacaaguaacucaagaugaaccaugcucagcacugcuaggguaucccugcuuuggagucuuuaaguacauacaugcucacagacauacacauacaauccaacauguuccauauauaugccucucuugauuugcuucaucuaacagcucugguaguuacacucuucauuuaaauaaggggcaaaagugaggccagaggcaccaaaaaacaacaacaacaaaaacaaacaaacaaacaaacaaacaaaaacccacaucauuugaguccuuuacagauacacuggcuacaaaaaaccuaauggcaaacuuaaacuuuuccucacugaacacuguccucuaaguuaucaaaccugaccaccaucuccuugauuucugauuguccccuacagccuggucaucaagaguagauaacuucaugaugcuuauucuuggauaggacucccacccuggcuucaucacauuuacagcaagaccuuacugagcagcagcaaugaccugccuucuccaagauucucacccuacucccccgcuaccccacacucaccaucccgaccaaauuacgucuaugcuuaacguccugaccacacaagcaccacaccacaucaaagauaggcagaaaagucauugaugcaaucuguaugugguaauauaugauauguguuucuuugguuuugguauucuuucauucuuuccuucuuuuugguuuuucaaaacaggauuuuuuuuuuuguguuuauguagcccuggcugucuuggaccucacucugaagacgaugcuggcuggccuaaaacucagaagcugggauuaaugguguggaacaacuugccuggguuuauaaugugucuuguaugugucaguuugguaguauggauauauaaauacagcaguacaccuggagaggagagaggacaaccugagguguggguccuugcaucccaccauguuugaaacaaggccuuuuguuguuggcuucuguagaggucagacuaauuguccugcaagcuuuuguaguuucuccugugucugucuccaaucuugcuguaggaaggagcuagcacuacauaugcacacugcuaugcacagcuucacauggugccuggcgauaugagcucaggucuaacgcuugcauggcaagugcuuuuaaaaccacugccaaagucaucaaaguugcuaauuguuaaaaacacucaaaucggucgggcguggaggcgcacgccuuuaaucccagcacuggggaggcagaaacaggcggauuucugaguuugaggccagccuggucuacaaagugaguuccaggacagccagggcuauacagagaaacccuaucucgaaaaacaaaacaaacaaacaaaaaaaaacccucaaaucucuuuaucuguaagaaaaacaacaaaaaauauggaagcaacauagcuuaguucauaggcuaaagacaaaauuaggacugauuucaaacaccugccccugguaagagccacagugcggcuuccuucucucaccaauuacucucugaagcuuaggggcuguaucuuucaaauaaacauaaccaccauucucaagaagggggaccauugccuacugauuguauguauguauguauguauguauguauguauguauguauguauguaugucuccauguucuucagcauuaaccacuggucugaaugcugcaugguauuauuucccauguugucccacauugauccauagaauuucacucugcaguaggagucaaagccuuuuccaucugaacuuaauaguuuguaacuacccuugagauuaaccuucacguuuuuaaaaaauaguuuacaacaacacaauguccuagaagaugccuaguuacauguagaaguuucugauuugagccguugauuuggcuucaauagugcaguagugcuccugaaagauucuaauggaaaaguugcugcagccaucuaacauggguucuguuuccaagauggaacagcuauggucggcuguauuccaaacaaccacaugcaguuauuuauauguugccaagaguaagcacgcugcugggagggaggggggggggggagaaucagcauuaagucacaugaugcucauucuacgacaccaagaaaucauuuuuagugauucuugguuucaggaagugugccuuauaugcccaauaguaggaccagcccggaagccgcugcuacagagcggcaacccggcugcauguucuugcuuuccuuuccuagaagccucagacgcugcccugaagaugccuacucugccucguguaccccaugucuccauacaucugacacuccuuguuauuuuuagcacauuugucaggggcagcuguugaagaguuagaagggaaaaacaagaagccguguagaaacaacagccaugcaugaugggaaugggagggguguagcagagauugaacagaauguucaguccaaacguuugggggggugaggggugguggagcccaaggacacuaaggaaggagcuguagcugagguaaaugaggacccgcucucagcuucccaagcucccugggaacugaaacacuguuguaaagcuuauuaaggaauucucaaaagcuuuacuuauuuccaacacucaaaaaacuccauucuguuaggguaccagaaaacagcucucucauccgauuuggaauguuacauuuuccacugcacguugcgccccacccucauguuuaauaccacauucuaguaaaggcacuccaugccuccacuaacaggcaaacuucaucucuccaaaaccugauuuucucaaaaagugaaagaacaggauuaaaaccuaggcccucuuugaaauaagaguccaaguucuuuugucucaguagguagcacaaucuagcccugaacugggaccccuccugcucagcuugcaucaucaugccuggcuuguuuuccuuacacaucuacaaacuagacucgauaccuauugucccaugauaugcauggcucaagauguacuucuuuuauuauuuuuuuuuaaugauguacuuccaaacacguuuuuacaagugcgcuaaacaggcgugggccuugccucagcuuugguagcacaggaagcugcaagcaauaagcaauguguuacuucugauagcuggaguugaaggaggaggaggaggaggcagagaaggaugaagggugaggacugcugaggagucucaggugcauuuuaccugcauucuguugggauggggaaagacccgugagcgacggucaaaggucugucccacgugguaaggcgggaaacgccgcugccgguauggagggcgauacugggggcggcgcagcugauuccuggccccagagaacugcccaucugcggcagggggcucaaauccuucacugcugccgcucccuuccuccuccuccuccccagcguacuagcgaagcaaagaaacauaguuucagaagaaguuacagcgaggcaagaaccaaagaauaccacuuaggaugagcuaucaccaggaaaaaccccaacucccagagcagugaccuuucauugugaagacacaacacugugcagacgcaacgcacguagcccagacaaucaaaugauuggcugggauaaacuacauggagauuaaaauagaucuaugcagauaucauaccgagcagcaggaaagcaagagcaaaucaaucuauuaccaaaucuaaggauacugaauuagacagaacagcaguguuacacuguuuggcuccuuucaaugugucucccaaauuugcgcaguggggaaagucaagaacuaucaagaaaaacaaaacaaaacaaacaaaauuuuaugaugucaccaguugauuugaccuaggcgguaagcaaccuagggcaguuggcucucuggaagccuucccaagcuagaggcaaagcacuaccacaauuccacuaagaugcucaucucucaccagcauauggugagcuucuaguuuagaauggcaggcaaucucucaaaaggccaagcacaaagcagacagaagauucagacugucuucuacuaaagcaugcaucacaagcaggcacacaauggcggagugcaacguccagucuucucucccaaugugcacaggacuuucaauugaaauguguuaucaguauugugucauuuuaaauuaaguuaauuuuaauuucuaguauaauagcaauauuuaaugauuaaugauuuugagauccuuaacacuaccuaagccgaaagguagguucaaaaucaaacagcgagggcuaagaucuauugcauacuuccuuucuauguagaaauaagguuuaauuguauuuuaauagcaggacauccuaauacuauuucuaaaacauagaacucauuuuucccuuuuauuuuaagaacuaaacaaacaucccuaaagcauuuaguaacucaaaucucucuauaaagaauaugaaaugacagucuuacaagaaaacaccuguaauuuuuuuuuaacugaauugaaaacuaguuagcuagugaucagucucucuuagacgauggguuacuuaaguuucagagccuccacaccaaacccagacgcccaacuacuaaacucccacagaacugguuuggucuaacuucacaaaccaauaacacgcucuucugagagacuggacuuagcucaagggaccaugcgugucagggaggcucucugccacugagccagagcccagcccuuuuacuuuucauuuggagacagggucuccuacguuacucaagcuggccuugaacucacucuguagcccaaacagggcuugcacuugcgauccuccugccucagccucccgaguagcugggauuacagaccugcgccaccaggccuagcucauucuacucuuuauaaaaccuguaugaauaaaugauucacaguuauguaaagauauauuuugcauaaaaaauauucaccacauaaauuucugaaggcauuaucucuaaguucauacacuuacauccuucauauagaccucuaugaagcaaucacaaugguucuacccuuguugaccauacucaacguuaguacaguggaagacugccacaaagaucaacuucacuucuuuuccagcucuuggagggaaaaauguucaggaaaaauuuuuacugaagauuuucuaccacuuuuacuucugaauugaccuaggcaugaaugugaaugaacugagucaaagcaaacugcccaucccuacuccugccccucaaagauuaaguggaacacaugcguguaucugucuguguguacauacgugggaggcuagacguugacacuggcuauuguugagacagggucucucacugaaccuggagcuaggauagcgggaugagcugccggcaucuacuugucucucucugugucccaguacuugccauugcccagugugugcuggacucaggucuucaugauuguauggcaggcacuguauugacugagccuuuuccccagcccucaucaauuguuaguaaaacauaguaagagaaaagaauaagcagaugaaauauaaggaaugcaacaaaaucaacaugggacaggaguggguggcaguuugaaagcagaagcacacagaaaauguauaugcaucaaaauagugccaagucaguuucaucuguguauuuuuuucuuuguagcucuagauggccuggaacucagaucuaccugcuucacccuucaaguacuaugauuaaaaacaggagccaccguaacuagcuaaucuaaagacauuuuguucuuuugagauuuucuucugaguuuuucuuugugugacacagguaacuuuccuacccuacugugcucagagaucccugacuauugagccuguggcucuggcaccagauuccauguuaacaauauguaucauuauauuaccacaccuucuuaaugaaaaucuagcaagcuccacaaauggguucauuguguuuaccuugagaauauuccuuuaaucuuaaucuaagaauguuccagccagauucacuucaccuaaagaugcuucaacagacagagacuaauccaaaugccuaaagaucuguaauuucgcaccacuuuacuuugaacuaaguaagaacaaaaggcuacaccaaguagccccuuaaccgaggcgugucacucaacacaucugaggcaagcaugcaccgugauuccuaagauagccccacucuuucuugccagacaaacgcagacuuucuugaggccagcugucucagcaucaaggcaggaaacaggcugcauagcugugaugggaaccccaauccuggugccaguaaauaccacaaaaugaggaucuggccaaaggaagacaaagccuuuggacaacuuggcaccuuugucaaaucugguuacgagauaagugaaugucuguuacuugcagccaacucuauccuaaaugacacaacuucugacuggcaaguuuccaaugggaccuguagcuaugaauaaacucugggcacuaaaaauuuccuuccaaaaaaugaucacgugccuuaucucuagaauauggcgcuuucaaauacgguauuuaucuguuccuaaguucauucaguuuuaaauaugggaacauuugcgaucaauaauuagggacacagagaacauacauuacggggagguccacggcgccugccauaguagccgcgucuguaccggcgccggucagcagcauagcgacucccuucuacaggaacuccaucugggccagucacguuugcugcuucagcacccugaagaaaacaaaagucuccaaauuuaaaagaaaccaaguaaccuccuuccaggagcagucagcuacaggguuaagaaccccuacugugauguuagggucccugaccucuggcuugagacaccccacccacccccuugucuggucagucaaguuagaagcaguucauacaucaaacaugaaugaaugaugaauacaagauacuucaauggaagugaaacaaaauacuaugaaacguuagcacaugcuaaacccugugguaccccaagguacuacuggaauccugagugguuagcuccggcugcucuaaccaucugaguuacugcuuagcuuggcagaaauaaggaagacaaagcccuugauauaggaauagucgccacauagcccuccuuuaggccuuccuguuauacuguugacauugacuuuuucuuuuucucuaagagguaagcaaugaagcugagaauucaagcaugcuaugagcaaguauucuaacacagagcuauaucccuagcuaccacaucaccaaauucaccugcaacaaaucuggauuuaaaaaaaaaaaaaaaagcccuacuucuuugauauauaggauacucuagagacagggaaaugugagccuggccugucugcgacuuuaaucacguauucuuuacuaugcagcuaggugcagaaguauaucaugaucuggccagggugaauccuagcuaucaaagcccuggugcuucccaaagucauccugcauaccugucuggagccuaaauucuggacagugugagauuagagacaaggaaaguuuuaucuccugggucccuuagagcaaccuauacaagaaauaggcagcauacacaacccaggaggcugcuguaugcagccauugcacaccaggauccaccaagagagaaagcuggucggcuuaauuggcugcagucaaacguuuuuguccucgaggugcuagggguauacuuuugagacagaauguuacuguguagcauagacuggccucaaacuugcaacauucuuccuccuucuucagccuuucuagugcagggaucacggaccaccaugccuaguuuauguggugcuaggaacugaaccaugggcuucaugaaugccaagcaagcacucuacuaauuggguuacaugucuggaccaaaacagugugagguccaaacuaaaaugugucuuacauuuuggaggcuuuauuccagaguuccuuuauuaaacaagaaacuaaaauauauagcauacugaauauuuauaauggcauccaguaaaaauauuucugcuuccacuuccuccuaucacaaaaaaauuaaauauuauuucagaggcugaaaggccacauguuauacaauaaaacuaugugcagacacacuuucauuacaaagcuucucaccuuuucuccuucaacuacaucaaacucuacaguuucuccaucccccacacugcgcagauacuugcguggguuguuuuucuugauggccgucugccaaggaaacagaaaauaccauuggaggugcauuccaauacugaaauguguucaucaauuucauguuagccagauaauaucuauauuuugcuuaaaacaaacaaauucccccauucuuccauuaaccugcauuucuaaacacccuuacaccacaguguacaugucuuuccugauuuguaggacgcuucaaacuguaccccaaucauaucccagucaguaguagagagaugcagucacucagucaagacauugacucaggcuguuagaucaagccaagaggcuccugagauuuucucucuagcuccuuccaugagggcaaaaaugccuacaugagaccuuguauaaacaugggcaugguuugguuacagaagcuuauacaugguggguggcauguuggagugauggcucaguaguuaugagcacacacugcucuugcaaagaaagacuugagcugggcucccauacacacauuauguagacaccugccuauaacuccagaggaucuaauauccucuucugaucuccaccagcacugcacauauuugcauauaaccccacacacacacacacacacacacacacacacacauaaauaaaaagaaauuaaaauguuaguguggcugauauagugauaugugccugcaacacuagcauuuggaagguggaucaggaguuuaacacuagauucuuucucaaagauacagaaagauggcuuaagggcucauguuuggaauugucagcacuugaugaagcaggggaauuaugaugaucuugaggccaaccugggcaaccgaaccuucaagaccacuguacacaaaguaaaaccuugucucacagaaauaaaugagcacauuaaauagugauaaaaaggagauaucaaugagauaaauaauacgcugguaacauaauaaaccagauucauuucaggauugauggcacacaaguguaauuugaccuuuaaggucuuccacuuuauggaagaggaaaacaugagguggugacuuacgugaggucacaaagcuaagagcaaguagaagauuuguauccuuacacuaugggaauguucagcauuuuacaccucacacccucacacaccagcauuagggaacucaagaaccaaucuacauaagacaucugcaccucgaucaucugcuuaagaaaaggcucuuucucuuuuucaaauaaagggagaggaggaagccucaacaaauuuccauuucccuggcuggcaucucuaaacgguuaaagggcuggggaguuucuauggaacuaggucaaccuuauuuuauaaagcgauuagacauguguaauccagccuuccucuacucugaguaggagggagagaagaggggggaaaagugagccaauagggcagagaccucacccacuccacaaggaggcagcucaggacaggauguaugcgcgcacagcaugaacauuuagccauuccaaaaaaacagccccucccugccggcucguucccuuuuuccuguuaaacugggcaggccucaacacacugaagugacucacuacacagccucauggggcuggaaucgggucauuagcucacaggcgaggaggacggccaccagcauggaaggcccuuucucccagccucacugaacagggcgcuucucccaaagaucauuaaccuccaacacucccuuuucacacugccaggacucuaagucgucuaucucaacaaagccacuccaaucaucuagguacaacagaaaccuaacccacagagcagaccuagcaaggauggaaaauauagcuugagauguggcuaucuccaccugccaaacugcagcccaccacacacacacucaaacccgagggaccacaugcagcauggcagcuguacagguccauggccaaugccacgauuucuggcaagauucuuaaaguggcaggccucucuuucagaccgaauauacaaaaggaacaucaagaacgggugugacuucucuuaaccuacuuuauaaagcaaacaaucuaggacaauaauagagaacaccugaggacugagacacaggaaacuguccuuggacuuggacauguacuaaauaagucucaaccaacaagagggaaaauugucuaagaaauggaagcuuucucaugucugaggccuacauacaucuaaucgucuucugggugcuguucacagaucaaagaaguuuuagccaacacgagcucaggcaaaaagccaggcugguucuggccaagcaccaaggagaaccacaccauuaggccagugcugacauggaagcagauuuuuuuuuccuuuuuuuucccccuuugcuaacgacucacagacuuuaaaaaccagaaaguaauuuaacugaaaaugacuucauucaaacuugaaaacaacccaaaugugugaaaacaguuuauauagugggacaggaagguuuaucugccacucugaauaauguugaacuagcucucauucuaaaaugaguucaagacacgacaaucauuuacagggcucacacagucaauguauacugcuagaaucccucuuaccugguguacaaacacaucuucuuuggugucauuucuguugggaggcagaggaaaagaaaaaaagaaaaagaaaaaagaaaaucacaauuuaaggggcugagcauucagagacacuucaaacaucaaaggcacuaugaauaaagaccgaagccuaaagagaaaaaaaaaaccaccuuuuaaauaguuuguccuuucaaaacagaugccaagaaucaguucccauaacccucaucucucccagaugccccuuccccgcuccagacugcaauguccaagcauuggauuccacacacacaggaacacucauuugcucucgcgucuuucucaaucacaugcuguguaaucagagcccuaaauuucccucccagccgaagcaagacaggcaaaaggacagggcacagcugugaacuaggcucuccuuacacugaaacuuaaaacaaccuucccaccaccccacccuaaccuccacacaacccagacagauaagaaacuggaggaauugguuuuaaaaagcaagaaaacagaaacacaucaacacccuguaaaauacaucucugugucuccaaguggccugugguuaccugaauuccgauauggucacaagucaccgaaguuuaaacacuguuuuccucacaggacuuggagcagaccagaacagggcucacagcccagcucaguuacucucuaguuugugaccuuaaguaaaguugcuuaaccagguucuuuuuuucuccaucugugaaauuauggacauggacuaccuaauguucuuuucauuucugacugcaauucuaaucucuguccuaaacacuagaguauaugaauauucuaggaaugcauauuaauauuuaaugaccaaaagcuuagaaauaaaacuauuauaaaacuauuuaccaugcuuagaaaucucaaaauguauauauacaacccauuaauaaaguggaacaauggauuuguagcugcuguugcuacaaaguagguacaagacaugcagacacauaccgguuuauaaauccauauccauuucugacguugaaccauuugacagugccaaggacuuugguggcuaaaaggcgggauuaagcagauauguuagcaccugaccuacaaagagcuaaaucuaucacuaaggcccugguaucauuacacaaagccuaaacaccuuugaguaaaccauuaauggcuuaauucaaaaaaauaaaaacuaaaaaaaaaaguggaauucugauaaagagagauuauuucaagccugagcuuuucuuuuguucagacuuuuuaccaagaacucaagggauggccaugugccuggacaacucugcaggaauuagaacugagaaagguaguugaggaaaaacaugcugguaaagguucaauuccaagagaaaggcagcugcguaugccuauaaauccagcacuuuggagguaaaagcagacagaucaggagucugaagccagcaugggcuaaaaacaaaaaagcuccagaaaguucccagggccggggauuuggcucaguugguagagcacuucacauucauucaagaggcaacagguguacgccucaaaacaaaugcaaaccaucaacuagggaaaaaaaaaaaacacauaaacacauuccaguuauuuacccagacauuaccaaugugcaaaggaagagccacagagaaagaaccgguaagcugggucaucuuaucaauucuaguacuuuaaaauauuaggcaaacuuuaaugaggaacacaguagcuccuucuuaguaaucaacuuacaaagauauaaagaaacugucaucagguggccaaauagggcuggccagaaguccagaguaauggcagaacugaugcugucucaccccaguucuguacaggccacaacagacccuuuucacaccaagggguuaaccugcugcugucuucaacagcugagaaggaaacucuggcauuugcuaaaguugacugacuacuauuuucuauccucugucauggguaauuucucuagaguaccucacuugaaaauucauuaagaaaaagaaucuaaauuuuguaaacuccaaacaggacugcugggaucaaugaugaaugucaaauuuaguaucuccaggaaauggauaggccuaaaccaaggaagugcaugagacagucaucaacacucagugaaauccaaaaccuggcaggacuacacuuagaagggaaaagcuaaggaauggacaagccaggucuacuaccucugagugagaagacacugugguucugaguggcgcaaggaugggcuugcaccaaccucuuagcuuuccuugaugagcuccuaagccuuaaagccaaucuaaugugagcugcagagcaaaugagaaaaaaaaaaaaaaaaaaaaaacugauguuucagaugucaacacagggaaguccgguuuggauaaacgguauggccucuacaucaggauuuacaugagaggauuuuguuucuuucaaaaacucuggauauacacaaauaaauaaagauacacacauggaggcucuggaagaaacugauacaaaaaaaccacuaagcccaaugugguggugcacaccuguaaugguggugcacaccuguaauccugccccuugggagauagaggcaggaugacaaagaguuaaagguuauccucugcuacaaggugagugaggccaaggccaguuugggcuacuucaugugaccaaucucaaaaauaaauaaauaaauaaauaaguaaaagugcaaaaccaaaacagauacacaaagaaaagaggggaagucaaugauaacagcagaagggggaagaugggcaagauucucaagucuguuuucacacaguugaugguguuucuuuccuucucaaaguuauuuuuaaaaauacuaacuguacaaauaucuaugaucagacaaauucauucacacuuuuaauacuauauucaaguacacaagaagguguugguugguaaaauacgccuacccagaucuuuuuacuugaauaaacuuguuuucccuaaaggacuacacgguauaaaccaaaguuaaggccccuuugcaaagaccagaaugagagcguccaagauauccauuucagucaguccugaguccagaacauuuuggauauccgugugucggccuggcacaggagauggcagaccacaucggacaaagacaaacagugcucaaagugucagguggaggcuugcccuucauuuucugagucuggacuuuuugagguggcaggaugaaagacaucagacucaucaccagguaucuggcagaaacagaacuaaacugcuggggauugcggaaauuaaccuuccuuuaucgcccuaccaccaccacccaccucccacccccaaucuccaaagauauuaucuacuuuucuuaucucaaaagugcaaggaucaaguaaaaaccuguaggauuccaucugcccuuaguaagguaucauuaagaaccugcuucggcuagcaacacaggguucuaucuuucauuuuguguggaaaugguccaaggagcaucuugguagaaagugccacaauguaacacccacaagaccuuuaaggaacuuuuuagugagaguggggaaaaaaaaaauuggcaggaaccaaguuuuuaaagccuugggaaaacaagaaccagagaacugucagggguggggaacaccgaaugguguucuauuucuuccacaauuauuccuucagcuuucucgcuagaauggggaggaagcucagagagcaggcgagcccaaucggccccacccagaaacagugaacauuucugaagcauccuacaccaucuguuaacuuuccuguuucggauagcaaaccacaugcgcacgcacacacccuccggggagcuuauccaccacccaccugcuaggcaagcuuguggaaggccucacaccgggcguuccuuaaggaagaugaggacacccaaaugugcgacaaaauacaacagccacaguuauaaaaccucugccccgcgccccgcgaaaucuccaguccccaccuucccuuucccuccaguaacaagucguaaguguuuuggacacucguccuacuccacuuccgacuaaguuuucccggccgucacaccacguguguucccacggugcgggagaggggauggugcagcaauuggaagguacuggaggcucuuugcaucugugggcacaguaaggggaggcgagugcccgccccaaguuucccggggcguugcaacaucccugugccggcauguggcccgcaggagcauggcggcugucccaagcccacgagggaagggugucagagacagacaccugacccucccaggccuaggggguaaaaaaaaaaaauacaccacacaauaaaaucuucccaagucaccccucucgugccuuccuaguguccccuccuccccaccgaggaaacgugcugcuuucccgacccacagccaagacuccccagagcuggcccacgugucccagcccgcccugcauccacguccauccucgcccgccgucucucccgggcugcaggcagggacucaccgagaacuuucuucuccgcguccucgccgcccgcgggggcugaugaggccggggcgggcccgggggcugcgucuccgccggggcuccccgcgagcagcgcggcgggcgccggggccuggggcgcgccgcuggccgccgggcucuuaggcgcgggguccgggggcgccgcggcgggcgcgucggccgcggccugcgggagcguggugccgccggugguggccucgcccgccucgcucaugccgccucuccgcucucuccgggcaccucgguggcgguuggcggcgguuagcgcgguggcagucgcggcguccggcucgcucucggggaggccggugcggaucgcgcggcgcggcggcgggcggcggcucgagggcuggggacgcgcgcgcucgcggucucgcuggaucucccggccccgaagauggccccgcgcaagugcucgcgggcggcgggcgggcaggcggacgcggggcggggag

SEQ ID NO: 3430 - RNA, 137 nt, Mus musculus
agcucaaggccagccuggucuccuugagacccuagcagagaaaaaaaaaaaaaaaaaagaaucucuaaugaguguuucucuuccccauucucuuuagcuuauuuaucacuuacugcaucauuuucuuuuucuuccuu

SEQ ID NO: 3431 - RNA, 911 nt, Mus musculus
gucaagucucacagcauuuuaaucucugcagugcccucauaguggcuugcuucagcucccugcuuguuagaauuaggauaaaggaauggcaacagggauacauggcugacaaagugaagccaaaaauaaagagaaguuuauuguuuguaagaaacaagcauaauguuucuaugagaauacccaaaaaauauaagauaaagaggaugauaaaugcaauuaaaacuuucauggcuuucaugugagcuucuguguugagaucucugaauccugauccaauggauugcaucugccugcugugucuccaaagggaaaugguuaacaagaaacaagcaauuauggcuacaauaaagagggaaaugggccccauauuggcaaaaacauaguuuauaaguaacucacucuucuccagguggaucagccaggauguguugcucugauauauuuuaacaucuuuaaugaccuucacagcuagcggaaaggaagcuagccacguuauaauuaagaauacaauuagaaagacaaaaacuuuaucagcucuucucuucauccagagaaauauguagugggaaaaauuugcuaucuucagaaaauaaaagaugccgaggcuggugcuaaaccaaacgcucagaugguuaauaauuacccauauguaacucaugcauucauguagacugcucggcauaagcauagucagaaggaaaaccuuuguauaugcaucuaaaguuauuauccauaugguaaaaauccuggaaauugcuaagccagugagaauaaaguuaaucuuagagaguuucuuauuccugacccagucuguguaguuuacaaguacaauaaauguguucccuaaaacucccagcauggcuucacuaguggcaacagaaagaaggaugcuuuccagugcacucagcauc

SEQ ID NO: 3432 - RNA, 825 nt, Mus musculus
aucagggaucuuggcuggagaccugcuuugaauagguuucagguauuuuuuuauuacuuauuuuccucaauuacauuuccaaugcuauccccaaaagucccccacacccucccccaccccacuccucuacccacccauucccauuuuuuggcccuggcguuccccuguacuggggcauauaaaguuugccuguccaaugggccucucuuuccagugauggccgacuaggccaucuuuugauacauaugcagcuagagucaagagcuccgggguacugguuaguucauaauguugcaccuacaggguugcagaucucuuuagcuccuuggauacaauuucuuaaacgcugugggguuuuuccagagcaguguguguguucaaagggcuaucgauauuggguuucuccuagcaggcucuggauagagagcaagaugguccugacaucauauagugcagaccacuuauccuugaggauguccaggcagauguugcccugaguguccacguuggggugguaacagggugugaggaacuucacugugggugcguuguaaggggagccacuggggaacucuagggagaguuuauaccucaggucuucauauauagugccggcugcuccguggaugguccccacccauuugaacagguuugucugacucagggaaggcggagauuccuuugucaccagaagucaugaggaucaucaguuccugcuguagcggcuuccccacagagccucgggcggcgcaccugcagggcuccgcuccuuugcgaacuggggcaacgcuggcaacagcugggucgcgguuuugcgaggccauc

SEQ ID NO: 3433 - RNA, 2743 nt, Mus musculus
acuugccagguacaaaaggaaaguuuauuuacaagcacacuggguaucuugacuugucuacggaucaggcauguuaaagaaguggugggaagggcuggguacuuaaaucucagaucuugugggagggaggcagaugguaccaccuucuuucuuuggccagcauguagggaacaauagagugcuugccuagaguacugcuuacuuuuaugucagcuuggcacagcuagagucaucagagaggagggagucucaagugagaaaggcuucaagaagcaguguauacagugcccacaguccaugugaaggauccaccuggggggagauaugcaagaacuccuagaugcuucgccacugacucuacagaccaccuaccuacaugggaugggaggagggagagggugugcuggccauuguggccuuucacuccaaagugccggugcuguaccugcugacagaguucauggucccgacuaccaagauguccucggagugccgcaggaaugucaggugggcagaacacagcagccuuaauagagugagaaguccagggagagagccgggcagccucugccuguagccaaugaugguucuuuccauccaggugugggcauagaagacugaaccacggggcauguucuguucaaggccagcaagccagguaccuccuguguccacaggaaagccuguguccuagcagagccgcaggcuuucuaugggaguaaaaagccaagacaccugaccagugccuguuaugagcucuuuauaagccauauucaaaaaccuuuuguuuugcaggauagcuucauuugucauuuaauauuaaaaacgaaagugucugcauugagaaaagaaaauuaaaggcuguagaugagucaggugugguggcacagcccugaaaacccaauacugaggagguagaaccaagagguucaggaguucaaggccagccucagcuauagaauacuuacaaagcuaguuuacucuaccugagaccuggucucaagaauuaaaccaacaagaaugccguuaauccaagugcuuccuuaccagacaccggcagagccuggccucacagcgucucuuaccuaagcuauggauggcuacagccuccucucugauugcuucauuuacgaagcauuuaggagaaagcauuuuggaugcuugugcaagcuuguaaucccagauguucaggaggcugaucugagucaagaggauggcgaguacaggacccgccugacugcagagcugaauuuaaggcuagcuggggcaacuuagcaagaccuuguuucaaaaggaaaggaaagggguagggcugcucaguggucaaaguugagaggagaaaaaaaaaaaaagagggggagcaaguugguagaaugcuugccuggcaugcacaaagccccuggguccccauccuagcccggccuaacaccaagcaccauggcguacaucugcaaucucagcacucaggaagcagaaaggaggggggucagaaguucaagcacauccuugccuacgcagccaacuggaagccagccuggacuccaugaccccauggcaaagagacggaaaagaaggaagagagagaggggggagggggagggaaaggagacauuuagagccaggcguuguagaacauaccuguaagucuauacuucuaaacugaaggcaggaggauugagaaaccguggucagccugggcuagagugagaacucaaaaagaggaagaaaaaaagcaagucuuucaucccaggaaaggugggcacuaaguggaggcaaggaggcaggaggcagcuuccauaaacauacagagagagccuuucucuuuccucuccaagcccacuaacgaggaggggagccguuuccaacucccaaggcacuugguuacaaaucugauucugcucuacaaguggauauucaaaaagcugcuuguucaaccaucgccaggcuuuauuuauucaaccuccuuaaagcuuguguaagcuccuuggagagcugugucaagcugguaaauuggaaaauacaugaaaaaaaaauggacuuucaauaggccagcuuuucucucaaauucguuuuacccagacuguggugguggugguggugggggggaggcaguuauuaggagaauggaggggaagaaggccuugaggaaagaggaggugaggagagaagaggugaggaggaaggggagaagcccuugggucauuuucuccuucugccuuccuggcuacccuuguuaaucagcuacugcccucuagugcuugcuguuuaggucacaugugaaguccaaaguguguguguguucaguguauguaugugccagauuguauguauacauauacacauauagguaccugugcggggccagaggggauggauguucgaucaccuggaacuagaguuacagaugguuacagcuguaggcugccggcagcugaaccccaggccuguguaagaacagcaagugcuccgaacugcugagucagcucuccauuuuuaccuuuaaaaaccacguuuagggccuuaggaaaauagcucagucaggaaaaggcugagaucagaucccagcagccacuuaaaaagcaggugugauggugcauucuggaauccuagcaccggggaggugagacagggggauuccuggagcucacuggccaguuagucuugacaaacgguaagcuccauauucagcaagagcuuggauuaaacaaaauaaauaaggcguaaagcagaguggugguggcgc

SEQ ID NO: 3434 - RNA, 949 nt, Mus musculus
caguggagaagagagccauggcuacacccacccagagcuccaacacgcaagaggcugagaaggaaggcugagaaugccgcgcuagcacaugcugggagaaugugauagagagacugaaguggaaguaggaagaccaugagguagguguagcugugugguaccguaaaccaaaaggcaaaaccaaaccaaacccaucccaacugggauucagagaggauaagagaauaguauuguucaucugugugcuaucucuuaaccugcuugguaucaaauuaagucauuucuacaucuuuccuauguuaauauaaauuaaaagcucagauaaaagguuuuuuccauuuauuuauuuaucuauuuaucuauuuauuuauuuauuuaauuuaugggaaauaaaccuagcacuccuggauaagaacaacagcaaaaaggcuaagauuauaacgugaaagccaagaaacaaguuugcuuuuuaaaguuuucuuaagguuagcaaaaccuaaauagcugaucauaagucaauguuagcaacugauuauuuugucuucuaguucaugaugauaauagucuucaaaaagacuacugaaacagauuucacauguacuaucugauucucacaaaaaaauaaucucuaaauuggauaucuauuuuuugauagcugaaaaagaagaaaaccaaaaaacauaaguccaguuccaucaccuuucuaaagacauucagccaugagcaguggagaaaaaacagucccuguccuuuucagcuucaaggagcaugucaagaaaaaugucugaaaccuaggucaccagugcuugucuuggccccaaguccaccagaagacccugacuccuucagagcagucuugcuuuucuuccuucuugccuuuccuccugucaauaucuaagguaauauuaucuuuaauauaaaccuuaaguguuugauaaaggcauuauca

SEQ ID NO: 3435 - RNA, 3150 nt, Mus musculus
uggcacaggaucucgcguugucuggggaaagaggcacagaggucuuuacgguggcguugugggaaccgcccaccaccucuccuuuaaaucuucuuucuuucuucuuuuuuuucucugucuuuucucuguccucucagccucaguguagacagugagcgaaagagcucaaggccggcagcucuguggaagaguuauggcugccauggucgcgcagccggugccucagagugagaguagcagaagccacaccgucgaucgucuuaagaugcuaggguuugcuuuggccuucccccuuuuuuaugaugcuaugcaaaccaaaaaacaaaaaacaaaacaaaaaaaaaaucaccuuggcgcacggcgccugcgcagugcuuguuuaccgcgggccgagcgcaggccccuucccuccgcccagauccugcgccugcgccugcgcggcugacguggauuucuccgggaaaaccgcgccuccuagucccgggacuagggagcgagcagccgagugugccgugggaaucucggagcccugaaaugagaaccacaacgcccagagucggugucgcggcaggaucgugagcacagaugacccaggugcugugcacgccaccgucgcugaagugagcagcggagcgugagagcgaagaccggcggcgcugacgccucaaaggauggacuuuguuuagcaaagaugcaaauaagccugacccuaaggccgccggaguucgagcaauuccugacugggcuaagacuguucuugaaggcgacucagaaaggcggccaugcaaauuuugaaacuagaaagagcugacacuagaagcaguagcccuuuaaagcagaagccaguuaguucauaagagucugaaugucccuucaaaguccgcucuaaauagacucagacagugcucauaaaauauuaucugauaagcauagauuauuuuagauaugguuauccauuugcaaguagaggcaaacugauuugugaaggaauuucuauugauagauuccaguacguucaaaaaaaauuaauaacuggcaacuuagcuaagccugagcauuuuucuaguuuucaaaacaauggaauuuauuuggcaauuuuauuagacccuauuuuuugaccggugagauugaagucuuuagauuuguaacauuuuucuaccagaaaaagugagauuuuaaccaguaagaagggggaaauguauguaugugaacagaagaggucagaacuugaagacuugucaugcuuccaacauuugucucaagagaagcuaucaucucaccucggauuuuuuuuuuuauguucaauauaauaguaaaauuuagcauacuuugaacauuuuuuuuccuauacaaucuggguauggugguacauugaagaagaaaaaaaaugggguuuguagaucaguugguaggcuccuugccuaaaagccacggauuuaugcagaacugaguaaaaugggacuuggugguagaccuauagaggcaggaucagaaguucagggcaauccccacguauggagucauaaaccagccugggcuacaugaaacgcuguuuuaaacaaagaaacagguucucuauuauagauaagaacaauagcuuacuugagguagaaugauaaccaguuuuccacaccuauauugaccugacauuuccuucauaagagagaaaauacagagagggugaaugaauuucuuguucauauuuaugacuagacuaacucaaaaagggcuuccuuuguuaagacugacaucuguccucaaagaagcuaucacugcagauuguagcgguugguuguuuuuugagagagggucuugcuauguaauggagaauggcuucaaauuuggaauccucuugucucauucucccaagugcggggacuacagagguacgccaccuuagccacccuaaaggauugcauugaacaguauaaucuggcucuaauggaaagucuguaugggaguuagaugaagaguccaucggggcugcagagauggcucagcgaugaaaagcagucgcugcucuugaagacaacuggaguccaauuccuacugcccacauggcagcucauaaacucugagaacuccaacuccaggggauccaguacccuuuccugcccagcgugggaaccacacgugaugcauguaaaugcacacagcaaacaauuuuuuugucuuuuuuuuuuuuuucuucaagagauaaaagucugaccuucaucuucaaagcuaguuucugggaggcuuaggaguuucagguguucaaagccagccuaaggagugcaggaaaacauugucucaaacaaccuggcaauggauaacaacagaaaacacaaaaagacaauuaaaagguugcugggcugucacgacuacucagugaguauaugcauuugccaccaagugcagaugaccugaauuugauccccuggaugaacacaguggaaggggauaaccuacucuuaaagauuguccucuggccucuacaugugggcuguagugucuuuacacucaaacacuaaauguaagacauuuggauuuaaaagaaagugaagccuugaguuucuaacuugccuacaugugauaaaaauuaguguaggccugguaagugaucaaacaaaaugucuuucuucauugaaaaggaauccuuuggugaagaaucaaaccagaguaauggucacccacuuagucucccguguaacucagaaaauauaccuagcaaagauuuuacagucaguaacugaaaaaacugacagugucauuucugcagccaacuuuuuaggcagauuugccugugauugccaugaccucauaaaguacuaaaaagucugcugucauuugugucuauguauugacaaaauacacacaaguucuugguauuucuggugggggcagggugggcaacuuuuuuuucuuuuuaaaauccuugcugucacuuugaguucuaugcuuucggacauacaaggcccuuguuaugcuuuaagaaggaaugacgugagcugguggugacacaugcaccuuuaaucucagcacuccagaggcagaggcaggaagagcuagcucagugaguaugaaaccagccuggucuacauaugcauagcuaagacuacauagacccuuguaaauaaauaaauaaauaaauaaauaaauaaauaaaua

SEQ ID NO: 3436 - RNA, 5127 nt, Mus musculus
cagugucaaucaucuucuucuucgucagccucccuuccaccgccauauugggcaacuaaaaaaggaggggggcucgugcuuuugggguguuuuccccccucaucccuugucccgacucacucgcggcuccgagacucgcgcggcggcaagguuuggagaggggcugcguucgcgggacacacgggcucgccccagccuacgcuccgacuguuugccaccuccuccugccuccuccccucccuuccccgcccuccaguacacuugaucacugaagccucgagcugcgcggcggcuggggugucccugcgccucucuuccccagaccugcgcgcuacugcggcucgggcggucgcucgccuggcucugcuccauuugacugucugugugcagucgcagaacuucgaagaggguuuugcgcuccauccguggcguuucgcuuuuguucgguuuuguuguuuauuucauuuuuuuuuuuccggagagaggcgaggcggugguccacacccgcccgaggaggaagaugucaaacgugagagugucuaacgggagcccgagccuggagcggauggacgccagacaagcggagcaccccaagccuuccgccugcagaaaucucuucggcccggucaaucaugaagaacuaacccgggacuuggagaagcacugccgggauauggaagaagcgagucagcgcaaguggaauuucgacuuucagaaucauaagccccuggagggcagauacgaguggcaggagguggagaggggcagcuugcccgaguucuacuacaggcccccgcgcccccccaagagcgccugcaaggugcuggcgcaggagagccaggaugucagcgggagccgccaggcggugccuuuaauugggucucaggcaaacucugaggaccggcauuugguggaccaaaugccugacucgucagacaauccggcuggguuagcggagcaguguccagggaugaggaagcgaccugcugcagaagguagugacucuuuggaaaacuuaaaaugucugucugucugucugucuccguaagcgccccuuuacuagacccuguucacuugcuuucuccagcguguucugcuuuagcucugggaaaucgaacuuguuugaagcuuagguuugacauacccccuauccgacugcuugcccuguuuaugauuuugaagucagaagccggagauaguaagaugugauaacuuccguagccgaacgcaucacaguuccuccccucuagccagcuguagauacgugacaaaaguucggauguuuaccaacugccuccuccuuggcugggguggggggguggggguggggauggggguggggaagagacgugggguguagaauacuccuuguguuagugggaacaaccuuauuuuguguccuuagaugcuaccggggaugacggguccaggggucguggguggagguagugaguggguuguucaucccuugggccuacuucugucagccauuguugucgauaauaaagaugguuuguguguguucucuuaaaaauuuccccuugccccccucuuagauucuucuucgcaaaacaaaagggccaacagaacagaagaaaauguuucagacgguuccccgaacgcuggcacuguggagcagacgcccaagaagcccggccuucgacgccagacguaaacagcuccgguggguuaaugaggaagaacacaaaacugacaccccaucugggcugcgcuccccggggggccugcagaccccaggacugcuggcagauuaguugccugccaggaggaauuacuuuccuugaucaaaaaaauuaacacuggggaaggcuggaaucacuugaggggacuauaaugcaguauuugcaccccaagauauuuaccuuaaaguggaaucagaaugagguucccaagcaagaacuugccaccaaggccccaaaggauagggacggucguauccuuaugaaucccacuaaaacuuaggcugggaaugacaguuuuccuuuccagucucaguucaugagaacccauuucccagagguucguuuugagccaauagccuauuuugaaccauuugaacuguagaaaaauggcaaauauauacuuacauguauguucuuaagagaaaaacuagguacccauagugcacguuugauuaggagugugaauagagcugccguggcucgaguucuuuuuaucuuuugcuuuuguuuugguuuuugguuuuuugagauaggguuucucuguguaacaaacagcucgggcuauucugggaauugcucuguagaccacgcuggcuucgaacucacagagaucuguauugucucugccuccugagugcugagauuagagguugugugccaucaccucuggguacuuuuuuauuuuuuuuuaaaguugugccuuguaugcugguaaauuuuggagagaaaggaacuucauacuuaaaaaaaaaauuagacuggaaaguucagaaguacuaaugcucccacagaauugauuuuaacccugagguuacaaagcagaaguuaaaugaacagcuagaggaagcagccuucccacacgucagcaccguaugcuaauuugcuggaacaggacgguuuggauguuuauaggggaaauggauaguagauguuaggaccaacugagaagguccaacacaaguguggauuuuuccaugugucaaaaaucucaucaccccacuugccuaauuagaguaacccagccccuaaauuuacauagauugacuauucauaugcucuaacuacuuauaauaguuuauaagcuccuuaugaagaaaaccagcauucucuauuucuaaagcccacuuauaacccagcauacaaauagaucuuaacaguuuauuauuaacuuuucagguccucauuuauugaaauuuaaaaauaaaugaaggaauauagagauggcacaggguuccagcuuguuguguuuauaaaucauaaagucaugauauaccuucuacagacauagcauuuuuucagagauggaaaauggccauuagagucacuuuccauauuauacccucuauaaaguugucgaauuggaugggaguucuuucuaacuagccaucacaccuguagcuuuaguugcuuuguguggcuucuggccuagcuuuucagaugagccgccuggauuuuuaccuggccuguucugauaaagaggcauuuauuagccaagcaaccauaagacucuagucaaaagcacucgugcagauaugcugcauaugaguaagaaauugcaauuuuguaaacauuccucgacuugguggggaggaauaauuuuauaauugcauuuccagguauuuuucaagauuacgaaaauaugcuacucugauguguuaugguuccugaauuucuuuucuuucucacccucuuugacccagauuuuauagagcgaguuucucaaccucugcacaguugacauuuugagccaaauuauucuuuguugugguaggcaguccugugcauuuuagaauguuuggcauuaucucuggccucccccacaagaugccaguagcaaucuucuucccgaagcugugacaaucagaaaugucucuuagacauuuccaaauguccccuggggcaugggaggguuucacaaaauugcccacuuguuaaggacccugacucuaauaccacacaaaacagaacaaaaauccagcaaagauaggaucggagauaccuguagucuucagaccuuuagugccuguauuuauccaucauuacugaaguauuuguuaacuaagcuagcaacaaaauaauuucuguacuuuggcaauguuacucuagugucuucucccuaauucuuuuguuucuuuugcagaauuaagaauauuuccuuguuuauuagauacaucacugcuuuaugaagcaaggaagauauacaugaaaaaauuuaaauacauaucgcugacuccauugaauggacauccuguauaagcacugagaaagcaaaaacaauaacacuaaaauuuuaggcacucuuaaaccaucugccucuaaaagcauuggauguagcauugcgcaauuagguuguuccuuauuugcuuuguuguacuaccuguguauauaguuuuuaucuuuuacucuguagcacauaaacguuagggaugggagggcaggguggggcugaggagucagcaugggggugaagaacuugcuucaauuuguagcaaggagaaaaauauuugacuugcauaaagagaagcaaccugggugggggugggggggggaaggguuugaauuccuuucuuuaaagauguagugucccuuucgguaagaauggauccuuuauuuuuaaaauaaucaaaauuugaauaauugcuacacaugguugcuauuuauuucuacaugaagcuuauucucacuuggagguucugaagauucuguuauagagcaagaaauggcuuaauuuuuuuuuuuaauuggaauuuaccaguuuauuguuuagcaguaauuaccccagguaacacugggcaaaaaucuggggugcauaauagggaauucugaauucuuagauuugauuaucccagaucauuuuugcuaagaaaaauucuuauuucuuuuuuucacagugaacauaauccuaaauccuuggauauuuuuagaagucuguaacuuuacacaaauaaugaaauaauuuuuaauucaaaguuucucacccuacuuguuaauuugcccccaaggaaaguuguuuuuuuuuuuuuuuuuuuuuuuaaggaaaaaaggacacuuguagaguaagugaaauggauacuacaucuuuaaacagcguuucuucauugccuguguaugagaaaaacuuggaagugugccuguguauauaacucuguaaagacacugaaaauuauacuaacuuauuuauguuaaaaagagauuuuuuuuuaaucuagacaauauacaagccaaaguggcauguuuugugcauuuguaaaugcuguauuggauagacuagccccccccccgccuuuguuaaauaguauggcugugcuuaaaagguugcauacugagccaaguauaauuuuuguaaugugugaaaaagaugccaauuauuguuacacaucaagcaaucaauaaagaaaacuuccguaguuauuuauugagugca

SEQ ID NO: 3437 - RNA, 1123 nt, Mus musculus
gagucugaggugggguguuuuagcugguuugauugcagguaguagggaguaggauggguggagcuuucuguuccaaaaguugccccccccccgccccgcccgcaagugccguugacagaaugcaggcgggaagcuucaguuuggguagagauguagcaucaaacauucacggauguccagggagcacgggcacacaggcugcuggccagagguacuaggaagguacaggcgggaguucgacgaggacgcaccuuccccugucuuggaaagguagacuuggggagggcgggagcggguaguuauccuagaaaugaauauuacccgucauaggaauaaaccaaccaaauacaagguguggcuauagacucuauauagagcaaaagagguguuauuucugggguuagagugucaaaauccaucaggacaaaggcagucggugucauuuucuuccuuuuuaaccuuaaaggggggggggaaccugucuguuuuccagguuugguuccccacccccccuugugaggaugagaaggggacauaaaguccccuuuugauuucugggucaggaaacucauuggaaagaguuuguuaagaucuaggaggauucaauuaguagaacaggucuaauacaagugauggcuuuuauuaauuaggauccaacuauguuuuucuuugcagugaagcuuuuaaaacgucauaauaauuaaacaguaguccuagaucagucuuucucuuuaucagggacaucucauauguauaccuuucuuugccuuugccuuuuuuuuuucuucccuuuuucuuuccuuaaaauaauuucuccugauaucuccuuucagucuguuuuagccagaagcccagccuuagccuccauuggccccugaaccaguaugccauguucuuaguuuuuuagcugucuaguucugaccuuaccucucccaguccacuaagcuccuugaccccguccauaaaccaacauguuugagcugcucuccaggcuguauucauggacucuguuagaggcucagugcuuaccucugccuuucagaggacacauccgaucagaaugagcaguccaugaggaaaaccacaucccuggaaggaggaagcuagucucagaaacaggucu

SEQ ID NO: 3438 - RNA, 1123 nt, Mus musculus
agaccuguuucugagacuagcuuccuccuuccagggaugugguuuuccucauggacugcucauucugaucggauguguccucugaaaggcagagguaagcacugagccucuaacagaguccaugaauacagccuggagagcagcucaaacauguugguuuauggacggggucaaggagcuuaguggacugggagagguaaggucagaacuagacagcuaaaaaacuaagaacauggcauacugguucaggggccaauggaggcuaaggcugggcuucuggcuaaaacagacugaaaggagauaucaggagaaauuauuuuaaggaaagaaaaagggaagaaaaaaaaaaggcaaaggcaaagaaagguauacauaugagaugucccugauaaagagaaagacugaucuaggacuacuguuuaauuauuaugacguuuuaaaagcuucacugcaaagaaaaacauaguuggauccuaauuaauaaaagccaucacuuguauuagaccuguucuacuaauugaauccuccuagaucuuaacaaacucuuuccaaugaguuuccugacccagaaaucaaaaggggacuuuauguccccuucucauccucacaaggggggguggggaaccaaaccuggaaaacagacagguuccccccccccuuuaagguuaaaaaggaagaaaaugacaccgacugccuuuguccugauggauuuugacacucuaaccccagaaauaacaccucuuuugcucuauauagagucuauagccacaccuuguauuugguugguuuauuccuaugacggguaauauucauuucuaggauaacuacccgcucccgcccuccccaagucuaccuuuccaagacaggggaaggugcguccucgucgaacucccgccuguaccuuccuaguaccucuggccagcagccugugugcccgugcucccuggacauccgugaauguuugaugcuacaucucuacccaaacugaagcuucccgccugcauucugucaacggcacuugcgggcggggcggggggggggcaacuuuuggaacagaaagcuccacccauccuacucccuacuaccugcaaucaaaccagcuaaaacaccccaccucagacuc

SEQ ID NO: 3439 - RNA, 12167 nt, Mus musculus
acagguaauaaaaauacaucuuuaaucauaauaauuauugacccacaucaggcugaaugccggcugagauaagguggcguacacaccauucuguagaagcuuuacaguuaacuacagucagcgcucuccauccgccaggccguggcuugcaggugggaaggcagaggugcagcaugaagagcacacggcacuugugucacaggugaggaaugcaagcugaagagcggccaguccugugucaacacuguaaaaguugucccauugcaaugacacugcaaucccgaggaacguucucccagcuggccgaguggucucuggacagaaucucacagcuggcgagcaggcgagcagaagucuuucuaaagcauuagcggccuuuccgcuucuucauuuugcccccagccaccuuguuccucacaccaauggcgcccuccuuaucaucaucaucuccugcauccucucgcuuccguuucuucuuuucuccgugcucccuuaacuccugcaaggcagcaaacacgaugugacugacuggaguuaacagcaacccccgugccccauccucaggucagagaaugcccgaaaaggcuaagaaucaacuccaaaugaacagaaacgcugaccucauacagagaccaaagcaccaaagugaaaugagacuggcuggcccagauguggucacaugaccugcucuggcuuuucuaggggacaaucaggcauucuguaugaauucuacuguauguguacucucuggucaaucucacuucuagaaguuuccuuuaaggaaauaagaggcuacuaggauauuuauuaagcacagcccuaguuaaaguggagaaaacaaaucaccauuguaaaccaugcuacagcaugcgauauagccaucaaaaagugauuacaugugcuggucaugguggugcacagcuguaaucccagcacuugggaggcugaagcaagaggcuggauaugaauucaagggcaaccuggacuacacaguaagugcaaggacagccugagcuauacagcaaaaccuugccucaaaaaucuaagaauaacaaaaaugucacaugguggacaggacgguaaaacuggggggaaaaaucccauggauuuauauuugcugagacauaaaaaugacagucacauauaauuaggucaguucuuacuaugccuuaaaaaccaaaaauuagcuugaugcucucaaugguucuccagagccugguuccccucuucagcuaccauuuuaauccguucuauacuuugugaaauuuuuccccaggcacagaucuggcccaaacucucacugaucccgacucagcuucagaagugcuaggaucaugguauaugucauuacaggaccaugguauaugucauuacaggaccaugguauaugucauuacaggaccaugguauaugucauuauaggaucaugguauaugucauuacaggaccaugguauaugucauuauaggaccaugguauaugucauuacaggaccaugguauaugucauuauaggaccaugguauaugucauuauaggaccaugguauaugucauuauaggaccaugguauaugucauuauaggaccaugguauaugccacuauacuuaacuacagguagcaccugugugcuugugcaugccuggcuaacuuucuuccccaccacagauagcauguuuauaaacaaaagcucacacauaaauuccacgugggcaaaaacccacagcaagucuguaucucaauuauucaaaauaagccaacaaaggcgaaguauccaccacacuucagaguucucuccaggaaggacacagcauuccaagguuuccucuagaaucuucucucaugcugcuacugcuacuaccccuaguaguacccuagacucgugguucacaugagcuugccugguguucagaacacacagaagguauucaagguauucaagggagggacugguucugagaggugaggcagauacccaagcucacuguaaccacagcuagucuucugaccuugagauugaccuuuggggggaggcauaguggaggauauggccagccuguucagacuacacgaacccagauucaguggugaauuucccauaagcccucaacuuuugcuagcucauuucaacucuggacaaaaccucaagugucugaugggguaaggccaucagagacugcuaagagcagacgcagcguaccauccgggcaaaccucugggccucauucacacguuccgugagcaucaugaccuccucauccugcgucggaaagacaggcagcuucuuuccaaucaagugcucgaugcgcuggaagaguuccacgucauaccugaggaaggacaguuggccuggcuuugcugagccgcuaauguggcaccuuccacuggcuagugauccuuugugcccggacaacugggaaauuacccaugguaugguuuacucacagaaaacacuagguaucccacacucaaucauacgcagcaacacuaauuagauuugguggguuguagaaaaaagaagaggacacgaaggggagaggggauauuuggggaaauaugaucaagauauauuuuauacauguaugaaacuggcaaagaguaagcuuuuaaaaugggccugggcagauggcuugcugcuuaagagcacugacugcucuucuaaagaccaugguucaauucccgucacccacauggcaguucauaacugucucuaacuccgggcccuggggaaucugacuucuucuagccucugcaggcacaagacauucaugugguacacacacaggcauacaugcaggcaaaacacccacacacauaaaaaauuuuaaauaagaaagucagacacaguuauucuagcccaucggaauuaagggaaacaaaggucaccgcucccaguucucguucuccaacaagcagcagcgccauuguguuucuguauggcacaacgugauguaugaaaaccagguaaccacacacagacagacagacagacagacacacacacacacagagccagaagagagucuguacaacagcacugcaccaggcagaaggugcagucuguugcucaguccccgugcugauuuacucacuguguuacaaaaguaauggccuucccagagcgcccagcucucgcgguucguccaacucgauggauauaauccuggaacauaaaagguaaauaaauucacaucugagcaaagaagggaugugugcaaaguccugccacaaaccucucaaagaaaacacaugccuuugaaacauggcggacuuggccugggaaauuugcugagaaaucuacuucuuuguuuauaacagaguuucucuguguaacgguccuggcuguccuggaacuugcuuuguggagcaugcuagccuugaacucacagaaauucauuugucucugccucccaaauguuguggugaaagguguuuaguaucaccccacccggccuccuccuccuccuccucuuuuuucaaaacauuuucauagcacaaaauucaucuaaugccugcuuucucuuauacaaagacaaaccuacaauacccauccacaggauuauggcaacacugaauaaagagaaacccuggcuggcagcuggagagauaguucagugguuaagagcacugacugcucuuucacagguccugagcuuaauucccagcaaccacauggcagcucacaacuaacuguacuagaaucugcuucccgcuucagguaugcaugaagacacagcacucauauacauaaaauacaugaauaaauaaaucaagacagacagacagacaugggcucuaggaguccuacacaauuaucugcaugccgccacgucucuacacguuaguuccuauuuacagaccagggcuagaaaggaaugcacaaucuuaggaguugcugugaauaucaagagagagcgacuuaucuguaagaacucaaugaagagccaagugaagcagaggcccaugggguccugccucuccccgggaacauuugguaacgccugcaacacuuuugguugucacagcuagaagagugugagacacugucuaguagacucaaggaauguuaagcauauuauacacaaacaacucccaagacaaagaauccaccaguccaaaugcuaaccgugccaagacugagaagugccgagacucuaagcagcagaagcuguguuugcagagcagcgagcaggucagcaucugcugcguuugcccccuuagccuguguccagugaugcucucugcauaucuucacacuaacaucugcuaaugcuguaaacaggcaugugcaaacggugagaaugaaucagucaagagcuuucucaguuguugcuaggagaccgggccucuggcagcccaggcuagccuuacacuuccuacgucuuugaggaugacuuuaaaguccugaucuuccuccuuguaccucuugagugcugggauuacagaccugugcuaccacacccaguuuacuggugcuacagcucaagcccucagcuuacgcuaaguggucuaucaaaugagcucuaccucaucacuuucucaguuucugauacugaacuaauagaggauaaaauacugcacuauaacuaaggaaaaacaaacaacaaaacacauuauuuagcaagcaaacuucagaacuagaaagucuaagcaacagcaggacucaccuuagaaugagucggaaugucaaaauugaccacuacauccacaugggguauguccagaccucugcuggcgacaucagucgcuagaagaauggaccucgccuuagccuuaaacuuauuaagggauccgaggcgcuugcucugagaagaagaaaugagaaacuugaauucugaaaaaugaaagaaucuuuauauacaggacauggaagacagacaaaauaaacaagaagaaauuuauuuuuauuuuuuuauacuuuuucccuucuaaguccaggcuggggcuucauagucaaaacaaguauggaaacaacaaaaaauacuuaagaccagagagucaacacuguuacuacaucaaaagcuuacaagccagacaagugccugugaaauguucuuuuguguggauguauauuuauguguauacucggugcacacaguaugcacaugaacacgcaugcagaggccagaggguguugugacaaucuuuuucucuuugagaccucuuuccugaggauggagagaugucucagugauuugcaggagauuugguucccagcucccacaguuccagcucacugaccugaagcucacugguuaggcuaaguuggcugucgcacgugucaccacacccagcuuuggauguuucuagggcucaaacucagguccucauguuugcacggaagguacuuuaccaaucgagccaccucagcaggcccaugugaccuacuccagucuuaccacacgcugccugaacaugagaguguaagggcagagaguguaaggcaacacacagagcacacaagaccaggaugugcaaggagcacggcugcccaugaaccaggagcgugcaacuggcucuggcgccgucucugcucacucaucuaccgacacaggguuugcuuccuguaaagaacucuuaccugacucaucuguccauggagggggauggcagugaacccgagauuucggagcagcaaagcuguucucugaguguuguuacaggugcugcagaauaucauaaaggaguuuccagccaguucauugagaauauaaaccagguagguauccuaaaaucacaaaacaagggauauggggacagcacgccuucuguggucaggcgcagacacccauccgugugcugguguugacaguguggagaaaauaccaagcagagguuccuccucugggauguauagugggauguguagagccaagacugcucccugacaggcccacucuggagaauagcuaagcccacccguguauacaguaaaacaaacaugcugacuuucccgguccuuguuggcacaacuaucagagggcacagcccaccccaucccagcuucuccaugccuguacuuccugauugccaaacugccccaccuaaggucaaucccucaucugugcagguguggcaggucucacaguauaauacaaacuggccucagacuuacgguaaggcccaggcuggcacugaaccuacagugugaccuuccugcuucagguucccagugcuggggacacagcaugcacugccacaccugacuagcuacugugcgcucugugaaccaagcgcccuguaaccccauuacaucaguggucacacauaagaucugcacucgacaaccacucaaggucuuuccaaaguaaccgugaacuaagcagaggaaggaaaucaaccgcagggguggccuggggagaaacccuaucauuuuaucaggacuuguacucugcuuuaacgccgugaauuccuggcauguucacuuuaucugugauaagccuaagcuggccacgcagcccucagcggguggagagcugacauacucucagaugcuucggugagggcaggaauggcagcaaugacaaagucaacacuuuaccuugaauuucgagggaauaaaaagguaauacugcugcaguuucuccacagucugguacuuagaggacacagcacauuucacaggguucuuaagagcugcacgcugaaguuuuuguaccuaaagaaagaaaacagaauaacacaucaauuccuaaaggcucaauguucuuacuuucaugugucuucauuaucguucuaauacauagauauagggguguguguauggugcacguacacacuacacauuaaacccagaacccccccaaguucaaccacagauuuuccuauuagcuacaacucgaacccuaguuuuacuuucuucuuugaggcagggucucccuacggugcccagucuggucgugaacuuacuuugugguccacucaggccuuaaacuugucauccaccugccucggccucccaaauagcugggauacucauguaucaauuccuuucuuuuuuuuuuuaauuuuugguuuuggguagggcuucaccauauggagcagccuggcccggaacuggcgauugccugcucguguuugugugucauuucuuauagaggaagcaggagcccaagcaaaccucaccuucuuggucaugguggcagaaaagagaaauguuuuccgaucucggggaaucacuuugaggaucuugucaaccuggagcacacaggaaagaaugccagugacauuuagacuagaugucuauagauucucugcaugguauaggggaugucgggcgacgagacaggacuacugagaaaccaaacccuggagguuuaaggacuuaaaacucaauucagauuuucagguagaauugacugaauauuuacacuuugauacuagaccagacaacacugucaagcagcucaggaaagauggugaaacccccagguauacagagcucgcucagcaaaugagacagaagugcaggguuaaggccucaccucucaggucagccaggaccacauucuaaaggugagacgccccaagccugcagggaaacagugggcaugaugcugcucucacugaggucgacacagagcucuacagagauggggcccaaggaaccaaaaccagugucaaagagaggaccagagaagcucuagggacacugcuguuauaaacucaccucuaggcugggcagaguggcacaugccuuuaaucccagcacuugggaggcagagacagguggaucucugugaguucaaggccagucuggucuacacaggacagccagggcuguuagagagaaacccuaucucaaaaaaacaaacaacaaacaaacaaaaaaaacucaccucugucucaaaauccauguucaguauccggucugcuucauccaugaccaaguacuuaagagcucuuaaguugaagccuuugguauuuuccaaguggucaaucagucggccaggaguagcuaccaagaaagguuaaggacccaaagguaagaaaaucaucuucuucccagaaaacaaugaagacacggaagagucagcagagucacagguccacuccccaggugucacccaacauuuuagacugucuccaacccauauggucauggugguauuuaccugugucagugacucaccuauuacuauaugugguuuuuuggccaaugcuagugacugagacauugaaucaauuccaccaacaaugacagcuacagaaacaaagcaaacacagaaccuucucagugagcaccuucaagccaauauuagauuucuacuuacaucuguccacccacucccaaggcuaaaccacaacaccagcuccuuaagucaauaccgugcccuccugcucuccuuccccacuugggauggcacacagggcucuguccugcuuaggcacuuaccacacugcacuccaauagaugaccccagggccucgaacugcucagagaucugaaaggccaacucucgaguaggggugaggaccagggcgaacagucgcuggggcgucuccagcagggcauucaggaugggcaaagcaaaggcaccuguuuucccagaucccguuucugccaacccaauaauaucacgaccugcaagaaacaaaacaaaacucuuuuacaaagaaaggcacucugagcuccuucaguguuuucuauacggacacaaugcugggcacaggcucucccucgucaauuagaauaaacugaauaaacaaaaagggcacggccucuacccuauauuagcuaaaauucaguaacaggccagagguagccugugccuuuaaucucagcacucaggaggcagaggcaggcaaucucuaaguucaaggacagccugaucuacggagugaguucaaggauagccaaggcuacaccgagaaacccugucucaaaacaaaacaaaaaaguuuaacuuaaggcuaauuucuaauucuaaaauuguuuuauguggucuguguguguguguuuuuccauguauaacuguggcaagucagaagacaacguguaggacuccguucucuacuucuaccaugugggucccagaaaucaaacucagcaguaagagccuuuaaccacugagcgaucuuaccaacacacauguuuaauuagguaaggcccuuaauacaggccccuagaaaagauaaaaaguacauaaaggggaaugccaggcuaacagagaucuacaaauucuacauggaaguaagcaaaaggcaggacagcuauuccugcaugaggacagagggccggggcucuaagaaacaguguaugacggggcuaugugaagccccaccugggcugaauggcaggguauuaaacagguaggaaugaggcuaggaaggggcucauaaaccccuaauggauccugauaaacagggaauuucacaggugguguuauucuucucgaagauaaacccagaggaggcaaggagcugaacgguccacgugauggugcacagcuguagucccaccuacaugggaggcucagagaaagaggagcacucaggccuaggcguuugaagccagccuggacagcacagcaaggacccaucucaaaaguaaaagcgaacaaaaacugguugaaaggaacguggugggugacaucaauuuuaguaugggaaacugaaaagccaaaaacggagacaggaacuauagaaaaaucaguucugggaggaaguuaaugauucuggauacagagaacuucagguucagagagagagagcgagagcuacaagcuacacaggauauacuuaugccagcaggccuucagcucaucuuccuaaagaauggcggcaugaaauaccccugguugccaaaacuacucgugacccaugagcaucuucauaaccucguuccucccauucacacaaaagcccugaauuuccacucgguucgcaucccugaggggcauacacaucagagguacaaucuaugaaggaggggcuaugucccacaucugaaaauucuucuucuguguguuugcuuugguuuuuuuuuuuuuuugugacagggcuucucuguguaguccuggcugcucuggaacucgcuguguagaccaggcuagccucaaauuuagaaaucugccaagcccugccuccugagugcugggauuaaaggcacgcaccaccaccaccugguuugacaccugaaaauucuaauucaguagguccaaguuguuuuagaauaaggaaauagaggauggugauagaaucgcuauuauaaagccaaaggaaagaaacaguagcuaaagagacaggcuaguaaaauacuguguugaaaugaaaagauaacuucaagaaaggucugaucaaggguguuggaagauacagaauaagcaagauggauuuucuuucugguuuuuuuuuuggggggggggcguuguuuguuuguucuuugucuuaaagacaaaguguuuuccuacuugcuuaguagaccaggcuagccccaaacucucagaaauccuccugucucugccaauggagugcugggauuaaaggugugcaccaccacgccuagcuuuaugguggauucuuuuuuuuuuuuuuccucuuuuuuuuuuuuaauuacguauuuuccucaauuacauuuccaaugcuaucccaaaagccucccacacccucccccccccacuccccuacccacccauucccauuuuuuggcccuggcguuccccuguacuggggcauauaaaguuugccuguccagugggccucucuuuccagugauggccgacuacggcaucuuuugauacauaugcagcuagagucaagagcuccgggguacugguuaguucauaauguugcaccuacaggguugcagaucucuuuagcuccuuguauacuuucucuagcuccuccauuggggguccugugauccauccaauagcugacucugagcauccaccuauguguuugcuaggccccggcauagucucacaagagacggcuauaucacgguccuugcaccaaacgcuugcuaguguaugcaauggugucaucguuuggaggcuaauuaugggucucuugaugguccauuguauggauucuuaauucucaucucuuagagcuaacagucaggaucugccaugcaaauucagacaguagagugcucuagggguuuaaaacugucgucccaccauucauuaacgucagugucuaccucccaaaugguacaggcuugugccaccgugaucacaccuggcuuuauauuuauuugaagcaaggucucugccuccucgguguuaagaacucaaguaguccugccauacccagggagagauuauaucuuuauuucacuuggaauuugacagcaauagcucuuagaagcaacacaaaaacugaauauaaugccacacuggcucuguacuagccugcauauuuaauuccaaccuaccuugcaaggccaaaggaauagcuucgaucuggaucuuggugggcuuugcccaucccaacuggucacaagcuucacacaauacauccguaacacccuuugaauucagaaaaccauacuuuagcaaagaauacauccucaccuuuaucagagccauccuccuggugauacguagcccuuugcacuuuacauaacuguacaucucagacccugcuuuauaugaacacuaugggacagcgccuugagacaauuucucuucaccaggggcugcugucaacucuuugcauguauuaucucauuuaacccgucaaaucaguuccgaccaguggcuagcuauuauucuaccaagugccucacguguauaaagugaggcgcacaccauaacaacuugccucuuguaaggaggucacgcgugacccuagauaacauaaggcucuacaguaacuggggagaaaaacaaacgggggcucucacgacccagcggcauccuacaaggcaaaugcacccgagggagcgugaagagaccccgaguuucugacagccugaagauagcaugagcuaggccccaagguguuuuuacacaccaccggcugggauaugaaguacccaaacccugggugagccuaaacgccaacaucacaaaauaaauaccagcaucacccauucucaccaggucuuuaaauguuuucguuuccuccucuuccgcagcugucugaagggcuccagagggggaaucggguuccucguccgccgccaucuugcucgugggcuccggaaguggggccgag

SEQ ID NO: 3440 - RNA, 19061 nt, Mus musculus
accgcuuugcgcggccaaggcgggauccuugucccaggaccugcccaguagccagggguugagcgcucucgccuuucacgcgugagucgcaaguucucgcuucaccccgagcgccgcggcgcccagguaagagggguuuacccaggagcgcgcuccgggccccaguuuuaaauccggagaguggggcguggggagccuuggggaaggagaacugagacaguacagcccgugauggacuacagcuggcuaggagaaacagaugaaaccgagaaaggaauguccuuaacuucucucaccucugaauguguucucugggcuaaaacagaggggaaagaccaaucagcaaacaguuagaaacuguagcacaggccuguaauucugcaccugggagguagaugcagaagaaucaagaguucaaggccagccuugacucuacugugaguuccuggucagccugggcuauauaagucucugucuccagauacaaaacaguaguuuaaaauaccaauauuaaaagagagguccgucuugaacuguacuaggccccucccacagguucuauguagccacugguggguggaagaugggcuaugaugcuuucaacucccaucugaguuucaagggucugugaaugaauagagggguagagggagaggaugccagccgcuuccuucccaaaggagcgaaggccguggaggucaggaagugacucaccucaacgcccccccccccuucucaugugcguguuguuccuccaccccaucccuuacuuuuccuguugccccagucucuaagacccugucucucuuuaacaagagggggugaaaagcuugucuucccggaggagaagagacacaggcaggaggaggcuggcagaucacauugaauggaaagacaggaaacagcaguuguuuuuuuuuuuuguuguuguuuuguuguuguuguuuuuuuuuguuuguuuguuuuuuuuagacauucaggcuggccucgagcuuguaaccaccauucugccucaguuugcagaguguugggauaacagguaucggucucaugguagaaggcucccaaauggcaaaagccugccuggaagcagguaauugaaggaccaucaccgugccugccugccuuuucuccaggcaagugucugaggcuuuuguugaagccuggugaaagguucucuggaaacagucucuucuuugcucuuuacugaaggagaauucuuuagccacuucagauacaauggccugggaagguggaggggagggugaggccaacacuucacccuuagggguuuuuguacuggccaucacugauagagagaaggaaggggaggggaggaaggguugggaggugccuuaggaucaaagagggaauggagaggcuggcccccaggcccaaagggaauggccacagcugucucugacuucccaagaaaaggucucuaccuggcuccaggcagcccuguguuuccugguucugcagucauuuauccagcagccaccugccgccagguccuuaugcugaggagucguaggcaagcgucuuuucuguguguagguccugccugucuguaguugcacaguauccguaagcagcagguugaaaaaaaugugcgccuucauuccauucuugagagguaauugaggauaacagagugugaagaggaauguggauuggggauuucugcucuuucugaagauccacagagagcaggggcagugggugggggcaaacagaacaguuuuucacuugaggggaucagagcaacgcuggcuuuuguuuguuugagugcucucucucucugucucuuucugucugucugucucugucucugugugucucucugucucuuugccucuguccucucugacucucucucucugucacugacucugugugauugucucucugucucuguuucucuuugucucugugucuuucugucugucugucugucucugacucugacucugugugucucucugucugccugacugucucugugucucucuuuguugcugugccucugucucccuggugugaacacgccacacugcacaucugguggucaaaggacaacuugagggaauuaauggugucuugugugaggaacuuggguccuuagacuuggcagcaaacaccuuuaccauugagccaucucgcccauugguguuacccuuuuaggaaagggacucagguaaccauggcugaccuggaauucacugugcacacgaggcugccccagucagaucuacuucugguuucugagugauggaauuacaggccugagcuacccucugaaagcccaguguuugcauuuuuauugcuccccuaccaccuuuuuucuuuuugagucgagguuucuuugugacccugaccagcuuguaacccacgauauagccuggcuggccugaacucuugcaacucacucuauggccgggguuggccugaacucugcuucccaagagcugagacucaggcaugcucuaccaugcccaccuuauccuuacuuuuauagccugccuccuucccuucccuucccuucccuucccuucccuucccuucccuucccuucccuucccuucccuucccuucccuccccuccccuccccuccccucccuucuccuucuccuuccuuccuuccuuccuuccuuccuuccuuccuuccuucgaacaaggcuugauccauugcccuggaguauuuuaaucucacaggcucaagugcuucuccucuuucacaucucaaguggcuggagugcaggugugacccaaggcacggaaucuguauguuuauuuuagaauuucagaucacucuguucuaaacugcacucaguuuuuggcaaacaugugugaccauuuggauagauuccaucugauagagaagggguagcaacuauggucuguuguccaaaguggcccauacguucguuuucuuccuucuuaaugacgaguuucauggggaucuauuaaaacucauuugcuuuuguaucauuuguggcuacauucaaguuacaaguucauggcuucuaaaagccccugcccggggcaugguggggcaugccuuuaaucucagcacuccagaggcagaggcagguggguuucugaguucgaggccagccuggucuacagagugaguuccaggacagccagggcuauacagagaaacccugucucgaaaaaccagccaaccaauaaauaaauaaauaaauaaauaaauaaauaaauaaauaaauaaauaaauaguaaaagccccugcuacuuauagcugcuauacaaagugcuugacaagugcagauucugagagugugaauucuuugguuaauaauggagauaugauugguaugaagauagacaguguuucugguaaaguauccagaaaacauucucgugauuuugcugguuauuuauuuuauguauggcaucugccgaggacuaauuuaaaaaagucuauaggggcugaggagaugucucaguggguaagagagagugcuugaugcguagguaugaggaugagaguuaggaucaugaguuagcacccguguaaaacccaggccauggcagcagauggccaugcauggaugcagaggcaaacagaucccgggaguucccuagccagccaguccaagaaaacagugagcuuccuguacagagagacucugucccaagggaagagagccauagaggaggacguuuaguguccuucucuggcuucugcauguuagcacacagccacacauacaugacguacauacauuuuaacgucuucucauuaugaugcuuuucuucuuuaccgugguggaucucggauucauuuuguuuuguuggucuggguuuuaccuugaacuugcugggagcccaggugugugccaucacacagugauuucuaguauuuuauugcacucucucaugaaagucuacuuuauaguacagcuuuguuuggaguaagaguaagauggccccacucucaggcacuguaugaaaguggaaaauggcccugagccucguucucaaacuugucuccgucuguuuuggugccaugaugaugaugaugauggugguggugguggugaugaugaugaugguuuucuucccaccaaucacugccuagagacucaacucaguuauguuaguaaagcauuauucacaggacgcugccaugaugugucaugguuaugugaugggaacuggggugguuacccguacaggggaucccgcagagguacuucccaccuaacuaauccuuuuucagcugcagaaacauuuuugugggacuccucccuuggaagaacucagccuggauaaacguaggagggucagaaaaaugugcacagauucauuuuuaagaucucuuacuccuuuagcugggugugggaacucauggaugagagcccauuaccugggagacggugucaggagggucaggaguuugaggccagcccuggugacacgagaaugagacucugucucaaauaaauaaaucauccuauuacucacacuugaggaaguauucggcagucaaucuuaguccaaaauacuugcucagaaucacugugcagaaccacauacagagagagaugccaacagacaggggacucgaucuguguccucacggagcuuguuagcuacugguguuaacauauagucacuaccaggcauacaggaaaaugaguacuucacugucagggcuaggaagagaccgaugcguuuagaaugaggugggauuaaccauacugugauacaaguucccaguagagguuauguugagaccaagcuuugaagaaauacaucauuauugugagcagaagggaaggaaguaugauuuugucugagaaggccuuuaacagccccaaauuccuauuuguauagaaaacacucuuggaaugcugggugugguaguguauaccaggaauccuggcacucaagagcuggaggcaggaggauugugauuuugaggucaguuuagguuacuuacauauucagacccagucuuuaaaaaaaaaagaaaggccugcuggugguggcacacaucuuuauuuaaucucagcacuugagaggcagaagcagguagaucucuguguuccaggcuagccugguuuacagauagaaucaggauagccagggcuacauagagagacccugucuuuaaaaaccaaaaagaaaaagggaaaaaaaaggaagcaagggagggagggagggagggagggagggagagagagagagagagagagagagagagagagagagagagaaaggaagaaagaaggaaagaaaaaggaggagagaaaggggcuggagagauggcucagcuguuauaagcacuuguucuucuagaggaccugagcucaguucccagaacgcaaugaggucauaaccaacuguaacuccagcuccaggggauucaacagauacccucauuuggccuccgugagcaccuguauaugugugugucacacacacacacacacacacacacacacacacacacacacacacacacacaccacaguuuaaauuuuuugcuuaaaugaaaugaaagcgaucacuuggagaauuugcaugugucaagccccauuaaaaaacucacauagccuuggacaaagacuuugauuucuuuuuggcuuaguuuucucagcugucaagggagugauaaaauaccagauggcaccucacaucuguaaucccgacucuugaagguagagucagaaagaucaaaauguucaagguuauccucugcuacauagcgaguccaaggccaaccugggccacaucgagaccuuauuuaaaaacaaauagacauuaaagugggacaggaggauuaaaugaaacaguacauggcucaauaaaauuuugcuaagguuugagcucuuacuauuccuauauugcuucgcuugcauguccugcauguuucugcucccuguccugggacaauggcaaccccuaguugcccuugagaguuuaggaauugaccugaccucugcccaugcucggggccuuucucuccuaccuccguaacaaccucuaacaaccucacaccucugguuaucucuucccccucuucucccagccuuccucacaucucaguccccucauccugguaggcuaggucacgguugcacgguugccgaagugcacguucucagcacuuccugacugccuacguggacagcuggucagucaccugacacacucuguuggcucucuaaggguggcagccacacuuggggucugugggauuuguccacuuggcgcugguuggugaggagcacugacugcacgaagucaguucuggagacaucucaacagucagaccuggacacuuugauagagcagcaguucucaaccuguggaucucccccucccccagccuuugggggagggggagugacucuuucacaggggucacacauccugcaugucaaugaaugcauuacaaucaauagcaaaagcaagacuacgguuuugaaguagcagcgcaguacuuuuaugguugggggucaccacaacaugaggaacuguguuaaagugucacagcauuaggaaccgcugguggagagucugugagaugcuggguaagguagaaggcucuggagaccuugauggugacccagaggaaauaaaucaaggaugagguguuugcuaagaaggcucucuccccauccucggcccucucaaaagaaaucuguguauuuuaagauagguguauuuuuauuauuuccaguuguggauuugcguguauaggggacuuuucacacaccugugucuuuucuuugucuuuuuuucuuccuguuuagauaggcucauuuauguaccccaggcuuggcuugaacucagagaucugacugccccucugccuccugcugguuugcaaagcagucaccaucaugccuggccucauugcugugcuuauucacuucccucccaggcuucccuccauagauauaauuuuagaaacuaucuuuuaaguaucaccaucauugucaucaucauuuuauuuguuugcuuuuauuuucgagacagggcuuuucucuguguagcucuggcuguccuagaacuuucucuguagaccagguuagccucaaacucacagagaucuuccugcuucuaccuccugaguacugggauuaaacaugugggcccacaccacucauuuuuuuuuuaagauuuauuuauuuauuuauuuauuuauuuauuuauuuauuuauuuauuacacuguagcugucuuccaacacaccagaagagggcaucagaucucauuacgggugauuguaagccaccaugugguugcugggauuugaacucaagcccuuuggaagagcagucagcauuuuaacugcugaaccaucucuccagccccaccagucagauuuuaauuaauuuuuuugcacaggaucucauuaaguuucccaggcuguccuuggauuugcuauguaguccaggcagaccucauacuugugauccuuuugcaaguacaggaucaucggcaugggccuccaagcccagcugaaauguagaauuaugaauacaucuuuccucuauggcacuggacuuguaaguucaucacuaaaaacaagugugcauguguaaguggguacacacacuucaggaugaggccagauggcauccuuggguguugaaccugccuucuacuuucuuugaggcagggucuguuguucaucguugcauaugucagacuagauuguccagagauucuccugccucccauaucccugggauagacccacugguagaagcccuggggugacagggacucacuguccuuuuugcuuuaacuggguucuggagacucaaacucaggucuuuauacuuacauggcaagcaccuuauccacuuacugggccuuagcuuuauuucuuaagaauuaacuuauaaauauauuuuagaguauuaggugagauaauguguaagaacacagaaaggggagaaugugugugaagcauagacgcucagcaucgugccgacccaggguguggguagaugucauuaauuccucaugauaaugugacuauuguuacuauggcugaauuuagagagaaaauggagaugucaccaagucacaagguggcagggccgagaucuugaugucaccccugggacaggcacugugcucaauucugaugacagagugucuuucagcuuugagcugucucagcuuugagcugucucagcuccucaacaagcucacuuaugagauccgcuagccagggccauguagcggcagcuuccgggucuaagccugugagcuccaucaccacugugcugaagaggagucuggaaguggcggacagaagccaggagcuucucagaugcuguccuuugucuuugcacaccagucagugcuacacaccaaagccaugccuagggcuagcauucuuggcagagcuuugacuuuguccccagucuccuaggccaucuccgcccucccacucauccuuaggccaguuuuggauugguuagaaguucaugauccauuuugcagugacaggagguggcauaugggaaagaagaugggacugggacagagagauguggaagcugucggcauggaacugcccagugggcgagcagagaagcugcccaagggcucagcccccugcuucagcagcgagucccuguuucauagcagagaaaucagguucagagaggcuagugaccugguccauacauacauugugucccugaaacccacugaucccaguuaccucucugauugcugugaccagagacucgucaagagggagcaaggguugacaguuugaggggcuguagcccuucacaauggagaaggcacagugacaggaucgugagugguugaucacuuugcuucuaucaacaggaagcagaguggacaggaaauuuggcugggcuaagagaucuacaagcucgccugcaguggcccacuuuuacaggcaggccccgccaagugugcaaacacaugagcacgcccacgaggaacauuuuguacucacaccauucuguaugugaaggugaacagagggcuugggguugagucagcaggagacucccuuccagucuccccguccccuucucccccuccagguccccacccuuacccugcaauuguagguuugucuguuccaccuuccucucuugcccugacucauuccaagaggauuuuuaaggcacuuccaaguaauuuccuguccugcagucucaggccuguaauccaagcacucaggaagcugaggcaggaggauagccaggagucuaggccagccucagcuacaguaagaccuauuucauaagacaaacaggcugggccagggagauggcucaguggguaaagguguuuguggcuaagccugacagugugaguucgauuccaggaccugcaugguggaaggagagaacugacuccugaaaguuguccucugacaugugugugugugcguguguguguacacauggccuccuugcuccaaauaagugagugaacaaacaaauaagugugaaaccaaugaacaaacaaacaagaaaacagcucuagaccaaagugaggaaccuggcuuccacugcuuuccugggcuccaucucucugcaggaccauauuccgaggagauuuuccgugugcccuugcuucuuagugaguuuuguuuuccucugaccaaauccaaaguacuucagacgcuuuuagacuugcugagcaaccccagucaucuggggagaggguggaggaugguuaauaggugaauuacauuggugauucccccaaaauuaaucacccacaaacaaaauacucacuaagacauuuugcuucuuguugcugcuuggggugaugugggugugaucccaggguuuuggagagagagcuaggaggaugaaguuugaugcuagucugggcuccaggagacccugucucaaaacaagacaaaacaaaacaaaacaaaacaaaacacaaaacaaaacaaaacaaccaaaaaaaaaaaaaaaaaccaaaucagggcuugcuaucacccuguugugaaaggggaggaguuccugaggcucgacccacaccucuaaggaauuguauguaguuacugguugguagggcugagguguguguggggggggggcgcggggggggucggcauuuucuucaauaaccacagcauguuucuauaagcagcccugaugaaauacauugggucauuaaaaaccaaacaaaacaaagcauaaaggccuucugaaagguuguaggguuggggguagggcauauaccuagcaugagguuacacacacacacacacacacacacacacacacacacacacacacacacacacgacuaacuggaugguugcuugauauuuaaaacacacacugccaauugacugcccuuauugagcacuggucuugggagguuccaggcaugacccacuccugcacagccgcagugaagcuaggggccgaggccuuguguccuuuuguucagggcugcaacuuucuuuuaggccagaggucacugaucucugucaagguuuagcgucauuggguucagaauccuuccuaaacaucaacuaauuuugauuauuaacagcugcuugacaacagaaccuugaggcuuaaagugagugacagucacaaggaggaucagagaaugggcuggggacagcaucuagccuggggcuggggguggguagacuggggacgaugagggggagcuccagcuugucucacagugaugguccucggcuugauugauggcuguuggcuugguggugguuguggcugggagugcagagaggagaggccuuuuaugguagauagacuagacaguggcucuauaggcaaaguccuucuuuauggcucuucacagugggagaggccgaacaaaagaggcagucuguguugucaugguggaaagugaauucauaaacccaugccccacuucucagggugggccugagauuaaauaccuuuugcagggaggaguaucuaggaaguuaagccuauugguaacacccuccaggccucuagguaccucauuugcaugcagaacucuguauugagccuacuugguuggucacauuucuuuuccuauugucuuggucugagaugguagggaugccuuaccuacauguggaagggcuuggguguugcccuuagugacugaaggccacaaaucuauagagggcugcagcuauaggugacuggggccuggugccugggucucugggacuucaagccuuuggcucaaccuucccagucuuccuuucauggucuaccuccucccucgcacaggauagcuucuaacucaguauguagcagaggcuggccuugaacuccuguucuuccuacuuccaacuucuaaaguccaguguaucuuaagcaguugugcuauuugucucauugacauuaaacaauuuaaagucaacaaaauacgggauauaucagauccccuucuguucuacuauaagcauuuccuucaaagucccauuagauuuuuauuuuauuagauauuucuuuauuuacguuucaaauguaaucccuuucucagucagcccccacccccuauuccaucccucuucccccugcuucuaugaggguguucccccucccaucuacuuccaccucucugcccuggcauucccccacacuggggcaucaagcuuucacaggaccaagggccuuuccucccacugaugccugacaaggcuguccucugcuacacaugcggcuggagccaugggucccuccauguguguacuccuugguuggugguuuaaucccugggagcucugggggaucugguugguaggguuuucuuuuuguuuuguuuuguuuuuguuuuuuuguuuuuaauaaugacggcuugaccuguaggauucuaagcuaugucuggaauaggcuucaugccacaauauccuaaaaguuguuguauuugaauggacaugugugucugagcaucaucaggucuagucuguaaaggcaucucucagacagucaucaucuuuaauaaacuugcaaucaucccucagauaucaaggccaaaguccauuagaaguccaaacaugcauaaacuguaugauguaucaacauguguacauaucccaauugcuccaaauucuauaaaauaaaacauaaucuauuguguggcauaguauuaaguuagcagcaguaacagaaucuagacucuuaauucaauauauuguaucucuuugggcugacgguccaguuucucaagccccuguggaguuuuccugucuagaacuauguuuuuuugauguuauugggaguuccagauuggauuccucugaggguuuccuauuuugauauaaagagucuuucaaccuauguauuaugaucgcuaaucuaguaucuauucuuagucucuucuuucuccaagucugucuuauucugaucuuucccagagaaggcguacaaaauuguaaucauuggaaaaacagccauuuguauccugauaaaaacaaaacaaaacaaaaaacccaaaccagaauuaaaucaaaugagauuaguagaguuaacugggaaguaugggauucauucccucuucuuauugguccuuagaguuaucgcaggugguaagaagaguuagcuuugcgggguauagguguguagaugugaaugugugggugucgguggggguaagguugggggauggggccuaugaguuuaaucagaguuaugcacagaagcaugggagcuuaccaguagcuauaccacagaagaaaaaggcuuucccuccccagcaacccguagacucccagagaagagaaaauccugagccccaccccucgguuaguuucaauguaacaaguuuaaaaguaagacugacuaaacacaaucccauuuuuguccucugucucagaggcuugcuuggucccuaauuuugcuucuuccuuuuaaaugcaggaccaaccagaaugacuacuccuagagcugccccuagcgguugccgcucagaccuggauuccagguaccacagacuuugugaccuggcggaaggcuggggcaucgcguuggaaacacuggcugccgucggggcuguggcuaccguggcuugcauguuugcacucguuuuccucaucugcaaagugcaggacuccaacaaaagaaagaugcuccccgcccaguuccucuuccuccugggagugcuaggggucuuuggccucaccuucgccuucaucaucaagcuggauggggccacaggacccacgcgcuucuuccucuucggaguccucuucgccaucugcuucucuugccuccuggcccacgcuuucaacuugaucaagcugguccgagggaggaagccccugucguggcuugugauccucagccuggcggugggcuucagccugguccaggacgucauugccauugaauaccugguccucaccaugaacaggaccaacgucaaugucuuuucugagcugccugcuccucggcgcaaugaggauuucgucaugcuccucauuuacgugcucgucuugauggugcugaccuucuucgcauccuucuugguuuucuguggauccuucucuggcuggaagagacacggguuccacauaugcuucaccucguuccucuccauugccaucuggguggccuggaucguucugcuccugauucccgacauugaccggaaaugggaugauaccauucucagcacagccuugguggccaacggcuggguuuuccuggcguuuuauaucuugcccgaguuucgacagcucccaaggcaacggagccccacugauuacccaguugaagaugcuuuuuguaaaccucagcucaugaagcagagcuaugguguggagaacagagccuacucccaagaggaaaucacccaagguauaauugaaggggccuugguguaaaaauggggugagaaguugggcgugguggugcaaguacuugugggcaaauaugcaauaucacacauagcaaaugcuaugugguaucacacauagcaaaaggcucuuucccaacugcccugaugucucccucucuuggucuuaauuguacuauaaucccauccaaggucccuagagcuucccuguaaucccaguaauggaaaaggagacuaaagacaggaggggaaauaagcaagcaacagaaugcuccuaaaugcagaagcaaaaaccgagaaaagacagacagagcuggagggaaaaucaucagacagaaccacgggaacucuggaggcucacgccuaccgugagcccuuggagggggaugucaagaggaucagaaauucacugucauccugggcuacacgagacccugucucaaaagacaagcaaacaagcaagcuagcuagcaaccaaacaaaaccaaacccaaaacaggggcuggagagacagcuuauugguugagagcaauugcuucucuugcaaaggaccagguuugcuucccagcauccacguggccguccauaaccacugguaacuccaacugcaggagucuggcacccucuucuagccccugugagcaccagacacacacgcagugugcuuacauucaugcaggcaaagacacucacgugcagaaaauaaaaauagauaguucuucaaauaaauccaaacagacacccacaaaacaaaacacucaaauucuaaggagcucacgggauauuuacagauucugaucuugaguaaaccaaccucuauauuaggagacacgcaccagaagagggcaucagauuccauuacagaugguugugagccaccauguaguugcugggaauugaacucaggacuucuggaagagcaguccaugcucuuaaccgcugagucgucucuccacccccuaaagaaaaucauuuuggcuuuugauuccaucugucagggaagcugggagcaugcaucuucaaacaccagcaggaagcaaaccggaagugggaguggggauuuaaccgcucaaagccugcaccaaugacaugcuuccuccaacaaggcuacccuccuaaauaguuccaccaacuacagaccgagcauucaaacaucugggcugaugggauccauucucauucaaaccacagcacuucauuccugggccuuagugggcucaugaccauacauaccauaaugcagaaugcacggagucaaguuucauaaguccccaugaucuuucagccucaguacuguucagaaacccaaaguuucuuccaagacucaagcaaucucuuaauuguagcuccccagauaaucuguuguaguuuaguagaacuggaagcuugccuuucaagucuucaucucacacuuucuacacaacuguacauagauugauucagaauaaggagggauggagaggaaagcccccuagugguguguggggaugagguugggcucuguguauaguauaugaaaggcauuccugaggcuggagaaauggcucagugguuaagaacauguacuguacuuccagaggaccugacuuccaaucccagcacucauauugaguggcuuacaaucaccuguaacuuuggcuccaggggaucugauguccucuucuggccucugugggcacuaacacgcaugugcaacauccauccauccauccauccauccauccauccacacauauacuuuuuugaaggcauuccuggcagaaaggaagaggcuuuguggaucuugaaugcuuagacccaagcucugauuuccuucagaggucacaggggguggaagacaggaagcccccuuaacacaagcuggcagaugucuuggcaaagucccccaggguuuugacuuagaacagccaccuucuacuguaugucucugggccugugggaggagaaggaucccaugugacaugagagcaagugaugguuugauuccugccacaguuaugaggagccaggggcccuagugauaucuucagaagaaaacgaggcuaagcugagggcuagaaacugcccugaccuguaggaaucuauugcucagcuccagguuaugugaaucuuucaggaagggaagugguugcuggcucaggcuagagggaccuucaaggcuggguuccuaguuucagcaauaaagaggucuuggcucugcuguuucugcuuugaggcagggucuaacuauauggaccaggugggccuugaacuuguguugaugucccagccucuuuccucuuucuccagagugcugaggucacgcacucucucucucucucucucucucucucucucucucucucucucucucucucucucucucugugugugugugugugugugugugugugugugugugugugugugugugugugugugugugugugguggugguggucgugggggcuggggauggaacccaggguuuugugcaugacaggcaagcucuucaccacugaaaacacuccuagcccuaggcugugcucuuaaagcuugaauuguagaguuuccuggggacagagagcaagaaaaaacucacagugcuucccagggccuugucuccugccuuacccaguacuucugugugggucccuaggcccuagugcucccuuuuuguuccuguuuuucuguuuguauuuuuguuuuguuuuguuuuugagcaagaccgagucuugcuauguagucccagcuguccuagaacuugcugugaagaccagacuagccucuaauuuaugcuaauccuccaccuuugucuucagggugcugagauugccaguguaugugucuagugugugugucuggcuugccuuucauguuugggccccugguggcuccuuucugguggcuguaugucuagucacuguccacugcugcgugcuucugacacuggcuccccauauccuguuauguugggucugcaggaguaguguugccuuccacaacacaagcuccacucuaagucauaucaggucaucgguggccgccagccucugugacugaucaaggugcaguugcuugccugauguggccuuccaucugucugcuucagaguccagcauuccccggucugucuuaggaacagcuccaccaugugcacuuguggaagugggauguucuuguuagcuuuugccucauucaggagagauuuguguauuuguuguauuucuucaagucaggacaaaccucacguucuuaaugcuaucuucgcuuguuuacuuauuuguaguaaaaaauuuuaauguugcuuguuuauuuacuuauugugugugugucaucauacacacauaugcuacuauacacauguaugugaggucauuggaccaguuucaggagccuguugucucugccaugggggcccugagauggaacucgggcaucaggcugggugccuuuacccacugaccuaccuugacugcaucuuaaauuuuuuuuuuuuugagacaaggucucauggagcccagguugggugggaacucacuauguagucgaggaugacugaacuccugacccuccugccuccaccugcuagguacugggaucacaggugugcaccacggauacccagguccucacacugucuuaaaugaagaagcauuuagcaaggggacaagggcaggcacauuugucaggaaacagaccaguugcuuuaaagugagcucaagguuaaaaagccuaugauuuuucccaaguacguuggguugcucguaaacucuuccuaguuuaggacaagaguaaaucucgugugguuccaggaugggaccgugccuacuuuaggacugagagucacggucucucccugcaagaaauuuaaacugcugaggcccagugggaccaacugucacagacaccacaccgauaacagcaaggaaagcacagauggguccuggugccucaguuucuccucucccucuguuucaggucuugagaugggggacacacucuaugcaccuuauuccacccauuuucagcuacagguaagugaccuuugucauuccucgaucaccccgaaagggacaguuguccuuugggaauagauauuaccaccacuuuggcggcuccuaaguggacaccaugaagggacggcacaccuucuuuccuauacucugggguugagguggcccauggguucagggaggaccugugagaaggaggucuuuugggacgggcauuagaggccauugagaugacuguaauaauaaccauauuauugcuucccuuacagaaucaccaaaaggauuucucuaucccgagggcccaggccccggccaguccguacaaugacuacgaagggcgcaaaggcgacagcuaacuguugggaagagugggacaaccagaggcagguagcagcagguccagccaggaauccugcugaugugaacugaacccagggcaucccagggaaacgguacagagaggcuugcaaccugcccagcacaccgccgucuugccuggggcugcuaagccuaacaaacugucuucaaagagcuccaggguuucauuugccccauuccuaggacacuucugggaggugggagucuuggcaacuccgggugagacucuuaccucucccgggaguaugagcaaaccuccagucaucugacugcucacuguuuggucauccuuggaagccaauucaccuaacccacgguggguucuaugaggauuugcuccauaccaagcagaacugaagauuuggauaaacccagaaaggucugggucuccgccuuguccaucucauccacacuggaagcuaaucugaucgcgcccuccaaggcuuuccugccgggggaggaacggcuaaaggucacgugucuacccucagugcacugccccacagugaccucuuggugcagacacugauuuccaagggccacauuuucaucccaaucgccuccaaacucacugccaaccccagaccucuguguccuuugccaggagcucuuugggauauuacuggaguagacaaggucuguuucucucugccaggagaauuuggguuuuguucucgcuauaaauuccuggcccuugcucuccccccccccaccccauccucaguaauacgcucacccugaccuccugaccucccuacgugucuauucuugggaugggauguauuuguuaugugguaaguuauucaccuggguaugcaauaaagauguggucacaacuauuuuuaaaaucuaaau

SEQ ID NO: 3441 - RNA, 46983 nt, Mus musculus
cuuucccgcccgcagccccacgcgcgguucgcagcgaacuacacuucccggcaggacgcggcgcgcgcacgcgcacgggggccuccgccauggcgacagugcuguccagggcucucaagcucccggguaaggagucugcagccccgcgaccacgcuguggagaccuggccuggggagaugagcgaggcgaggcguggcgcggcggggccuggcuguuaucugggagggcugcagcguccgggguagaggaagggggcucccgggugugagucggggaccggggacgcucggggacacuuggggacucucggggacucccggggcagacauugcuggaggugcgcggggccgggucgaaaguggagggacgagacgguuacugucaggucagagcgcaugucgucgcagucuccaagggaaggccagacauuggagcauccuucccugagcgccgggacuagcugcugcuaucuggggcuggaccagagggggagccgggggcugcaggacuguaagugaguggccugggcagaacagcauccacuuacugacagcagcuuugccgcugugagcuagcccagacagguguucuccuuccuccugugugcaggaggaaagaagaaagauuaggaaaauggcuaauugaaucacacgggaucacacagcaggacacugugcuguuugaauugcacuguuuuaaccaaaguguauuuauucugucguuggcaaaauuuaaacauuuagggcuuucgaaaaaucuguggcuccacuuaaaaaaauuaaacacuaaguuauaagcauuuauuggcugaucacauaagacaggaagcaguuauuuucucugccacguuagaaagggucgcucugauaguaagccugaggcccuaggaggguugcagggaccuuguucucaaagaguuucuagucugcuaccuugaaaccggccuuguauuuuagauaacaagagacuccaugucuuuagaucuuucuccccuuugcuggcugcuuggaacucuggaaagaacagugauacgaucugucuuggaguguacacaauacugaaauuaagagagaggcuugcuuucucugcaggauacauugacuuugacgaaaguacccuggguuuugaaugcuaucuugucaaaggcauuuucagcccuuuuuguuuguuuguuuguuuguuuuuagaguucuuguuuuaguucagcauagaugauugcuacucucugagaauaaaacagaaagggaauguaccucgggguacaggcuuacuuagcacccacagagccaaguccccccccccccaaagcacugaaaaaaagagguaguuauagucaaguggagguggaacaagagauaauaccgggcgaauaugagaaaaacacaauccuuuuguauacucuucaaaauaaucauuaaaaaaaaaauaaugggagaauagcuugccugagcucuuuugugucuucacucugagaaugugcugcgcacagaauacuccuugguguguuggcuuacaguuaucucaucagcugacagccuggggugauggauucuuguguuuggaaggcaguuuggcccuaagggaugagcuaugaucaauacuaaggccuacauacaguaucuauauuuccuguaagugauguggauuuucuucuuucuuuuggcuuguuuuucuccuggucucuccuuggcccuuucccuucacuacccaaaauaugguuuguggcuuuucauuagguagaaguugcuuucucaaagcugcuuuuggauaccgcguguaauugggaagaugagacuguagucccggcuguguuaucuuaguuaacucucuuacuacuuuccugugugaagggagcaaagggaacgguggcugagagcaggagaggggcucuggauuugacuggauccguuuugauuugacuucugugcugaggagccccuccagggcuuugcauugcugggcaugcaagcgaccagcugaguggcauccccagccaugccccagacuaaaugcuuucuucacuugcuuagcugcuuuaucucuuuaagcguucauuuccucaucugccauaguaguguuguucuagaacauucucuacgcgccauacacugcuuggcauauuuaucucacaggguuauuuggagugguacaagagauggucguccuuuggaauuuaauuagcuucugacacauuagcuacaguuuuggucguuaguagcgcauggggguggcauacgaccgaaggguccauccagcagauccagggacaaagcucugcuggggaugcguuucauaaucuaaaaccuguucacugagcucagguuggaaagguguuuggcucccaggccuggcacgagguuaauaaguaacagagggacaauguggcauuuauaaagcugguagggcagcuuaucucucagguauauguuuucuuaguuuuaaaguuugaaggucaaacacugaagggacuguuaaagcacaauguuauuguugugguuuguuuuauggcaugugacuuagagagucugugccccuagauaaacuaaccuagauugggggguuauuuguuuuaguauagguacauaucccaucgcacguguagguuaccguauaugcuguggugccgggugucacaggguagcacacauuucaguguaucucccuaaggacauuugggcacagcacagcugcuucccuucauaggcaugcuuccuccgcaccaugcagggacacuugagucacuaucucagccuccuaggagacaaagcaggcuccagaaagcuuuuauaucuauguguuaugaaaccagugucuucuccuauauucuuugcagacauaaaacaguuaauuacauaaaugugugugagaguguguaugugagcaugugcucgugcaugugcccgugugugcgcgagcaucuguaugggcauguucauguguuugcaaggggccccugcuggcuggaggcauagcauccccucuggagcuagagguacaggagcuugcuucacgucagugcgaaggauucagugcagguccucugcaagaacagugcaugcucucagcuguuaagucaucucuccagugccuccuugcagacauuucauugacugaaaacuggggccugggaagauggcucaguggguaagagcagucacuguacacacccgaggaacugagcuugaauuccuccuggcacucacauaaaaagcuggccaugaccacacguguuccugguagccccggugcugcaguggguagaaaagggaagauugcugguacuugcuagcuucuaaccuaguuuagguucagugugagaucuuucucuaagaauagaaaguggagaacaauacaacaggauuccuggcauccucuucugguauguguacacacaucagcguauauacauuauacauauacuauacaccuaccauucucagagacacacacauacacuauacauacauauacaccaucuauauacauacacauacauacacacugcacauauguauauaccauguauauacauaccauacauacauauacacacacugcacauauauaucauuauguguguguguguguguaacacacaccauacacacacauacgaacauaccauauacauguguaccacaauuacaacacacacacacuuguauauacaucacaccucgcaugugcauacuacacacacacacacacacacacacacacacacacacacacacacacaccaccugugcucacuggaagcagcagacucagagugagucuggguccuagacugugaagcacagguucaugucugaccugaguauggccuaaggccagucagggacuuguuguucugcccauuucuguuaucuuucuguggauagaaaaaaccuuggccuagucagaauuugcagucuguaguaacuaagauguuuguuuucauacucucuguguuaguguaaaugcaaauauuuaugcuccgaagguuggucuggaucuaucccaaucuucugggaucuuuaaaggcagcagacaaugguggcucuagguucuggggugcuuacuucauacuucagaggcccugaacuuuauacuguaaguucuuccccugaggacuuuguaguucuauuacgcucuucccacuauccauguagcccaggcuggucuggaacucaccauacagcagagaucgauuguaaaggccugguucccugccuccaccuccuaaguguugugaucauaggcauguguuaccacaaguaggggaaauuagccuaguaaaagguuauaaaaugugugugugugugugugugugugugugugugugugugcaugcacaugugugaugguggcaaggggcaugcauguguggcacacauguggaaggcagaggauaacuugcaagguccuggggauugucaagauuggcacccacugagccaucucacugucuguuuuccaggcuauccucaaacucuugaaccuacugaauuaggugcuucacuguagcagcugcuaguuugccuucugucaugcuuaggacuugauucccccuaagccuagagggcaugcuauuccuuugcucuucuugaagucuuacgguuuuaugagaaugcucagugaugguuauucugcacccgguucucuuugggcccugggcuccauuuaugcugcagugagguuugccuaucacaggcgcucucugucuccuuuugcaucuccucuaaguaccaggcccaucuucuuuccucuucagcuauacauaucucugcauuggucaguuucuuguuauuuuguucgguuugagguuuuuaaaauuuuaaaaaucacgugcguauguguguguggguuuauacaugugagugcagugucuguagaggccagaagagggcgucaggcccuggaguuacaggcaguugucaacugccuaaaacacauggcaacugagcuccuguucccugggggaggcauguaugugcuuaacuguugagacauguuuccagcccuggauugaguguuuucagacagggucuuuuuuuuuaaagccgguuggucugaaauucacuaaacagccuaaacuggccuggaaucccaggcagcccccuacccaacccccugccgcugaguucuggagcagaggcgugagggaggagggaggcgacugccuugcuucgaacuuacuugcucuuuagcuaugugggccaauuuuccaaaugcuucagccucaguuuccuccuccggaaagugggaggcauuucugucugaaagcugcuacauaguuuccugaggggagauauucaaagugcccagaaggaauggcuagcuuuguuagccauuuaauuuagguagguuugcaguagucauuaucuaugucagcuuucagaaauaucuauucuuuuuugaugauucuaugauuuuuuuuuuguugauguuguugacuuuuuuuuuuuuuuuuuuuuuuuuuugacacagaguccuaaccauguagccuuuaaauuuaugauucuccugccucagccuacggaguauggagacugggggugccagacaguaagaaugucuuuucuaaauuugcuuuguuguuucccccccuuacccauuguuuucuugacuccugauaguugacuuuucaucuccugaguugugguugcuucuuagaaguagcucaucuuuuuuuuuuuuuaaccucuccuuauuucagaaaagacgguauucaauuuuuuggaauuuacugggaaauaaagugcucaauauuucucucaccugacugugggguuggugugcccuccuccgguagcugcgcugaggguggaacccaggaccucaggcccgcugggcaagggcugagcuaugucccuacuugcuccuccuccacugaaguuuucuuuuucucaguuugcucacaguauugugcuguagccucucggguguuuguagaacucuuuggugucuuauggcgugaauacuaauacuggcuccuuucuccaggcugcuccuguuuggaugggguagcuguguuacuuuggguuccuggcugaguagggagcagaguuugccaaggcagggagcuggggcaguuggaagcuaggauuuaaggaggauucggagcacagauccccuucccagcaaugcacuuccucugcugucuguguccaggcagaaugcggggcuuagaguugugcugagagagcauuugugugcugguuuuaaaucuccuaccuaagaacuucacacuuagccuuuguugcuugaguugugaaaguaggucugggcucuuuuuuguuuccuuuacucuguuuuuguuuugauuuuaagacuaagugucacuauguagaccuggcuagccuuuucucagagagagucacugucccuguccccacugucauuccuccugaauacugggauuaaagguguauaccaccuugccugacauccuuuauuuuuaagacauuuuucccuguagagcuugggcuggccuuuuauguagcucagguuggccuggaacuuguggcaauccccuugacucugcuucucacacccaggcguuuguuuuguuuugucuuugagacgggaucuuauguagcccuggcuggccugcgacucauuuccagaugagggcucugguccuccugcuucaacuugaagugugaggacugcggguguguaccaguuuccuagcuuaugcuucaguugcuaccaauucuaggccagccaaguuuuccagccaagguuaugguuguuuugcacagcuuagcgguauuuuguauggaauccucugaguuauugucugguuucuggcucccagcuggucucugccacagcaaccagccucuucaggacugccaugccuguaguuacgcucuaaccacugggcagcuuuagucuuguagaaaucaucucccgcacuuuuguuuuuuuguuuguuuuugugacucugcuuuuugucacguuuugugagacagggcucauagguguuccugugacccuagacuuucuuuuucucagggaugaaauuauugguugguuuacacauucaugagacaaggaagggucuuaucaguuagaacaagugggcucuucucucugaugccugggugugagcccugggcguugcuucucccuagguccugaggucuuaggcaaauuaccucaguguuucaauucuuuuguugauaaaauagguauuagacacgccccccccccccccccauguagggucaucaugaggauuugaugaauuaagacacccaggagguuugggucagugcugaggaugcuaggcaguugagacauuuucaauucuuacgccaguaucgucguugucaucaucauuaucaauucuccgcagaaucguggacuccgagaucauuguucaaguacugacgugugcaucuccuguuauuuuaggagacagaauuucccgaauucagcagcaacuguccauacacuguguguugggaauguauugcauucucccucgguuccuuaccgccucccucccccuacucuuacucuuuuucugucuuccuccucucuucugguuuuaaggaagguucaaugacagaagcaccucccaggacauuacuaauuagaaguucguauuccuauaaaagaacauccacuaauuauuuuuuauagauucauuaucauugucuacguuucuguagcgugugguaccagggccucuucuuucccagcagaguuuaagauucaugguaaaagcaaauaaccucucagucggucuguucacugggucuugccagugguuucagucgggcaguuguguuucuuugggaaccuugggaggcagagacugccaagauggaucgaaguagaugcugcugcuaaauuuuucacuuggugcucaaaacccagggguaaggcgauagauagauaggguggccugagggugguucagaauccauggaaccuucaggaggauugcugugugaggcugccaagaaagcuaccaauguuuacugaaacagugaauuaucucgagugcaauggcaugguucuguccugccuguggccagaccacacccuugcauuucguucacuuccagaaaaccuacuuuugaaaguaugggcuugccacacugugugcagagaagggucacagaagcucuuccuucaaaucaaggggugaagaagauggaggagucuaaccuggagaagagaaggcuggucaaaggcuguugacauacuuaggcaauaauaauagaggcucagauugauaaugaccaucauccaggcacugagggccauuuguauggcccuuaccuaauccuuauaacaagcaggagcuguagaugauaauuuuuauaguuuaaaguggagaaauugggaccauauagagguaagagaaggguacacauagcugguaagugagccaaacuggucuuuccauagugaacagcugaauucuuucauuuugguuagagaaaaccucaugcauguguaaacucaccauggagcugaagcuguccuugaccuccuggugauccugucuuggccucccacaugguagcuggagacuaguggguucccugacacuggucacauucaguuggguaccaagggauugcuugcuggaugauuugaaaggagacacaauuuaaaacagggauuauaugauccuuaaauuuucaccccaggauuucaagauuuaauauguuuucuugguugucaggaguauuuuuuuuuuaauuauuuaccaggcuggacaguggaggcacauaccuuuaauccuagcaauugggaggcagaggcugguggaucucugaguuugaggccacuguggucuacaaguuucugaacagccagggcuacacagagaaaccuuguguuggaaaaaaaauuauguaucuuauguguauggauguuuugacgacauguauguccacgaacccaagccucucucugauuuauccuguagagucaauguagaguuuguguagaagcagaguucaggccgucugccaccucuguguccggggagacugccaccccucccaggacgcaugcucagaauagcagucuuuccaccuuuacugaaagcuguucuuaaaggauauucaaaucacaggcaguucuaagaagugagguuuuugucaaacuucuuuagcuggcauguaguauucaacuugcuaacuuguuuccauagaaacagcggggaaaccauagacauuuugugagagacagccuacagaagagaauuguucuagaaguuuaucaggaacaaucacgccucacggcucugagaaaaucuaacgugggaacagacucgguguaaagaaaguuaacucaagagccagagccucaggcuggcuguggggugcacacauagaaccccaggaccagggaggcugagguaggaagguuacugcagggccgaggacagccugggcuacauagugagucccugccucaaauuuauaggugaauacauacgugcauacaugaauaagugaauaacaaauuuaaagucaaagccauggccauguuuguuagugacauucaaucaaaugcagaagcuaauaagaagcgcagauauuugggcuggcaagaugcuccugugggcaaaagcgcuugccaccaagacugguaaccugaguuuaaccccugguucccacagggacagccaugguuagagauugcacuagagaacguuggaaguuauuuucccauccaacugcagcuauuaacugcuguucugcccuucucuuaaaagaaaagcauuuacuuuauguguguggguguuuugcaaauuuguaggccuguguacuacaugcaugccuggugcccaaggaggucagaagagggcugcagauccccuaaaacuagagucgcaccuaguugugagccaccuuguagguucugggaaucaaagcugggugcuguggaagagcagugcucuucaccgcugaaccguaucuccagcuccgccuaaaucaaccaagagucuauuauguggcaaauuggccucacacuaagcugaggaugaccuuggauuucagauucugccacgguuuccugaguguuagaguaagaggcacucaccgcugcauucaccgcugugccugguuuauguggugcuggggcaaauccggcuuugugcaugcuaggccagcaguacaccuuaaacugaugugcaccccagccuccuuauguguuuuggggacaggauuuuuuuuuucuauugauacauuuaaaaagcuauauguauaugcaugugucuuaggguuuuacugcugugaacaggcaccaugaccaaggcaagucuuauaaggacaacauuuaacuggggcuggcuuacagguucagagguucaguccauuaucaucaaggcaggagcauggcagugaccaggcaggcauggugcaggaggagcugagaguucuacaucuucaucugaaggcugcuagcagaauacugacuuccaggcagcuaggaguagggucuuaaagcucaugccaucggugacacacucacuccaacaaggccacaccuccaaauaggugcuacucccugggccaagcauauacaaaacaaucauagcaugggaguaagaucagaugacagcucauggaagugagugucuuccucccauuguaugggcccuggggauugaacucaggucacagaccuagcagaaacugccuuuacccacugagaccuaucacuagccgaugaggcaggaucuugcuuuguagcccaggcuagccucaaacccaugacaauucuguuuuagcgucacacacauugagauuaaagggaugagccacuaugccuggcucucugcucucgugauuacugucuuagcucccacaugguagaacuugcagcaugcccaggucugacucauuuugguuaacacagugcauuauacuuuucaauuuucuuaacccggaaaggcaauaauucuagaacaauugacucccucugacccccuccuccggccaccuaaucauacagaaggccacacuacaggcucacugauguaaagcuagguuuguuauugugacuuugcuuccaucucugucugacuuuccagggaagaagagcccagaccucggugaguacgacccccucacgcaggccgacagugaugagagcgaagaugaucucgugcuuaacuugcagcagaagaauggaggggucaaaaacgggaagagugcccugggagaccugccagagcccgacucagaugccgauguggcuggggcggcaaagccacaucuuucagaagucaccccagaggguuuccccucggaaccccuugggggccuggagcagaaggccaccucuccccugguguccuaugugcgcacgucugucuuccugcugacacuggugaucuccaugguucugguauugcucugcgccuuccucauccccugcccucccagagaccugcauagcgcuuggagccggcgccugggcucccaaggaggugaguugcgggauuuuaagaaauaaaucuguaaauuuucauaaguuagugcacucaaguuucccuccagguauuuggcuuuuuuuuuuuuuucucauuuaguuuaguuuaguuuuuguuuuuugucuuggguuuguuuuuuuuuuuuuuuuuuuuuugguuuuucgagacagaguuucuccguguagccuuggcuguccuggaacucacuuuguagaccaggcuggccucgaacucagaaauccaccugccucugccucccaagugccgggauuaacggcgugcgccaccacgcccggcuuaguuuuuguuuuuugagacagggucucacuguaaccuuggcuggccuggaacucacuguguggaccaagguuuugaacucgcagaaaucuccucuaccucugcuucccaagaggucagacuaagggcacguaccaucauuccuggccuaaauguuuuuuuggagaacggugucucauggcugucacccugauuggcuuagaauucccuacacagaccggauagcuuccugccuucaccuucccagugcugcugucucagcugcgcaccacucugccuggcuuucccuccaaaucuuaaaaaaaucacgugugccgugcagucuuuccuccugugcaugggguuguucaggcggugaagguuagacacgagacagaaggcuacagcucugugccccuggacccugcucucugaguucccugaagacagcuuuaguuuacagcguugcggcugcauccaccacccacccgagggaacaggacauuguugaggccuuccaguccccugaccccccaucccugucugcccccaaaagacucugauccugaauuuggccugauuauuaauugaccuuaaagcuuugccacauugauauggacauugauauauucauuaauuuugucucuuuuugaauuuuauguaaauagaaucauaguuucugugauuuuuuuuuuuuuacaauauaauuuucguuuugggggacaggaucuuacugugaagcacaggcuggccuuggccuuuaacuuccuaucucaguuuucugagggcugggauuauugucccaugccaccacaccugguuugucaacacaaguuuugugcuuguuugcgccugagacccuccuguaguucagguuaggcuugaacucauggaguagcugagucugacuuugaacuccugaucuugcuuccaccuccagagugccagguuacagcauuccaugccacugacuuuuuuggaaauuuuuuuuuccuuguuggagguugaagccagagcuucauuuauaccaucuauaacuacucuggcacacuauaauucacguccuuugaaaagagacacuccugagauuaaucuaugcugaugcccuauagcuagagucuucuauucauuuucccagucuaacuucccauguugggaauagcauacaauuuauuuuucuagggugauaaacauaaaugaguuccaaucuuuuuuaagugagugauucuaagaacauuuuuauacauucccaaaggguuauguacaaauuacuccaagacagaagccuagaaaaguugcccuucggaggguauggucauguucuuucuaaaguuucccacucucugcuaaggugguuguaccaacuugugcuucuacuuuugucugaguucccugcagauuuggcaggcauucucugacuccucagaccaaggaggggcuccccauuaccucugcucugcacaggccucugcugcccacugaggaggaagggcagggcuggccggguagagcuucagacuucccuucccacugcagaugggauggcagucccagcuccccgcaaaccccguggauauuuccgucuugacucuggugggaggagagggugccgugguggugccagaacaagguucccgauaucaggcucugcagccuuugcugugggggugguggggugguggggccauuauuaucuauaaucaauuugccuugcuaggcugcacccuugcugggccucuggccagggaagcagguuccuuagaguguccuaagccuccugguguuucugaguugcaguuauuucacuacaucuugucuaguauagucagaaaccccagggaauuccauacauuaccguuccuuaggucuugcaaucucuagucaaguugacuuaccguccccuccuuucagagucucuguuugcuuuauguauagugcccagggcucugcgggcaggcaucaggggagaugcagagcuccucuugucugucugggaacaggcaguccaccugggcugggagggugcuggcggcauuugcaucugucuucuuucuaaccuggcagaaaagaacuagucugugguaacuggcucaggcccuuuuuguuucauuauguguacgccaggcggggaccugucuccccuggaguuggcugacgugaauagagauggucugcgggacgugcugcucaccuuugugacaaccaggaaugggacugaaggagguaagagcuccauccucuggaggcuaccacgggagaaggaaagcauuggucagcuucccagggucagugcacaggaaggucugcaggggaaaggcuuucucuauaggucugccuugcauagcacgccucaucagaaugguccucauguaaauccagaucauuucaaaauaaaagaucacuccaagaaaucagggcccagugugauagugcauaugcacgcacagacucucucucucucucucucucucucucacaccucuuuaaucucaucacucugaaaguggagguaggccaguuccugugaauuugaggccagcuugcucuccauacugaauuccaggaccaguguuagagggacucugucucaaagugcaccuucccccacauacacaaaaaggaagaaggaaggaaggaaggaaggaaggaaggaaggaaggaaggaaagaaagaaagaaagaaaggaagaaagaaagggagagagaaaggaagggagggaggagggagggagggagggagggagggagggagggagggagagagagagagagagagagagagagagagagagagagagagagagagagagagagagagagagagagagagacccaaguccuagcuggagggacuugguggccacucaggccagugaagaaaccagagcugagaaguaacuuacccauaccuuguggugacagccuuaguaauuagauguguguguguguguguguguguguguguguguguguguguguguguguuacggugggagggugguagggcagagacaaccucaggugucauuccucaggaacuguccuguaaauggauuuuaauaaacucaaugaguuauuaauaugaccuggccaggcccccaguaauagaggcaguguccuauggauuuauuuaaucagcuuagcacgauuacugggggauuagcccuaaucuauuuuucuauaugcuagacuguuaauuccccagcugaucucccaaaguacuugcuguuugagucucacuggguuauuucugcucaaucagccuguccucaaggggcauuuuacuuggccaagugcuccuauccugacauaucuaauggagacuuuuuguucucuuccuuuucuucuucuuuuuccucuucuucuucuuuucccucuucuucuucuucuucuucuucuucuucuucuucuucuucuucuucuucuucuucuucuucuucuucuucuucuuccucuuccucuuccucuuccucuuccucuuccucuuccucuucuuccucuucuuccucuuuucuuccucuuccucuucuuccucuucuucuuccucuuuucuuccucuuccucuucuucuucuucuucuucuucuucuucuucuucuucuucuucuucuucuucuuccuccuccuccuccuccuccuccuccuccuccuccuccuccuccuccuccuccuccuccuccuccuccuccuccuccuccucuucuucuucuucuucuucuucuucuucuucuucuucuucuucuucuucuccuccuccuucuccuccuucuucuucuccuccuccuccucguccucuuccuccuccuccuccuccauuucuuucuuucuccucuucguuccuaccugugacucuagcucaguaacugaaaacucuacuuacuucuguaguccccaguaauuggcuguagcuacuuuuauuuaaucaguggcuuuaaauuggggaguaaaguuuaaguagcaucacuagcgguauguuagaaucugcuagugggacguggugggggggaaccagauuguggggaccagcauuuagcauuugaauacauagcagcaccagaccaacccucaaugccaucuacauuauauuuugaggcagcgccucucauuggccuggaucuggcuagcacccucagaagcugccugucugccgcccccgcccccugcaaugacugugccaccucuccaggccuguucuguggguucuggggauugaacucaggcuuucuugcuuuuauagccaccaccuugccaacugaaccaucuccccagccaguucuccacugcucccugguuacagugaauguugcuucuacccugcuuucuccauccucgcggggugguucaucacucaggucuuugcacacagaugagugggccagaggccuuccuuuccccuuucaguugaauucuccagguuugucgccccugggaaggauagacaguguacaggauguuuaucagcucccuagccuugugagagagacugaggagagcaacuaacuucccugcuucuucacagcuaggguuggaacaggguggucucagguugccccucuuagaggacuuucuuuuucguccuccuuugucccugggaacauuaacagcuuugagggccuguacugccacuagugggauccggcaccgggacacaucucugucaauagucucuuuauuaaagccuccauagcuuacacauagcaaccaaccaaccaaccaaccaaccaaccaaccaacgaaucacaguaaccaacaacaaccaaccaaccaaccaaucauccacaaccaacaaccaacaacagccaacaacugacaacaaccaaccaaccuaccaaccaacaacaacccuacccccaaacccaaaaaaguaaacaacagcaacaacaaacaagcaaaaaugccucauuuccgugauagcuacacagggucuuaguuugccugcaauggcuacugaauugguaaugaugacaguauaucagcugaugcaugaccccuacccggagggugaagaaauccuagcaaguguauuuugaucauuuaggcccagagugaguguccagguaugcuuuagagaucuccguagugugcauuugccugacaucacuggaccaccuuucagaagcauguuugauauauggaugcaacucugagacagggaaagcagacuuucgugugguuguagccugauggcguuuuccuggucugugacucauuugccuuuaaaggaaggcuagagaugcugaagcuguuugguguuuugccugcuuugcucuauaucaagaugcauagugaugagacugaggguuucgauccuuuguagacaaacaggauuuguccacagguuguaaaaguaacaauguaauuacuuuaguugcuucugugugccugugacaaaauacucuaaccucaaacgauuuacaaaagaguuuauuuuuggcaaugaacucucaaagcccucccugccuuggugacuuccuuccuucagcaaggcaucacaucuuaaagguuccauaauguccuaaaaugaaaacaccaaccaggggccaaguguucaaacacaugagacuguuagggacaugucucacucaagccacaacaauaaccaccauuaggaaccuucuaggugcuguguuugguuguaggcacacagcccaugcaaauggauuugcuucucaacacaaucugaccaaguaggcuaguauuguccccucuuccagauguggaaacugaggcacacuagguagaggaacucuuuagagucccacaucugguaaaaugcagaccugaaguucaacucuaagaacgaggcucuguaguucaugcacccagcccccaugccucauggaugucccuacagugccacugggagcagagggagagaauuagcugauuaugauccagucaacaagcacaaauuggcuacaguaggcccucuccugaguccagagauccuccugccucugcccuccaagugcagggguuaaaggcaugcaccaccacggcugguccucucauggggguucuuaagcaggaagacuagcacaggacugguuuggaaaagucuagaagguaaugcaggaggucugauacagcgggccacguccuguuuccggucugcagcuguaucguuuaguuaauagcgcugaggagcaggaagaaugaagccuagagacuucaggugucugaaaguagaaagugugagucaagaugucucggccucagagugaaagcagagucagccagaggugugacugucaccgagucacccugaccugagcugcuguggccucccuuccucggaccuggcuguucuuuuccugcagacagcgagaccuccuugcuguucgccucuguagcuugcaggucauuucugaaaaccugcuuuucuguguggggaaccuuugcugcugcugacuggguuuaggguugacucccugcucugccuggguucuaggucagccugggcucuccugugcauuccuuuccagcccgaguggcucguuuguuuccccucaacgacuacuacacccuguucuggauuuugcuccgucuuuuucuuuucauuuuuaaauuacauuuauuuaguguguguguguguggugcacacaugcguguaacagagcacacguggaagccaggggacgacuuuuaggaguugauucucucccacguagacgugggaauacuggaauagugcugggggcuggagacugaacccaggucuccgcucuuggcagcagacaccuuuccccacccacuuugcuggccuuaccccugucuuuugcucagcaaacaacugguuuuugcucagcuacaacucuauagagcaagcaucucgugacgggcugagaaaucagauguuacugucucuccuuaaggaugccacuguucagugugggcuaagguggcagacagguaaacagaugcguugggaaaggugccaaaacggagacauggugaggcaguuuagaggagcccaccgcggcuggucuuacacguguccuacaggaggugugaagugggggaugacaaguuccguguucacaccuugucagaaaccacaggaaggagcugagcagacaagagcgagcugcugugucaccaccaucucccuaugucaccguucaucucccugacucuucccuucugcccuuuccccaccucucuugcuugccuuuagguguuggcucacaaccaacugcagaucuggugugccuuucggggaugaacggcagcacacugugguccaguccccucccagaggaggcucaagaugucacaugcuuagaucugauaccaggaaguguggccaaaaccaucugccuugugacggggacucgcaagaugcucagcgcauucaaugcgacgucagguaaagaguggccuugggcgcgcagagugcugccuccggagccucagugucggauccgagcagccgacaggggaaacugcuuugcucuccugguucagaaggugcuugguuauuaaggguaagagauaaagggcuugggaggaccgaguaagcagauucuuguugcaaccuguuuggugauaagacagggcuaaauaaacucuuacccaaacagaugcuaccccggggaccuggguuguagagucucucuguacuggucuuuguacaacaggcaagagcaugucaccuccuugccuuugaauugugcuggucuguaugugaaccugggcccugguuggaugcuacugaaaagaacucccagucuugugcugauauggccuuuuagcuucuuuucuguuuuagauccacaggcuggcagugaugaaaaugagucuaguaugaaaaagauaucuccauguaauauaacauaacuuaauauaacaugacauaauauaauauaauaugauauaauauuucuaugggcuauaaucucgagaaguugaauaguaacauccuucccaauucagagguaccaaaauggggugcuuuauuuuugcucacucccuuuugagacaugguuuuuacacuguaccccagaccuugaauucauaagaucuuccugccucagccucccaagugcuggaguuauagguguugaguacuaugcuugucuaguggaguaccucuggguggggaaaaauuacacacacacacacacacaccauuuugcagagagaauccuuagcaugcaccaagcacccaguuugauucccagcaccacauaaacugggcauaguggugcaggccuauaaugccagcacucauuuaagagguagaaccaggaucugaaguucaggaucauccuuggcuacaucuaaguucaaggccagccugagacauaugagcaccuguauuuaaaacaaaucuucagagugcacuuacuguccuagcucaggacugaaguccuugaaagccuucugugguuucucuggugugggcuccuuagugccugcaaugcccugugacagacacauuccgcagcccuaguagagugagcuccuacuugccaggaggacauagccaucucuauuugauauacaaaauccagaugugugggacucaagagaucacucaaugguucagagcacuggccacucuuacagaggaccuggcuucaggucccagcaacacagggcaguuacaaccagcuguaaugccaguugcagggguucugaugcucucuucugacuuuccagggcaucagcggacacacaguguacaggcauacaugcaggcaaagcggucacacacauaaaacaauagcuaaauaaacugaaauccagaugugaggccuuugcaugcauggguagccagacgcuugagguuuucauaaucccacuuccugcucuccucgucgucagacagaaguaauggcaggauguggggagcugucucguguucguucagcugcugaguuuucucuucuggcucaggaaugcugcaucuaccuuuugcugagacagaaagcagaagugaugaucuaccucugucuccuucccuagggaaaguccucuggacucugaacccaaaccaucuguccaacgguaccuuggcagccccgguuguggugcugccagaccuugaugaagauggugucagagaucugguggugcuggccauuggagaacugcagguacggucucuggugaugguuacuguaagugcugcguaggaccuuguuguugcaauggcuuaggccgaaauagauucuccuggugagcuuaagugacccaagacuauuccaagcucauuuccugugaugcucugugguucugaguacugugcuuuagcagggcucuggaggcagauggcucguguguaaauuccuucugugcuacucuguagcuuuguggcccggggcaaacuguacccuauccaugcucugaucucuucacaugucuaaaugagaaaguuuuaucuuucccuguaggccgcuuaugaaaaugagagcuaacaaauuaagucccuagaaaacuguguaguuuuuacucuguaaacagaauguuagcuuuaccauauuguaucuauuuaaaauuuacuucaauuguaaaacaacaggauggauggagaaggcucauaagagguaagcuuuggauauaucuuaguugguagcgugaugguuuagcaugcaugaagcccuuguuggguccccugaacugcauaaaucagguguggugguaauacuccuguacuuaggagacaggcagaaggaucagauacucaaggccgucggugauagcauagugagcuugagauugacacauguguggugaaacccaacaacaacaacaacaacaacaacaacaacaacaacaacacaagcaagugcuucccccuuguaaucgcagcauucagagguuugaaaauuccaggugagccuggguuguugcacuuugggaccugucuaaacuugugguguguaguuuuaaaaaucgcuaccaccuuuucccggauuggaccgagcucuggccccucccugguuuccuuuuguuuuacccggcuuagcucugggaucggcugccaccagcccuaacccggcaucucuuucuaccugccuuugcucugggaggggccaugcuaccagcccacucugagacccuugaaucugaggauuaaagacacaaacuguuacuuuuuaacuugccuacuaggcacaauugcugggugcagauaacuccugccuggaaaagcgugcccuuaccaauuuaauauuucuguuuuucuagcuuguuccaccuaaaccccugccaaacaucuuuggcaaucugcccguagcagaggccgcagcccccaagccucacaugguugcuguguccuucuuccuccaaagcauggcagaaccagcaaucuccuuccuugagucuccuuuuccuucugggaccuggaaguccuaccuguaccuucuguccagcgauuggccgcccccagccuucuuuauugacaagucaagaaccaauuggggaaugggauuuuaacaucaggaccucccucuacacaaacuaaucagacuaaaauccuuucugauucgucaaugaccaaagggaggugccagaagaggacaacuuucagcauggaugugguagcucauaucuauaauuccagcacuugaaagcugaggcaggaggauugcugcaaguucgaggacauccuggacugcuuaauaaguucuagucugucuaguaugccccagugaugcagugucuuaauuuccucccuucccccugaagaaagauaagcucugauuccaguacaguggccuccuaaagccauggcucagacacuggagcagcugcucuguaccugaugggauaaaaggcccucuucucccuagucucaggagagaucacauuaaugagcaguuaccucaguuaaaaguuuuguugguuuuuuugagacaggauuucacuauguagcccuaccuagccuuaaacucaccuacauuugccugccucugucuccccaaauacuaggauuuaaaggcaugugccaccaugacuggcuugcaauuuaaauuuaagcuauaugcagcagggugguuguggcacaugcuuuuaaugcuagcacucaggaggcagaggcaggcaggucucugugaguucaaggccagccuggucuacagauugaguucaaggauagccaggaauauacagaggaaacccugucuugaaaaccaagccaaagcaaaacacaaaaccaaccaaacaacaauggaaaaagcuauauguauuguauauauggaugcuuuuuuuaaaccaguugacauuuugucuaggcuccaccccacaauuaucuggcaacagccaggugugccugacucacuauaagaggggcugcuugcccccucuggucccucagggggaagggauuccucagcaugggcccacagaggcccccucuuccccuacaccugacugcaccuccaccacacauauuccuucucuccuuaucuucuuauaaaacacauuaccuacauauaugucuguguaccacaugugugccuggugccccuggagaucagaagggggcaucagacuccuugggauuggguuuacagaugguugugagccaccauguggguggugggaaccaaacucaagcccucugcaggaggaugcaguagaaccauccuucuugugggcccagucuuucuuaacuuaaagaucaguuucacuggcucagccuguuuuauucuuauuuuugagacagggucuccuuuuguagcucugccucagacucagauuugcgaccccugcuuaguggcuagguuggccugauacaggaauuauucacauuugcgaccccugcuuaguggcuagguuggccugauacaggaauuauuuuauguaugagugccccaucugcaaguguuccugcaugccggaagagggcaucagaccuggguguuggagaauugaacucgggaccucaggaauagcugagcuaucucaccagccaccucacagaguguuuuuaaacuuugcauccuagccacuaugaauagaaggagaggggguggggcuggaggggcuuuguucccgcuauuaggaagugauuuucuacagugugagagugugggaaaccgcuuucugauggagcccaggucucacagcccauugaggccaccauacacauucuuguacgucagcacacuuggagaucuugguucuuuuguuugagauuuugggggacaaagucucacuguguaucucgggcuugccuuaaauuucugacaaucuucaucaucuugucuguuuccuuagcacuggaauugcaccacgaccagcagaaaucuuagucuuaaugcccccaccugcuucuuaugcccagugguauugaagggcagugcucaggccuuugagauccuccacacuaccgggcccuuguuagaggagucaucucacuugcucuuaacucuuugucucuaccugucuaugggucagcuggccucgcagaacuuauucauuugagugguagaguacagauuauauaauagucuccauccugccugaccgugacaguuacaggauauucuaggauggauuuaggcagcggcuacuucugccuugauuacaggcagugaugaaugugaggagcugugugagccacagacauaaagaagggaauauauuuaggacugugaauuaagaguagaggaguccuuaggucugggagggguaugaacugaacuuggcagaagagccugcuuucauaugcggggacuggucuggccuagaauguuacagggaaugaacuugagaagccuguagucauuguggucacacuauguaucagugagucugagccuagaaccauaguccuguguacccuucucaagccccuaggcuaaugcuaauggcacugaugugugagccuuguugcauugcuaaucaaucagcucaggagauguuguuauuggagauguuuauucucauaucuucuucucuguccccacuucagugucauuuggcaucuuggagugaaucugaucuccaccuaguuuaaacccagugacuguuagccuggucccgcugagccggucacuccaaaggcuaaauaucgaugucuuauacagcagucccuucagaguugggaguuccuuuucccuggaaccccaucugucauaugcucuuuaacaucugcaaagagcuuggcucaugguuaccucaaccaugaaccaugaggauaccauuacuucuuuuaaggcaaauucaauuuuuguuuguagcagaagacuuucuaacaucugcuccuugcuuauagucagugaaugagcucauaccuucucauuaaucagugucuuaguuagggucucauugcagugaagagacaccaugaccagggcagcucuuguaagggcauuuaauuggggcuggcuuacagguucagagguucaguccauuaucaucaaagcaggagcauggcagugucuaggcaggcauggugagggaggagcugagaguuccacaucuugaucugaaggccucuaggagaagacugacucucucaggcagcuaggggaagggucucaaagcccacccccauagugacacacuuccuccgacaaggccacaccuacaccaacaaggugacaccuacuccuaauagugccacucccugggccaagcauauucaaaacaccauaaucaauuaauugguaaaaugauuucuucuuacaacuuugauucaucuuccaaccuaaggucuuuuagagcauuguuuguuacauaguguuucugcucugagguacacuuacucuagucauguggucuuugacgggauguuuuaggauacaccauagcagcgugccaggaccuuccccuaaaaacucccuucugguacugagggaauaagucauuuuuuuuccugggugugcuguaagccacacuuguuaucuucccuauaagaauccguaaugauaaacagcagcaaacacuuuacugaaggggcuggcgggugugugugugugugugugugugugugugugugugugacucaguggcgcuugcugcucuuucagagcacuggggcuuguuuggugcacacacacacacacacacacacacacacacacacacacacacgcacacacacacucuacaauaaaagaaaaugaaaaacagagucuuuagagcucaagcuaauaaaccggggccaguggguuaaauucuccccacuguugguuuucccaaauauauuuuuuuuguuggagcauagucauucccuguucuuccugugacagauuucaugcuagaauaacaguagagagugguugcuauggagaccaugcaaccagagaggccuacaguaucuacuagcuggcuguaugcagaaaagaguugcugcuuuugagaguggacuugacaguggccaggccagacaucugguguuacaggagaauucuaugggaugcuacguggaugcaucaguguguuagucacagcugaggccaaauaccgggcaaaaucaauggaggggaggaagcuuucacugugucuuacagaguguagagccagguggggagggaaggcauagcagccccaggcgcugucacauuguauccacagucaggaagcacacugucacauuguauccacagucaggaagcacacugucacauuguauccacagucaggaagcacacugucacauuguauccacagucaggaagcggggagacagaaaugccggugcucacuucuauuucuuuccuauugaaaucucauuucauuucuguaugugcauguguuuguauaugugucuguaugagucugugugugugugugugugugugugugugugugugugugugugugugugugugugugugugugugugugaguauccuaggaaggcagaugacuuuuagucccacagagccagaguugcagggauuuguaagcugccugacuucaguccugggaucagagcaccgguccucaugguugaacgaguacuuagaacugcugacccuucuccaaagccccugauuuuuuuuuuauucagucaagaccccaagcugauaggaugaagcugcccauauccaggguuggucuuccuacuuaguuaaaccuagaaacaucuucagagacacccagagcuguguuucccugcugauuccaguccccaucaagaugaccaucugaaucucucugguagaaacugguuagagaguaaagacccuugcccccuuguaucagcaucuuauauuuagcccucgucgaucuuuaguugcuuuagucaaugacaaccacugugcuucaucaucugaggacucuuccuacauaucuaauggggggggggacgacgacacauuugccccgcuucuuaucuccagggggaaauaagcaagcaaguuaggcuuugugcuuuccaaccucgggaaguguucccgagcccuuagcuugugaggccuuuggaaaugaaaggccucuauuaauaugcccccuuucuuuuacuuuuucagccagaucuguguuuucugcugguaucuggccggacagggaguccugugggccgaccugugaaguauaacaucgugggaguagggaaucugauugguccccagguuuacaucaccgccaguggagcugucuacauccuguuuggcuuugguaagaagcagggcuggcuuuggcuucugcuccccugguguggugcccuggccuuccaugagacagggguugcuggugugggcucuuuuucaucacuauuguaggaccucucucccugcugcaugcaggucauuaacucagcuuucccuugauguggucucuggagagggacugcccacaucacuugaucacuuucccaucacuccaagcgggaccagccggagugggcucugcgagcuccgcaggcuccacucugugucuccugcccagccauacacuccucgauccccaccaacccgcgcccugggauagccugggggaguucuuuuaaacccagcugcucaauuugacucuuccuguggcacuaggaaacauacaagcugucgcccugcgggacauuuuuguucaggcccaaaaucgggacagcucgccacccucucugcagauagaggagccggagugggagaagcacagaucugucaaccuuucagagcucaucgauguuuacagguauggcugauaagguguguggccgagagagguccucuggagacucauacaccacggggucucuggguuuggguugacuagugaguaagggcagaaguguggggaaaguggagcuaaccuuaaaauaccaacguaugcuaaacacagugaggaauuuguuucuuuugguuguggaauguugggugugugauugugucauaaauagauuauaaggauugauauuaacuuaacaguccgaauuagaacaacuaaaggauauauuuauaaaauggcuguaaaacuagauaggaaagcuuugacuucucuccccuauauugugacagaguaggaauaggauacaugaacucuuauuauuuuaauuuuuauuuacuucucaacuuguguugucauaugaagcgaucuauguauuuuaucuauacaacucuugucuuggguaauaauuguuuuauuccguucugucagaaacuucaauucauuucuagcauuuuccccucugguauuaucacguuguuuuagugaauuugauggaacgguuccaguaguguagaaaaagaauaaugacaaucucaggccaccugcgccaucucuguccucugugccauuauccuugacucuguuacuguccccagaggguccagguagagaggauucccaaccaggaagaguuaggagucccuaucauggacugccgauucacuccucugcaaacugaaaauauuuggaaaaaaauugugcaugcacccaacauauacagacuuguuuucuuguuauuauuucccagagagugcagauugcaacucuuuauacauuguaccgagaguuauaacuaaucuagagaugguucacauuacaucggaggauccggguuguacggauacaauguaucauucagcuuaaggaugaugaacaggcgaauuuggucucugcagcagcuccugggaccggcucccacacagacaccaagagacaacagaauacacaaacaucaaaaugaacagcuaugggaaucucauccacaccagagacuaacuguuggguuuuguucaauguagugauggaguugagcuucuccaguuggugaaggcgccagauuccaacagcagcagccuccugauuacaacccgacaaggccugguccugcuuagaggacaagaucuuacgccucauuggaaacugaaccuucagggccugcgcagguuugcagaguacccuucauggcugcuguucugagcaacuuuccugacuuaaaauuaucuaaaacaacugcuuguuaccguggcuggugcgaggggaagggagggaggugccugguucuuucugucuaugcuguuuauugcuucuuugucugucugcagccagcccacuccuggguauuucacugaugaccagacauuggacuuccuucugcagacacaagauggagaugggaugaaaaagguaaaaagaggucucaacucaaucagcacuucuggaaagagugggcucuguguccagcccugggucggacacugggaagaauaugggcuggaagcacagucucucccuucggagaacuccagucuggaggauggaugaauuggagacucagaucauugcuaaaaucugcaacagcagcuuuucuagacuaacccaauguucuuuggggagccuauacuuccaguuaggugggaggaaucaccguacaaagcuggguggggaaauggaugccauauucaguacaggcacaaucaggugucagagaagucagaacucugggaggcguuugcuaaaggcaggcaauauggguaggaccucuaagguuggauuuaugcugugggcagcaagguguaccagguuagaaacaguaagaccagagcucagagacagaggugccgcagcagguugagaggugcugaaacaugcacgggcuggcucuccaucucgccuuuucuguaagguuauauguguguggauggaaugcucucucugggagucaucuuucauucaguucaugucagaggcagaauuauagaguuuuuguguucauuuguuuugauuuuugagauaggguuucacccuguagcuauccuggaacucuuaucuguagaccaggcuagccuugaacucacagacaucuuuccuccaccuccgaguauugggauuaaaggugugcaccaccacugucuggcucagaguuuuaguuuuuaaaaauacaaucggccuagauuuuaugaugacaaucaaagcuaaccaacugugggcugaaaaauggcucaaaaccuguuuguacugaagccuugaagacuuucuucuuacuaugucuuaaagacuacaacaacaacuauugauuaagcacucauuacaucgcaguaguucuugcagguaaucuagaaaaugaucuaagugcacaugacggcguguguaacuaugugcaaaugcuugcccgugcaaagggacugggcgucugguggcuccaugugucacgucaggugcuggagcucagcgccucacaaauauggaggaggaugaaugcccacucuuggggauguuguugccuuaauguuugcuugccugugucuucuuguccucugcucuccuaaggacuggcaguauccucucugucuucucauuugcagaugacagugguagauggagguucuggcuccaucgucuggaguuacaguauuccaugucacaugaaggaaacgccaaccacuucugcaauuacuucagaccagaagucugucuuccucuucugggcagaggcacugacugcugcaucucucaguucugugagugacggggaggaagggguagguggugggaaugggggaggguggacugcuucccgucucucucacacagccauagcugcugcucuauggagcgugagaagaaagagagagagagagcucgggggugggggccagaggaggccuaagcugaggggucggugggaaucauggguaagaaagcagccuugacacccagaaggcaggugucaguuuuugucucauacugccguaucuggguggagugcgugagcagggguggcuuagacaggguugccgccuagaaugugguggaacucagcuauaagcccagcugacuuaguccaguggaaugcacuccgccucauuugcuaugugccagaugcugguucuaucuguggggaaccgagcaucagaggauacaguucugaaccucuggagaaggcagggggcccagggacgggggagcauaguaggcacacaguucugaguuugucagccgcgaccucccaacacguuacuguucugagccuucugugcuuuuuuuaaacuuccuuuuuuuaaaaaaaauauuuauuuguuuauuuaauguuuauguguacacuguagcuauacugaugguugugagccaucaugugguugcugggaauugaauccaggaccucugcuuguuccagucgaucccgcucucucuggccuaaagauuuauuuauuauuauaucuaaguacacuguagcugucuucagacgcaccuugaagagggcgucagaucuuauuacagaugguugugagcuaccaugugguugcugggauuugaacuuaggaccuuuggaagaacagucagugcuuugaaccgcugagccaucucuccagcccaaaccuccuucucuuuacucuuuaaucuauccccucacuuugaugaucagucuuaucugaagucuaggguauggaucuaacucugcugugcccacaguccugguuuccuuacauaauagugaggggauuggaccagauggucuucacacgagcuccugaaugucacuccaagggugucuuaagaacacagagauccagauaagaacuguggagggggcugacaagauaagaugucccugugagugaguugccugccgccaugguuaacaaccugaguuugaucccugggaaccccaugguaagaaaggaagccugacaccccucccucccagccaggagucuucugaccucuacaugcacacugcggcacauagccucccccccaccccacccccacacacgucugcacauacacacaacauauauagauagguauguggacaaaagaaggcaccacguacugauuucaguuaagggcgauuagggaauguuucauggaggaaguugauuacauguuaagguugaggacgggagguuguacaggagggcugugugguggagaggguacuuagacaggaggagagaaugugauggaugggcaguggcuuuucaaggaacugagaguuagugcguguggcuugagaaccuccucagagguuucuuaaagcacgguuggcagcaaacgagugcagcuggaguuuagaguaagugacgugagacacuuuagguuuguguuuguuugaucaguuuuuuuguuuucguuuuguuuugcuuuugagauggccucuuucuacacagcccuggcuguccuggaacucgcuacauagaccacgcuggccuugaacucgccgaggucccuaugccuuugccucccgagugcugcaguuaaaggcaugugucacgauacccagacugugaaacacuuuaacuuucaugcugagaacugugggcuucacucagcaggcaugagggaaguguucaauuauuuucaugucaugugagcugagccuaaggucugucccuccauacaugggcacauagaaauggcuuccucugcuuuaaggccucaugguggcugugaggauacaggaugguguacccaguccccucccccaucaacuagggugcuucucauacagaguccauugaggcagggcccgacagucucuauacuuuaaccaguguguggcugugcacacaugggcuaccacgguccauccccacggagaaggcauguugauaaaguguccugguggauguuucuccugcugccagaaucagaaagucaggacucaggccuuggcacuucuuauuugucauuggugguuuucuucaguugagucagucugguccccugagggacugucagguguuuccaguauuuaccccggugcuugccaccgucaucaaacacaggucuuuguacaagccaggcaagaccacugugggguugguuaugccucagccccuugcaguuagucuggcauccaaggaaaggaaauauauuuggcuaccguugagaaauagcguuucucucugcagagccucaccugcuguaaggaugaaugaaugggaaucccagcucugccauagguugcagauaggcgucuccacagacuuccuccucucuccucucugcauucuauccccugccucccuccuuucugcuuacaugugcaagcauucucucccuuacccccccuccuccuucuccgcucuuccuuccccuccuccuuccucugcuccccuccaccucccucccucccucccucccucccuuccucccucccucccucccucccucccucccucccucccucccucccucucuuccuuccucuccuccuuccccugcuccccuccaccucccuuccuccuccuugucuuccccucccucccucccucccucccucccucccucccucccucccucccucccucccuuccucccuccuugcccauuucccuuucucaccccuucauuuuucccuucucuuucucccuuauauauuguuggcuauggauaaugguuuagagucaggaauaaaccugcgcuuuggcuucugugaaaucguauggucccuguagcugggaacaggagagggucuggccggaacuuugcuccacuccuuccccugacaguguccuguguucccaguguagucaccauguuuuccuuuucugugacuguugccaggacgacagcucaggagcggagccuccuggccuuuaccaccuuuaccuccugcacccagccuuccccuccauccuccuggaccugagcaacaccacuggcauagugacagcuucggagggugagucccugugacacaagaguguccuggcugagugauacccuugcucaccaagggaaggauaaaggcauuucaggaggcaguagcaucauuucccguggugucccuggaaccagggcacugcuggggagcuuucucggaguucuggggugagaauacauauucuguggaugugcugagagcugaggggaaguguacccucauuccaggacuccgcugugugccaggcgucuguagggguuuaggauuggcaguuaacuguaugggcuauaauggagaaauguuacuucuagggaauugauuuagcuauuacuucugugaauauuaaacacauugugucaaaaucugagucaacagaagaaccaagcagaggagaguuaucgcccguaaccugaccacucugaacgcuggggagucuucuucuucaugugcaucuaaguaaacucuaaagcggacuagagagcauauccuagaauuacuccauucagggacccacagcccuggaaacugagccacuacugucugcuagucucagcugggcaaggagggagaccagucuagccacagcucccugcugucuuucucuuccagcuggggaggggacaguuagacaggucucauauagaccaggcugaccucaaacuggcucuguaguugaggauggccuugaacccucgacccuccugccuuuaucucccaagugcuugauugcagguaugcacccuuacaccugacuccucugugccuuuccacacuguugccucugguagacuugcuccuuguagugcuucgccuugaagugaagcaguacugccuguccucuaugcccugagcuucgugggacagaaaagcugaucuggaaugugcaggcugucaacugguuaggaagugggugggcgucagcuuguggaaccauguaagagauauaaauaagcugguuugcaucuucugcauaaagcaugguaaauaagaaucccacgggcuggggauguagcacacuuggcagagugcuugccuagcaaugcaaggggcccaggguuugaucccaccacuggggagguagaggcaggagaacucauuucuccuuggcuacagagccaguucaaggcugcuuuccaagcuaggacaauacuggucaucuauguguccuccagaguaaagcaccaugguuacccgaaacccugggcagaggaggagaggagaguggcuccagaggaagagacagagugagccgaagcaacgggguggaggaacgcuggcuggguuugaagcucacagugacagcguguuaaggggaggugccagugagccugaauaaagugaauaaagcucuguauggaaaaaagaaccucaugucccuuucagacaagcacggcugauuccuauuuuaaagacaaggcagggagucgaguguaggaccuugugccugucauauaaaugcucgugaugaugaccugcacugcuggacggaaccacuccucucucgcuaaccgcuucuugucuuuguccuuccucaguuggaaucaacgacaucuggaaagaugccuuuuaugucaccaggacaacagggaugagcccugaaggacacccuaccucucugguggucagcaagcuuagccugcgcugggcacucauggaaggccagaugguccagcugaaggagaccaccccuaaaauuggccguggggaacugcgaagauuccugucuaggauaaaguuuguugauucucccuaccagguaacuagauuuuacuuuuuaguuaaaaauaaaauucuuuuuuuaaaaucacaucuauguguaaggcucacacauauccugacacauguuuagugaucaguggacaguucuagaaauuaguuuucuucuguguaggauguucagguauuuagaaauguagcauuguguguguguguguguguuuuuccaucccaaugacuggaugggguagaucuuccugguaggguaccaaugauguucaagucuaugcaacuuugguuuacagaaacuauauacuacacaguuaccuugcugagaacaccagcccuuucccuuaaaaaaauaucugggacaaguuuaaaguugaagagcuuggucauugagaaggaccaagucccugggacucacaaacuguuggaacuaaaccacaagaccgggaaaggaagaaacauucccauguuuagauuucccauugcuuuggaaaucccauuuaaagaggguaauaauggccccuucccuacagaucuagugcaacggaauucuccggauucagaacaacuugacggacuggcuccugucucuccugcaucaguucucuugagagaggaugacuucaggguugugcagcacuugggaucacuguccugcggcagcguguugaagcugagauguagcaugguccgcuuagcuggggaaccucacgaccuuuccguccccacgcuaaccccuucucccgagaacucuguguggauacuuuggaaaugugaaucuuauagcuguuuuaauuuuuuuuuguaccuuuaauuuauaaacccuuguggggaaagccagugaccuacaagcaggauauauguuguuuugccuuaggcccugugugucucucuguguaugugugugugucucuguaugugugugugugcccaguguuguaacaauuauucuugagauaugccccaagcuucagggauuccguuuccuguccuggugaaguucaucuggcuuggccaucuugaugcggcuggauggccuaucucugguccugagggucgcgcaccacuguuuucccucugcccgccuauacugugguuccuuuccacagcagugaggaacacuggagguugugcugggggcucguuauccugugugcucaucugucugucuccuagacucuccacccgcagagugcagacacgcuucuaucacagagagagcaagggugccucggaccagggccuugugccaagcccuuagagcuuugauggcucugcagcugugaucuuugauucugcagcaauggcagaggguuugcaugcgcacuguccucagucccauggccuuguccugccguagcucugcccucucgcccugagucuuucuucucuggggcaucuccaucucuucccgcuuccucucuuauucagggaucuguuucuggacuucugcuucuuggguccgguaugcaaccacucuggccccguguccuucccuccuuguagagcuuugaaagcauauucugagaaaguucucuuguaaauacuguaacuuuuuuauaaugaccaaguucuuuagaauuauugccauccuuuucugcccccuucuagguaagugugugaccucuuuuaacucuuucaaaugucuaugucauuaucugucaugcugucuguucucaugguggccaaugaaaacacacuucucuugagggaaagccagauucucaucucacuugggcauguaugucuuuuuagcuucuguuaauaaauuucaggaaacguagauucuagguuuaaggggcuaacuaugaguugcccacaagagguguuauggguagcagagguugguccuuggaccacccagcagauuggccucaccagacuuguugguacgucugccagaaagagcagaaaagcauauuuggaagucauaugggaccagguugaccuuggggagggggaaacaaugaauaggauccuuuagagucuggagaugauucuagguuauuucuaguaaguugaauuucugccagugaaaggguuuagaauauaguuuggaguguggacuaguuuucaguggaccaacacgggagauggguggggguccucuggccugcuugagcccuuguaggcccaguguucucugcaguguuguucucagagaagccagccugugcaggaagggggaagauacaaggcugcucaauggagugcuuggguuguugcucggccuggaggcuguuuaugcugguugagucuuagcugagaggaagcuccacagacaauaucccugaauuaacauccuaacuucuuccuagaagugugaaucgcuucccugcugaaugcaaugcaaacucuaggcuuacuuccuguugcagcugguuauagaaagguagcugaggguugagauggcuucaucuggccuccugucaaaggccuccucuaaacccuccuccuuguaggcaacaacuuccccagauauucaagauaggaaguguucaaugagggcagcccacagaaucagccugagcacaccucaguagugcugucugcauggcaagggucuccccuccucucagccucucccuuccuuccuuuguaagcccuccugccucugcccugcacagcacccccacaggcccccaaacauguggugcggugauaccgacuaaccccaggaaugugaauugcuguccacguuaccugcauugaggagcagcccgggguuuguugccaggaaguaagguuuaaaaugugaacugcuacagaacaaauaaaugcuguguacaggaauauacacguguguccuuuucucauuugcccugcuaaccaggauggcucacuucccuuguagaauaaagacgaguagauagcuggcauccuccguggagggaaacagugggaccaguuucugagaugagggagcagguggauauccagagggcaacaucugccccagucucauucaugguagaaaccccuguaugagucuccucugggaacccgggaggccauuucuagaagggggccugaugcuauagaaaccuccauguaccauaccuuccuaauggcuucuagggccauauuuaauaauguuuuuaaaauuuuaucaucauaugugccauguuuccuuccacugaaggauccaggaaucaacuccaggcugacaggcgugugcagcagguacuuaaccacugagccauuuaaccagccuauuuuuuuuucaaguuguuuugagauuuauucuguguguaugggugguuuggcugccuguaugucuggcuguaugugcaugcgugugccuguggaggccaggagagggcguuagauccucugcaguuggaguuacagugauuagccaccaggaguggaauguucuggaagaauagccagugcucugaaccacugaggcuccuauccaacucuguaaccagcccauuuaaucauacuuuacaagcuacuaugaacauucaagacacuugcaaguguguaggaugcccucaauagugucuccaucuaucucccugugcgugacuuccagaagaacucuaguccaccacagauaagccaccgucaaagugcuuagcugcauuucaacuuccagacagcuuaccagacucuuaaagguaggaacuguuuuacaccugaccuuuuuauccgaagcguguagucuagaaccugccuuaagcaaucgguagagagaaggugggucuggagacgcgagaugggagacagauagggugaagcagugucaaggagaaggaggcagagcaaugcccucuggguagugguggugcacaccuuuaaaucccagcacuugggaggcacagggagguucucuuaucuuacucuuagcuucuaaaaauaaggcucaggagacuuguuugcuuaagcagauguugauagugagcgacaccuaugguaggacuuagccugcuucccaaacccacuuaacuccuaacgcugcucuucuacagauggcucgaccacuuccuuuagcuccuggcugaucccuuguugaaauucuuuguccuguagcgccgaguagaggucaauagcuucagagacagagcggaugggauggcugggguacugauggcagcuggacaaagguuccccugcguggguugugcacgucagcggaggaggaaggaaacagcgguggugcugcgccaggcagcugggguugguguuaaagcucuugcugugccugcacuugaacuccagcaccauccucguguacauguugaagguggugaccgcugacgccaugcagcaggugaaggaaacccacgcugugcuaggggcaaacacaaaggagggccaguaagagucugacucuggaaagagaagcaccaugcauacugccacaggcuaggcgcugucuuuagggggauauggggaccugaguauauugccuucugccaugcuacugugaaggacggagaccagaggacuucaucggccuuaguuuuguacucaaagagaaaacagguagucuacugcacugaauuccaccacucgccaccgacugccaugcuuugauaccucugucugugguauguuuauuuaccccuauaaaaucucccagaccuccuagacuucaggcucucaucuauguggugggcaggcucagacauacccccuuaccccuucuuuuuucccuuuaugcccuucgccaaagagaucccuucacccugauccuggaguaaccgucccuccacugcccagcguuguuugaacuuaacuguucccaaguugagccuuuugaaucauucaugaagacauuuugcuacagcucugcaggcaucaucaccuuuugcucuagugggguucaacuauuaugaacgcugugguccuuggcacagggucauuuacaguggaagcugagugugaauagaagcugggugggucccagaaaggagaaagcacagcagggaacgacagcauuccuaaagacuugggaaaccaaacccuuaaaucucgcugcuaucuugggaagcccaggaaacaggagguuuugugagguuaagaccugccuggaggccaaaggcuggugaaaggcaggcccagggccuguuaucccugacagucgaugacuugcagccugagccccagaguucucugcuucuuugugugugucuccuguguacaaccuuuuggaucuguccaccuuauuugaggcuacaugucuuuuguuguuugccuaacuggccuaugagcuuccgggaacucuccacgccucccaucccucucaaucuauaauccacagggauuauagacacaugcuccuguguccuccuucuacauggguccuagggauuugaacucagguccucaugaguucaucauagauggcacacgucuuuaguuacagcacuugggaggcagagacaggcagaucucugugaguuccaggccagccuggucuacgaagcaaguucaggacagccagggcuccauggagaaaccuugauugaaaaacaaaugaaaaacaaaggaaggaaggaaggaagaaaggaaggaaagaaaaagaaagaaagagaagaugagcaaaaagcaaaaccugacugguugugguuggggcaaacggcaaagcugaccuggggcuggugguccgauuagaguccucagucacaacacauugcagcuugaggaaauggauaggaucugauguggaaaagccccacuguagguacaguuauuauggaacugugagcccagccuacugcguuuucuguacccuugguauguuuuuuuuuuuuuuuuaaagcagaucuaguggagguuuauucaggaaaaaugagaaaggacuccuggagggggaggggcuccgaguaaagguggcauucagcuuggauguguggaggguggugaacgccuaaaaugccagcgcuugggaagcugaggcaggagaaucaggaguucacggccagccuccgcuacauaguuagaggcuaacuuggcaacaugagauacaccucacaccccacaggagaaguuugaaaugaccgagcccuuuguguuuaaggcuaccguguagaaggaaacaguauugugugaggccaccggggcuggugugggcuggagcucuuucugcgcagacgcucugaacuccagcacugaccucuuggugacagcuggugccauacgguucuauuucuagcaaguucaguagaauuugaaacucaggaguuaggaagaaguuacucuuggaguaaggguauauauacucgaugcaagagauuccgguugaggaucgccgacggaucagauggcguucaauccaauuuucaagguuauaacuauuguccgcauuucucuaauacccugagucauaaacuauagagcauguagcauaguucucacaagcuguauaagaccagccuugcuucucaaggacaguacacagaucacagacaaagaagcaacuauuacagcugcugagcagaaaagcuggaccagguugcauccucaaagccagagaggagaauguucuaugcacccucugaaggcagagagcagggagggagggagaggaugccuccugguccugcucugcauuugaugauggaugaagauggccuggagucgagcugucaagccucaagguauaaagauacuuacuagaaggcccagccguaauuccaagaguguggucuccaguccuccggaccuaaguuggcaguugccuggaagacuugugaauauagcauaugagccaccauccccagaaguccuacggaggaacaagaaagcagagauguguguggcaucuggcuauuggcaccagggucagucugcccugggcauccauggcuccuuugccaucacauuuccugggauacugugggaggagcaucuccucacauguccauaauucacaacagucgagagcugggacagagucugagucacucucauggcuauugcccauuuugaguucuuccuacacauuggucuucagugugugugugugugauuuuauuucacuuuaaauuuuaaccaacagugacugugcugugugguaaagcuauagauucugguugggaaguagagccagcuaaaaguuguacauguugaggaagcgugcgaauagaggaaccuagaagcgaaagccugugugacggacagaacauagagucuugccugcugcuucaguuuaaagugaaaguugccugcacaguauauuguuccaccucucucugugugauuguaugcaugaaugugugcgggugccugccccgguauaggcacaaggguccucagcuuuuccauccuauucccucacggucccacgcugaauuuacagcucacuacuuuuugccuaggcuggcuggccagcaagacuuagcgaugcugcuaucugauacuugcaugcccagagcucggguugcagguacaaguggccauacucagucuuuauguggugcuggagagucuaacucaggcccccaacuugagcaacaagagcucugauccacugagccaccuuccuagauccuacccccagcuuuucuucuugcuucccagcccuuuucuccucucagggacaaagauucaagccuugaagguggcacuucacauugaccccugugaaccaagucauggcgcuauacaccucuaauuucagcuguuggaagcuggaggccacccaguuauaguugaauuacagucuaaccuagccuacauaggaaggcccugggccccgucucacacaaugagcaaaacaaagcaaaaccuccaaaggagccuggagaggaggcacacucugccgaggcacugucacugucacucaccugacaggaccaaggagacggcugcaaacgcgcuuagcuugagcccacagccaggguucguggugagcaacagauccgucaguagcaggaggaagcugaugaguugaaguccgauauaggcagucugggcucccagugacagccaaaagaccucugcgaggagccaggaaaagaaaccccacccagacggugagcaaccacuguggacacacacaugcacgcccacuagaagucagaggcccagaggaacagggagagagagagacaaagcguccucaaggaaucuguguaucaccguacacacacacacacacacacacacacacacacacacacacacacacacacacacacacacacacacacacacacgaugggcugugcacacugcuaagcuucccuguggaacagagucuucuauuuucacaagcccuguacuuaucaucuuccuugucuuucucuuuaauuugggcguaugucuucauuuucuggaccucucuccucuuucaguaaggaaaaacuugggcgaggcaggaagagagcaacgucucgaggcuagcucagcuacagagacccuaucucaaggaaacacaacuaaagccaaccauccccuccccccccccacaauaagaaaauagagaggaaagggguugcuuucugauuugugagcuacauucguacaagggcgagucagcuucaggaggaauucccgucagccugugugaggcucugagguagagaaaggagaucacaguacaguuuagauccagagaggcccaggucugucugcaguuaugaacacguacuugccacgggcccccaagggagguggaggagagaagccuucuccauuaaccacuccccuccaaaucggagaguggggugacaugagccuugcaacguggcaaauuccaguaguccuuucucaccucucugggcugguggugugaguucaaugaaacgucugcacuucuccccugaaacacacagaaggcucaguguuacaaggcggguccuggaacugugugguggagacucccccccccccccaagcccugccacauuugcucugacagcucucccccccccaccccccccccacccccgcuccaggcgcucacaccaccauucauucccaagacucgcuuucuggccuucaccucuggugugcagaggaagcgucuuccuaggucagagcuccaauuuccugucuugauguuaacaaguuaacaaguccuuuugcugcuggaccaaaacuauuuauggaauugugaccgggauaaugucagguaccacaaggcuacaggugauaugcaucugggcucucucucucucccccuucucuccccuccccccuuucucacaccccacccauuuuuauuucucuuccauguuuuuccccuuagcccacuuggaaauuuuaauaucaaguugaacaugaucucagguuuuaggacuuuucccuggccccagugugacuuuuaaauauucugaaugcggaggaagaggaggaggcagaggcagguuauaggugucauucuuucugaucuaaggcauacacaccugacuggugugaacugaccuaaggcauacacacugauugguaugaaccgaacaguguuuuuuuuuuuuuuuuuuuuuucaguaagugacaagagacuuggaaagaccuguccguaguuccuccagggcauccuaaaaucugucuaucuauuuucuacauuaucuacguauguaucuauguaucuauaaguauguauguaucuaucaauauaucucuuucuauccauccauccauuuugaaaucccgggaaccaacacagggcuugcacgugcuaacuacucaacccuggcacuacauguccaacucuuguuuucuucaagacucucucacuagacaguccaguaugcucuugaaaucaccauguagggcaggucuuccucauccuccucacccuccugccucaaccucuggaguguugguucuaucuauaggauugugcugcuguaguuuccccuuacuuuuuaaaugccagcacugauguucagccaaaaaaaguggggggggggauuuaggugugcuguaccucagcccuuucaucuaaaaggagcaucaaggccuacagaaaugaagucguucaugcagaggucugguugggcagagcuaggguuguuucuaagcagcaaugguagcccacuugaagaaagagucugaugauuuuaaagugucagcucuaaaggucuaagggccaacacuguguuaaaccacaccugcugaaguuagagaaguugcaaagccucagggggcuuaugacugugucaaaaggggccacagagaagacauuacagaaagaguuugggcgugaggcccaugguggaaaccguacaccuucccauugcugcgcagacucuucucagcccagugggguuucuuuacuugcauaagaucccaagguugccugccuuagucugguauggugucucccaucaguacucaagaagccaaagcaggaggauuggggcaacuucuagguuaggcagguguaccuagugaguucuaggauagccugggcuaccaauugagguaaugucucaauaaacgguuuucucuuuaaaggcaggugagauggcucaaugcgugcuugccaagccuggcuacuugaauuugauccccuggccccacaugcuggaaggggggaauggaguccugcacacuguccucugacuuccacaugcaugugcguaccccuguuccccguacauacccacacacaaugcaaagaaaaauguaauugagaaagcaggucaggucgugcagccagcaugagggaauuaccuggcucuuccaugguuuccucacaggauagccacaugccacugcggaaggcaaggaaggagaaccggucauccccagucucccagguguauuguaccaccuccugggcugauguguuggcgaugcccccauccaaggacaucggcaugucaaagcacuuggcugccagacuuugcccgcacaggggcuugggcaccuucugugugcccacaaaccacucgcugcugagcaaggaugcuguggagaggccgagugauaacauguugaggauggcagaaaugaagguccgcuggucagaggaacccuucuggaacuccaucugcaacacacaagcaggcggggaggacacagaucugaggagugcgcucccuggaccccacucacuccucuucaacacggaugggcaaagccugacacuugagcguuuucuccaggaggccccguagaagccaugcuucuauguggccaggagcaagggcuguagugaugauccucaucaaacugggacccugugucacuccugcucugcaggagugauuuucauaggcagagugauggcuggauagacacuggacagguuuacagagggaugaaggugauaccagaugggagacauucugauggggaacucuaaagucagcgcaaauuggaugugagcagggcuuuaggaagcaggagaguuugccuggcuuccagcuggcaagcccuagggaauguguguaagugcgcuugggcagaagacuuccucgggaccccacugaggguauguaugcucaggcaaaggcagcaagggaacaagggcggcucauugugaaugcucugagcugucagccuccuuuuguguaauuuuuuaauaauaaauuguucauguauguaaa

SEQ ID NO: 3442 - RNA, 1264 nt, Mus musculus
auucaucauauaguuuguuuucugcuuuaauuuuuuuaauuugacaauaagcaaacagaauuaauguaaacaacucccagaauaacuauuuuuguucaggacugcauccgggcucaugccaagccagcacacagcagaggugucuuccugauugcuucuuaacagagcucugcucuuuaauggaggcauaagacacagauacuuguccagcuguaugccuaggaucacccagauacuaagucucugguugugcaggugggagacaggaccuucagacaacucugagaacuggaaccacugagcacagcuccugauucagaacagaggcagaggccaguccuugcuuucuuccuguaggccuggucuuuucccuuggauuuugccuucuuuacuuucagaguuacuguucuuuuauuaccaauauaacgaguccaucacagugccaaaucuccaccagauggagcuuaaguuugaucaaaaccaacugggugcaacuauuuggaaucuuuagggugagaaaaagucauccuaaacuaccucccuacaacagcucaagaaucccuugggcaggugggaaugggaaaaggaaagacaugccacucauugcugaacccgauaauaauauggcaggaguggccaugaucaucaagagauccuccuauuucccagacagcuguuuguacagcuuugguacauagcugucccauucugccugguaacacgugccggccaccggggcucccaggugauacuucuugcggaaggcugcaguuuugaacuucccacgauggucuccagaccgguuggugaggauggguucgucacaucucaguggcuuguccugcugguacaccagccagacauagcgauggaggccagugcccuugggagguccggaacccacguaauccgagaggacguucccacugcugaugucauugccuuucauguugaccaccagaaaauggugccauucccuguacacggguuucuuccuacugggagcauccgggucugugaggaucaagguguagaguuucccugugucaaggccaucccaugaaaugcuuccgggucugugcuuaaccugggugggcgucagcacuuggcccagcucuuccaccuccgccucgguguaggugacccgcaguaggugcuggggcugcucauccacuucguggaggcucagcggcccgguccacaugcucaugucuguaggcauggugagaggcuggaguggcgguugggugcugcugaaggcgcg

SEQ ID NO: 3443 - RNA, 1264 nt, Mus musculus
cgcgccuucagcagcacccaaccgccacuccagccucucaccaugccuacagacaugagcauguggaccgggccgcugagccuccacgaaguggaugagcagccccagcaccuacugcgggucaccuacaccgaggcggagguggaagagcugggccaagugcugacgcccacccagguuaagcacagacccggaagcauuucaugggauggccuugacacagggaaacucuacaccuugauccucacagacccggaugcucccaguaggaagaaacccguguacagggaauggcaccauuuucugguggucaacaugaaaggcaaugacaucagcagugggaacguccucucggauuacguggguuccggaccucccaagggcacuggccuccaucgcuaugucuggcugguguaccagcaggacaagccacugagaugugacgaacccauccucaccaaccggucuggagaccaucgugggaaguucaaaacugcagccuuccgcaagaaguaucaccugggagccccgguggccggcacguguuaccaggcagaaugggacagcuauguaccaaagcuguacaaacagcugucugggaaauaggaggaucucuugaugaucauggccacuccugccauauuauuaucggguucagcaaugaguggcaugucuuuccuuuucccauucccaccugcccaagggauucuugagcuguuguagggagguaguuuaggaugacuuuuucucacccuaaagauuccaaauaguugcacccaguugguuuugaucaaacuuaagcuccaucugguggagauuuggcacugugauggacucguuauauugguaauaaaagaacaguaacucugaaaguaaagaaggcaaaauccaagggaaaagaccaggccuacaggaagaaagcaaggacuggccucugccucuguucugaaucaggagcugugcucagugguuccaguucucagaguugucugaagguccugucucccaccugcacaaccagagacuuaguaucugggugauccuaggcauacagcuggacaaguaucugugucuuaugccuccauuaaagagcagagcucuguuaagaagcaaucaggaagacaccucugcugugugcuggcuuggcaugagcccggaugcaguccugaacaaaaauaguuauucugggaguuguuuacauuaauucuguuugcuuauugucaaauuaaaaaaauuaaagcagaaaacaaacuauaugaugaau

SEQ ID NO: 3444 - RNA, 7409 nt, Mus musculus
ugaccuggcuccagcucuguuggaauuuguuugccccugggaugucuacugaaaaaugugguaagacuucagacucaacaaagccugugggagggggaggucugugggucugugggucugugugucugugugugugugggaggggggggguucuaugggugugugucugugugucugugggagguguggaggugucugugcaugugucuguguguguguccugugugugucucugcaugugucuuauauaugucucugcauguguaugucuugugugugacugugugugagugugugucugugucucugugccugugugucacacguacuuguguacaugauggaacuaaaagccagaggucaaugggaugucuuacuaaauuacuuccccaccuuaaauuuugagacaagucucucacugaaccugacaaucacuguuuuuguaucauugacuggccggugacuaccaagaucugccugucucugcccccugcgcuggaauuguagaugcaggucaccaggcgcaaaucuuacuugggaugcagggauaugaauucugguccccaugcuugcauagcaauugcuuuguccaccaaaucuucuccauaugcuguauuuuuuuuugagacaagaucacucacuggagucccucuauuuggccagcccagcuggcuagcaaguuccaaggggucuuccugccucugccuucccccuggcaugacuauagguguauguuaccccucgugagugcuggagguacaaauguggguccucagcaagcacccugcagacugagcuguugccggugccccugcuuuguuucuuucguuuuguuuguauggagguguugugguugugauuguugguguugaggcaggguuuuguuguguagccccggcugguaaggaauucacuuuguagcccaagcuagacugaauuugaagcaacccauccaucucagacuacggggcacuaaaauuuacaggugugaaucaccauaucugacucaggccauggagggcaaaagcccugcacaccggggagaugcucagagaagccagagauacugagccuagcuccggagacacauccaauuccccugcccuauaccuccugccaccucugaacuaaacucccaaagacauuucuaugacucuaacagcaagaggauccaaaccuguagcuaaaucaacccuguucugggucucuguugaggucauaaguuagcauggcuacaccugacaaaucgacauauucuuuagagauuuguucagaauuucuaccugggccucuguugggcuacauuuccacaaucuuuauuuguugcugcuuuuuuguuuguuagguauuuuuaauuguguguguguguguaugugugucugucugugacucugugcgugugcguguguguguguguuuaaguuuucuaggagaccacacaaauaagauucccuggagcuggagucacagaugguugugagcugucuaauguggauacugggaaccaaacucagaucaucuccuagccaauaugaacuuuuaaccacugagccaucucucuacaccucaccaucuuuucuguugggauacaauuccaaacauagauagaaucucugaguccacacugggucccuagagaaucucaucaaugugccuuagucacggggcagguacaauuguagugggcgagagccucagugugguacaauuguagugggugagagcuucaguguggacucacucgccuucuugccuuaggccuggagcuuguuuucauucccagcacugcucaguucuucuguggggcucugagauucucucuucaagauguguccucaacacuaucuuaucuauagaggccaaugacagacucucgacagaggccacaagggaaucugagcuuaaagccaggaccuccuauaccuccucucuuacuaggaaucucaggagcaggcugggcaugauggugcaugccuuuaaucucaguacuugggaggcagacacaggcagauuucugugaguucgaggccagccuggucuacagagaguucuaggacagucagagcuacacaaagaagcccuaucucaaaagacagacagacagacagacaaucaaccuuaggaacagcacagaguguggcuucaaaauauaugcaugacagucuuaauaagaauuuaaggccauccuggcuacaugagacccugacaaugucaccaccaccaccaccaccaccaccaccaucaccaccaucaccaucagcaccaccaccacaauaauaauaauaacaacagcaacaauaacaauuacuugaaaauauagcacucaaauauuccaaauuuuuagcuucuuuuaacuuuggaaaaguaacauuuuucuguaucuuucauguucauuuuaaauauucaaauaguacuuuucccuuuuuuuuucucugaaugucuauugcauuucauuuguuuuagcuuuucugauuuucucaucaaaucauuaaaacuuuuuccauccugcucgauggaaucuugaugaaguuucugcgucugagaucauuucaaaguugcucuugauccagccaaguucacuuaaugaucuacccucugcugcuuucucauggaucagaccaucuuuacuuacgucguuagaagcacacugcuuucuuagggaacagacaguucucuugggcuuccuuggacagauggcaaagcaagaacacuugcuugcuaccugagcaagaggaccugaguucauaucccaacacucucauaacaagccagguauaaccccagugcuggggcaggcaugcagaggggcagagacaggagggccacuggggcuggaugacugaaguauaacuccacauuuggugagaggcugugucagggaauuacuguggaaagugaugauagagcaggguagcagaaguccuccuccacccuccauaugcccacccaugugcacaaugugcacauaccacaccacacacacacacacacacacacacaacauauauauauauauauauauauaaaacggagaaagaacauugaaccaagaggggaaagguagaaagcucugagacuacaggucccuagguggcaauuuauuuguuaaacuuucagcuacucaggcaaaccaggcccaagucuacagaugcugaaagcaacccugagcacauacucaggaacccuuccaggccacccacaggaagcuaagacuguggcguuucuaggagugggaguggagagcuaugaauaauagcuucuacauucaggaagugggaaaauaaaauuuccuacuuaagauuugagguagaaguaauggcccauuguguucugugugggcucuguaugacaguggagaauccuaaggucugguguaacuguauggcagaggucuuaguuguuuagccuucacuucucuguguagggaugugggaagggcacagccagccuuaaaauauuaacauucuacacaaguuuacaaaggcagggaagaaaaaugagcaggaaggcuagggaaagaauaaagcaggggagaaaugggaggggggacuucauuucaguguguuuaauuuuuagaauaaauuugccagaagaaggagaggauauggguuauaauuugauuaaauuuagacaauaaggacaauugggugagaaagaggccacacaugacaagagcaacuacaucacugcauaaggcaaauucucugaccuccccuugcccucagaggaacagaacuuucuacucauggggcaagagccugcaccaugauggagccgaaggcaagcuaggccuucugaacagguccaaccuaaaggagccuggaaggugagaaugauuccacaacagagagaggggggagggggaggaggaggggagggggagggggagggaagggagaggggaggggaggaggagggagagggggagggggagggagagggggagggggagggggagggagagggagggggagagggagggggagggagagggggagggggagagggagaaggaggagacaggcagagauaggcagagacagacagagacacagagacacagaggucccugagacagggagacacagagagugcacugaggaccaaacccuaggccuugagcuugccaggcaaguguucaaccccugagcucagucucuguccucuauauuccacccugagauucaagagcucucugagaauccagacucgauucucaucuuaucauagccucaucuuguaguccccaggcaagauucccagucuuuucauuaacuuccaaaggaaguuuccagguaauccuguuaggauggccaccagggccaguaaaauuauuagucguacucuccccuaagaaagagcagauuugcuguuagucaagagaaagccauggccucugcagcagaagaaaagagaaagugaaucagaaggaaacacggagagcgagccaagguaucuaaagccagcuugcagccaugcacgacgguagauggaagauccccuuucauggggaugagggcaccgccuaccugccagggucccaccaauaacuaagacucaugaacaguuccaaaaaaugaauaaaaugguaagcaauuuguuuugugauuaacaagguuugauuuaguuugguuuucuacaugggcacugaucuacaucacuccagacucucucccuauggaacuccccuuauccuaaaucacacacacacacacacacacacacacacacacacacacacacacacacacacacacacacacuuauaugugcaaaucuguauauauaaccuacuaacuucauguaguuuugcuugaacguguaugcgucuggugaggaccacuugggauuggacaacauaugugggaguuugucccagaaggcaacugguucucuuucagcagccauuggucaucugaagcucuucaucuugggauggaaccacgugggauuugcccugucuacacuggcgcaucuacuagcauugucauuuugcuggucuugaucagguaaaugauuuauaaagcaugaaauaccuuacacagcugugugaaucagcugggacuaaaugagugcggacacuuccugaggguccccuggagaugauguaccagacuuagaaaguuaaaugaaaauucauggccaauuuuuuccuagauguccagaagcugugccuauaaguguucugaauucuacgggcugccugcgaaaggacccuaagcaaaagucgccaggaagcagcuaaagugacccuugaggcuggccucuaggagcuuugagugcuguguuucuaagccauuggaaugggagggagaggugacugaaaggacagggagcuuguggaucauagacaucuggcuaccacacccucaucuccauccugucugaaaucgcaccccuggggcuggccugaagcacagcccagacaagcggggguauaaagugcuucucccgggacucacccggcacguccguccauccugggcuuguuuucucuucucuguguuaauuuugcagcaugccuuucagcuuugaggagauaaagccauguugacuucacaagcaaguccaagaaaccaaagaacucugggucuugcuccugguaaacuuuagagucacggcuucccccuuggaucugcuuuuucuccugucaguaaaugaaaauagagacacaaacagucucaaaaauauaccuuaagggggcuaguaagguggcucagcaaguagaggugcuugccauaaaguccagcaaccugaggucaaccccuagggcacacaugguggaaagaaguaugcaaaccaauagugucacggcuccauagucuggucaaggggaagguuuuuauuguagauauacgagagaacagccagaagcaucggaaagaguccagagcagagagagaaagaaguagacugaacauagccagaaaacuggaccagggcacgagagaaacaggagcacagcagagagagagagagagagagagagagagagagagagagagagagagagagagagagagagagagagagaaacagagacacagagagagacacagagagacuaucacagaaauuagcagaguuuuaaagaguagcugaggggagccagugagcuggaaaacuuuggguaggagaggaggccagaagagcuaggaugcuagcauggaccuucuaaggaguaacaguacuugugauacugaaggauccuggaugacucugugagagcucugagugaauaaaauaguaaauaugaacaugucacaucucgcuuugcacaaucuaggucaacauuaaaauggauauugaauauuuaccuagcagguuaacauuuaccaagugucuuauauuuaaugccccaguucauaaugaaagcuuccugcaggcuagugcuagccaggcucuaacugguuccaaaggauuggcauccuugguauuguugcccuugguuagccacuccacacuguagggcugaccuguguaaccaauagacucugcaagaaugagggguacaguccccaggauuagacugucaugaacauugcaauucucaccucauucugucuugggugacucccucugagcaagauagcugaugucugugaguacuucaagcucccucggagaagcccacaucgugauaacaggcaagaauagcuagaaagaagagcauccagucccccagggagucuuuggauaccugcacucacugccaaucccauuuggguuuuuugcuuguuuuauauaaugucuuuauugaaauauaauucacaugccauauaauucagccacuuaaaaggcacaguugauggcauuuuagaacaguuacagauacacguaagccaucaacaccugugcccuuuagcugucagcuccucauuuccccggccugcgucacaaagcaaccaccgaacaacuucuagauucaucucugucgauuugccacuuagauauauuugaagaaguggauuccuuuagacuagguuuuuuuucuuuucaguuuauuuauuauuguauguuuaugugcaugauucaaggaggcagagacuuacaugccacggugugauugggagucagaggacagcuuuaucagccuucacucucccacucuagguggguucugggaaugaaaccugggucacuaggcuugccugggaaacaccuucacccacugagucuuuccccugggccaggguguaguaguuucugacugacggguauuuaccguuauguuugcaaagucagucuggguuauagcaugugucagaaccucguuuccuuucauggcugaauagaauucuguucccguuguuuauacguguauuuugcuugcccauucauggacauuggguugcuuccaacuuugggcuauugugaacacuguuacuauaaacacugauauacagguu

SEQ ID NO: 3445 - RNA, 20253 nt, Mus musculus
uuuaaaacacggggaaaagaaaccgcccaucacacaccccagcacaucagcccaggaaacuuauaaccucgggagucaggucccuccccucacugugguugcaaaucuccugaagagaggaccagaccagcagccugcucuaccacccagggcaucugccucucucacuggauacuccagguaagauuguccccacacuggagaaacucugcagagcccgcuccuuucuuuccucucuuaggcuccuugaagcccuccccucucuucuugccucugcuaucccucuauggcucacaaagaacggaguccuugagacuucuagcuuaacguaguaguggaggaaucugggauaucagugggggccacauucucuugcugguauguggauccuugcuccgaggagacggacggaacgagaagggacuuuggaacaaacuugagugcaauauucuuuauggaaggaacucuaugugccuucgaaaugaauuagcaggguuggaagauguuuccaaaucuucuguuuucauucagauuacuuugagcugaaaucuagaaggaugcuauguuaccaaaacgcuccggcuuuucuuuucucucugcgaaggcagguuaaaggcagucucuggggagaaaguuuguucugcuuuguggguugguuauuguuguuucucuuuuacgcuuuuaggugacgguggauaaauaucugaguuucaguuaauuuuugcgauugcauuuacugucugucccccucuugucuguugaugucuguuuaaguauuucguucuuucucuuguuuuccuccacccccuucucacaggaagggaagaggggauugguuuguuuaaagaaaaaccguuagggaaacagaggcaaaggguguuucaaauaaaccuugggagggguugauuugguggaauguguggguuccagaauccuuagccagauguggagguggaggaaggaggcagaggggagaggguggggcugggggccuucggggauuccuguaagguugcugaauggcucugugcuuccacccaggcuucugcauucuggagccaacuuaggaaaaaaaaaaagaucuuucagaaucuauuaaaggauuuuuuuuucuaaguggacauggaauuuucuaguguggcaguggucauaugggaauauuuaccuuauuucuuuuguguaaaauauuauauaacuacaaacccacgugcuaagugcaaaaagaacaaaggcacucggcuguguuugcuuuuguuuuuauuagcuuagcauuuuggucgaaugucuguggaggugugguucauuucaacacagauguggguuuuuuuuuucuccucucguaaacaagccagaggagagugacaggauucagcuugccugaugaagagcgaggcgccuuucucuuuagaaaugcagcucgcugguuggaagagaaaauuuaaaaguaauugguggguguguauccauugauccuucagaaaucucugcaaagccuuuccccaaggagggggugaugaguaagcccugggacccauuucucaagacugaguuugcuuccaauguuuaucacuuccagauugcaugacugugaacuggggaagccgucuucguuagguccacagccacaguuuccugugaagaucacaugugugauugugugucauucugaucugguugaaacuaggcaaccuuaaacaagucagcaaaaagggaacacuagagggagggguaaacugccaccaacuccaugagccauggagcugucucaaacuccacugucccuugauaaaugagaauauaaugcuuugugugcuacccccucccugcccccauucccuauggaguuggaagacaauuuuaaaaaaaaugaugcucugacuuuuugccuccaaguagugggagagccccugggcugugugugaaccuuucugggcgucuucagcucuaagucuuugguuguccuggaaaaagaggccauuaccacccccucccaaaucauagccucccauccuuaggccgcuccaguuucauccagagacugcagaaugggguggaggcagaacacuguccagggcugcuggacauccgguuuggcauccuugccagagagcccccagauuuuacauuguuccaggguucuaaacuguccugggaguuggcagaagaucagcaagguccagcuggagacgaucauguccugagacuguggcuacgggccaguaguaagggcagcccuuugccagaggacagaugucuguccccagaccuugagaaagguuggcuggcuuucucagcagucuuugcuuuccucuggaaacaagauuaggccggucuccagcccggaggaaagagucuguggaagcuguugggaauacagggccucuugccugguucuagacagcuuugggaccaaagagcaggaaagccaagcccauuucuguuauggaaaaauggauuuucuguagccuccacacaaccugaaggggucuccaccugggauguggccaaggguuccuuccuuauucuucuucauugcuuuuuauagaaucuuaaauuuagauguuggacaugguaguucauaccuguaaucccaggauuuagggagcugaggcaggagauugcuaaagguucaaggcuagccugaggccaaccagugaaacuuggucucaagaacaaaccaacgacgagagagagagagagagagagagagagagagagagagagagagagagagagagagaugaaaaaagaaaagaaaagaagguaaucuuauuaucuuaccauaugcagaaaucuaacuuuuacaucauuaugaauggaugguugucccguggcucacagcuccuuaagauagcagggcggggacacccagaguguacgugccucagacguucacucacacccacccuucuuucuagacaguaaaucauaccagacagaguuucugaaauucagcaaaaauggcuucuuugaaaguucuuguuuuugcaggccugaaaugacccugggugugugugugugugggugggguggggaggggaggugcuuuucaauucuguucugcugcugccccuccccccaacugcugcccccuccccacaaugcuccacuuccugucccucuagacauuucaucucuacuuaacauuaaucaguauggcuccaugggauagcauugcccauaugaucuugcuuuauucuuuuauuauucaaauacagaaucacacaguguagcccuggagguuuggaacuuacuauguagaccaagcuggcuuugaacucacaaagaucuaccugcuucugcuuccugaguucugggauuaaagucaucggguacuauacucagcuguguuguguugugagacagggugucuccgugaauggcaggcuggagccuagaacuuuuuuccacacuucuucccgaaugcugaaguuauggguguauaccaccacugcuggugcguguggggaugcagaaagaacauuuuugaaauauuaagacacccgccuggucaaaccauuuguuccuauaugauugauucugagcuauuucauuuucuaagcccaugacuguugucaugucuguaacucgcuauguauguguacauagcuaugcaacauacacucucagaggacucuaggacucuuagaugcacgugggaugacacauccaauguugauaucuaccggucauagugaaaucaacaugaccccugaaacacaagcugucugauagccagcaaccuucuugguuaccauuaaacuagaauuaucuggacuuaagucuuguuuuggaauaaucucaggugacugaauuucuggguuguccuuguuuuuccagaaccaaagaaugugcagugggucuaguugggaucuccuuggcuuucgaacacucaucucccaaacaugaguccccaagaagacucugaaacacuucagucccugguacccuaacuugugaaacgcaucccucaauuugacugguggguucccugacagcaaaggagaaaaagaaaaacacaaacaugacgguugcugcuucugagccuuccguuuaagcaaaaaaauugauaugugugugugugugugugugugucuuggggggguuaucaauguuuucuucccuguucagaaagaguauuuucacagccaagacaauugaucuucugugacuggacugacuccaacuuucccgagucucuuucauggagcacuacacagcacuguuggcacauguugaaacugugucgguaauagugggggagaugugagaugacugaguagcaacguugggcucugaucuugucucgaaucuucccugugaucagaagcaacuaacucacuaagaaaggacgaagaaacaacuuggccagcaagacacucaaggcucugaaaaaucuaggaccuuaccacuucaguuuuaagcaguccuuugaguccaugcuaauggcuaacuuaauccauaaaaguuaguguagucaaaccaggggcuagggauacagcccacuggcaguaugcuugccuagcguguucguggcucugcauucaauuacaagagcugcaggggucaggggaugaggagguggcuucugcugcccuaccugauccaagaguccuugggcacaguauuaaagaacucaccugaaauagcccuggauauuacccgagcuuggaaagaaggaagauguuuggcuuaucaaacaaagggugccaucuccggaggagucugugcacacaucaguucacuaggagcauaacugggcucagaaacugagcugguccuggguaagacacuccccuccucuggaggagggggaacaggcacagguguggaugagagcaaauggagggcauacugggaggaaaaagaagguuagggaacuagagggugagagagagagagagggggggggagagagagagagagggagagcaagagggagagggagagggagagaacagaaacuguguuugggggauagagcaaacagaaaggucuagagagagccaaguagagagagaaagugaaccugaaagggagacaugacugacugcucucacugccccaggauaggccuuggaucaaaauccugguuuucagaccuccauggaagucuuuucucuucuuaguuguggcgcgguuguugcauguuuggggacauuggguuuuauagguagaguuccggcgccucuccucucagaugagagagucaagccuagugaggcccuagacuuuagacuucugccuucagaaaccuaaguucuuucccuugggguccaagagaaggaagaggagagagcuuuguugaacugcaacggugaauuuugcuuaagcaggcgcguucacagaggccuggcaaagccaugcaguggaggccaggagcuucccucugcucagggcugcucccugaacucccauagggaggggaaugugccagcgcugagaguguggaaaccagucucagggcuggcagggaaggcuuugacagggccagcugucuguucuggcuggaccauagagagcagugugacaggagaaagcaauggucuuugcaagauccuuuguuuagagcauugggacuacuuugaggggcuguccaauucugauuggcucgaaaguugugggaggaacagagccaccaguaacugucaaacccucagaggacagcgggauguggugccacaugccuuuagucccaaaaccagggaggguugaagcaggaggauugcugugaguuugaggcuagcaggggcuacauagugauucagugucaaaauaucaaagggggggggcuggggagauagcucaguggguaaagagcucacugcgugaaaagaagacuugaguuugauucucaaagaccacaugaauaaucggguguggcuggauuuacaaucucaccuauggggaaggaaggcaggaggcucccuggggcucauagccagucagcuuaacugagucuugaagucccagccacuaagaccccaucucauaaauacaacagcaacaaaaaacaagcuggaggacaacuucgaaugaauaacaccaggguugucuucuggcugcuacacacacauacacacacacacacucacacucacacauacauauacgcacucacacauacauacacacucacacacauauacacacucauacuuacacacacauauacacauacucacauacauacacacacauacacacaugugcacauacacucacacauauaaauacacauacacacauacucucacacacauacacaauacacacaugcacacacacucacacacacacucacauacacacauauacauguacacucacacauacacacacucacacacauauauacacacacucacauacacccacccacauacagauaugcacacagacuuacacacucacacacagacucaaacacacacacacacacacacacacacacacacacacacacacacacacacacacacacaccucagauagaagacagaaaaccaagcuggaguggagauccaagacaguggcuucauucucugcuagcugggaggcagaggucuuggucaaaugacugagagaccccaguaucucucaaaacaaaguagcugccaucucugaaacugcaccaagccagcgcccaccuagcaugcuugggugccccugcucugcacaguccuccagcuccaucagccuuugcugguugaagcauguuacugccaucugcugucagaugcacccagaagccucuagggcccagccacaccuugauuuuucuuaccaaacccuaguuauuaucuuggcaaugucucccuggaagacaaucuggcugcaggaguacuucuccuuugucgggaacagaaggcagcagaagcuucuguccucacccaggagacauccuucccgacacuggccagcugcagccagagggugugggcugaaaucaggccucacagccgaggucugucuccagccuuugcagauguuguccagauccacccacuccauggacacaauggaagacaagcggaaaugagagggagggagagagagagacaaggguggggcgucucuggaugcaucugcaaaaacaauauucaugcuauaugcuugccuuugcauaguccacggcucucaggcugcagagaagccuugugaccaccucguuugagccuuucucuguuacaccaaugaauaaauaugaccuacagcauuuggcuugcuuugucuuaggcauggacccuucaaugcucaugcuaagccuaugagguccuuaagaaauuugaacuuagagucuguucuuugucacuugggacucugccucucuagauuucaccaagcagacagguuuugcaaaaucuuucaacucuggccauuagccagacaagaaugcugugggacuccggcucaccuucuaauuagaccucccucccaaccuaccucccucccucccucccucccuucuuucuuucuuucuuucuuuuucuuucugacuuauucuuccucuuuuccucauuuccuucccauuuccuuuauuuuucauaucuuuuccccuuuccuuccuuucuuuaucucuuucugucuuuccuuuccucuuccucucccuucuaacccauuugcuguucuuuacucuauauucuaaccacauguggcagguggcacaggugggauuagcuccaaagaggcugccccauuuaugacaggccaccuuuguagccccuuugccccaggacuacaaagaaacagcuguuuccccgaaucacccagaccccugugucuuucccugcuuaauuguuaacaggcaccgaauccaccacuacuugaagugucaucccuagugugagcuacacagaucaaagggcgacccacaguguuuucuuuccacguccgagcaucccauaugcagaaacaggaagacuuggcccuuaaggauccccucaucccguuucccacacggagaugcaugccucccuuuccaucugugcgugaaaacaauguugaggauggaaaaguacacaugacauaaaaagcaacaacaauggccagggaagcucacccaaggccccauccaccagccugccuucaaucacagccuucccauccuccagauacauccuccacaccguuccccaagggcagaguuuccuuuugcuuauuugcuuuuugucccacgggcaucuguuuugccaacuaaaaugacccucaaugggaacgcacacacauuggaaccccaagcacagcaagaaugguguugacauggaggaggguagacagacuuccgugccacccugcaguguucuuaagaaacacagagagccucagauccacuucaaaugucacauugaagaagaugugcacagucagggcugacucaugaaggccgcuugacccaaucccuuuaagagcgacuuggucuuuccucuuuucccccugccuugcaggaaguaccaggucuuggaucagauggggugaaaaagccuucacuccaauugcaguuagccagcaggaggugggaaugucuuugcuagaacaucacuggccaauggaaggacagaggaggcucuaggaagaaucucuggacagucucauuauguagcucuggcuauccuggacuucauguauaguagaccaggcugacuuugaacucacagagcucugccuguuucuggcucccaaaugcugggauuaaagguauguuccacucuauguggaauaggcaagcacucgcucuuaccaaaugaauuauacucacauucugugggcuguauguacuguuggcaggacuuuucuaacagggccuuggauaguucccaaggacagguugaguuuaaguaugauuugcauagauuuucagguugaguuuguagaugaguuucauggcuuuggaaccaaaucuuaaagcucuccauuagcuuggaaguucuauaccaaaaaguuaaguggaaaugaaauaauaugaaguuuguguauaauaaggugcccaacccauaacuugcagcaauaugacaaauaauuuauaaaagugacagaggacugaaguauaugcuaccuuaaaauaaaaaaggaaguucuguagagaugggucacugacuaagagcauuggaugcucuuucaggggacucgaguucaguuuccagcauccacauugcugguaguccauaauuguuuguaaucccaguucuaggggcccuggcaucauuuucuggccuccauggguacugcaucaucucaugguacacagacauacauguaggcaaaacaccuacacacauaaaauaaagauuuaaaaauggaaagaagagaaaggagguguucugugucuuucagccacucugccauuauuuuuccacagugaaggaaauauugcccucuuuaguucauuuauuuguucauuaacuagguuuaucugguaccugucauagagucugcccuuaggaacucagacuccugagggugggggagccaagcagguccauaaagaacucugucaucaggcaggcugccaugagggccuuuuauuaagaauacguaacauaacaggaggaaaaacaucaacuucagcccugcggacagaaggaggcaggauuugagcugggugagaaaaaauaauagguaguuacuaggggaaggacauaaaaguagcuuucauuuuuggaagucaaauucccaggauuccgugggcagcugucuggagucucauuucccggauacgggugcuugucucaguugugguagggggaugaggguuguaggcugaggaaggccauggccagauaacccaauagcaggacagagagagcauggugagggggagguuagagaguguguccugggaggagcugacaucagcauccaggcuaggguccugacagugccggcaggauagggacccacugcaagauaacacagguagaaacucccaggugacugugaagcuuaagacaggaagccagggagaggcagaaaugguagcugagccauuauuggucguuucuucccaguaacgggcucucuuagguaccccucaucccuacuccagaacuguuuaaacuaguuucagccagccaaacccacacacacaguacuaggaagcaucuuguauagucuugccaaccauagagacgcucucauuuguaagggugccacccagucucacacgaauuguucagcucuauacacucaggauguuagcucagcacuaaggaggcaggagaauucccacaaguuugggcuacguggugauuuccagcuguacuuggcgcuaagagucugauccuucuuuuuccuaauaguuacuuaguguggucaucugugccguuggguugcuucucuguuucccuagacccugagcgcggcccugccaaucacacagugcagaugggguaccugcugugcuuacagggggcaggcacaagaagaaggguucuuguugucugcauagaaggcagagcacuucccacgguuuccgaacauugugaacugaccaggugugguggcucacuggagaguguaaaagcaccacaggccauauuccugguaugggaguccccaacaacagaugacacacuuugagucuguccaugcagcaagaagggagggcggugguacagcggaagucagaguuguggcacuguguucucugcuuccggguuggcuccaccccuugagguuggggaacgcgcucuccacugaagagugugaacugcagcauuuugggggaauaggagggagaaucccauuacuguuucagugagauacaagcugcagcagcccauacuuucaaaauugucuaaaugcuuguguucguuuuguuuuugugguggugcugaggagagaucccagggcucugaacauguuaggcaagugccauaccggugagguccacucugagucugaggccagaaauggucuuauuccuugggugaggaaugagucaaaggaugagcuacaggagaucaugguggguggaagugucaagagcuugaacuuagccucauucucaguugccuuuacuggcuucucagauacccccacccaucagcaccacuggugguuuucugaaaacaccuugaggguuuggucuuuccaaacccauaguucucagccuuccuaauuaugggacccuuuaaccauaaaauuacuuuuguugcuccuuccuaacuguaaucuugcuacuguguaguguaaguaucucauaugcaacccccgugaaaggaucguucgacccccaagggggucacaacucacagguugagaacagcuguccuagacuaagggguaggcucucuaauacagaggcuggguaacucucuggauacagagacuggggugauccaacauagaaguuucauaaaguguuccauuggguuuccaaguauuuuggaagagggguguuaagaauaaugggagccccucuaagauaacaauggaugacacugguaaacuugacacaaagaugaaguucugugugucacucaguaacuccuccacaguggauggacacagugccuagaggcacagagaacugagggucuuguucacuaagaauacucauugaucugagauauuuuguuccuugccuuagaggaaagacacagaacacacacacacacacacacacacacacacacacacacacacacacacacccuaucgcagauaaaagagccacuuuuugguuugcaucuccucaucugcucuucaaguggcagcaggcaggggacaagaacuaguugggccugcgcugagguaagaagagagacggaguagcccaaaguguccaugcugcccagacaugacgagcggccacuggaccaggcugucagcaggaugaaacaagagggacucugcuggauagggucccagggcaaucaaggagacagaaagacuucuggauuugccugccugucaggcaacucauuuaaagaggccucacuuggugaauuaugguccauucuuggcuccucagcuacuuuucacgauuaggagaaaauuugucaauuauaaacaaaaugaacccgagagucauuacagggucgaggaggguggggggaaaguucccauuaugugauucuuguccuuuucuuuccugagccagcuuuauucuagaugggcaagccugggcugagaaaagccaacugucucuagaggaucuguucuuaauacccucccuacuggaggggugaggacuagacaaaaaugucaauuucugaggaccaaagugauuuuagccauaugcuguccggugaacuacccugcaaaugucuuauuucuugacuuugaugugggguggcaugugacugaguaacuggaccggguugguaacagucauucugcuucauagaagaaagacaguaacaacaacaacaaucacggcaacccuguuauuaguaccaugugacacacacgguacuuacuguaccaugcuucagaaggcauuuuuacuuacguaauccaguugcagccucacaccucuggguauagucgguaucauuaccccucuucacauaugaggaaacggaggcagagaucaaagcccuuggaauaauucuaagucaacuucuaacucaaaaaacaaaacaguaaaacaaauccuuuucuccacacaugaaagccaagggggaaguuacggagguaggcgagaaccacagaaaagcagcagugaacuugaaaguugggagagaggauucacaggcucuccccagaggcagcaggaaaauggcaucggguuuugccauucacaguuaaauugagaacauucucugccugccucccucaccguuggagggaagcagccaguggggaagaggauuuuuuuuggagaguagaaaccaguguguacaaagagccaagaacccaggcgugcaguagaucacguuugguuuugaguagcuaaugagaaagcgagaggagauaaaagacacgcagaaugucagaauaaugauaguaucgguguucuaauaaauaccuaguguagcuugaaaguggcuuaggcacagacaaagcaucaauuaaaucagguggagggggguggggaacaagcaauugcaggaugcacacagcaucuccucuaugguuggugcauccucacacacucccugccuagagggugaauaccucccccaccuccaaguccuuucccuuugaugucucucugagcugacucugcaucugucauaggugugacacagaggguaugcacggcugccccaugugugcccucuuacgcuuccuuuagcuucuagauuuuaugaucaguggucucuguugagauuguggcugagaacuuuuguuuauccaugcacauuguuaauuuauauuaguucaacucuuccgaagggugauucauacaucuguuugucuuuggggaugggucuugaaugacugaaguugcauaaacaccacacaccagcaaaaagcacaucugguguuaucucaagcuuuacacuucuggagccccagagcugucauguugaaccgcaggaaaucuaacaucgcccuagacccauaacagcauccccaccaagaggcacgcagggccaaaggcucagguguugcaaauauuagucuggaaugcuaaaucaguaaguggccgggccauuacccaguaauuagguugucacacuauugggugccaaagagcacuguaauaacagaaguugugucucucuuauuuuacgucucauccgggaucaaauuaguagccaauuugcucuauggccguugaguaauaguggcgugugcugcagaacucauuguuucuauucaguuugcugggugagcauuuugcuggagcacugaugcuuuccucaugcaaauggaaaccgggcaugcaugcugcugcagaguucuggaggugacaaaaaucuuccaaaaacucaaagccugacauuuuuggccugucaaucacaaacaaaacauuagcagcugcuauaaagcauaccaugcgcuucuuaauauaaugaauauuauauucuguaauuauacucauuauaucuguagaauauucauuauauuaaagagaugaaucuauaaacaugugggagcaaaacagaaguacuugucuauacacagaugaguaagcauuuggguauguguaucaaucagguuuuagaacauuuugauguaauuuuaaauuuuaaaaauugucacacuuucuugugucaacagagauccugaaaugagaaggugggaugcgucuuacugacugugacaauaaccuuucugucucccccgucuuuuguuuucagaauucucuacucagaagucaccaaaaagccaagauguuggugcuacuggcuggucucuuugugguccacauugccacugccauuaugcuguuugucuccaccauugccaacgugagucccagcccccuguuuccucaucccaggaaggaucuuaggaauaguuugguaaaagguuaaaaaacaaacaaacaaaaacgggagcugggaguguuaaaucacagagcagagaacuucuugaauagcugugaggggaaaacaaacaaacaaacaaacaaacaaacaaacaaacacauacucauagaucgggaagaaauaaccaaaguguaaaaggcgagaguccacaagugauuccucuagggguguugggagguucagcuuugagaagaauccucuccacgggagguggacacugaggugcguuuggaggaugggcgugucuccucuagaggaggaaguagaagaaaauagaagugcaguucaggcagaagggcaaagacgcccucgugggacagacucucccugugcucagguuaacaauaucugcucaugcgcuagaucgcagauuccugauagauagauagacaucagagaauaaggacacugcuuugguuaugagguugacaaauucaaguuuuguguggaaauaggugugugaaauggaauuugguaggauuaacuuggugucccgugaaucaaauaaaacgaucuucuacggagaucgcuagucugucuuugcucucggaacccggggcuacucugaccccuaguggucauuuuuagcacccacuuuguauugucuuagacaaaaugagccaguuucuugaacuuagaagucaaggcagccagcuagcccauugugaugguaggauuugcaugaagaaggcagaggcaagagagaggaccaugaguuugaggccagccagagcuacacauuuugccggguguguuggcuuccgccuuuaguaccacuugggaggcagugaguaaaggucagccgggucuauguagcaaguuucaguauagccagaaaacuacagagagaaacccugcucgaaagaaaaaaaaaacccaaaaauccaaaaaccccaaaccaaccaaaacaacaacaacaaccaacaacauuaaaguuaagacagccaaucauuagacacacaaacagugcuccaggguggacuacaguccuugcugugguuaaagggugaauaagguuugcuuuguuuuguuuuccagauagaguucauuuguguagcccuggcuguccuggaacucacuauguagaccagacuggcuuggaucuuaagagaucugccugccucagcuucccaagugcugguauuaaaggcggguuccucuguugauugacaagggugaauaggucuuaaaguccagacagaagggguuuugcaaacaucagaguguaaauacaagcuaggccaguuuaaguguuaugaaauaggacauaaccccugcccaaccugucuccuguaggcuuguaauuuggccauucuauaagcagacuccuaauccucacaggauaacaguguggugguaaacgucaaacuguauuaagagcuaccaugugcuuccuauucacccaguaccagcucugaugugggggcugagagaucaggugauuagguaugcuagggauuccuguuucagcacgguuugcgcauguguagacagaauuaucuucuguuccagaagggaauuguuuuucuugguccaggcaagaagggauggagaaccuggggaugugcauuuuggccacaccuugugcuuuuagcugccucugccuuggagcccuugaugcugcauuuugacauggaaugacuuugcauguucuaauggucugcaucugacccuucuguauagaggaagguugccugugggccccagguucauucuugucuccgcaguaguccucuguuucuuuguuguuuccagcuggacguuuucccuuaucuuuuuuuuuguuguuguuguucuuuaaagauuuauuuuuaaaaguaugucuauguguguggauaugcacauacaagugccagugaagaagauguuggauucccugaggcuggaguuacacaugguugugagucuccuaguggaggcgcugagacccgcacucuaguccucuuguaagaacuauaaauguucuuaauugcuaagccguuuuaagauccccagacauuuuuguuucuguuuuugcguuuugagacggagucucauguagucuacauuggucucaaaguugcuaucugaguggaagcuuuaauuccggagccuccugaguuauuuacagggugcugcagucacagcgaggugcucccaggcaagaguuaacuuguuuuccucauuagcuagggauuuaaaugugagucuuuuuaaaggagauugugcauacucaauauauauuuccucacccagaguuuuuguuccuuagaacuucagaauuuuaaaccacuaugguggaauuucuuuaguuaguuugugugugugugugcaccaccaauagugaaauccaaaauauaucuuuuuggggucacaauucucucucuugggaccuuuguguaccugggaucuaauuucuacagagacaugaggcuuagcaguauuuauagcugcauaggacgucuugguuaagauuugguccugacacguguugacauccucuucugaaagcagaaggguaauucuuaaucaacuccaucuccugguuucaggucuggaugguugcagauuacgcaaaugcaucuguagggcuuuggaagaacugcacuggugguaacugcgacggcucccuguccuacggcaaugaagguaugcaugcagacaucaaugccuagaacaccguggguguguucaggaagguguccagacucucugguugucuaaugcuccugguucugucuugucuucacagaugcuaucaaggcagugcaagccuucaugauccucuccaucaucuucuccaucaucucccuuguggucuucguguuccagcucuucacuauggagaagggaaaccgguucuuccucucaggguccaccaugcuggugugcugugaguauccagagcagcagagucuauuuuacaugagagcaucaguuucccccccacccccgccccacuguuccagacugagcacagggccuugagaugcuaaacaaauacccuaauacugagcuacauacauagucccacaggaaaagcuuacauccuugcuucagucacugccccucagauuagcacauggcuguguggagcugccucucugggcuguucucuccucuaguuaucuguugguggccugguauugcugcuuggaucaggaacccccauaugcuugggcaccaucaggaccacuucaauacagaaggugggaauccccagagaagaugcagcuauugccaugaugugcacaauuacugcaaugcaccaucuucuccauucuuuccagaaacacccaguuagguaaaaggccaggcuucucucauaacaccauaccuaguuguauggaggcccagaucggacagacagguagaaaucaggaugcgucaugauuuauucuucauuacacacaaaucaguacagauaggagagcccagcuaucucuuauucaccaacauaccaucaagcgcaaaucugggcaaaccaacacagugaccuuuuacggacacacgaaaagaguccacuuuccuauugcuguccaggaaaaugggaucauaaaaacaccaaaaaaacccccaaaaacucacuucaaugccaaucaugccagcucccccuuucuugcagggcuguguauccugguuggagugucaaucuacacucaucauuacgcccacagcgaagggaacuucaacuccagcagccaccaaggcuauuguuucauccugaccuggaucugcuucuguuucagcuucaucaucggcauacucuauaugguccugaggaagaaauaagccgaauacgcucaugggcgucugggggcggggugggcuggguaggaggaagcaaccuaaccugggagggaagcaggagucacuguguaggaauaacagagaggggagggggguggggagagggaaggaagagggggagaggcccaaacccaaaccauaucuggggcggugggauucucuacugccaagcacccauccuuggaagaaaguuguuggcugauaugcugaugcuuccuugacgucaccagagaguccuccucuagccaccaaauauggccccguccauccucaauuacauacacucggggccuccccagcugccauaccacuggcgccacucuugaggguggcugcugggucacacacugaggucuuccacauccauauuaucaaguucugauggugguucaggucuuagcaagagcagauauugcucuaugcugaggcuaagucuggaagccacuuuguccuugugaccuaaaaacaaacaucaaauccagaucccaugugccuguagugggagcuuuggccaggaagccaaugugcauauuugguggccuuucuaacaaaaguauaggaagagagaugguuuguaaguucaagcugauggaauugguuuagccaagaaauggaaguuucuaccccagaggaucuuggagacagguggggacaggcagugcuccucagucacgugucaccgagcugucccacauggaggccuccuauugugaacuuugcuagacucucacuuacagccaaggcagcuuuucuggaguuuuucuagauucucuagagccaaagaugauaaugccucacaaaacauagggucaaagcauaugcccaccgcagugcuauaguaaguuuguggguuuuuaggauucccccaaagcacucaauguaucuuguauauguaacaggggagaaaugcauguguuccuuugacauacaauucugaacuaggaauauuugaggaaguccaaugaugaccaacaacacuggggaccagaauauaacaucuaaaugcaguagucacuauugcuuugaccugggcuggaguggucuccucucaacagcuuucaucacacuauuuuccagcuaaagauggcaaagcuguaagccaauuaacauauacaccaaccuaaacuaaagaaccaguccugagggugugagaaaggugcuaucugguuauggauuauuaagcaaaccguauuucauuuauguugagaagagaaugccugcccucagggaaaaaaaugucauugugugagaugaauaaaguccuggugaugggcagacaguuucucuuuuaaaacaggagaaacucuuagggcauccagacagaugguagcuaaauuguuggggcugcagggguauuccuguauaagacuuagagguaguaugauaucucagauuucugccuuaaagggcuuucuuuuuagaaauaguuucuuuuauugcccuuagaagaucacccccaggaagaguaugagcuaucuuuucuacauuucuuuuccuaggaauauucuuauccauuucuuauauacauuucuuuugggagggaguuuuuaugcuauaguugcugguauuuauguaaagggaccauuacuaaguguauuucucuagcauauuauguuuaagggacuguucaagguagguuacugaacugccgggcugauguuagagacacuggccagaaaagcuauaauaaguucuuaaauuauaauuugaucacuauacauuuguucuaugcugccuuauguucauaagaauaucaacagacagcuagagccagaaaaagauagucacauuuuguuaaaaaguugaauuaugacuggagugaaccgugcauucccuugccuuuuacuuuuuuucugugacauuuacgucucauguaauuugcaucgcauugguggguuauucuaguacuguauuuggcuucuucauuaauaggauauuucacauacuauaauuguaaauauuuugauacaaauguuuauaacucuagggauauaaaaacaaauucugauucccuaca

SEQ ID NO: 3446 - RNA, 20253 nt, Mus musculus
uguagggaaucagaauuuguuuuuauaucccuagaguuauaaacauuuguaucaaaauauuuacaauuauaguaugugaaauauccuauuaaugaagaagccaaauacaguacuagaauaacccaccaaugcgaugcaaauuacaugagacguaaaugucacagaaaaaaaguaaaaggcaagggaaugcacgguucacuccagucauaauucaacuuuuuaacaaaaugugacuaucuuuuucuggcucuagcugucuguugauauucuuaugaacauaaggcagcauagaacaaauguauagugaucaaauuauaauuuaagaacuuauuauagcuuuucuggccagugucucuaacaucagcccggcaguucaguaaccuaccuugaacagucccuuaaacauaauaugcuagagaaauacacuuaguaauggucccuuuacauaaauaccagcaacuauagcauaaaaacucccucccaaaagaaauguauauaagaaauggauaagaauauuccuaggaaaagaaauguagaaaagauagcucauacucuuccugggggugaucuucuaagggcaauaaaagaaacuauuucuaaaaagaaagcccuuuaaggcagaaaucugagauaucauacuaccucuaagucuuauacaggaauaccccugcagccccaacaauuuagcuaccaucugucuggaugcccuaagaguuucuccuguuuuaaaagagaaacugucugcccaucaccaggacuuuauucaucucacacaaugacauuuuuuucccugagggcaggcauucucuucucaacauaaaugaaauacgguuugcuuaauaauccauaaccagauagcaccuuucucacacccucaggacugguucuuuaguuuagguugguguauauguuaauuggcuuacagcuuugccaucuuuagcuggaaaauagugugaugaaagcuguugagaggagaccacuccagcccaggucaaagcaauagugacuacugcauuuagauguuauauucugguccccaguguuguuggucaucauuggacuuccucaaauauuccuaguucagaauuguaugucaaaggaacacaugcauuucuccccuguuacauauacaagauacauugagugcuuugggggaauccuaaaaacccacaaacuuacuauagcacugcggugggcauaugcuuugacccuauguuuugugaggcauuaucaucuuuggcucuagagaaucuagaaaaacuccagaaaagcugccuuggcuguaagugagagucuagcaaaguucacaauaggaggccuccaugugggacagcucggugacacgugacugaggagcacugccuguccccaccugucuccaagauccucugggguagaaacuuccauuucuuggcuaaaccaauuccaucagcuugaacuuacaaaccaucucucuuccuauacuuuuguuagaaaggccaccaaauaugcacauuggcuuccuggccaaagcucccacuacaggcacaugggaucuggauuugauguuuguuuuuaggucacaaggacaaaguggcuuccagacuuagccucagcauagagcaauaucugcucuugcuaagaccugaaccaccaucagaacuugauaauauggauguggaagaccucagugugugacccagcagccacccucaagaguggcgccagugguauggcagcuggggaggccccgaguguauguaauugaggauggacggggccauauuugguggcuagaggaggacucucuggugacgucaaggaagcaucagcauaucagccaacaacuuucuuccaaggaugggugcuuggcaguagagaaucccaccgccccagauaugguuuggguuugggccucucccccucuuccuucccucuccccaccccccuccccucucuguuauuccuacacagugacuccugcuucccucccagguuagguugcuuccuccuacccagcccaccccgcccccagacgcccaugagcguauucggcuuauuucuuccucaggaccauauagaguaugccgaugaugaagcugaaacagaagcagauccaggucaggaugaaacaauagccuugguggcugcuggaguugaaguucccuucgcugugggcguaaugaugaguguagauugacacuccaaccaggauacacagcccugcaagaaagggggagcuggcaugauuggcauugaagugaguuuuuggggguuuuuuugguguuuuuaugaucccauuuuccuggacagcaauaggaaaguggacucuuuucguguguccguaaaaggucacuguguugguuugcccagauuugcgcuugaugguauguuggugaauaagagauagcugggcucuccuaucuguacugauuuguguguaaugaagaauaaaucaugacgcauccugauuucuaccugucuguccgaucugggccuccauacaacuagguaugguguuaugagagaagccuggccuuuuaccuaacuggguguuucuggaaagaauggagaagauggugcauugcaguaauugugcacaucauggcaauagcugcaucuucucuggggauucccaccuucuguauugaagugguccugauggugcccaagcauauggggguuccugauccaagcagcaauaccaggccaccaacagauaacuagaggagagaacagcccagagaggcagcuccacacagccaugugcuaaucugaggggcagugacugaagcaaggauguaagcuuuuccugugggacuauguauguagcucaguauuaggguauuuguuuagcaucucaaggcccugugcucagucuggaacaguggggcgggggugggggggaaacugaugcucucauguaaaauagacucugcugcucuggauacucacagcacaccagcaugguggacccugagaggaagaaccgguuucccuucuccauagugaagagcuggaacacgaagaccacaagggagaugauggagaagaugauggagaggaucaugaaggcuugcacugccuugauagcaucugugaagacaagacagaaccaggagcauuagacaaccagagagucuggacaccuuccugaacacacccacgguguucuaggcauugaugucugcaugcauaccuucauugccguaggacagggagccgucgcaguuaccaccagugcaguucuuccaaagcccuacagaugcauuugcguaaucugcaaccauccagaccugaaaccaggagauggaguugauuaagaauuacccuucugcuuucagaagaggaugucaacacgugucaggaccaaaucuuaaccaagacguccuaugcagcuauaaauacugcuaagccucaugucucuguagaaauuagaucccagguacacaaaggucccaagagagagaauugugaccccaaaaagauauauuuuggauuucacuauugguggugcacacacacacacaaacuaacuaaagaaauuccaccauagugguuuaaaauucugaaguucuaaggaacaaaaacucugggugaggaaauauauauugaguaugcacaaucuccuuuaaaaagacucacauuuaaaucccuagcuaaugaggaaaacaaguuaacucuugccugggagcaccucgcugugacugcagcacccuguaaauaacucaggaggcuccggaauuaaagcuuccacucagauagcaacuuugagaccaauguagacuacaugagacuccgucucaaaacgcaaaaacagaaacaaaaaugucuggggaucuuaaaacggcuuagcaauuaagaacauuuauaguucuuacaagaggacuagagugcgggucucagcgccuccacuaggagacucacaaccauguguaacuccagccucagggaauccaacaucuucuucacuggcacuuguaugugcauauccacacacauagacauacuuuuaaaaauaaaucuuuaaagaacaacaacaacaaaaaaaaagauaagggaaaacguccagcuggaaacaacaaagaaacagaggacuacugcggagacaagaaugaaccuggggcccacaggcaaccuuccucuauacagaagggucagaugcagaccauuagaacaugcaaagucauuccaugucaaaaugcagcaucaagggcuccaaggcagaggcagcuaaaagcacaagguguggccaaaaugcacauccccagguucuccaucccuucuugccuggaccaagaaaaacaauucccuucuggaacagaagauaauucugucuacacaugcgcaaaccgugcugaaacaggaaucccuagcauaccuaaucaccugaucucucagcccccacaucagagcugguacugggugaauaggaagcacaugguagcucuuaauacaguuugacguuuaccaccacacuguuauccugugaggauuaggagucugcuuauagaauggccaaauuacaagccuacaggagacagguugggcagggguuauguccuauuucauaacacuuaaacuggccuagcuuguauuuacacucugauguuugcaaaaccccuucugucuggacuuuaagaccuauucacccuugucaaucaacagaggaacccgccuuuaauaccagcacuugggaagcugaggcaggcagaucucuuaagauccaagccagucuggucuacauagugaguuccaggacagccagggcuacacaaaugaacucuaucuggaaaacaaaacaaagcaaaccuuauucacccuuuaaccacagcaaggacuguaguccacccuggagcacuguuugugugucuaaugauuggcugucuuaacuuuaauguuguugguuguuguuguuguuuugguugguuugggguuuuuggauuuuuggguuuuuuuuuucuuucgagcaggguuucucucuguaguuuucuggcuauacugaaacuugcuacauagacccggcugaccuuuacucacugccucccaagugguacuaaaggcggaagccaacacacccggcaaaauguguagcucuggcuggccucaaacucaugguccucucucuugccucugccuucuucaugcaaauccuaccaucacaaugggcuagcuggcugccuugacuucuaaguucaagaaacuggcucauuuugucuaagacaauacaaagugggugcuaaaaaugaccacuaggggucagaguagccccggguuccgagagcaaagacagacuagcgaucuccguagaagaucguuuuauuugauucacgggacaccaaguuaauccuaccaaauuccauuucacacaccuauuuccacacaaaacuugaauuugucaaccucauaaccaaagcaguguccuuauucucugaugucuaucuaucuaucaggaaucugcgaucuagcgcaugagcagauauuguuaaccugagcacagggagagucugucccacgagggcgucuuugcccuucugccugaacugcacuucuauuuucuucuacuuccuccucuagaggagacacgcccauccuccaaacgcaccucaguguccaccucccguggagaggauucuucucaaagcugaaccucccaacaccccuagaggaaucacuuguggacucucgccuuuuacacuuugguuauuucuucccgaucuaugaguauguguuuguuuguuuguuuguuuguuuguuuguuuguuuuccccucacagcuauucaagaaguucucugcucugugauuuaacacucccagcucccguuuuuguuuguuuguuuuuuaaccuuuuaccaaacuauuccuaagauccuuccugggaugaggaaacagggggcugggacucacguuggcaaugguggagacaaacagcauaauggcaguggcaauguggaccacaaagagaccagccaguagcaccaacaucuuggcuuuuuggugacuucugaguagagaauucugaaaacaaaagacgggggagacagaaagguuauugucacagucaguaagacgcaucccaccuucucauuucaggaucucuguugacacaagaaagugugacaauuuuuaaaauuuaaaauuacaucaaaauguucuaaaaccugauugauacacauacccaaaugcuuacucaucuguguauagacaaguacuucuguuuugcucccacauguuuauagauucaucucuuuaauauaaugaauauucuacagauauaaugaguauaauuacagaauauaauauucauuauauuaagaagcgcaugguaugcuuuauagcagcugcuaauguuuuguuugugauugacaggccaaaaaugucaggcuuugaguuuuuggaagauuuuugucaccuccagaacucugcagcagcaugcaugcccgguuuccauuugcaugaggaaagcaucagugcuccagcaaaaugcucacccagcaaacugaauagaaacaaugaguucugcagcacacgccacuauuacucaacggccauagagcaaauuggcuacuaauuugaucccggaugagacguaaaauaagagagacacaacuucuguuauuacagugcucuuuggcacccaauagugugacaaccuaauuacuggguaauggcccggccacuuacugauuuagcauuccagacuaauauuugcaacaccugagccuuuggcccugcgugccucuugguggggaugcuguuaugggucuagggcgauguuagauuuccugcgguucaacaugacagcucuggggcuccagaaguguaaagcuugagauaacaccagaugugcuuuuugcuggugugugguguuuaugcaacuucagucauucaagacccauccccaaagacaaacagauguaugaaucacccuucggaagaguugaacuaauauaaauuaacaaugugcauggauaaacaaaaguucucagccacaaucucaacagagaccacugaucauaaaaucuagaagcuaaaggaagcguaagagggcacacauggggcagccgugcauacccucugugucacaccuaugacagaugcagagucagcucagagagacaucaaagggaaaggacuuggaggugggggagguauucacccucuaggcagggagugugugaggaugcaccaaccauagaggagaugcugugugcauccugcaauugcuuguuccccaccccccuccaccugauuuaauugaugcuuugucugugccuaagccacuuucaagcuacacuagguauuuauuagaacaccgauacuaucauuauucugacauucugcgugucuuuuaucuccucucgcuuucucauuagcuacucaaaaccaaacgugaucuacugcacgccuggguucuuggcucuuuguacacacugguuucuacucuccaaaaaaaauccucuuccccacuggcugcuucccuccaacggugagggaggcaggcagagaauguucucaauuuaacugugaauggcaaaacccgaugccauuuuccugcugccucuggggagagccugugaauccucucucccaacuuucaaguucacugcugcuuuucugugguucucgccuaccuccguaacuucccccuuggcuuucauguguggagaaaaggauuuguuuuacuguuuuguuuuuugaguuagaaguugacuuagaauuauuccaagggcuuugaucucugccuccguuuccucauaugugaagagggguaaugauaccgacuauacccagaggugugaggcugcaacuggauuacguaaguaaaaaugccuucugaagcaugguacaguaaguaccgugugugucacaugguacuaauaacaggguugccgugauuguuguuguuguuacugucuuucuucuaugaagcagaaugacuguuaccaacccgguccaguuacucagucacaugccaccccacaucaaagucaagaaauaagacauuugcaggguaguucaccggacagcauauggcuaaaaucacuuugguccucagaaauugacauuuuugucuaguccucaccccuccaguagggaggguauuaagaacagauccucuagagacaguuggcuuuucucagcccaggcuugcccaucuagaauaaagcuggcucaggaaagaaaaggacaagaaucacauaaugggaacuuuccccccacccuccucgacccuguaaugacucucggguucauuuuguuuauaauugacaaauuuucuccuaaucgugaaaaguagcugaggagccaagaauggaccauaauucaccaagugaggccucuuuaaaugaguugccugacaggcaggcaaauccagaagucuuucugucuccuugauugcccugggacccuauccagcagagucccucuuguuucauccugcugacagccugguccaguggccgcucgucaugucugggcagcauggacacuuugggcuacuccgucucucuucuuaccucagcgcaggcccaacuaguucuuguccccugccugcugccacuugaagagcagaugaggagaugcaaaccaaaaaguggcucuuuuaucugcgauaggguguguguguguguguguguguguguguguguguguguguguguguguguucugugucuuuccucuaaggcaaggaacaaaauaucucagaucaaugaguauucuuagugaacaagacccucaguucucugugccucuaggcacuguguccauccacuguggaggaguuacugagugacacacagaacuucaucuuugugucaaguuuaccagugucauccauuguuaucuuagaggggcucccauuauucuuaacaccccucuuccaaaauacuuggaaacccaauggaacacuuuaugaaacuucuauguuggaucaccccagucucuguauccagagaguuacccagccucuguauuagagagccuaccccuuagucuaggacagcuguucucaaccugugaguugugacccccuugggggucgaacgauccuuucacggggguugcauaugagauacuuacacuacacaguagcaagauuacaguuaggaaggagcaacaaaaguaauuuuaugguuaaagggucccauaauuaggaaggcugagaacuauggguuuggaaagaccaaacccucaagguguuuucagaaaaccaccaguggugcugauggguggggguaucugagaagccaguaaaggcaacugagaaugaggcuaaguucaagcucuugacacuuccacccaccaugaucuccuguagcucauccuuugacucauuccucacccaaggaauaagaccauuucuggccucagacucagaguggaccucaccgguauggcacuugccuaacauguucagagcccugggaucucuccucagcaccaccacaaaaacaaaacgaacacaagcauuuagacaauuuugaaaguaugggcugcugcagcuuguaucucacugaaacaguaaugggauucucccuccuauucccccaaaaugcugcaguucacacucuucaguggagagcgcguuccccaaccucaagggguggagccaacccggaagcagagaacacagugccacaacucugacuuccgcuguaccaccgcccucccuucuugcugcauggacagacucaaagugugucaucuguuguuggggacucccauaccaggaauauggccuguggugcuuuuacacucuccagugagccaccacaccuggucaguucacaauguucggaaaccgugggaagugcucugccuucuaugcagacaacaagaacccuucuucuugugccugcccccuguaagcacagcagguaccccaucugcacugugugauuggcagggccgcgcucagggucuagggaaacagagaagcaacccaacggcacagaugaccacacuaaguaacuauuaggaaaaagaaggaucagacucuuagcgccaaguacagcuggaaaucaccacguagcccaaacuugugggaauucuccugccuccuuagugcugagcuaacauccugaguguauagagcugaacaauucgugugagacuggguggcacccuuacaaaugagagcgucucuaugguuggcaagacuauacaagaugcuuccuaguacuguguguguggguuuggcuggcugaaacuaguuuaaacaguucuggaguagggaugagggguaccuaagagagcccguuacugggaagaaacgaccaauaauggcucagcuaccauuucugccucucccuggcuuccugucuuaagcuucacagucaccugggaguuucuaccuguguuaucuugcagugggucccuauccugccggcacugucaggacccuagccuggaugcugaugucagcuccucccaggacacacucucuaaccucccccucaccaugcucucucuguccugcuauuggguuaucuggccauggccuuccucagccuacaacccucaucccccuaccacaacugagacaagcacccguauccgggaaaugagacuccagacagcugcccacggaauccugggaauuugacuuccaaaaaugaaagcuacuuuuauguccuuccccuaguaacuaccuauuauuuuuucucacccagcucaaauccugccuccuucuguccgcagggcugaaguugauguuuuuccuccuguuauguuacguauucuuaauaaaaggcccucauggcagccugccugaugacagaguucuuuauggaccugcuuggcucccccacccucaggagucugaguuccuaagggcagacucuaugacagguaccagauaaaccuaguuaaugaacaaauaaaugaacuaaagagggcaauauuuccuucacuguggaaaaauaauggcagaguggcugaaagacacagaacaccuccuuucucuucuuuccauuuuuaaaucuuuauuuuauguguguagguguuuugccuacauguaugucuguguaccaugagaugaugcaguacccauggaggccagaaaaugaugccagggccccuagaacugggauuacaaacaauuauggacuaccagcaauguggaugcuggaaacugaacucgaguccccugaaagagcauccaaugcucuuagucagugacccaucucuacagaacuuccuuuuuuauuuuaagguagcauauacuucaguccucugucacuuuuauaaauuauuugucauauugcugcaaguuauggguugggcaccuuauuauacacaaacuucauauuauuucauuuccacuuaacuuuuugguauagaacuuccaagcuaauggagagcuuuaagauuugguuccaaagccaugaaacucaucuacaaacucaaccugaaaaucuaugcaaaucauacuuaaacucaaccuguccuugggaacuauccaaggcccuguuagaaaaguccugccaacaguacauacagcccacagaaugugaguauaauucauuugguaagagcgagugcuugccuauuccacauagaguggaacauaccuuuaaucccagcauuugggagccagaaacaggcagagcucugugaguucaaagucagccuggucuacuauacaugaaguccaggauagccagagcuacauaaugagacuguccagagauucuuccuagagccuccucuguccuuccauuggccagugauguucuagcaaagacauucccaccuccugcuggcuaacugcaauuggagugaaggcuuuuucaccccaucugauccaagaccugguacuuccugcaaggcagggggaaaagaggaaagaccaagucgcucuuaaagggauugggucaagcggccuucaugagucagcccugacugugcacaucuucuucaaugugacauuugaaguggaucugaggcucucuguguuucuuaagaacacugcaggguggcacggaagucugucuacccuccuccaugucaacaccauucuugcugugcuugggguuccaaugugugugcguucccauugagggucauuuuaguuggcaaaacagaugcccgugggacaaaaagcaaauaagcaaaaggaaacucugcccuuggggaacgguguggaggauguaucuggaggaugggaaggcugugauugaaggcaggcugguggauggggccuugggugagcuucccuggccauuguuguugcuuuuuaugucauguguacuuuuccauccucaacauuguuuucacgcacagauggaaagggaggcaugcaucuccgugugggaaacgggaugaggggauccuuaagggccaagucuuccuguuucugcauaugggaugcucggacguggaaagaaaacacugugggucgcccuuugaucuguguagcucacacuagggaugacacuucaaguagugguggauucggugccuguuaacaauuaagcagggaaagacacaggggucugggugauucggggaaacagcuguuucuuuguaguccuggggcaaaggggcuacaaagguggccugucauaaauggggcagccucuuuggagcuaaucccaccugugccaccugccacaugugguuagaauauagaguaaagaacagcaaauggguuagaagggagaggaagaggaaaggaaagacagaaagagauaaagaaaggaaggaaaggggaaaagauaugaaaaauaaaggaaaugggaaggaaaugaggaaaagaggaagaauaagucagaaagaaaaagaaagaaagaaagaaagaagggagggagggagggagggagguagguugggagggaggucuaauuagaaggugagccggagucccacagcauucuugucuggcuaauggccagaguugaaagauuuugcaaaaccugucugcuuggugaaaucuagagaggcagagucccaagugacaaagaacagacucuaaguucaaauuucuuaaggaccucauaggcuuagcaugagcauugaaggguccaugccuaagacaaagcaagccaaaugcuguaggucauauuuauucauugguguaacagagaaaggcucaaacgagguggucacaaggcuucucugcagccugagagccguggacuaugcaaaggcaagcauauagcaugaauauuguuuuugcagaugcauccagagacgccccacccuugucucucucucucccucccucucauuuccgcuugucuuccauuguguccauggaguggguggaucuggacaacaucugcaaaggcuggagacagaccucggcugugaggccugauuucagcccacacccucuggcugcagcuggccagugucgggaaggaugucuccugggugaggacagaagcuucugcugccuucuguucccgacaaaggagaaguacuccugcagccagauugucuuccagggagacauugccaagauaauaacuaggguuugguaagaaaaaucaagguguggcugggcccuagaggcuucugggugcaucugacagcagauggcaguaacaugcuucaaccagcaaaggcugauggagcuggaggacugugcagagcaggggcacccaagcaugcuaggugggcgcuggcuuggugcaguuucagagauggcagcuacuuuguuuugagagauacuggggucucucagucauuugaccaagaccucugccucccagcuagcagagaaugaagccacugucuuggaucuccacuccagcuugguuuucugucuucuaucugagguguguguguguguguguguguguguguguguguguguguguguguguguguguguguguuugagucugugugugaguguguaagucugugugcauaucuguauguggguggguguaugugaguguguguauauaugugugugaguguguguaugugugaguguacauguauauguguguaugugagugugugugugagugugugugcauguguguauuguguaugugugugagaguauguguguauguguauuuauaugugugaguguaugugcacauguguguauguguguguauguaugugaguauguguauauguguguguaaguaugaguguguauaugugugugaguguguauguaugugugagugcguauauguaugugugagugugaguguguguguguguauguguguguagcagccagaagacaacccugguguuauucauucgaaguuguccuccagcuuguuuuuuguugcuguuguauuuaugagauggggucuuaguggcugggacuucaagacucaguuaagcugacuggcuaugagccccagggagccuccugccuuccuuccccauaggugagauuguaaauccagccacacccgauuauucauguggucuuugagaaucaaacucaagucuucuuuucacgcagugagcucuuuacccacugagcuaucuccccagcccccccccuuugauauuuugacacugaaucacuauguagccccugcuagccucaaacucacagcaauccuccugcuucaacccucccugguuuugggacuaaaggcauguggcaccacaucccgcuguccucugaggguuugacaguuacugguggcucuguuccucccacaacuuucgagccaaucagaauuggacagccccucaaaguagucccaaugcucuaaacaaaggaucuugcaaagaccauugcuuucuccugucacacugcucucuaugguccagccagaacagacagcuggcccugucaaagccuucccugccagcccugagacugguuuccacacucucagcgcuggcacauuccccucccuaugggaguucagggagcagcccugagcagagggaagcuccuggccuccacugcauggcuuugccaggccucugugaacgcgccugcuuaagcaaaauucaccguugcaguucaacaaagcucucuccucuuccuucucuuggaccccaagggaaagaacuuagguuucugaaggcagaagucuaaagucuagggccucacuaggcuugacucucucaucugagaggagaggcgccggaacucuaccuauaaaacccaauguccccaaacaugcaacaaccgcgccacaacuaagaagagaaaagacuuccauggaggucugaaaaccaggauuuugauccaaggccuauccuggggcagugagagcagucagucaugucucccuuucagguucacuuucucucucuacuuggcucucucuagaccuuucuguuugcucuaucccccaaacacaguuucuguucucucccucucccucucccucuugcucucccucucucucucucucccccccccucucucucucucucacccucuaguucccuaaccuucuuuuuccucccaguaugcccuccauuugcucucauccacaccugugccuguucccccuccuccagaggaggggagugucuuacccaggaccagcucaguuucugagcccaguuaugcuccuagugaacugaugugugcacagacuccuccggagauggcacccuuuguuugauaagccaaacaucuuccuucuuuccaagcucggguaauauccagggcuauuucaggugaguucuuuaauacugugcccaaggacucuuggaucagguagggcagcagaagccaccuccucauccccugaccccugcagcucuuguaauugaaugcagagccacgaacacgcuaggcaagcauacugccagugggcuguaucccuagccccugguuugacuacacuaacuuuuauggauuaaguuagccauuagcauggacucaaaggacugcuuaaaacugaagugguaagguccuagauuuuucagagccuugagugucuugcuggccaaguuguuucuucguccuuucuuagugaguuaguugcuucugaucacagggaagauucgagacaagaucagagcccaacguugcuacucagucaucucacaucucccccacuauuaccgacacaguuucaacaugugccaacagugcuguguagugcuccaugaaagagacucgggaaaguuggagucaguccagucacagaagaucaauugucuuggcugugaaaauacucuuucugaacagggaagaaaacauugauaacccccccaagacacacacacacacacacacacauaucaauuuuuuugcuuaaacggaaggcucagaagcagcaaccgucauguuuguguuuuucuuuuucuccuuugcugucagggaacccaccagucaaauugagggaugcguuucacaaguuaggguaccagggacugaaguguuucagagucuucuuggggacucauguuugggagaugaguguucgaaagccaaggagaucccaacuagacccacugcacauucuuugguucuggaaaaacaaggacaacccagaaauucagucaccugagauuauuccaaaacaagacuuaaguccagauaauucuaguuuaaugguaaccaagaagguugcuggcuaucagacagcuuguguuucaggggucauguugauuucacuaugaccgguagauaucaacauuggaugugucaucccacgugcaucuaagaguccuagaguccucugagaguguauguugcauagcuauguacacauacauagcgaguuacagacaugacaacagucaugggcuuagaaaaugaaauagcucagaaucaaucauauaggaacaaaugguuugaccaggcgggugucuuaauauuucaaaaauguucuuucugcauccccacacgcaccagcaguggugguauacacccauaacuucagcauucgggaagaaguguggaaaaaaguucuaggcuccagccugccauucacggagacacccugucucacaacacaacacagcugaguauaguacccgaugacuuuaaucccagaacucaggaagcagaagcagguagaucuuugugaguucaaagccagcuuggucuacauaguaaguuccaaaccuccagggcuacacugugugauucuguauuugaauaauaaaagaauaaagcaagaucauaugggcaaugcuaucccauggagccauacugauuaauguuaaguagagaugaaaugucuagagggacaggaaguggagcauuguggggagggggcagcaguuggggggaggggcagcagcagaacagaauugaaaagcaccuccccuccccaccccacccacacacacacacacccagggucauuucaggccugcaaaaacaagaacuuucaaagaagccauuuuugcugaauuucagaaacucugucugguaugauuuacugucuagaaagaagggugggugugagugaacgucugaggcacguacacucuggguguccccgcccugcuaucuuaaggagcugugagccacgggacaaccauccauucauaaugauguaaaaguuagauuucugcauaugguaagauaauaagauuaccuucuuuucuuuucuuuuuucaucucucucucucucucucucucucucucucucucucucucucucucucucucucucgucguugguuuguucuugagaccaaguuucacugguuggccucaggcuagccuugaaccuuuagcaaucuccugccucagcucccuaaauccugggauuacagguaugaacuaccauguccaacaucuaaauuuaagauucuauaaaaagcaaugaagaagaauaaggaaggaacccuuggccacaucccagguggagaccccuucagguuguguggaggcuacagaaaauccauuuuuccauaacagaaaugggcuuggcuuuccugcucuuuggucccaaagcugucuagaaccaggcaagaggcccuguauucccaacagcuuccacagacucuuuccuccgggcuggagaccggccuaaucuuguuuccagaggaaagcaaagacugcugagaaagccagccaaccuuucucaaggucuggggacagacaucuguccucuggcaaagggcugcccuuacuacuggcccguagccacagucucaggacaugaucgucuccagcuggaccuugcugaucuucugccaacucccaggacaguuuagaacccuggaacaauguaaaaucugggggcucucuggcaaggaugccaaaccggauguccagcagcccuggacaguguucugccuccaccccauucugcagucucuggaugaaacuggagcggccuaaggaugggaggcuaugauuugggagggggugguaauggccucuuuuuccaggacaaccaaagacuuagagcugaagacgcccagaaagguucacacacagcccaggggcucucccacuacuuggaggcaaaaagucagagcaucauuuuuuuuaaaauugucuuccaacuccauagggaaugggggcagggaggggguagcacacaaagcauuauauucucauuuaucaagggacaguggaguuugagacagcuccauggcucauggaguugguggcaguuuaccccucccucuaguguucccuuuuugcugacuuguuuaagguugccuaguuucaaccagaucagaaugacacacaaucacacaugugaucuucacaggaaacuguggcuguggaccuaacgaagacggcuuccccaguucacagucaugcaaucuggaagugauaaacauuggaagcaaacucagucuugagaaaugggucccagggcuuacucaucacccccuccuuggggaaaggcuuugcagagauuucugaaggaucaauggauacacacccaccaauuacuuuuaaauuuucucuuccaaccagcgagcugcauuucuaaagagaaaggcgccucgcucuucaucaggcaagcugaauccugucacucuccucuggcuuguuuacgagaggagaaaaaaaaaacccacaucuguguugaaaugaaccacaccuccacagacauucgaccaaaaugcuaagcuaauaaaaacaaaagcaaacacagccgagugccuuuguucuuuuugcacuuagcacguggguuuguaguuauauaauauuuuacacaaaagaaauaagguaaauauucccauaugaccacugccacacuagaaaauuccauguccacuuagaaaaaaaaauccuuuaauagauucugaaagaucuuuuuuuuuuuccuaaguuggcuccagaaugcagaagccuggguggaagcacagagccauucagcaaccuuacaggaauccccgaaggcccccagccccacccucuccccucugccuccuuccuccaccuccacaucuggcuaaggauucuggaacccacacauuccaccaaaucaaccccucccaagguuuauuugaaacacccuuugccucuguuucccuaacgguuuuucuuuaaacaaaccaauccccucuucccuuccugugagaaggggguggaggaaaacaagagaaagaacgaaauacuuaaacagacaucaacagacaagagggggacagacaguaaaugcaaucgcaaaaauuaacugaaacucagauauuuauccaccgucaccuaaaagcguaaaagagaaacaacaauaaccaacccacaaagcagaacaaacuuucuccccagagacugccuuuaaccugccuucgcagagagaaaagaaaagccggagcguuuugguaacauagcauccuucuagauuucagcucaaaguaaucugaaugaaaacagaagauuuggaaacaucuuccaacccugcuaauucauuucgaaggcacauagaguuccuuccauaaagaauauugcacucaaguuuguuccaaagucccuucucguuccguccgucuccucggagcaaggauccacauaccagcaagagaauguggcccccacugauaucccagauuccuccacuacuacguuaagcuagaagucucaaggacuccguucuuugugagccauagagggauagcagaggcaagaagagaggggagggcuucaaggagccuaagagaggaaagaaaggagcgggcucugcagaguuucuccaguguggggacaaucuuaccuggaguauccagugagagaggcagaugcccugggugguagagcaggcugcuggucugguccucucuucaggagauuugcaaccacagugaggggagggaccugacucccgagguuauaaguuuccugggcugaugugcuggggugugugaugggcgguuucuuuuccccguguuuuaaa

SEQ ID NO: 3447 - RNA, 1237 nt, Mus musculus
aagcugauggaauugguuuagccaagaaauggaaguuucuaccccagaggaucuuggagacagguggggacaggcagugcuccucagucacgugucaccgagcugucccacauggaggccuccuauugugaacuuugcuagacucucacuuacagccaaggcagcuuuucuggaguuuuucuagauucucuagagccaaagaugauaaugccucacaaaacauagggucaaagcauaugcccaccgcagugcuauaguaaguuuguggguuuuuaggauucccccaaagcacucaauguaucuuguauauguaacaggggagaaaugcauguguuccuuugacauacaauucugaacuaggaauauuugaggaaguccaaugaugaccaacaacacuggggaccagaauauaacaucuaaaugcaguagucacuauugcuuugaccugggcuggaguggucuccucucaacagcuuucaucacacuauuuuccagcuaaagauggcaaagcuguaagccaauuaacauauacaccaaccuaaacuaaagaaccaguccugagggugugagaaaggugcuaucugguuauggauuauuaagcaaaccguauuucauuuauguugagaagagaaugccugcccucagggaaaaaaaugucauugugugagaugaauaaaguccuggugaugggcagacaguuucucuuuuaaaacaggagaaacucuuagggcauccagacagaugguagcuaaauuguuggggcugcagggguauuccuguauaagacuuagagguaguaugauaucucagauuucugccuuaaagggcuuucuuuuuagaaauaguuucuuuuauugcccuuagaagaucacccccaggaagaguaugagcuaucuuuucuacauuucuuuuccuaggaauauucuuauccauuucuuauauacauuucuuuugggagggaguuuuuaugcuauaguugcugguauuuauguaaagggaccauuacuaaguguauuucucuagcauauuauguuuaagggacuguucaagguagguuacugaacugccgggcugauguuagagacacuggccagaaaagcuauaauaaguucuuaaauuauaauuugaucacuauacauuuguucuaugcugccuuauguucauaagaauaucaacagacagcuagagccagaaaaagauagucacauuuuguuaaaaaguugaauuaugacuggag

SEQ ID NO: 3448 - RNA, 1237 nt, Mus musculus
cuccagucauaauucaacuuuuuaacaaaaugugacuaucuuuuucuggcucuagcugucuguugauauucuuaugaacauaaggcagcauagaacaaauguauagugaucaaauuauaauuuaagaacuuauuauagcuuuucuggccagugucucuaacaucagcccggcaguucaguaaccuaccuugaacagucccuuaaacauaauaugcuagagaaauacacuuaguaauggucccuuuacauaaauaccagcaacuauagcauaaaaacucccucccaaaagaaauguauauaagaaauggauaagaauauuccuaggaaaagaaauguagaaaagauagcucauacucuuccugggggugaucuucuaagggcaauaaaagaaacuauuucuaaaaagaaagcccuuuaaggcagaaaucugagauaucauacuaccucuaagucuuauacaggaauaccccugcagccccaacaauuuagcuaccaucugucuggaugcccuaagaguuucuccuguuuuaaaagagaaacugucugcccaucaccaggacuuuauucaucucacacaaugacauuuuuuucccugagggcaggcauucucuucucaacauaaaugaaauacgguuugcuuaauaauccauaaccagauagcaccuuucucacacccucaggacugguucuuuaguuuagguugguguauauguuaauuggcuuacagcuuugccaucuuuagcuggaaaauagugugaugaaagcuguugagaggagaccacuccagcccaggucaaagcaauagugacuacugcauuuagauguuauauucugguccccaguguuguuggucaucauuggacuuccucaaauauuccuaguucagaauuguaugucaaaggaacacaugcauuucuccccuguuacauauacaagauacauugagugcuuugggggaauccuaaaaacccacaaacuuacuauagcacugcggugggcauaugcuuugacccuauguuuugugaggcauuaucaucuuuggcucuagagaaucuagaaaaacuccagaaaagcugccuuggcuguaagugagagucuagcaaaguucacaauaggaggccuccaugugggacagcucggugacacgugacugaggagcacugccuguccccaccugucuccaagauccucugggguagaaacuuccauuucuuggcuaaaccaauuccaucagcuu

SEQ ID NO: 3449 - RNA, 482 nt, Mus musculus
ugaagcaaagucuugcuaagucauguagcaagcuggcuuugaacucacccuguaacccacaaaagcccccauuuuuuugauuccuucugccucugccaucugacacuaucuugaaacacgugcuucucccuccagaaaacccuuacacucagaccucaucuauuuauauaugaguuaguuacaugauuacauuuauguuuauaagcucucuauagauggggccagcaagauaucucugcagucgagagugccugugaagaagucggcucaggaacuuuagaaaauuccaccuccuggaacagaaaggucaugaagacuauaggcagcccuccccucuggaagggaggagcuagguacauuccucagaccacaggaaggagggaccagccaccugccaccugcagguaggggaggcccagagcugguggacacauuuugcgacccuuggccaccuaccucauuccuuauagaucaaucaguuu

SEQ ID NO: 3450 - RNA, 1829 nt, Mus musculus
uccuguuugaggcaugcucuuuagcccagauuggccuccugccuccgacuucugaguccuagacuuauauucaugggccgccauccccagauuauuugguguugaggauugacuucugggcuuuguggaugcuauguaaauacccuaccaaccgaguuacagccccacccuggcuuucuuggauucauucuauaguucuaaaagcucuagagaagacuuuggagaugugucucuguucuguauucucugagcugcuguuugaauuuaagauuuuuaagugugugugcgugcgcacgcacacgugcgaguagaugccagaggaggguuccagggcaucuuuuuccuuuucaguccuauuccuuugaggcggggucucucuccgaaccaggcaggaccuuuuguuaucucagcuaggcugggaagugaacaaaucccagcaauccuccugucuccacccucucaauggugcagcuucagauuugggcagguucucugcugguuuguuagaugggugaugggauuugaaaucugguccucaagguuuugaaugugcucuuaucagccgagccaucucuccggcccugguuguuuguauuuugacucaggguguugcuaugcgaucacgguugccugguacuagccugguaauuggguaacccacaguggccucaaacucgugaucuuucgaggacugagauuacaggcaugagugaacacucccggcucaccaaguggcuuugcuuaacgaaugguuguauaacugaauuuucucaacugccuguaacuuguggcuuucacuucauuuuaauaauaaauucaauuuugagacauggauuacucuauagacuaggcuggucugaugcucuuuguguugaacucuaagcaauccuccagcuucaguuuuuggaauguugacauugcaggcugguaguucuguacccuuaggagaugauaaaggcuggaggugaagccuaauuagagaaguaacugcugagccuggucucaggggcugucagcccucuuucucuuagacagggucucucucucugugacccuggcuguccugagacucucuaaguagaccagacuggccuugaauucacagcgaucugccucuaucucucaaaugcuggaauuaaagaugcgccccugaaaaccuguccucuugugacccuugcugcugcaauggucaacaaaaacuaagaaauuuccuucucccccauccucccuuagagaccuuugacucagcacaaacagcugaccacggacugaaccccagacuaaauaaagccugcagcacacagagccaaguuaaauuucuauuccuccuguggauggcuugcuuggcauuugucacacagaccaaagccaccucauccagcucugcucagcggugugugugaaagcaaccacugcaugcagaagcaaguuucagccucacggcugcuuguacaggcaaagcagcggccugacaacuggagacucagaaagguuagguaauuugccuaaugucacacagcuguagauggcaggacauugacaaaagcaggauguuguuugagucgcuguuaagcuggcgcgugcuccgugcucucagauggcauucuuuugcuuuccucccuugcuuuccucaggaaaccuuaauauaaaaccguggaaacugggcgccagcccagcccccagcuucuucagaagaggaaaugcaaguccacgggcgaggaaccaggccuggguuaguggcaucugccuguagcgccggugaucgggaggcagaggcagcaggaccacugggaguuccgggcuagccuuagcuauaccguuuuuuuuuu

SEQ ID NO: 3451 - RNA, 122313 nt, Mus musculus
guugccagggcgcgugcgguugagucgggguucgcggcggccggucucucguucucaucgcagacacuucuacugcaaacauggucaacguaccaaaaacccgaaggacuuucuguaagaaauguggcaagcaucagccucacaaagugacccaguauaagaagggcaaggauucccuguaugcccaaggaaagcggcgcuacggucgcaagcagaguggcuacggugggcagacaaagccaaucuuucgaaagaaggccaaaaccacaaagaagauugugcucaggcuugaguguguugagcccaacugcagauccaagaggaugcuggccauuaagagaugcaagcauuuugaacugggaggcgacaagaagaggaagggccaagugauccaguucuaaaacuuguguucucugagaggaaaauacugaagcaguagagaaaugaccugcuagagaauaaagauacuguuaaugauaagccaaggugcaucccugagaaguuauaccauccaauagaucugguaaaagguucacugcagaaggggagaggagugaggcccugaggaagggauagaggcagugagagccacguagacaaucgggaagcagaacugugaacagagaaaagaaaaaagauggggcaugcacacacagagagaaugccagaaacagagagagacacaggagggcagagaaagagaucugggaugacugguuggggggcuuucaucacugaaaucacagggaauggggaaccuaauagcagugaugacuaaaugguugcuagauccuugagggcaaucagcagaacugccugugugcuaacagguacacucguacacucuacauauacaauacauuagugcugcuuuauauaaaggcacaaaacuugaucuccuuauuuuccauuugcuuauuuguuuauuacauuuugcaguacuagacaugacacucagucuuguuuguguuaggcaauaaaucuguguuuaaggaagggagggagggggcagaaguaguugaauaccccuucaguuucagcauuaggaagguagaggcugccuucugagguugagggcuacauagaacccugucuccaaacaaacaaacaagagauagaagaggugggcaggaagaggggggagggagggagggagggagggagggagggagggagggagggagggagggagggagggagaagaaagagcaaaacauaaaaacuucaguuggauaaaaggauaaaagacuaauauuuacuagcaguguuccuuagaaauugccacacccuuacuuccugccugaggagcaaguucccucccugaccgguuggacugccuuucauuucuuucacuuuguauggaauuaacucauuuauugaccuuauuaaccuugagccucccaaagcucccaucuaguuuaaggcaccgaccacacccaagaaacaauuuccaacacaaagagaucaucaggcacacaauaguauucugcccaguggccaaagcaaacucgguucaaauccaagucaugucacccauguuguacuuuauaaaaagaaagaaaugaagaaugagccaggauguuuuguagaggugcaguauggugagguggaagggguggcucugugggccuaucuugaggcaucccuuccccccccccccuccagguaccagccauaccauaguuuggaauagaguuuauuuagggcaugaggaaggaaguugaggauggaguagagacagaaaggcaaagagggagagggagagggagagggagagggagagggagagggagagggagagggagagggagagggagagggagagggaggggaagaagaagccggucaggaacauguggugagagaggauggaggggaauggagagagaagggagagagagaguaauaggauaagagaaugagagaguaagagagugaggagggggcaagcagccccuuuuacugugagucagacacaccuggcuguugccagguaacugcaaggcaaagccuagaaggaaugcuaacaaggguggcugauuuugaaucuagaaagagcagcaaaugauucugcaggagugaucuugguggcaaaggaaggaaguccaugcuagggugaguuguugaguccugguuggacauguuagucggugaagugagauaaguaaauuugauagcuggaccuugguggucagcaucaggaaugagucagacauaaguaaguauucaaauaagaagucuaguggggaguccagugguuuaacaaaagggaagggugagggaggaccucccccccucccagcaccaauuuugccacguuugggccuguuugagcuauucauuucuuauccuuguuagugacuauauugugucccacucaaaauuccucuuguguauguuuaugcaugugcagguguggaagcuugaagacaacuuuuaggagucaguuugaggcaggcgagcacagccuccaccuguuucugaggcaaggucccuagcuaguuuucuucugcuggguugaacacuuuagguuagccaguauuaggacaaagcagcggaaacggaagcuuggugggugggagccaagaaacaucacagucacauuaugccacagagcuagugcaagagcuuuauugggggagaacaaaagagagauugagagauaggaaaaauaaacaagacagagagggagagagagagagagagagaacaugaaacaguaaacaagggagggggggggaaaggaaggaggagaagaggaaucagggaggguggagagagagagagggaaagacagugcacauuugagcuagccaugacuuuuaaagaguuuacaaguugauacacaacucauaucgaccauggaaaugcacugcaccuggcacaguugggugaugacuuaagcugcugccaccgagucacugaaaggcaggcuggaggaccaccaaacuuaacacauuuaacagcuguccugugagcuuuugggcaacucuguuuugccucacaucucaucauaaaagcacuaagauugcagaugcgugcuauaucgcauggcuuucagcaggacuccagugaucucuguuuagguucaggcuugugaauuacacauuuuuaucuacucagucaucucuacacauaaaucucuguugaagcaggauguggugguugcucucuugcccguaauccuagcacuugggaguugcagagagaagagucaggcguucaaggucauccaaguggccauacugaguuggaggaaggaagaaaagaaggaaggaagaaugaaagaaaacuauguugaaucccuaaccuccauguggcuguuuuuggaaacagcaucuuuguggaggggguugagauuaagcaaggguacgaaggugagcacugaauccacaugacugauaucuuuauaagacaagacuccagagauguguucaacauaaagaggagacacauuaaggauacaaccaccagaaaacagagaauugaggucucaagagagaugaagucuggccauagguuauccagaacucuaaggccccagaaccaagagcaugugaaguucugccauuaaagcucucaaggcagagguauuuuguuaugacagacacggaugacuaacacauucccuuaugauugccgcucagaaguuccucuuuaagcuacaucuuccaugaccauaucuggguucccuuuugaagcauugugaugagcuuagguaaugcacugcuuaucuagcccuugagcugucagucaacugagaaccgcccacauuccagaauuaggugcucccacccgccacucagccuuuagugacucagagccaauggccaugucuucacuacuguccaaugggaauccuuuucaugggcaugcuccauaccuccccuauaaagcccaccaucaugaccuguuugcugcuggcuccauuccugcuuuuaaaggcagccaccauuuugugauuccacaccccaauaagugucuuguucggugaggucuccuugaugauguaugcuauuccucgguauuccucggauccccaagauccccuuccacuguaaacccuuucacuuucuaccuauguagacuuggggauuccuuuaagccucaaauacacucacagauauuuacauucaauauaauagcuacaaguauaauuucauuucuuuuuuuuuuuuacauacauucaguuaauuacucagcuaaaaguaauuguuuccaagcccgaaaauugauguuuuauuguauuguuagagacaaagagcaaucccagcgcuacacaaagaaacacaggaacaaagugaaagccgcucagcaagacuuucuuccugcuaaaggggagccccaggguuagcaagcacacugggucaagauggcucccaucuucuguuccucacguaggugugacugugucucaucccacuggugggaguucagcuccacaggcugaugugauuggcuaauugguacaaagugggaagggaaagaaaaaaaggguccuugccagacuaacuuugauaagaauaaacaaaaguuucucacaguaguauucuaucugcccauucauucauuugccucucaguauaaggacaacuacuuuaaaauuguugaaaacagacuuaaaacgagagaacaucuuuacaaguuucugagacuuaauguuuuuguaugaugaugugaaaaacaaauuuuauccugcuaagaucauaguuuuuagcugauggauagaauuaauucuaucuugaggugcaaaaucuauuguccuuuuuuccuggcaggggaacaagugacuaauuucacguucgagccucucaagaagcucuguuagccgaguggcagucuccuacaucucuguucuucacugucuguuucuagccucucaggcuuaguguggugacgcagcuguggcacacgaaaaccauuaauauuuuccaucgugucuucuaaaugcacaaccucaaacaguguguggucuccuuggccugcuacaguggguaaacauuugguaccacauuaccaguucucugauacagauauuauacugcaucauuuacgugggugucagguuuaguaccauguucaugaguacuuguuugaaggcaagaccacacacacacacagaccccuacuuauccaaaaguggaacccacaacagaucaaaauaacaguuauaccaaaguccaauguauugaaccagugauuuauugggguuacuuaaaggaacaugggcgccgggugaugauggcgcaugccuuuaaucccagcacuugggaggcagaggcagguggauuucugaguucgaggccagucuggucuauagagugaguuccaggacagccagggcuacacugagaaacccugucucgaaaacaccaaucaaucaaucaaucaaucaaucaaucaaucaauaaauggaacacagacaagucagagccagggcuacacugagaaacccugucucgaaaacaccaauaaauaaauaaauaaauaaauaaauaaauaaauaaauaaauaaauaaauaaauggaaaacagacaagucagaguggccacaucacccagagcccacccucacacagaggacaacugugagagcuacaagccuggcggucuuagcacaccuugcagguaacuuggcaagucagagaaucuucuacacagcucucagcucaucagauuuucuuuucucuaacugcagcauugcuggucagucccccuucccuaucuagcagcuguuacgguuuccaugacccugguaagccacuaggaaucuuguaaauuguaucuuucccagacuuugggagguuuguuuacuggcugagucucucaaaccgcccuccccacuuccuggagagacuguuucaauuccuggaauugguaucaacaauacuuaaucuuauuauguccauugggaaucuauucaggagcuaagcauggugcucagaauauccagggucugacuucaaucccuaauacucgcaagacacagcaagcaugaacccaucaacauacgcugccguuucuagcuaauacaaaggaguguguaguguguggggaauagucaaacauuucugaagacaguuuuccagaagugcacauagaugcucccuggaacgcaguuuggcuacauauagcuuaaaggggugcuuucuucaaacacugaggcaauaaagguuaaauaccaaguuacaaaaaaaaaaaaaaaaaaaaaggagagagaaagagcuaagaaagaaaaaaaccuacacacucucaguauuuuucuuguuggugugaaaaaauguccuacagaaacgauuuaagggaggaaggauucauccgagaccacagauugagggaacucguggcuggcgaggcauuucuguggagugcaagacggcuggucacacguuugcagucagcucaggaucucauuuucccucugucuggacuguaguucaugggauggaaccguucacauccggguggaucuaggagccuggcucaguuguccagcauuugauugcaggguggguguggugauuuaaauuggaagcgcucccacaggcaucaggacuugaguucuuggucuaaaguuggcggcucucuuugaggagguuuuggugucugucuggcccugcaggaggaaguaggucaucggaggcuggauuugagaguuuaaaagccuugcucuagccuggugugguggcgcacgccuuuaaucccagcacucaggaggcagaggcaggcagauuucugaguuugaggccagccuggucuacaaagugaguuucaggacagccagggcuauacagagaaacccugucucaaaaaacaaacaaacaaaaaccccaaaaaaacaaaaaacaaaacaaaacaaaaccaaacgccuugcucuacuuucagggugcacuuucugccuuaugauaaugacuaagauguaaucucuuuguuucuagcuccugccgccaugccaaccacuugccgccaugccagacaaccuuacauagguggcugauuccugcuauuucgagugauacuacuuuaaaaaauaaaaaaucuuaagagagauauuugcuuuaggcucacaaggaaacugagcagaaaguacagagagugguggcaucucuucuccccacccccacucacauagcuucucccaccuuuaaugggcagcuuuuuguacauaccacauacaaguaaaauccaaugucuuuguuuguuuaguuguuguuguuguuguuguuuggagacaagguuucucuguguaacagccugggcugucagaguuaggguuagucuaggcuggccuugaacucagagaucugucugacucggucuucugaguguugggauuaaaggagugugucaacuaggccugacuacacagucuuuuuuuuaucauuaaugaaacaaaauuuagcugcacacaaagucaguucacuaugacauaaagagaucuuaguguaugggucuuaguguauagugucugagcuggcuugcaacuugguauaaagacuaggguggccucaaacucacaagaucugccugucauugucucccaagcacugaaauaaaaagugugugccuccauagcugguccuuaguucauacauuuacaaguauuuauucauuauuaucuuggggcauauauacacuauaugugaacaugcuauagaauguauguggaggucagaggacacuguuauggaguggguucucucuuuauauggguucugcagauuuaacucuggcugccaggcuuauaccggaagcaccuuuauccacugagccauuucaguggccccuuuuguuuguuuuaaaacaaagacuugauauguagcccagguuggccuugaacucauaccacucucuacuuuagccuccucggaauuggaauuaggaaucuaucccaccacgcccuaaucugcaguggauuuuaaagaacaaaagccccucaaauuuccuuuuguugcugugacaagacacaccaaacgaaaucacccugggaaaggaaggauuuauuuguuuucuacuuccaagucccaacccaucacugaaaacagucagggcaaaaauccaagcaggaacuugaagcaaaaaccacagaagaacacugcuugcuuuggcucaugcuuagcuagcucucuuauauagcucaagggaauggugccacccacagugggcugggcucuccucuaucaauaaacaauaaacaaaacaaucccuuacagacaugcuuacagguuaauuugaucuaggcuauuuccaaguugaggcuuuccacucagaugcuguagauugugucaagcugacaaagcuaagacaaaaacccaaagcucuuuacauuuuccuauguuuauaugauuaacacuuuuaaacaaccaggugguauuggcacaugcuuaccugcaugugagagacagaggcagccuagauucuaugaauucaaguccagcuuuaucuacauaaugaguuccagguuaguuagggcuaacuagugagaauauaucucaaaaaagaaaacucaaacaauaacaaauguuaguuaggcauaaaucaaucguauuuucgaugcaccuuugauuauaugaacuauguaaauaaguugguccuccuuaucuguggauucuguaucuguaucuucuaucaaccuacaguaacugagacuguaaaaacaugaagaccaagauaaaacaacccacucaagaaagguucaggccacaaccaucaugaugauggugcuuguuuuuucaagauaggaugucuuugugccaccuuggucauccuggaaugugccucaaauucauccagauccaccuaccucugccgccugaacgcugagauuaaaggugugguccaccacaucuagcuuugaccaccauaauuacuaggacaguugaagguauaaaugcccuuuuauuuuuggccagugaccaagaguaggcuagugccucagaaaggcucuugaugccaaagcucaagagauaugggguuuuaaaggcaaaauacuauagagaugacaauuacauuagucuuugaugacagucugagaacuuuuacaauguuuguccuccacccccaucggccacugagcauugguggccucaggaugaggaggagcagggucuccuccgguagcagugaguagagcagguauaaaugacccaggagacuguucaggaggacagcucauucacugacaucguggaacuugcuuauauagcucaagucagggagggggaggggaagacaaaaggucaaaggaggaaguguaacagugggggcagggacuuuccacuggcugucacaugacuucuaagaagcuaguucuuuggcaggggaaccgaaguuuaacuggccuuaaggugacaaggccuuugucuuuauggagaugagaaggcccaagccugauuuggguagggagcaggcccccguccugcagggcucucugagagauguccagggcaugggcaacacuugaccacuccuucucuggcuugagaacccagggcaacgcuguaucagcaaagcccaguaggcauuucaaucacaauguaacaguuaaucauccucagacacgacacaagaggguaucagaccccauuacagaugguugugaaccaccaugugguugcugggaauugaacucaggaccucuggaggagcagucagugcuuuuaacugcugagccaucucuccagcccuugagacuagauuucuuuaugucacuaguucuuaaccuuccuaaugcugugacccuacaauacaguuucucauguucugguugaaugaaaagaagaaauaaaaaugaaaggaaaggacaugcgucauccuagguaugguggagaacaacauuuauuacaggugugugggagagcagaggcaaaggcaugugggagauggggagugggagggggagcagagaggggagccaggaggccaaaguuacacaaaagagggcagguagccaaaaugucuggauuauaugcagaauagccuguguggaaaaggaagcccaugcccuaggcuggagaguucaggauggggguggaguaugccagacuaggggaugcuggaagaaccugauugccaggaccucuuugauauauuaaaugaggaccucaguuguuuauucuggguuugaaaguuaacaguggugacccucaaacauaaaauuauuuuuguugcuacuucauaaauguaauuuugcuacugguaugaaauauaauuuaggcauugcauaugcaggauauccaauauuugaccucugugaaaagguuguuugaucccaaaaggagucuugaccugcagguugagaacagcuauucucuguaguccuggaauagcuguguagaccagucucaccugaaacucauagaucuucuuccggcaucugccucccaagugcugggauuuaaggggcacgacaccacacuuggcucaagagaagcaaauuuggaagcaauguguuccugguuuucuucagagaugguuuucagccccgaagugaaaaaccacaaggagguguguagaagugagagcccaaacacgguccucaguuagcucgaguucuugucucauguuguagcucagaauggacucacaaaacucacagucuuucuccugccucagccuuccagaggccagucuuacaagugugaauuaccacacaguuugcuguaacccucuuaauugaugguguguagcuugugacucauguucauguucucaagcaugagucaacauucacucagcugagggugugggaaccaaggaccgcauuggccugccuucccacucaaaguagcucaucugaucucugggcaggacaggacaugccuuccugccucccacagccagcuuucaggaaaauuccacucucauucuucaaggccucgagauuagcugcuuaaucuagcauuuaaugucgacagccuuggacacugcggguuuguuuguuuugagagaaggcauucgacuguucugcuccugagggugaccuuacacuucugacccuccagaggcugccucccacucgccggaucacagggaugcaccaccacacccaguuuaugggggugcuggggaucaaauaauaggaagcucucugccuacugggccuuuguccccauuguccccaaugccaacagcucuccuuuauucucuccggugagcacucgcuuucugaggcugacccauuguuuuccucccuagcauuuugcacaaacuccuacucuuguuugucuccugagcuaucucagucguccaguccagccuggaacucacuagcccaugcuggucugcugagugcugggacuacaggcaugggccuccaugucuggcuuuagaaauuuucuuuauagcugacauauccagguguuuucuuuacagugcuugagaacugacugguaaauacaggcgaagcaccgcgcuuuaggagagguucaguucuuccuguggucgucuauacuuacaacgucagcuugagacaguagaagcaagaauggcaggggcucaaagguagccucuguuaguaagcuugaggcugcaugauaccuugucucaaagacaacaccacgcaugaacaaaaccccuguccauacauagugcaugccugcaaucccagugcucuggaggccaggccagggaacugaggcagguuuaaggccaaucuggcuuauacaauccgcucuaggagaguaauuaguuaaggcuuugcuuauagaagcaguagggugggaacuuggggagaagaaaugaagauuguaacucacuagaguuccagccaauagggaaagcaggaaugucuuaugaucagggacuugaaaaccacaggguagcuauuuuugucuuuucucuauguuggugugccuuucugcagaauggugaauaggaaacugcuuuacucucaccaguuagucucucauauguauucucgagggucuugcuucucacaucccuucugccacgggcaacaugaccaacaugagaaggaauucaaaguucucauaauugccucaguucugauaagcuaaggaacccuaugggcuuuuccagucccauccccuccuuacagcucccccccacccccaucugcugucaaggcuaggccaaguuccauucuccacccacaggaacauucuugaguaaaaaaaaaucucagaaaaauggcagaauguacugauuaauaaucaccugacccucuggaaagucccagauagagcucaaaugcgugucaugaucugcccaugcuugcuggccaauagacuuaaaggucaauaugcuuagccaauguuugaacuguaacuuuggugauguaaccugugccccuaaaauguauaaaaacugcuuguaauagcuauuuggggccgccuucucaucacucgccuugagggacugauuaaagggagacuuugugcuggaaaauaaaccucuuuugcauucaucugugucucagggccucacuugagggugucuugaaguaaguaccacugaccaagaguugaggucuuacaaagccaugacaacauucacagaaaaugcuuccccuauggugaguuuucuuguugcagaaaguuacuggaauacaugcaaaaagcagagaguggaaggaacgcagagacuccauguccucugcucaugggaucagggugagcuacccuccuggcccacugcaguguuugccaaccuggaagcuccacugagcuuugaugucuaguuuaucggugcuuuaguacugggcaagauugcuaauaccuuggcccaguaggguuuagugguuagggugacugccucaaagucccaaccaccuaauccgauaaucacaugguuggucuuucugaggccaucaugugguccaagaugagucacucccaucauaagaaagauguauuucccuggaaguucaaaaggcuuuuaagguucugugccagaagccaagggaaaauuauacauacauauauaauaauaauaauaauaauaauuauuauuauuauuauuauuauuauuauuauuauuacaccaugcuauaucaucaugccucaucaacuuuuguaagaaucuggcacccuggcugugauaaaaugagaaggcuuuagagaagggagaguguguguuuuguaguugugguugggacauggucuuacucuagaaucuagauugaccuagaacucacggcaauccucuaggauucuaggaucacagucaagaaggaccagaucugucugugaaaagaaauucucagauaagaaaaggaccaagaaggcaauucagauggcacuucuauuaccaggacagacuguuuaaaagaaaauaaggaugauuuuuguuuggccacaaugagaguucuuggaugacaacgggugaaggcugcuuuguucaacaaggaagcaucguggauccccagguaaggacuuugggaaacuuaggugagaggaaguuucaguaaagaagagacuaaacaccacaagcagugcuuuagggugccuuggacugugggacagaauagaggaaacagaggagcugcugucacaguauaguuuuaaaauauacuuuuaaaauucaauuaauuuuuguggaugguguuuggccuguauguuuguuugugcaaagacacugccugguaaccaaggccagaaaagagugcaggaguccuuugaacuagaauuuagacaguugagagcugccaugugggugcugggaaucaaaccuggguucuuuauaggagcuuuuguccucuuuuuuuuuuuuuuuuucaagacaggguuucucuguguagcccuggcuguccugaacucacuuuguagaccaggcuggccucaaacucagaaaucugccugccucugccuccugagugcuaggauuaaaggcaugcaccaccaugccuggcacuuucaguccacuuaagugaugagucacaucucccaaaaguauauaauuuucaaaagcacagcuuucuuacaaaucuagaaugagcacgugccaacugcaauuguuucaauucacuagugagcugaugucaguugaucuaaagaauuacaagaacaaauccagccagaaaggcauagagaaauacauuugcaaggagcauggugguguauaccuggaacugaauauacuuuugggaggcaaagacuggaagaucaggagcucaagaccugccugggcuacaugguaaauuugaggccaaccagggcuacaagagaccuuguuuuaaaaaauaacaauaacguaucugcuagguuuaggagguuucauaucuuuuuacagacaagaggugauuuguauccuucucuggaaaaaaaauaauaagacuuaagccugcaacuucaaaaaaugcccacaaucaacaguaaauacaggcacucagaggaguuucuucaauacuagaauggugcaaagugaccaaaaaaaauaugaaaaucauaacuuagugcaguaagacaggguugaaauaauacagagccgauauuuaugagucuauuguucaguuguugagaaagauccgggcaugauggcaaauggugagacugaaggugcuacaggcugaggcaggggagggcagaggauagcauucuagauauccuagguauuuuagaucucauaaauacuuagauauccuuugccaagacccaugacauuaguuagguaggcaggaucuugggcuugcucuuaaacuuggcuuccugcuggagcuuccugagugcuggaauuacaguauguggccacacggggcaaauaccgaacuuuuacaaguauaugucaggugagugugcucacuaguuuuaugucaacuugacauaagucagacucacuuguaaaaaggaaacuucaaaugaggaaaaugccccacuacauuggccuguggaggauuuucuugaucaaugugacagggcccagcucaugguggguggaugccacuacuggucggggaguccuggguguuauaagaaaccagucagguugagcaagauguggagagcaaggcaguaagcagcacucuucuauagccucuucaacggauccuccauccaggauccaacccugacuucccucagugauggacuguaauguggaacugaaagcugaaagaaacuuuuucuuucccagguuguuuuugaccauagugcuuuaaucacagcaacagaaauccgaacuauaacagcaagcaugacagaacagcaggacggagguugauuggcuuugauuauuaacagucagcaauaauauguuaguacagaaaauaaauuuuauaggcuguuguuguuaacaaagucuuagauguuugauuuuaucaaugaagacuugagagccagauguuggaguaaaaacucgcuagccgagagaggcagagaaagcaccucgcugacccuccuccucagcaaacaucccuaaaggcaguucucugucuuaaaaaucccucaagcuuaaugucccucccuuccauuuccugugcaucucucucuccauccuccugacuucccuuccucuguuuuuuccccuauguucacucccugucaacugguuucuugcucuaccuuuugaccuauggcuagcuuuacuuaauacuguuuacaauaagcagaaagcccugaauuagggguauguuagcuuuuccaguaaauaacucuauguaggguuucagugugaucaaauauccugcaccaauggggcuugacaggagugggguggaugggauagugaugcaggcuuuuaaucccaacauuuaagaggcagaggcaggcagaucucugugaguucaaggccaaccuggucuacauagugaguucugggucaggcaagguuacaaagugaaacccuguuucaaaaacaaaaguuuauaagguaaacuuuauaauaauuauacuaaauauugaucaaaggucuuuuccuaaaauuaaaaaaaaaaaguuuauguaaccuauaguucuauugaggaccauuuuuuaaaccaguuugaaauuagcuaaggagguuggugauauuuagugguaaaggccccggcauauucgagguccccgguucacguccaucaucagaggcgcuggcuguaguaguagcacauacuguaauccuaggacucagguggcagaggcuguagggucaagaguucauggccugcuucuguuacaugaugaguuucaggcuccauguucuccugucuuaacauucuuugcuuugcucucauaguuccuaguaugcgcauuguuugcuugguuucguuuucuuuauuuuugagacagccucauuccuuagcccuggcuguucuggaaugcaccaaguccaccagaccaggcauguuucaaaaucagccuucuuccaagccucugccucauguguauucggauuaaagguaugcauacucuggcugccucacauuuacuuuuuuauuuauuuauggugugugucuguguguucuaugugggugggcacauauauugacgucaaaggacaauuacaggaguugguucuuuucuuauacucuugugggucccagagauaagacauggcagcaagcauccuugcccgauaagucaucucaaaagccuugguacaugucucuuaaaauaguguugguaccuacaaaacguggaacauaucuaauuuaaauuugaauguaagauaaaauaucaaacucguuuaguggucaggucuucugggaaaccccuaagaccccaggagucuuaaagacauuuccccuuucugaauauguccuuguucuuuuuuugggggggggggagaaacccuaaaaccuaacagauuugaaaaccuagcagagauuuggccacuuauuuaagcuagaaccauacaucuuaacacacaguuuaagugacugcagcaggugaaucuacccaggcauuuuggugacaagaccuuuauaacugccaaaguaucauuuuuuuucuuuucuuuuuguuuguuuguuuguuuguuugugagagaggguuucucuguguagcccuggcugucccagaacucacuugguagacaaggcugaacuugaauucccagagauccaccuuccucugccucuuaauugaugagauuaaaagugugugccacuaccgcccagcuucuuucauaucucuuaaaagagcuaaauguugagaaauaugaggcaugaaagcaacaggaagggguauuucagagucacaggggguguaguggcuauuucugguugucaacuugacuauauuuggaaugaacuacaauccagaauuggaaggcucaccagugacccuuaucuggaggcuuggagauucuuaucuggaucuugguaaggagaucuugagcaauaguggcuauggauuccagaagauuagaucuccgaguuuaaggaacacaccuuuaaucugggcuacaccuuuucaucugggauuaagggugugguggcacacaccuuuaaucugggcuacaccuucugcuggagacaauauaaggacauuggaagaagagagucuagcucuugcuccuucgccugcuugcugugugagacugaguaacugcuagauccuuggacuuccauucacagcugcgacugaaccauuguugggaauugggcugccgacuguaagucaucaauaaauuccuuuauuaucuagagacuauccauacguucugugacucuagagaacacugacuaauacagggggacuagcacaaggagaggaggaaguacugaggggacagugggauguaaugguauauuugugucauuguaaacuuuaacugucaauugacacagccuagaaucaacugaaagaaaagucucauuugaguaaauugucuauauuggucuauggucauguuuuugagggauuguccugauugugaauugauaaggaagcucagccaacuggguggugacauucccuggacuguguaagggugugacccaaggaugagccuuaguggccaguaagcagccuuccuccauggguucuacuucaagcuguugcuucaguuucuguccuugccacccucagugguggagugugacuuggaagcauaagccaaauaaauccuuuccucucugaaguugccuucugucauaguguuuuaucacagcaauacugugggaaccagaacaauacaaauaaaaauuguacaaugaggcccuugugugcuaaagaagaacaaaggagacaguaaagguaguaaacucucuuacuggauuugaggccugcuuugcaggagaggaucugauauuuuacaccugggggucacaggacuagagcagcggcucuuucuauugcugauuugcuaacuggacauagcaucaaggugucuuucugacauuuauuuucagguucauagguuaacacuauucucagccuuggucacaaagcuccucuuuaaaugcccaucaagugaguguuuagcagcaaauggguaucaaaaccaccaaagcucagcaaacauuguggggucuuaauguuacaaggaugaguaggagcaauuuccucagugguguugcuaugguaacuugcucaugcuccuuccauuaucugagccaacauccuucagaauuucgacauauacagaagaccaucagagagagacauucggccuugugaacggaacaacuaauggauucuugaacuuuccauugauugagagccauuguuggacuagcuggaucucagccaguaaacauucuaaucucgugugugugugugugugugugugugcaugugcgcaugcgaguaugugugcaugcacacucaggugugugcagaaagagacagacagacagacagaagaaacccuagcuaauacauguguggaggccagaggacuaauucuacuaaucaguucuuuccuucuaccgugugccugcuaggccuuucagagaaugacucugcagaggauucugcuuauccauucuugaaggggagggacuuagagaaucugguuaauuucagggacuuccugaaacuguuuugagcuguuacugucuuaauaagcuucccugcaggguggaauguuuuaaacuuggaagaaacugcuacauaacaaaucuggaaagaagcucucugugaaucugcauagugaauuccaaacuagcuggugcuauacugagagacccuaucucaaauaaauaaauaaauaaauaaauaaauaaauaaauaaauaaauaaauccaaaaagaucugccauacgguccaauauaaauggacuuuaagccuagugauauauaaaauauucucgggagaucaucugcuuuugguuuccauaacugccccuucuccuaccucauagauaagugcauuauguacugcucagagccaggcccuuugcuuugugccugcuaggcaagcacuauuccaaugagcugcucccagauccuuuuuugcuuauuucuaagacguuuucauuugaguuggcaagcaagagugagggcaagcaggcaaaccacaagggcuuacuucuucuauguccuuuauacaagcaccaguagaagguauguaccagauuuaagguggaucuucccaucucaaaagaucuagauuaaaaguggucuucccacuucaaaugauucaguuaaggaaaaucccugacaggugugcugagcuacuuugguuuuagguaauuucagauguagucaaauugacaaccaagaauagucauuacaacacacaugcugucuuaggugucuuagucaggguuuuacugcugugaacagacaccaugaucaaggcaagucuuauaaaaaacaacauuuaauugggacuggcuuacagguucagagguucagucuauuaucaucaaggugggagcauggcaguauccaggcaaacauggcgcaggaggagcugagaguucuaugucuucauccaaaggcugcuaguggaagacugacuuccaggcaacuagggugaggaucuuauacccacacccacagugacacacucauuccaaccaggucacaccuauuccaacaaggccacaccuucagguggugccacucccugguccaaggauauacaaaccaucacgguuaggguuugcauugcugugacgagauaccaugaccaaggcaacucucauaagaacaacauuuaauugggaccaguucauggguucagacauucaguccauuaucaucaaggugggaacauggcaguauccaggcaagcaugaugcagaaggagcuaagaguucuacaucuggcucccaggugguuacaaggagggucucauugccuacucccacggugacacacuuccuccaacaaagccauaccucuuaauagugccacuuccugggccaagcauauucaaaccacaugacaacucccuggccuccauaggcuucuucaaauacuuaagucuaugggggccauauccaggcauaguauaauaaaaaacacauguaguccaacuuccaacgucuccauagucgacagcagucucaacaauguuagaaguccaacauuuaaagucuauucugagauucuucugaccacuuaacuguaaucuccaaagcaagacaggaaaacagcaaacuccaaacugugcaucuccauguucaaagucaaaguagucuuuagaucuccaacuucuuuuucaucuuuguuuuccugggcugguccuguuagcagcuuaccuccacagguaucuguaguggcuauuccugguugucaacuugaauauauuuggaaugaacuacaauccagaguuggagggcucacuugugauccaggucuugaggcugccagacacaaauuucugaucuugaucuuggcauagagaucuugaggcacaguggcuacgaaaagcuuaggcccaggcaagggagugcaugucuuuaaucccaggacucuaaggcaaggagaucaaggucagccugggacaaaacaagucccaaauccaggaguggugauuucaccuuuaaucugggccacaccuucugcuggaggccuacacaaggacauuggaagacggaagguucucucuucuucaccugcuugcacuuacuugcacagcacaccuguugcaaucuacuucuacagaagaccagcugaaacaacuagccuuguggaacugagcaacuccuagauccuuggacuucccauucacagcugaccauuguuggggaguuggacuacagacugcaauuagucacaacaaauuaccuuagcauauagagacuagucauacaaucugugacucuagagaaccccaacuaauacaguaucccacaguuuugguuaucuuuaauguauuggggucuccaacuucaacuucacagcuuccuguuccaaugucagggauccacacaugaucuucugggcuccuccaaaggguucuccagcugugcccucuuuagcgcucgaggcucagguugguccacuccacugccgcugcuguucuuuguggucaucucacaguacuggcaucuccaauaugguggagccuucugcugcaacuucuuugcaugaccccuuugguccaaggacaucaacugcaacugaggcuucacuuucaccaauggccuucccuggccucucacagugccaagccucagcugcucuccacgacucccucauaucuucaaaagcaguacuaccuggguuauucuuacauauuaacaaguacagcugcagcacaagguacaaccuuggcuaucucuggaacacagcuucuuugugcucucagaaaacacuuuccagaagauuucaccucggugaugcuggucucuucuuaaugacugcuaauuuuuuagcuccagguaaccagcaucgauugucccaguagucccuuccauucuggacucuaaauucagagccacauggccaaagcugccaaguuccacugcuugcuagggauggaacauggcucccuuauucuuuuaccagcuuccuguuuuccaacucccucacugacuaagcuuggcuguccuagaacuugcucuguagauugaccuugaacccaagagaucugcauggcucuguucuccugaaugcuagggcuaaagguguacacaaugccuggauuuaagcuuuucaccccaagguacaugggaaagugcaugagaggcagaaagaauguaagagccagaggauggagacaagagcuuugaaauguuguccuguggaagugauacgguuauuauuauucuccuaaacuccuggcagcccugguuaucuaugcaagaccugcaaacaccaagccagccaaaaucccagucuagaugcauguccuaauuagcauuaacuccucaauuugacauagucuagaaucaccagaaaaaaagaauuccaauugaaugguuuuuaucagguuagucuguggcaugucugugagagcuuucgugacuguuucuugauguaggagggugcagaccauugugggugacaccauucucugggcagcugauccugggcugcauuccgaagcuagcagagcauaaccugcaaaugaagcggagaaauccuuuccuccucuagguuguuuugggucagaguuucaacauggcaauggaaugaaugcgaacaauggagaggcuucucuaguccccagcguuuccugggaagcugcuggccacuggcagcggcuggacgagggagaauucuuugguguguauggguuuuucaugcuacaguggauggcccaaugcccaugcaguagcuggacuuagauagauagauagauagauagauagauagauagauagauagauagauagauagaguagggcacaauggguuguguggauaugauauuucacuguucacacauaugaaauucccaagaauaaagaaaaaaaaaaucaaaguaccacuuauccaauuaaaaaaaaaaaguauacagagaaccuuauaaaaaugacaccugucauaucacuaaauguagaauuuucagugaacagauuuaauuugaaugaugcaguaguccaggacuguuuuuuguuuuuguuuuuuuauuguugcucuuuuauuguuguuuuuuaguucuaucauuaaauaacuguauagccuugggcaggauuuaaaccaagaacagcaguagucuguuccuuguaagauugcugugaagauuaaaugagacaauuuucuucaaguuuuuagaaaaggcaaaaacgaaauaaagcaaauaaaugaaauuaacuacucuuuucuuuuuggcucauaaauauugauauuucccaaggucugguuugacuucuauuuuauuaugccuuauaugcucgaagaauaaccaugauuuaaaagucuaucuauguuauaaacucccaccuuuguauuucuaauggaguucucuguguaucuacugugucuuucagaaaagaaggaaauuuaaaccagagaugauuugaguauagccaaauauccuucuuguagcuuauuuuacaucuuaaacuuauaauuuuuuuuuaaguaauuaguuguacuuggggaugaacacagggucucaugagugcuagacaauuauccaguaaugaacuuguauguccauucucaacauaguaaaauuaaaaguaauuuaauuagaugauauauguauuuguuacuuucuuauuguugugacaagauaccugacaugaagcgauuuaaagucugaagggcuuuuuuuggcucaugguuugagggacacagaaggcaaagcagcaugaacauggugcagcuagucacauuucaucuacaguugguguuuuaguuaacuuucuacuucugugaugaaauccuaugaccaaagcaacuuaugaaagaaagcauuuauuaagggcuugcuaacaguuucugagggugugguuguuugaaugaggacgccacaccacuguggacuccugucugaaugguuaguccucaaguggugaaacuggacaggauuaggagguguggccucguuggaggaggugugucaaagguacagggcauugagguuucaacaaccuaugccaggccucauucuuggcuggcugucuacagcucaggauauaaggcucucaacuacugcucuagugccacacccauuggcuucuuucuauaaauaucaucaacuacgcuucuaaacuguaagcaagcccccaauuaaaugcuuaaaugcuuuuauaagaguugccuuggucauggggucucuaucaauagaccaguagcuaaggcaaagugugacucuguaucaucaaggcugggagccugguaagaggcagaccaacauggugcaggagcaauagcagagagcuuacauuugaucugcaaauugguguggacgacuuucccucccucuccccucccucuccuucuucaauuuauuuauuuauuucauguauguggguauacuguugcugucuucagacacaccagaagaugacaucagaugucagaugguugugagccaccaugugguugcugggaauugaacucaggaccucugaaagagcggucaauguucuuaaccacugagccaucucuccagccccugguguggauuuuucaaaccucaaagucuaccuccuagugauauaccuccuucaaggccacaacuccuaauccuuucccccaaauguucagcauuccaauucaugagccuaugaagguaauucucauucacacuaccauuuuugggaaacacagaaaaugaaugcugguguguauuaggcuuucaguuauaguaggaaugaaaaaugucucauuuaggcuuguauauuugaauacuugcuccuaaucugguggugcuguuuguggacauuugaugauacugugguggaaccuuuacaagaggcagccuggcuggaggaaguacaacacugggaccugcuuugaugcuuugagcuuuuauagucuuggccuacuuauugcuugcucucuguuuucugugugcaauugagauguagucuuucaccauuuuacuccuuccuccugugugacuaugaacagcuagacugcuggaacugcaagccaaaauaaacucuuccuuaagauggugaugcaugccuuuaaucccagcacuugggaggcagaggcaggcagauuucugaguucaagaccagccuggucuacaaaaugaauuccaggacagccagggcuauacagagaaacccugucucgaaaaaacaaaacaaaacaaaacaaaacaaaacaaaacaaaacaaaacaaaacaauacuuccaguuaugcuauuucaucacacaacagaaaauaacuaauauacuuccucaagugcuuccuucuacuuacgucuuacuccauuaaaaaaaaagucuuggccaccgucuuaguuucuauugcuguggauagacaccaugaccaaagcaacucuuucaaaggaaaacauucaauuuggguuggcuuacaguucugauguguaguccauuuuugucauggcaggaagcaugguggcauguagucagacauagugcuggggaaggaacugagaguucugcaucuagaucagcagguagcaggaagagagggacuuugagcucggcgugauuauuugaaaccgcaaagcuuaccuccagugacacaauucuucuaaaaacccuguauuuaauucaauaaggcaauaccuccuaauagugccauucccuaugagcuuaaggggccauuuccauuaaaaccacuauagcagcugucuuagguacuuuuaaauugcugugauaaaacaccauggccaaggcaauuaauaaaagcaguauuuaccugggaucaugguuucagagggaucggcguccacuaccauccuagguagggaacacggcgguggacaaguaggcacugugcuggagcagcagccgagagcuuacauuccagcucaaaagagcaagcagugaguucauuagagaugauggcuggaggguguuaaagccucaaaauccagcccguaugauacacaucuuccaacaaggcuauaccucccaguccuuccuaaauaguuccaccaaguggggaccaauauucaaacaugagccugggggggugggggagcggucaugcucaucccaaccaccacagccacuaugaaguccuugcaagcacagugaguuucugcugcugauuucuccaggcacacacacaguaaccugaaacagagcaucucuuggggauucggagaagagcaaagugaagggcugugacuaucuuuaaagaaugaggcaguaugaucaugauugauuggcccuuuucaugaguuaaggcccgaugucugggcagugaaaucaagucagguguaaguacuugugguuagaucuuguucaacuuauuuaaucuagaguuacgaauucauauuuuggcuuccuauaguuuucagugcuagaguguccagaagaggaucugaugaaaccagggaggcagaagcaaagcccuagcaguucucuuucucagaugugguaacagggagauuggcacuuucugggucaugcugucuccuucauuucaccuuuagcucucuuagcugccaaaucuguuugaguaaccauaaccacgagcaagcaaccaacagaagugugacuauucacaaggaggagagacaacagaagcaauacaccccuuuugccauuccacuuaagcgaggacuggaccucauguuucugcguaauuagcuggugacucuuucccuuuuagucuagcuaacuggaguggauuacguuucaucaguuccagaggcagguagguauagggggcuuaaguaaacuuaaccccagaacucaugagaguguccaaucaucuuaccaaauccuuaguggauaccaucauugguuccagaaguggguccaggguccugaugagacuuuaaauuuaguucucugaucuuccuaaaugugaaagaacagugacauugucaguaauaaaauggcggcucacuugguaaaguggcaaaaauauuuuuuguuuguuuuguuuucuaucacaagccauagaaaacugggaucuacaugcagaaugauacaguucagacuccugacucuauguauaaaaauuucaacucaucaggacugcugguccacguuugcaaucccagagaucuggaaggcugaggauuucaaguucaaggcuugccugggccucacugacuuuaaggcagccuguagaacauuguaggauuuguugcaaaaauuaaaaaagaaaaaacaaagauccaauugacaaaaauaauaaaaaaguaagaaagggcugggcauguggcucagugguagaaaauuaaagaaaaauaccuugaaauggauuaaggacauaaacaaacacaagccuugaaacuaaaaccagaaauaagaaaguguaggggaagccuucacaaaauuggucauaacaaaacaauuuaaaaacuuaaaaaaauaagucccuuuuauucagucuuaaaggcuuuguacaugcucugggcucagcacauacauuuauuauuuaaaucuuuaaauaucacuccuccacacacacaaagagaaaaacccauggaaauuuacaaauccccuacaaaugucuuuuugguuguucacuuccucuuuauacaaacaaccagaaaacagccaaggcuggcccuguagcccacuguccugcagaagcccagaggaagaacgaagagccccgggggcuuccugcagaccagaaaucuauauucagaccaggggacuugucuuuugacuucuguagacccuugcguaugcucuuuauguucagaugcaagcaguucaaggugcugaggcuguugaguuuuugauaagguuguuuuguuuuccucccucucuuugcacucaucuggaccaucacuggcacuccugcacucagagaaccacugaggcccacaaaagucagccuuagagggaccuucaccccugcagcuggccugcaucuacagggccagggaugcuugcaccugcuugggcucuaccaguggcaucugaucuuguggaaaccaugaauuuugauguucuagaggguaggcuagugcacaugauauggucucagaugauccaucacuaggcaggaguaggcacauguggguggaaagaugguucacucauuguccugguuguucagaacuggcugcucuucuggagaacuuagguuugauucgccaagacugacauggaggcucaccugggugacagcaugaggcagcacaaccuugcccagcucugacauacaucucuuguguguugguccugaggaaacacuucccacaagauuucaccucaaugaugugggggcaguccaucggccacugucccggaagaacaaaguucuggucucuuguuuaucacagcugguucuucagcucgagcucauuuuaaaccacagauucuucacacaaauggccugguagagucuuugcuucccucugaaacgucacaagcugggccacugucgucugcacugcucucaacauucuugucucucuaguuucuacguaacaggucccugaguucuccacacuccauggcuuuaguacaauguccuaccaaucugccucuaaucaacaugcccaggucugucacaggaauucuggggcuggagcaggaacauggagcugauguuuucuuccuuuucuucuuucuuuccuuccuuuccucuuccaccuuucuuuuccuuucucuucuguuuccuuccuuccuucuuuuauuuauuuauuuauuuuuuuugagucaagguuucucuguguagucaaggaugucuuagaacucacucuguagaccaggcuggcuuaaccucacagagacaggcuuacuuacugcugccacccaaguguggguggcaccacacucagcuggguguuuccccuuucaaggccucuuguuagauuaagucaagucuauucuagauauucucucuuucaacucaaaaucaaucuagaaucuuaaauacaucuauuaaaaacacuuaccuuuuuccuuuucccuuuuuuggaaacaggguuucucuauauagcccuggguauccugaaacuagaucuguaaaccaggcuggccuucaagucuuagauuugccuggacacuguaucacauuuuaugaccccagaaguuguuucuugaauuucaauuuccuuggguuugccuguuuaauguccuaguugaauugucaaguacaggacaauaaugaaagcugugagcuucuuuggagagagagucucaagcucuagaugaucugggagcauguggccccagguuguccuuguucucucaagaccugccucaucucccugagugcuucugggaauugagccacagcugcccaugggaguguagauuuccucagcacugacagcuacuuaacuuuuugauugguuaaguuacuauugaacaaauacuuaaagggagaaaauuaaguuuaagggauuccaccuaauauuauuuuucuggcucuuacugauuuacaaaacauauuuagaaucuuuucuucauucuagcuucucucaauuugucggaacagugauuacugucucuauuuaagcgacacgugaauuuaugaggugugaaggcaugauugguacugcuugcucucuuacaggauauccccccaaaagauguucaucuccacaucuugaugauuaacacaauuaacuuagugaacuuuaagugauaccuguaacacuuugacagaguuugaggccgauagauuucaaauuccagaccagugugggcuacguggcaaguucaauggcuagacugaguuaaacugcacgaaucuucaucaacaaaacaaaacaaaaagauaaaaauuaaaaaaaauuuuuuuuucgaauaaauuaccguacucuagguucucuagacuuauggaaaaaucuuuucgcuuuuuaaacaccuacuuuuuuuuuucucaagucucauggagggguggccacugaggaaucuccaugcaaaaaaaaaaauaaaaaaauuaaaaaaaaaacaaaaaaaaccccaaucaccuccaggauaaaaaagaaaagagccaaccggaaaaaaaaaaaaucaccuccggaugcgaucgaaaagacggcagcgccaccaccgcagacgggcuacaauuucaaggcaggaggcguggccaaaaaucccucauucaaauaaaaaaccaggagauuugcauggagaauaggcaucgcgcacguucauuggccgaucgcucaguggguggaguacauagugugcccacgaagcuccgcccccaucuauuugcauaacggccccggcgcgugcuggggagaagcggguuuguuuuugaaucugcgguggcggcgaguggagcgcacggcugagacggcagcguccgggacggcugcacgggacggcugcguaggaaggaacucgggucccaggcucucaccucccgcccccgaagguauacgcgagugccaggggcuguucuaaccacugucggagaaaugacuauuguauuucggaagagucaagaccgcauuauggcggcugcgggaguugagugugcgccugcgcgguugcgaagcugcgggcgggcgcugcaugggagcacgugaucgcguggggucgggcucuagcugcaguugagcagcuggccgggcgguggcugcgcaggcgcaauauucauuuucaagagcuaauguucuuguuggacgccauuuggguucuagauuuaauuuucucauucucgaggggguuucgucucgugcuucuucuuuucacauuuuccgaggaaaacguuucucucgugucuuacaccuacccgcaccuuaaaauccuuuauuucucucacgguuucaccggugcagacuugauauuuugguacaaauugccucuugugguucucgauuauaauuucgcguuuaguuagguauuucuggauucgcguuccauuuagggagauaagaucggcaccuaguggugcucucgggggaagugcauuuacuucagcugcacuuuuguaaauacauuuuuaacccuguuuuuaccgguucgcuuuuggaugugcaauguuuacaaaauagaaacuuuuauuuuugauuuguuugagaggacaagaaaaggauguacaaguuaaguugaaaucucaauuuucucagguauuacaucuuuauuauuuuuuuuuuuaaaaaggaacauuucauccaaagucaaugaaguuuuaauccaaacacuugagucuuucauguuuuuaguuuuacuguuucuucaguuagagaaauguuaaagaaaauuagugaacacgauuucucauuauuuugggaugacguauaagcuauuauaucauuuuuugaugaagaauuuuacaaauauuacaaguucuauugagguccuuauuuaagggaaucaauuaaacauuuugaguuuuugaaaaaaauaugugcacuguaguauauguguauaauguacacuuuaaauauguuuuagguguauauguccugguuuuaguuucuuaaaauaacuaugggugugcuacugauuaaaguugugaugccacuaaauuucaguuguauguagcacaauuaggucaguuguauguagcacauugggucaguauacguauaauuuaauauaauuuucuuauucuacccguuguuucuuacuagucuaaaaacuuguguuuucauaaacaucugucauucauauguauaguugcuuuuuugguugcuuauguaacccaaguuuaaaucagucuguugucaaauuaagugcuguuauaaugucgauugguuugggcuaucucuauuacccgaaacaaauacucuuagaaauaauaggauauaauugaaaggaacauuuugggcuguuuuuuuuuuuuuuuuuuuuuuuuuuuuuuuuuuuuuaaaugcugugacauaugcccuggaauggaaggacggggaaggaagucuucuccuccuguagcuagcaggucuaaaguugauguaaugggaaucuugagccucugcugucuuguaccaggaaugaaggcaguucugccuuuuugagacuuugaugcuucugaggugguuuccccucaccccauuuuguacuccuaguauuugaguuuauguauuuaagcuuaacauuuuuguuugaaugcauggguaauugugucaugcguuaauauugagcaucauaagaggcacuagaaaauuacauaacaugcaauuucaauauugaugggacaguuuugcuguauuucuuagaagguaaauguaauuuuaaguuuacuaaaauuaaugaauugucugaaugucagugguugauucuuuaguauuuuagaaacaaguacuaaaaguuugaaauuuuaguuugguuauaauuaaaugaagcauugugcauguauguacacacacacacacacacacacagacagacagacauguuacucaaaguaugaacaaucacugauauguaguuuagaaagaaucaggcuggaaugauuuaagucauaaaauuaaaauuuuauuuuuuaaaaauuacuugauuuuguacucuguuggaauauuuucacguccacaguaugaagauuuaguauuguguuaaucgcccuuaacuacuguggugauguuuguaacuucacuuuugcugugguagaucagucuauaaauauuuaucacuauauauacauauaaauacguacacacacacacacacacacacacacacacacacacacacacacacuuacauguguauguuuuccaagacaagguuucucaacccuggcuguccuggcacucacucuguagaccaggcugaccuugaccugccugccuuugcucugccucccaagugcugggaugaaagucauguaccauuacugccugauuucauuuuuaauuaauuuccugcaauuuuccuuuuugguugugugugcugugggucaaacucagggccucaggcaugcuaagcacacacugucauguuaagcacacacucucaugcuaagcacacacuaccaugcccagcugcauuccccagcacacugcaugcucuuguaacuuagucugacuagcuccccauuuuaguguucuaaaauguuuuuuaaauaacugcauaauaauguauuaucaaaaucuuaauuaucagauauuuucaaaucaaucaaugucuuuauuccuuuauugagacaauguaucccuauguagcccaggccauacuagaacuugcacugaagcagauggauaugguucuucugggauuaagugccuggcuccaguauguuuguuuuuaaauaucugaagguuauuuguacaggaugagugcacucugacuuuguaagccuccugcucagacuguguguggcucuguuucucuuuguucuccccuccucaccccagcuucucagauguagcucaggcuggccuagcccuaggcuguuuuugccucaguagccugagugcugguuacuggcauugucaagcuagcuuguugcuuauuugccuaguagaaauuuuguuaugguaaacacauggugaacacaaucauaauccauaaaaauagcuguucaaaauugguguuucuauguggagcagcaguggcacacaacacagaaaccuggcuuggaaaaaaauaaaaauaaauaaaugcaaaaaaaaaaaaagcguuucuaaggguuuugccagaacaauuaauuugcaaaauagaacaguguagagguuuuuaauuuuguuugcuuuguuuuuguuuuuccaggggcauuucucacacugccaccaguuaaggggagucacuaacuuuaauuagggaagucgauuucuuuccugugaacugaaguguuugagguguguguguucaguuugcuaaugcuccuccucucugcuugucagcaacaggugugccaacuggcauacuuaauggagcaaguaagggucucccgguguagcccugccuguccuggaacucacuauguugaccagacuguccuggaauuuacaggaauucaccugccucuaucucccccuggaauuaaaggccugugccaacauaccuggcugcacugucuuuuuaauuuaugauuuauuccagagcuucucuguugacaaaguauuaccuguggugagauagauuuuuccacuucauuuucuucuagaacuucaugauuauuuaaaaguaaucuuguguguaugaugugugcgcaugcacuugugucugcuuauguaugugugugcucuuccuuggcuucuguauggacuuuagaguagaugcucaggugacuguccuuguuucugacuugguuugugccaggaugccuuaguuacuuugcuuuuauucccugccuacgugagcuaggagcuucuggguguugugucuuucugagagagcucuuggaugacagacacuuacgcugucauggcugcuucugggcuuugaacuccgggccuuccauuucucuagcucugcuuuguuuuucaagacaguguuucugucuaacaguguuggguguucugggacugaccuugaauuuagagauaucccucugccuuugccgucccuaaaacugagauuaaagguauacacuaccacugccagccuaaguaucuuuuaauugacuuucaaaaucgauaaauuaugugugugucuuuacagauacaggaaugcaucuuuuugcagagagggucucauuagcauggagcugagcaguuggacugacugacuggccaguaaacccuggggaucaagcaacccccaguacagagaggacaagugcgaccacuaccaucaucagccuuugauguaggccagggguggagcaaagguccucagaguugcacaguguuguagggccauacacuacauuaaauaguagguaagaguuuuacaaugcugcuauguacuguuuaauuaaaauacccaugacuuggucucacaguuguguuagcuaacgugugguuuugcagaugaacaugagauucuuuugcuuaaaacaguagucuuuguuuagaauuauauacaguaaauuuaaauuugaggaauuuuuaacucauauacuuaacgugucguaaagagcguacaaacaaaacgugcacuucuucuagacuccuaaaauguacuguuuuuaggaaauguugggaaaacucacaguuccuaugaucauucaauaaguugccauuuuccuguuuucugaguauugauaguaagagggauaaauuaugagagagcauaaggcuaaauuuuuuuuugaacauguugauuaaaaaaguaagccaguuagaagcuggaaaaguagguuucaaaagaaaguauuuuacaguauuugaagccauuauuauuauuauuauuauuauuauuauuuguuuuuuuucgagacaggguuucucuguauagcccuggcuguccuggaacucacuuuguagaccaggcuggccucgaacucagaaauccaccugccucugccucccaagugcugggauaaaaggccaccacugccuggccauuauuauuuugauugguggaauuuugaaaaguuauuuacucaauguuuggccaggaugggaccaaauuuauugcauaauaaauacaaaaauaauuuuauuugggaacauuaaauugauauacuuuuccuacuuucuauauacauuuguuauuucauucaauuuuuuaauguugauuguaguaacauauuaauuuuuuuguuuuguuuuguuuuguuuuguuuuuuuuggcuggccuuaaacucacaaagauccuccugccuuugccucccaagugcuggguucaaagguagugugccaccacacccagcuccuauuacuaauaauuacuaaugacauaauuaaacuuuuuaaucauuuuuauauugaaaggagucugguuauugcccaaauacuuauugaacuuguagaggcaugaaaaaaagaaaagaaauaaagagaacucaaauaggaaaaucuugcuggcuuugugaaaaugaaccuaggaaaucgauaccaaguguuaagacccuggcauuuuaucaugccuguaaacuuaauuauuuugcuuuuuuuuuuauguuagcuuugaccuuggucgagaucuuuucagcuucuaguguaguacauagagcauuugauuccuuacuuggcacagaagugcccguagagaaggacuuugaugaggagcaagacaugaagguuggcaucuuggcagaguacaggggagucacacuuuaagggcuagagacaagaauuugucauuucauuucuuuuuccuucccucguuuguuuucuuucuuuucuguuuuuuccuccuccccucucccuuucuuuccucuguccccgcccccuuccccucccaccuccugagugcugguauuacaggcauguaccuuccugucuggagauugauaggcaagcacucugccaauugagccgcaccccaaccuccaguuuugucuuuucuuguguuuuuguugcugcugucuuguuuuugagacaguuugguaacccuggcuggccuggagcuuaauauguacuucaggcuggcuucaaggucacagagagccauuuucucugccucgggaaggcugauuaaaggacaggcuuugagacagggucauggucuauugcucagucuggcuacaacaaggucaucguccucaugccuuguccucuuugcuuguguucaccuuagauccucaagccaacucuggaaaauacgaugcaaugacacaaguaaugauuugugucuuaugcuuguaucauuuucuccuucccuaucagauuuaagugauuuaaaaguugaaaauguggcgagggguguagcugaguuggccgaaugcuugcuuaaugugcauggaaucuuggauuugauucccagcacugcauacaacuuggcauaaucuugaacaccuguaaccauagcacuguggagguagaaguagcagauacauuucaaguauaguugugauaacgggagacucauaaaauauucaaagaugaaucaaguaaaugaaagacaaaaagaacaaaggcagaaaauauuucuaaacaaguuagaacaccgugaggagcuguuguaauuuguguuaggaucuuggcaaccaccuggugucucuacaguuuuucuuuguuugguuuuuauguuaauuauuuuugcaguauuggguuuuaaaccuaagaccucauauaugcuaggcaaguacucuaauacugaacccuauugcuauccuuccuuuccgugaaaauagauuuaacaucuguguggugcaauaauagggcuagagagcuggcucacugguuugauuauuaacaucuacagcaggugcuuuacagucgcuuguagcucuagcuuuagggugugugguggccuccugcacucacaugcgugcaugcauacaugcaugugcaaacucucacucuccacucccucccccaucggaucuuuauaaagccuuagcaguuuaaggcaugugcuauauauaagauuaguaaccuagguucuaucccuagaauucacuuaaaguuggaaggaguuaauugacuccaauuguuauuugaccuacacaugugugcuguggaauauaccccucacacacgaugaacaugcagaauacaauuuuaaaaauccuuguggacaauagucuuaauuuuuuuucagauuuuuauuuauuuauuuaauguauauaagcacaccauugcucuccagacacaccaguagagagcaucagaucccauuacaguugguuaugugccaccauguggcugcuggaaauugaacccaggaccucuggaagagcagucagugcucuuaacugaugagccaucucuucagcuugacaauagucuugauuauacuaauagaauuuaaauguuuugaaaaguaauuuaggaaaaaaaugguuugauaauaaaugcauaaggaauuuauacauuuagaaagguuaauuauaauuuuugugugugugagaaucugguuuuagaaccaacuaaaaacuuaaacaagccacaucauuauuauggucacagugaaucucuucauaaugaaaaaaaaaucagcuuuuuuuccauuaauaauucuauuugcugguccaggaaguauauuaucauugaagauaauuguucacuaguaugcuaccacaaagcaucuuacugaaaacauauaaucugacuuauaaaaguaagagaugaucugugaaguaccccaguagauaaagcugacugccaccaaacuuuuaucacaugaguucaauuccugggacccacaaaguggaaggaaagaauuggcuccuacagauugcccucugaccuucacacagaaccuguagcaugggcuagcuucugcuuccuaccccaaauggagagagagagagagagagagagagagagagagagagagagagacugagaccccuuacucaguguaaacauuuugaacaguauuucuacagaauuaaucuuaaaauguuucugauaauuuagcuuauuaucuauaaagucuuuuugaauaagugcuuuaacaaaguugucuguuuuguaugaauauuaauaugaaaauccugaccuaguuccuugauacagauguuaauuugugagaguaaugacuccuuuaugucauaacaagucucucuggccucuuuucuauuuaacuuuaacuuuuguucaauauuuuggagguuucuuuuucuuguaggacccuuguuucccagguggcacauauuuugauugacuuagccucugaggaggaggaaacuauaguauguaguaaauuuuauauuuuguuuauagacaggacauaggagauauuuuugaggaauuuaaagaucaucuaugucagaaaaauauucaguauuuucauguuuucuaugauaguuuggcuggguauagaauuuuagguugaagucauuuuccuuuguuuuacaauggaagauugugcacaggaagcaaguguuguacacuggaaaguuuucuuaauuucauuggugauaucuucugucauuuggccauuccauuuugaguuuuguauagauacuucauuucucucuauuuauacuuugucuuuuguugaagcaguuuucuucaaguucauuuuuuuaauugguuuuuauuucucucuuucucucucucuuucuuucucucuuucuuucucccuuuucugagaugggguucucugaguagcccuggcuguccuggaacucaucuguuugcuucugccucccugaaugaugggauuaaagucaugcaucacuaccagcuggcugaauuuuucauuucuuauauuaaauuuuauuuuucauuuccugccuauacuauucuguucuggacuugaaaguauaccuuuucccuucauauaauagguuuuauaguguucuucuugauguguaauguauugcugauauguaauguauuguuaaguauuuuuuuggcauuugcuuucugucuuucauguuaaaggaaugccaaauauguuuuucauguuugaguucuuucuugggggcuuaaggcauaauguaacguaauagaagucaauugaaauaucuaaauuuagauagacuuaaacuuuucucuaguaugauugggggggcauuuuuggugaacucaaaaugucuugaguuuuguauugguuauacacuuaugcuuucccuuuuguaaguuggugcacauguauauaugcauacacguaugugugugggugcauauuaacauauacugcauguggaagccagauggcuuaggguuaggguuaggguuagcagaggucagugcccuaugucuucuucaaucacuuuuuaucuguuuuuguuguuguuguuguuuuguuuuuguuuuuuuguuuuuugagauagggucucucaucgaacuuggugcuuuccaauucaauucaccuaacaggcuaccaaguccugggauuuucuugucucugccuuccagcccugggauuacaggcccacagccucacaaaguagauacugaggaucagauuuguggcaaucauuuaaucauuuuacugcugucucuccacaaaagauuuccauuuuuaugcauggagaauaaaauucugauucauggaggaagaggcuuaaguaucuccucauucagucugcacucugucaguuuucaguguuuuucuucccucuuuuucuuucuuccuuccuccuccucucccuucuucucccccuccuuguuuuuuuggcuguuguuacuguaguuggaauccagcaccuuguaaaugguacacaagcccucucacaaaacuacaauguugcugugacccucuuacuuauuuucagaccuugcuagguuuagggaaagcuaguguuuagugaucuguuuuugauaggagcuucuagaguucuuaccuccccucauagcuuuggccauugguagagcccccucuaccauucuuuuuuuuuaacuuguugccaagugcuucuugaaauacguuuuuggccuuccagaucuuucuagcuguuuuaucuuacuuucauuuaaagaaaagaaauuacgccuuggaaaaaccucuccugacugccuaggaauaaagcucagcgguagagaauuugccuaacguggacaacaaaaccgaacaaaacaaaacaaaaccaaaaaaccaaaaaccaaaacuucucguuuauaauuuuuauaggauuaaggggaugaaaugagguaucuucaguuuguaucuuaguuuucuuuucuucuucuuuuuuuuaauuacaagcuuauucuauuuuauggaguggaucauguguuuuauuuaaugggugugggggacauugagggacuugauucuugccagucacugugugggccccagggacuaaacccagguuguuggauauccucaaagaaguuuuuacugagacugccuugagggagucgaggacaaggacagagaugcaugcccuuugauucaggucccagggaguaagugggcccagcucugccuucuguaauugcugcagggagggagggagggagggacagggccuccagaaaaggaagcggguuggcaugagaaaguggaaaguuguguuuaaaguuuguuuaggauuuuggucaguaaccuaagaaauaaaauuacauuacauuguuugaauuauaaccuagaaaagcuagugaagccaugaagauguaguguguauguuagagcccuuuuauaccuuuucaaaagaaguuuucaauaauuuauacacguuauuccacuaaugugguaaauaaaaauuauaguagcugacucaagugaauuucuucccucuugcaaaugauuauaguucuggauauaaaaauugguuuguaacucuuguuuucagggcuaucuagauucuugauugugauauuacuuuaucauuuacaaauucauuagaccagauucuuagagcagagccauccugacugcagguuguaguugggacaugucugcaucacugucgugaugagaugagaagacugugacaaagcaugcuauuuucuccuugugagaugaaaugugagauugucgaggaaccaguuacccaauuaaaauucuuuccaagucauuuauuuuuacaaauaaaugauguggcuuuguaaauaaucucaucuaaaauuuccuaaaagauuucuugugacauuaaguuaagccauguuagacuuagaaauauuaauagaauuuaaaaacaaguaauuaaguuauuaugugaaaaugucauaaugaaaucuguuauauuuuaauuaagaaacagugcuacacaagccugaccuuaggucuguuccugaaaccuacuuuggaaggagagaacuccuggaaguaguccucuaauauccaugcaaaagccaugggcaugcauaugugcucauauaugugcucauaugggcauaugcauaugugaauaugugcauucguguacauacacgaugaugauaaugacaauugaacaguaauaauacaaaguugaaacaauauuucuauagcugucuuagaacucaauuauucuaugcaaacaguagacacuacaguccuucucaaaacacuaaaaaugggaaugugcuguauaaaagcacauucuuuaccacauugaacucugaacuguagucuuauaggagaaaauuaggaaaaaaagagacauuguaagugaagguucacaaaaugcacaguuugcugaguuuuuaugucagaagcagaauaaugagaaucucaaaguacugugugaguugagauaauuuuauacuauugaauagaaaaaugauauucuaauggaagacaaauuaaggugcaguuucugaucuucugauuuuacaugguaugugaagagagaguguugaaguguggucaaugaaguggagauaagagcuagagaucuugagagcaguuaccucagguuuggaugauggacacagugaggagaagaggguuggcuguuaaggagaggaccauuaguguuaguucugaaugguggguguucuagcccauguuuguuaacccaggacuuuggaaggcagaugcaugaagaaugcuauauguuuuaggcuagucuaggucuaaagagugagacugucucaaccaaacaaaaccuguugaauccagacgagccuagacuagaauuuaucuguugaguuggacuguuguuuuucugggacacggaacaaaagguauaagccacgacagcagccugauauucucuuuucuuguuuuuauuagaaggagaaaacccaguaucuaaacagguuggcuaaaaacuguauggaugaguguacagcuagguuauuuuucagcuuuuauugaaguuugacuguuauuuagucucugagccuguuauggauaucacagauuggugguaaagccugccauuagacucaguaacaauugagauaguacccaagguuuaucagguuagcuauacugugagcacaucuauucagaacagucguaguuuacuaacaucuugauuuuauugaauaaacgaaaccauccucagccacaaugcucuaaggcuccuguggcuuggccagguaagguaucacaaauaccuucgggggguagaugcaggaggauugcgaguuugagggcagcuugaauguacuguggauucaggguuuugguuagugagauugucccaaaaaaauacaaaacaaggguuggugucauacuucagugauaugaagcauguaguauggucaaggcccaggcuugacccccccccccagacuaauuuuuuuuuuguaacuuuuauuuuuauuuuuauuuuauuuuauuuuguuuucuaauauagcuuuuaagacaguuuucacagacauuguccaguucaucucauggaaacuugaauaaugucucuuuuaagacugaguaauuaaaaaaauguauauguaauauaucaaguguauacagaaauagaaugagauaaggaaacacgugaauuaucaucucuugcggccagucugucugucaccucucuuaugccuuaaacagucguaguaagugcccacauuuagauagcacaacacaagaacacugagcuugaacccgugugcggaaggauggaggagccuggcuccagagcugcuggagccugagaagcagaacaggcccuuugugugccuuggggccuuucuucugccaaguuugcugggguguucucagauguggcuugauuauaccuccccacuuccggacuagguugcacccuuuguccuccgguuccccuucccugggagucucuggucuucauugacuuuauacuaguaccauugacuuuauacuaguagcucuguguauccugggaguguacucaggacauucagacuacaaagagauauuuaauuuuaugggaacuuauuaaaauaugcuuuguuaccaccuuaguuuuuaagacuguaucauuccaacuaaaaaaugugguuguaaagucuaaccauucugcuagauugaguacuuuugaagcuuagauuuugucaaaacaauuuaauuagcuuuuuaaaauuaaaaucaacgugaucaaaugaauauaggauuuagacagauuugacacucuucuugugauggccguguuccauuaaagguaaaauagaaaagguaaauagaaagaaaaaggggcucuugagugggguucgagggacuggcuuucuccucucuuuucuggacugaaauggaggcuugcuuucaggcaauucccuggugugcacucugcgugauuuggcucuaucucuguuacugcuaauacguggccuggauuucaaguuguuugggaucggaaugugcccagacucuguauugcaaguccggauucccaggcauuuuguugcaaaacuggcuugcugccuucuuuuuucuuuucuguguccuaaguggcugcauuguuuguugcaguauaugcauuagcuaucuguguucaguuuauugcagccugacaaagugggaggggcuugcuuugcuccauggcugaguuuucacugugugaguucuucagugcacagugcagccaucuuaauuacacuuuugugcaacugagacugugcagcugucucaaaauggcugcuaacccaaucccugaagcugcauaggcagcaagugugccagugaggagacuugucacaugcaccaggaucagagguaagagccaggaagcuuugaucuuuaagcauuacaauuagaaaacauuagaacaugaccaagcuuggauaggaaggagaacucgcaugugaaaaaguuggcauguuuacuaagaccuguaagcuuguguuagagaaaccguguguugggauggugaggucaaagguuaaauuccuccugugauuccucaccaguuuguugucauugucaggacacuggaucaccacaguggugcuuuucugauccaugccgaauuuaaugcuccuuguguauuugauaauuaauucauuagauauuuguagaaauucaaacuguauauugagaguuuuuuaagaagccauuaauuagccuuguuuagaaagauuaugauuuucugacuuuuaaaaugagauuuuuaugguaguuuuauaaaaagaaugguaauuugcuacauuaaaacauagaaaaaauauuguuuuuuuguuauaugcuucagugcugucucacaugcucacuaauuauaguaaauauauguguacacauacacacaugcacacacacacaugcacacacacacaaacacacacauuuauauagugucguacuuuuccuuagguuacuuuuuguucgaauuggcauuuggauuuagauuuuaaauuucagaguaguuucacauauagaccuguacauuuuuuggucaaucuaaugcaaucugguaccuagaauaaauauuguuuuagguaaguagcauuauuguacauauuuaaaauuguuaauacucaaauuguaaauuugaaaaagguguuuagcauuguaaaacagaaauguuugcuaaacuacaauaucaugguuuccuagcaaauugggagaauaauuuuuucuuucucuuccuuucucccucccucauuccccccccccaccuucuuuucuccuuuuucgaguugugaucucaguguggccugcuguugguugugccuagauugcuaaguaugugaggccccugaccucuagucucugccucaccaguacuuggaucacagguucgugugcugcugcgcacucccgaaagcaggaaugacauuccacucacauaauucagguagaacaguuuuaucuuaagcagugcuuauguuauaguaguuacuaaauuauuuucugaaugcugucauauacuucuguugcuuuguuaauagaguaguuuaaauauauucuugacugauacaguagagaacaguuaguuauguauguuuugauagaggagcuuuuauuuuuuauuuuguaaucuuuuacgcuuuucgauuuuuauuuucuccccucuguuuuuauuuuuaucuuuaaaaaacagugucucauauacuauaagcuggccuuggaacauuuguucuguggccugggcuggccuugaacuuguaaucuuccugcuucagccuaccagaauuagaggcaaguaccaccacgucugauucuaaagcaacuucuaaaauagcaaauuacauuuuugcaaauugaauuuguaaucacaugugccuguguagcuuugaaccuugagcuugugauccaaggaugggaggcagagacuggaggucaggaaccuaaggcaagccucgccuacuuagcaggccaggggcaaccaauagcaggccacacugagaucguggcucaaaaaaagagcaagaggaggagggagggagacaaggaaggagaagggaagagagagaaggaaggagggacagaaagagaagaaaguuacucucccaacauauuaaaaggcuauacaugaaguuuuauuuuguacuuauuucauaguauaaauuuauuuaauuuacuuguaauaauuguauuuaauaaauaaaguauuguguuuaacaaaacuuugaaauaagaucacuuaugaccuuaagaauuuuauauuaguauccagaccugguugacuuuuuugcagagcucagccucuaaggcauuauggaauucuguuuugaguuuuccugaaaugcaucuacuuuuauuccuuuuuugauuuuucuugaagaucuacacuggaacauuaaagcugcuacuuaauaguuuaagauugcugccuugucaugaacuuuaauuuauacuuacucuugcuuauauauuuuuaaauaaaauaauguuuuuuguaauuuaaacucaaguaaaauuaugaauuauugauaaucuuaaugauaguuuauauaaaucaucuacucgugugcauuugccccccaaacagaaacaaggugauaaguaugagagugagcccugcuuucuguaagcgugugcucaguguggcagaagcagggacuggcucccaucucugucacuuuccuuuucacgucugagcaguaaggaucuugggauaaggaugggggaggggaguguguacuauuuaaaauauguguauuugaauaaaaugccauaagacagccauuugguuuuuaauaugguagaaaacuacugcuaagguugaagugcccgaguaguuuacgcuggcagucacuuuuucugccuucuguugcucaguauguaauuuacucucauacuuuauaagauuaucuaucaguuauucuggcuaccuuagaauauuauugcuaaauuuuucauugccguuucccauuuuuacagcuuauaagcauaaaguagaccucagguuauuuuucauuugguggaaaaauuuucaaaauuucugugaauuacagguuagauguuaugcuggauaauugaagccaugguccauauucugggaacugaauucuugaagccauauauuaucaguucuucuuuuucuccuuuccuguuguuuaccuuaucucauaagcuauuuuuaaaaauuagcgucucaaaaggaaauguugggauggggaaaguucauugaugaagaaugcaguuaaauacaaaucuccugucugagcugaucggcaucuuccgauucuuuaguuuauucucucucucucucucucucucucucucucucucucucuccccaccuccacaucccuugucauaugugacuagaucagagugucacaggacaggaaugggaguuucucacauaauucaugcugacguauauauuuguaagucaauccugaauggaauguugcuaucacaggauuggaaguguagcuguaauaaaugcuucagcuguaugcagucuggcugagucuuucagauauacuuaaaaacaaacaaacaaacaaacaaagagggaaagagggagauaaagcuucuccgagugauggauggcugcaggccgaguguucccugugcuggugcaaaugaggaccuuucaguggccacagacugacagcugcuacacugauuucuguccuuuaaccacggcccauuuuucuaguuaacaucuaacgucaguuagauccacauaucuugcaucuuaaaagcugcuagauggggcauuggucagccuguuugucugcccagucaucugcaccgaacacaaagcauaucuccucuguuccauccucuucacucucccuuuuguacucuguuaauuaaugggaguguugacagccaucaauaucuaaaauacaguuucuaacggggaagaaaacaaacacaaauaaaaucuagucuacuaacccuaaccuaaggaagaucuaacauguaaauugaguguacucuuuaguagauaugguaccuuagguaacauuuuuuucuaauuaaaaauuuuuugagauuuuaaaaauuuuauauguauagguguuuugucugugucuauauacccuauguuuacagugccugcagaggucagaaauggacaucagaucccuugaaucuggaguuaaagaugguugugagcugccaugugggugcuagaaauugaagcuggguccucagagccugugaucuccaaucccaauuuuuuguauaaugguacagugccguggggccucuuagaaagauuagugaugucagcccacgguucagagggagaagaguacucacuggaguguagaaagggucugugagguuucuucuguuaaugguaucacugucuuaaagacauuacuguugucaaccagucuuuauggugguguggaagaacaaauuaaauugcauucugaaauacaguuugguggacagguaaguaaaauaacauuuuugucaaaaauuucugccaaaacugaacaacauguaaugaguuuucuaauaugaacuuuucuaaguugaaauuuuuuuugauacaauacuuuucuugcauagauaacaauaaaagccaauauaaauuuagcuuugaaaaucucucuuuacauuuacuaguuaacagcaccauguuagcugucaaaauuacuuugauguugugugaccaugguauguuaacauugugauugguaugauuugaauucacauucuuccagggugucagcccagcuagguugguugguugguugguuccuuccuuccuauuuauuucuuugggugauagucuuacuguguaguccaggcuggucucaaacucuucgugccuucuggaagcugggauuaggcagauggcaggcaccacacccagcagcuucuugacauucauagaaugacagguaacuccaaggaaacuccccuuuggaagcagauuucaagauaacaaugaaaccauacuggaugaagagguugccaacuuguacaggaaguagaccacucugguucccacacugccccaagacagugacuggggaguaaagguaauuacuauucacauagcuugaauaguucaggugaguuagaacuuucacaaagugggauuuuuguuuguuuuguugcucauucauaaucguuuggauuggaacuaccgaguaccacaucaguugaccacaacaguguaaguuuaaugaggaaggggcuuuaacuugagagaugucugaggaguuuugaguuugccugagugcguccauccugucucugaaguaaggcaaaggcagcuggugaagaauggcgacugcggugcuucuugguugcauauggaugcucauguauuagaguggggcguuaacacagaugucaggaaaggugaucucagcucugcuguucaugacuucaggguaaaucauuuaaucucuuugcacuguucuuugaucacuagagaugauuaaagaauuagaaaguacaugcuagcccccuggaguaagaggauucuaaguuugaggcuggcuuacacaacuuagcaagacuaaaacauaaugucaagaguccuggcuuugcagguagaguagguaucuuaggguuuuacugcugugaacagacaucaugaccaaggcaacucuuauaaaggacaacauuuaauuggggcuggcuuacagguucagagguucaguccauuaucaucaaggcaggaauauggcagcauccaggcaggcauggugcaggaggagcugagaguucuacaucuucaucugaaggcugcuagcagaauacugacuuccaggcagcuagaaugagggucuuaaaugccacacccacaggacacaccuacucuaacaaggccacaccuucuaauagugccacuaccugggcccagcauauacaaaccauuacacuagguaagcacucagugcaagaacuguuuguuauaggacccagucuugguccuccauagcauaaaagcuuuaaaccagaggguccagauauuuuuuuccaaucaguuugauaaacuaauuuuuggcaguuucauaaaaaguaaauuaagcucguuuuguuuugaucucucucauguuucaagcaauucuuuucauuguccaucacacacuauucauguguugguguacuggaacuacggugccucuccucugcugcugcuggcuaaagcugcugggagaggcucaccaguccuccauggcacuuucaauaagcaggaauguugagguguuucugauaauucacugcaagugauuaguuaacucauuugauauuaaaauaauauauaacugcuuauuauuuacauuguauuuuaugcugcauuaaacuucaaguuggaugcuuaaccaaguacacagaaggagaaccagcaccugaacaaugagaggcuggggucagaaucacaggccucugaucacagcaccugacagcuaagguggaagauuaguacagcgcuucucaaccuuccuacuguugcagcucuuuuaacacucaguuccucccguaguguugauccccaaccuuaaaguuauuuauuguaaugugacuaucugauaugcaggauaucugaucugugaccucugcaaaaggguuguucaacucucaaaaggcgcaacccauaggucaagaagcucugauacuggguuuaaggccaacuuggacucaaauguaaaauaauaaaaggauuguaccuggugguuugaauaagaaugguccucauagguucauauauuugaauucuuaguuacuagggaguggcacuauuuggagauauuaguuaaauaugaccuuguuggaggaaguguguugugagugggaugagguuaaagcccaugccaagcccauggucucucugucuguggauccaaauguagguccugcaccaugccugucaugccuacugcuaugcuucccacugucaugauaaugaaugaaaucucugaaacuguaagcaaguccccaauuaaaugcuuucuuuuauaagaguugcuuugcccagugguauuuucacagcaauagaaaaaugacauacagaagucaguaugagguguguguguggagugcugcugugacaggccugagaccaugcagcuuguuggaggaauauggaagacuuugggacuuuggcuuaagaaaguacuugaaugcucuaaguggggcuuaaugaaucauaucaauaagaacauggaagaugguggugcaucaacacccccucccucucacucacacacaccccccaagagauuuaagaggggggagaauauuaguaaaugguucuugugauauuuuagcaaagaauguggcugcuuucugcccuugucugcaaaaccuuccuugauguugaagaauuuuggauuaauggccuuugaagaggagauuccaagacagccuaguauuacugacuguguugugugguuauuaguggcuacucuuaugcagaucuauaauguacaggaacaagcuggacaaauacaauuacaguuuguagagaaaaaggaacaccauuguagugucugugccuggcugucaaccugcuuauaucuggaaugagcuacaugcagaauuggaaggcucaccugugauccuaaucuggagacugggagauauaaguuucuaaccuggaucuugacguggauggagaucuugagacauaguggcuaugaauuccaggagaucucuugaguucaaaaucaucugggacaaagcaagucccuagauccaggcaugguggcacacaccuuuaaucugggccacaucuucugcuggagaccuacauaaggacauuggaagaaggaagauuuacucuuucuccuccgccugcuugccuugugguauugagcaacugcuagauccuuggacuuccauccacagcugcugcugaccauuguugggaguuggacugcagacuguaagucaucaacaaauuccuuuacuauauagagacuacccauaaguucugugacucuagagaaccccgacuaauacaaccgugaaguaaugauggagcuaagucuuguacuaaaggagauagaaaguuuaaggaaaaacguguugcuaaauggagugaagggaguggugacuucagggcaacaucccacccugcucacuuuccaacuuuagagaaggaauuaaaagcuucagcaacaaagauggaaagcugauauaaauguuauugaacauggaugccaaguuccaaccccagcaagcagaagaacuuuuuggcagcuucagccgcaugggccuggcaucagaguuaaugauacaagaaaggguuguggaaccucccucugcugcuaagaaaaucugcuguugggcaugugugaaggguguccuuguguggaggccuacagaggccauuggaugaggguaaagccuggauuauguuggagacccaguguuggugcuggaggugccaaucuuggcacaccugccgaggagagcugcagagacaacaacauuggaaggaguuggggagacagauuuggagcuugcccugguaguuuugggucaugguuugcuucaguauuuucucauuauguucucuuuccucccuuuggaaugauuauguauauucugagcaauuauauguuggaaguaugugacccacuuuuugauuuugauuuuugauuacagggguuaugguuaagagagugccaucagucucagagacuuuugacauuuaaacaguauggagaguggcaucauagacuagggugaucuuugaaauuggacugaaugcauuuuugcauuaugauauggcuauaagccuauaggagccagggacuggaauguggugguuugaauaagaaugaauggccauggagucauguauuugaaugcuuagucaccagggaguggcuccguuuguauguguggcauuguuggagaaguguagcaugaggagagugggcuuugaggauucaaaagcucauggaaacucagugucuccgucucuaccuguggauccggauguggcucucagcugcuucugcagcgccaucccugccaugccugcugcuagucuucccaccgugaugauaaugaauuaaaccucugaaauuguaagccagcccccaauuaaaugcuuucuuugucuuauugcauuggucauggugucucucuucacagcaguagagcagugauuaugacgcuguaaagccuucuaagcucucuuugcagcucuugagccuuucugaugaaugugguacuuaagaaucugguguuuagagcugugugccccccuccccaauauuaaguguaugguuaauucugaaauugcauuguauuuuacugucauuuugucugcugggguguaaugggcaugguggacaggucuugagaggacagugugguugucugagaagaauuuauccauucccuuucaguuauucucuuucacaggggacaguuauaauugucugcauauugaagauuccgauuuacuguuuauacaauaguacuucuuuauucauauuuagagucucauuacuauauaaagggugacuuaaauaaguuaaaaauuaggauaaaacuagagacaugguuauaggagauggcucagcagcuuaggagagcuuacugcucuugcaguuccuggcauccacuucagggagcucacucacaacugccuucaucuccagagagaucugacacaucaggccucugugugcagcuagcauuuacaugaaccuacccaugugcaaaaugcaugcagacagguaaucuaaaauaauaagaauaaaucuaaaaauaaaaauguauuuugaagucaucccuagaauuuuaaguauuuucuaguuuguuaauuugaauguagaacuaggcuguggauuuggcuauaguuuagguugucuguacuuuuaacauaggguaaagccaaguaaauggaguugcagaauuuguaucaguaaaucauaaauuagccaaaacaguuuaaaccagguacccacaaucaccaguagugacuugaugcuugcacaugaggaaauugaaaugauaaaucagccacauaauuuugacaggaauuguggcacugacauuuguaauucaauaugucuuuguuuugguaggaagaaagaacauacuuuacuaauguuaguugguguuaguaaauauguugaauuauuugaccaucauaauaaugguacaugaggaugugcguuuuauucagugaauaugucuaacagcaaguuugcuugcaaaaauuuauauuuauucauuaauaaaacuuggaaacauaauuguauauuagagugaagauagcuuuuauuuaaugaguuauaauuuaugguuguaaugauuuauaauuagaaaauauuaaauuuuauauauacauauauauuagacugugaccaaguaagcuaaggauuuaaaaaauuuagugggggggguuaaauuguuucauguggcagggguugaguuucgguagaaguugcuuuuguuuuuuuucugggaauugaauucuuuuaguggcuagcuagcuagauggcuucuagaaccagccagugccugcuggagaacuaauggaagggcuuucucuccagccaugaagaaaggacugcuuuauuuauguaaauuguucuuacuggcgccagcuagcuggaacugcagucugccugugcaguggcagcagauaacacguguccuggacuuccucuuuggaaugugugggcugacagugaaggguugaagccuuagugucccaguaaugagacuccagcacuggcagugccguggaugacgagagcaacuguguguuuuaagcuuuaaguucggcucuuagagacugacaccauuaguaauaggugggaggcacuuaacuucgaacaguugcugcagaccccauaguugccuggauagagaguggcacagagaauccagauucuaggcaucuucacugcaaacgguccuuuugaagauaagagcucuugugccccgugagcaucacugauacauugaauaacagcuuuuuggcuucgugguuaaugggauauuaaugggauguuugcuacgcaaacuacucaacaaaugugaaacaacaaagggaaucacaacacuuagccaacuauuguauuguguuccugaguuuuuaaaaaugaauaugaaucaaauaagaaacuuaaacucaagaagucucauuagauuuuaaaguuugcacugccuuaagugaaguacaaagcugcccccagggaagagauucagguccccucucugggacagcuccucaucauaggugcuccagcugucucucugccuuuggguguuuguuuguuuguuuguuuguuuuucccccagcuauaguaaugacaggauugguagauuauuaguguuaauauucaggagauuuugagagccuuauuuggauuuagucuuuuaaagagaugucauuguaaauucacauuugaagugaaaugaacuaauuaauaaaugaagugagcuucauguggauauuacuaauuuauauuacauaugaaucagccacuauagccuguuaccauguccucaguuauaucagcaccaacugguguaugaggagaaauggcauucuuaccauaacuaacucacugcaaaguuuuagugugcauuuaacagaggucagcauuuagaucagacugcuuaugcauucacauuugacugacauguuaaacaauagauguuuauacagaguugauaguaucguuuucacuccacauaauaaauuaauuuccaaauauuuaaauuuaucacaauuuuaauauguauuaauuaagaauuccauuauaucuaauacuuuauuucguaaguugaccaaugguacacaggcauuguuuuucuuguguuauauaccugaaauauuacauccuguggaaauaaaaauauauguauaauagagguuuauauaauuacuacaaagauagaaagauguauguuugugaagaaaugcacauguguuuauuaaugucauacagagauuagguauuuuaaauuguuguaauuguauuuguggaauagguguaaguaggaggagaugugaaguagugaugccaacuuagggacacagaggaaaaugcuccagcaggccacccucuuuugugucuuccucuaucuagcagguaaacacuaggcuuuuccuacagccuuaaaguguaauuaggugguguuuccaguucgcuagcuucugaaagguagcuggucacuauuacuuuaugguuaugcauguaaagagcuagcuagcuaugguagaguauugccauguuccccgaguguggacuuaacuguugucuuuugacaguuuugcucauuaauacuguuuuaacguauaagucuguaaaguacagaaacguauguuuuuuguuuguuuguuuuaauucuguuucacuaugauuacaauaauaauacaaaucagcuuugaguaauuuugagguagaugggaagaagguuauaauuuuguuaauguugcuggacaaagaugucugaaacauuugggaaauguucccauguauuuugagccauuauguuuuaggaaaauguuggacuggccaauggagugguauuuaugcauaugaaaaggagaggguuauugaacucaaacuaaguaauuuauugaaugcuguuaaaaguugagggccaagccauagcaaauuaagauggggauucuguguauagaugaaccugaaaggaaauaugcaaggcaaaggugaaaguguccaaucuuugagacgagggaaucugggaguggcuccgaccuguaaugucagcacacuagaggcuaaggcaggauccccacuaacuucaguccagcccggacuagagaaugaguuaguucauggcagccugggccgucggugagacucugaaggauaaacagccaaacuauguaggcaaaguauguaguucuguuuccuguacagcaauacgaucacuuagaaccauagaaccauagacucuuggaaauggcuuaggcagauuggaguaguuggagcgccuguaugggcguuguugcuuagguuccucacagacagggaauccucugguccugcagcugccuuuucauggccaacgggguuagaagccgaggcagcugcuccgguuuuagucuguuacugucaggcauggggcagacagauuggugcuuuauacaaaguuagcuguccucauagcucuucaauuccaucugucccaugucuguguuccugaagucaguaagauaccguguguuuccuaggcuaaauauucuccauuugccacaacucuuccucuuacaacauguuguucagggcguucuucagggugggcauucucauguuuagguuuuagguauuauaagacugucucuaauguuuagucaaccugcuacccugaagcgcuaggaacuuuauauuucuugacauuaucuuucuguucuguggcuuaacuuuguuuugguagccauuuugugcuguugaagguuuuaaguuugguuguacauuuauuuguugagagaguguaugucaugaugccuguguagaggucagaggacaacuuuuaaaagucauaucccacacccccccccccacacacacccccccccccccccccccgguuuuguggauuaaacucaggucaucagauuaugaaagccuuuaccugcugagacaucuuaccagcccagaucuugaguuuauaguaaauuaaaagccuucaguucuuucuggugcuccauugaugaucuauaauuuaccugaauacuugagacaaguagauuuucuuaaaugugugucuuucacauuucuguuaguguguucugcuuucucugcacgcugcuugcuccauuucccuuuaucuucucaugguuugacagcgguuagccuggaacucagauaccugccugccucuucuucugugcuaggaucccugcaccuccacugaugugggcucucaguucucuuaugacuagcuuugcagaauuacuuaggauauauuguuagugcuuugcugguagguuuuguuuuuuuacaaauucccucuuuauucugaguuuuguucuuuguuuuaauagauaaucuuccucuuauccugccgguauauaugguuuuauuugugugguuuuuuuuuuuguuguuguuguuacugaauuuauaaaauauuuauuaccacaugugagcucacuauugauauuuauugguauauuuauaagaauuuuacacuugacuauauauaugauucuauauauuucccuaucauucuguguuguuaauagauuuuuuuuuuauuucaucuauagauuuuaggaagaaaugugugcauuuugggcauagaaauuucuuuucagaaauuucuucacaccuuaaaaaauuauaucaguuuacauguuuaaaacugucuaauguucuuuaguuuggauguuccauuauuuuuggaaaguauuuccuuagugauuuguuguuguuguuugcuguuuauaguguagcuguguacgcuguuccgauccucuuuuaaacagucugaaauaaccugagauguaaaggucaggccccuggguggggcuaacgccugcuggcucucacccgugcuucugauuaauuauucugacacugagcgacaugacgucuguacacuaauguuagugagaaaacauuuauuguugacauuuuauuuuucugaaucguuuguggcuauuucuguuuuuccaugguccucaggguuuguguugaauuuccauucugugccauuggguuucucuaugaccguauagagccuucuugauauucugcuuaugucuacucucacuucuuucuaaaguugucucauuguuuauuucauuaugaacaauucuacugcacucuaaauuuuaaacaagaauuuacuuuuucauaagcuuuuuuauuugaugagaaaacauuuuugguuuuuaaaaauauucccuuuuuauaaacuauucuuuuguuuuacauauuaaucuuaacacuuuuguuauaguacaaaaauuacauaggugaaauuuuagccagaauuuucuuuugacagauuuugccuaggaaaaguaaugcauuuuuuugcauuaagucuuaugucuucuuacauaguuccaauauuucacauaaauuaaaaauucauauaaauguuuuuagauagguuuuuuuuuccuugcuauacggaauggaggguuuucuuacucuagucagguauuugagaucuuuggucaggguuuuuaguauugaacauagcaccacacuggcuuaaguaugaagauuuuuugauugacaugaucuuuguuuaaggacuagaucuugacguugcaaaguuuuauuuuuaucacuguuaauuuguauaaaugaaugaauuuugaaacacucauugccauccgaguuuuauucagaaaggacaguuguaauuguuuuggguucuuaguacauuuucuaaauuuaaauuauuacaguuuuaagauagaaaaauaguuugguuuagugugcacacauuauccuuuagcagugugucaagcauauaggaauaaauuucagggaaaucuaguugguuuuuuccaguccuuaaaggucugaugucauggaaguccugcgcaugcucucgcccguuuccucccucacccaggcuacauugucugcuuauuagaagaggggcuucaggauugcaaaccuccugacgauugucaaguuuuggaaaucaggugcuagcauaaauaauaugcuuggcauauuauaguuuuuacugucuaguuuuggauuuuuuuuucuuuucccuuucucaguuccuccucauugucccgccucccuuuccucuucucuuucugucucuuucuguucucaucccuuuucuccuccucaucuccuugucugcuucuuugaauucuggaggcucuaggcucaguuaaauucucuaauguggcagacagccagcucuccaauaggcccaaacugagcaugcugcuguugccuagcaacuacuugggaagucuuugucuaugacugaauuauaaauaggguuaugagcaaaagugcaauugaaaaugggauuggaaagaaaggcauacucucuuuuuuuuuuucucauucgaauuugaagaauuaaagauuuuuuuaauguacucuuuugaaaucuggcuuauaaaaauugagcuaaucagaaagaaaauaaaggcuuuauaaguuuaugucuguaguuaaacauuuaaaucuuuuaaaauuuuauuuuuauauuugugugugugcgcgcccgcauacacacacacacacacacacacacacacauacacagacacacacacacaccccugcauaugcucgugcacaugguguacacuuaugcucgugagugacuuuggccccuagaggaggacuuuggauccuaugaagcuggaguuaauagcaguugugagucaacagauauaauugcuagaaaccaaacuuggauccuuugcaagaaccaccaggccaauucccuaaagucuauucuuuuaaaugauuaaaaauaucuguguuguaacuguuuauuagugcguggguauagauuaggccauuggaaccucuggagcuguaaucacaaauugcugggaguuuccugauugugggugcuggggaaugcuugguuuucucaaaguaaaacugaccaaauguaagaugugaaaaauaaguuuaacuaguacugcaguagaagaaaauagcaauucuaaggcuuaugaauaguuucaguaaugaucuagauuaaugaucuagauuuaucaaagaaacucucccaucacuggugccuucugacacauuugaucacaugugaggacuagaccucauuaauuguagcuuauugcuuucuugugugaugguuauaauaguuuacuugcucaugauuuaagauuuuauuuuaauccuuucuauuaaaauaaauauagcuagguucuggauaugcaacaaauaagaauagaacguuaagaagaaguaaucuuuauuuacuuuuuagguaaacuguuuaaaauaaguaauuuuaugcuagaugaaacuccauuuuaauauuuagccauuguguuauagaagguagauuuaacguuuaucaucuguuuccuggagcuuuuucuauuuauuuaagugagucuuuguuugauccccaucaccacaagaacaaaaccagaaacacuuaaaagaaaaccacauaaggcaauugcuuguuuuaauaggagcggacucugccacagucugagauuucagcagcuacagcuugcguugaagugaaaugcaaguguuaccuugcauuuuuauuuuauuuuuauuuuuugccuuagcuugccucuucuuuguuccugucuuaaacuuuccuucauuauccauguguccuuccaccuccauaccuaggauucuacccuagggcgacacacaugcuuggugagcccucuucauuuugagccagaucucuugccuuuauauucuucuuugauaguuauuauuagauugcagauuaucaccuucagaaauaaacauuauuucuggagcaaauauguaauuuacagagaaaaagucauacauacgcuaaaaaccacuaggucgcaaguucagagugaagaaaugugucucacaucuugacagcucaagauuuuuuuuuuaauuucauuuuuacuuuuuuuuuuuguuuuguuuuuugagacaggauuucucuucaguugcgccaggcuggcaacugaagaaauuuuaaacauguggacuuuaacaucuccauuguacuaggaaccaauugaaacaucaaaaauggaauuuuguugggauuauuuauguucaaauauauuuuguuugacaauuuuuuuccucauugauacuaauuaacuuuugauaaaauaauuuaugucuugugugaauaggagguuuauguuuuaaaacacaaauauggaaauccuuaccuuauuuagaggucugcuuuauugaguugugcuuuuaguacacaaccaauaagcuuuugaaaauuaauaaaugacauucucaaauaauugcacaaaaauagguagacaaaugcuguguuauucagauauuuggauuuuucuuuuucuugaaagccugggauuuguuagaauugggauucaagugccucauuguucuccuggaagagggaaaucgcggaggugcgugugcaguggaggcgcgugugcaguggaugugcgugcuuguaugggcacaggagaacagacaauggaaugcuacuuggcacugauccauuuauuuaauggaacaugcuuuuuuuuuuuuuuuuguaauuggaaucuaauaaaagguaucagcuauguaagguguuauaaaaugcaagagucuauuucucuccaagaaaaugagauuuuuuagccaggaaauuuugcuguuagguucacaucuguucuaggaauuaggcuugcauguuguuucuauuuuuaggcuguugcuagguggauuuaaauuuucuccucuuaugguugcccaaguucuaacuuccugauugguuacaugacccugcuuucauuagccaaccacagugacuaugcaaauuguauuucaguuucuguuucugucaaagagcugcuaagauggcugcaaggggcuccuuugggguauguuuaucauuucaaggagggcuuucaucagcguguaguguagugauaaguagagauuucucuuaaagggauguuuuaauuuugaaauaaaaacacacuguccaugcaaacuuucaugaggcugaaaccgccucuugucagcugugauuuuaagguguucuacuuugauacuuagacacuguguacauuuuauuacuuacauguaaaugugugagcaugcuagcuuagaaacuguuagaauguucuagauuacuaccuuugcuuucaaaaagaacagauuuuuuuauuuaagaaauuauuuguaggugucaguuacauacaugcagggcauagucucuagucgguauuuauuacauagucugaacuauauagugugugcucauuauuauaacauuaggauacuccaauuuucauuauauugugaauggcuuuagaagcauaucauggcauugguauauuuaagauguuuucugauaugaaaguuuugccuuccuaaaauaugccuguacuaaaaaucuuauacuggagauauaacgagauaugcuaaagugcuuuguuaauguacauguagguauuaaaaccaaauaauguuuauuuuuaaaugaugccuuaaaaugguggcagaaauaggaaaugguagcaauacuggugaagaauugauaagaauacugguaaaauauuguaaagccaccaguccaggacgugcgauaaugcaucuccugcacccugccagguuugguuacauguuaggcuucgauuagacucagaagacauuuguuucauuucagauuuucugguuguccugggaaaagauaguuaauggaauuuuccaugaguaagaagacuguuagauucucggcgcugcaagcuuugauauuuuauaguguguuuaaugaacaguccuauugucuuuugagauaaacauguuauugaaucuuguccuauuuagaauaaggaagaagaguaagaggcuuuuuuggguaugcagagacaaauguuaguaguauuuacauguacuaccuuuauuaaaagcagaaaucacaccaaauacuuaagcaccuggaaaauugaacuuccuaaaauaaaguaugaacaacacucaguuucuuggaauuuuuuuuucuucuaaauuuauuguguauauaugauuuugccggcauauacauacaacacacacacacacacacacacacacacacacacacacacacacacacacacacacacacacacacacacacacugugcaucccauguaugcuuggggcccagggaagccaaauuuugagccaucucagugcugggugcugggaauugaaccugguccuccugaagagcaaccaguguucuucuuaagcacuuagccaucucuccagcccuggugguaggccauuuuguuuuguuuuauuuuuaauguuaaaaauaugaccgaaugaaagaggucagaguaaagucacagaaaaagaaugcacuuuaaacaaaacaaggcaucuugguuuuugagguacauuuuuuuuaaaguuuugauuuaauacauauuaaccuggauaaggccaaaguaaugaauuauuaucagacuaauggauaguaaacagugagaaagguuguuaguauuuauuguguaacugauuauuucuuauggcccuucaugaauaaauacugccaauucccaagcaaugcaaaccuuagagcuaucaacugagaaaugaggguuuguuuguuuuuaguuuauauuacuuauccacccacccauccauccacccacccuccauccaccuaccuauccauccauccauuuauuuauuuggugugugauuguguguucaugugugucuugggagucagaggacaguuugugggagucuucuuuuccauucuuccaaauucaagucaugaagaucaugaugaugaaggucaggccaggucagcaugacgacaaacagauucuuagcaauagaaaucguggguaaugaguaaaaugauguuuagggguugauuauuaguagucacguuuguugauuugauuuuguuaagccaucuaaggaaagaauuugaauaaaacauuuucccggccuagagagauggcucagugguuaagaacacugaguucaguucccagcagccuuaacucaggauccaaggcaucugaugcccucucuggcugcugauggcacacgcacacaugugacagacauuuacauaaaugaaaacagaaacaaauucucaaaaccugggauuuucagcaucugauuagucagaaaaguauuggugauguuucucccagcguggacauaacugaaguguuugucaaagaaagaucugggcugcauuuacuuaacaugauuuugcuuuuguucaaaauuuuuugugaguuguauuuuuauguauucuuuauuaaagcuacuaacuuaaauuagcuuggugguuguguguguguguuuugaaucaaugaucuugguauuuauuugggcuauuuuuagaaacuacagacccuaguuuaaauauaaacaauaaaaugggggagagacuucucaaaaaucaacagcacuguagauggcuuuuaucgacacaaagcauuugaguuguggugauguauaagagguuuccauuuucauuguuuccuuugacuuccaccgugccuguaguucuuagagcacuugcccucaucugcuuccuuuguugcuggguaagguuugugauacuuuucucugauuggcuuuaggcagcuaaggcuuugagccaaucagagagugaauuucaguucccucgcaggacugaaggacgcgcugaagcagcuguugauuuauuucccuuauggggcgauuauauaaacuaaaauuauggcugcagcaagcucccucuuggguauguuugaaaaauugcaagguucaccuguaaugaagggggaaaaugaugaguuuaaaaacguguugacuaggaaaagcuaauaaagauagugaauuuggggcaaauaaauucugaucauagauuuuuuuuuguaguauuaaaaaaaacccuguaaaauuaacuuacaauccauaccuuuuauugcuucaaaagcagagcuuguguugucuuuuuaaaaaucaacugugaaaggcaauuaauugugcuuguuguaguaaauacauuguuaccacuuagagcaaccaaaaccggacauuuugauuuuguucugugauuaagcugagucagguccaugcaguagacaacacagcgcuuugucauccuacccaugguccagaagccuguugaauuuuccguuuggaaaucuguauuaguaacgguaggugaaaugguuugagagaucaucuuaauuauugggacuuaauauuuuggugggauauauauauauauauguauauauauaaacaaauagaagagcuauuaaccuuguaaaagaaaauauacuuugaauuuuauagguucuaacucauuauguaggagugguauuuuuauguauugucccuguuuagcugauuccucagauaaguuauauuuuagaaacauuuaugaacauugauuaaauccagauaaaguagcauaaaagaucuguaaaucuuagccacuugucuaugugugcuguauauguaaaccauaucauggauuuaagacagggaucuguguucuagguuauuuguuucagacaaagaaccacauugcaccauuucagcucugggcuuugucaacuagguuucucugaccuuauugucugucuccuguugcugggcaggaaauagaaugcuggcuacugauuggcugaguuucuauguagcucuugaacagccacuuaaauucuugaguuuuuugagcagggagauuauaagcuaagacaaaacaguuucccuuuguuucauggcugucugugaucucuugcuagaaaaugaaagaagugggugcggggagggggcucaggaaaaguucuccuuugaagaagaggcucacugcucuucccuuaaaaagaauuuaucaaaaaauugaaaaaaauuacaaggcauagagacaucucagguaacacacuuuucucugguuauuaauguauaaauuucuauagaaaaauguugauaauauuucaccaaguucuuggaucugaauauguaaaguaaggacuuaaauacuucguuuuuaaacuccuuuuagauuaaaaaaguacuuucaggagaaauuuaauucaucacgucaugugauguacuucuagguacggcagacauguucugcuguaaaauagaaaugccuuuccuguaaacugaggugcgguccuguggaagcgcuuugacccauguugcugcuguaccgaggagcagagauucuccagaauaauguagguggauguggaugguaucugaaguccagagggcgaugcuaaagugagcuguaggauugcuuaccuucugcuaaugccgccuuggagacuuguuugcaggguacacgcccuucccuaauguaaauuuuuccuaaugagcuuugcuuaugcaaaauagauuucucaaagcagacugcugauugguuugcacagauacgccugaacuaauuugaacuuguucaugcuacuuccuuauugcuuugucuguuuaguuauacauagaacccacgagaaucugcugaauggcuguagugugcccccugguggggauggaaaguauggaaggucucaggcaggacuuuaggugauuagugaauucaguggcuuuguugcaaaaaaccaacuugacuuggguuauauuuauuuguauuaaguguuauuugguagagagaauuuaguaauaguguuuguuuacacuggcuuacuauauuuucaaauaucucucacacaaacacacacaauauguuauuuaagagaaaauuugucucagagucugaaaguuauacuuaaaaacuccacggaauguacauagaggcuaaacauagaaucauucuagaugaccuguuugugguugcagucucacacuguagcacaguuuggacaggaacugacgauaacuuaggcuggcucagacuuguaaugauccuccugccucagccucccaagugccaggauuaccaguguacuccacuuugcuuggcuucaauccuuaauauuaauuaauuaaucaucaauuagucacaucucagauaauucucagcaaagcugguguugguauaugcaguuccucuuaagauacuuuaagauacaguuucuuuuaaacacuuuaaaaacuugaaaugcuaggcaagcagccucaucccggagaugugggacucaaacuuacaacucccagccaaguucauugauuauuugcauugugaaaaguuaaguaugguuuuuuuguuuuuguucauuuguuuguuuuuguuguuuugagacaggguuucucuguauaguucuggaacucagucuguggaccacgcugaccucgaacucagagaugaugccucucuccuccacaccuaagcuuuggaauuaacggcaugcaccacuacacuggcuuauguuuuaaaaauguuuaauuuuaauguaaauaauuauaacucuuguuuaggcauagaauaucugaaaauggauauuucaaaguuuaaaggaauaguacuucaguauuugaacauauuuaaauggcagucacacuacauuuaauauguuuauuauagucagacucaugagugcuaagcuugugcugccuggcuauaguucacagcaugcauuggaagccccuggguuuuaucuccugcccacaguuuaugcagaaaaauguccagguaacaggacuugcagguggaggagaaaagaugcucgccgaguguaaauccuaggcuuaaacaggaccaguggggguuuguuucaagguuucuguaaauagaguugaaagaucauuuuucuaagaacuguacuuuaaauaaaaagaagacacuaagaacuguuuaaauuauugacuuaaauucagaaggugagugcaaaguguaacauaaucgggacauucguugacaauguaccgugucuuuagagcuguacuggucucugacaaauaggucaagcuuuguauuuauugaacaacauucacuauuaacaacuuagggugcuuauuuauugcagguaaguuauauuaguaagggugcuaaacgauacaguguagaguagauuguuuuguggaauuuaaaaguaaagccucacucuugauugggugauaccaggaacuaaguguaucaauaaaagagagaaaggggugggggagagagcaucuaugugcauacacaugcacauuuacauaugcuuuugucugccuauaguuaaucucuugcuuuggugguucugggcccauacccaggaccuuccuuacgcaugccaggcagaacugcucugcagugagcagguagucuuagcucugucuucuuacuugcucuuuuguacuagccuuuugauaacauaaaauuggugauaugggcugccuuuguuucucuuguuauuuuaauaucauuucacaauuaaauguagcaucuuccucuugaaaaccuuuagcacucuugcuuuuuuagagucuuaguuuuaauuauaagguaguacugaauaugaucuaauggauauucugucuguucagguggguccucgcuuacucuugcuauuguguuuaugugguaaaucacacgcacacgcacacacacacauacacacgagcacaggcacgggcauauuguuuuaauuuuacagacuagaaguugaaagugaugcuguagucaaggcauaguuccuuggauggcucugaggaaggauuuguccagacacaucuccgagcugcuucgaguuguuuggccugugaugguauagcucuuguuucacaugguuuuacucugugcaugcugaagucucagagacauuaaucaguuuguacuaaggcccauccuauuuauccucuucucaucuacaauuuaagcaguaagacuacaguaccauauucucacucauuuuaaggaaaaauugucaaucaggcucuuuuguggcccuguauagaccaggaugcuucaagacuuguuaaugaucagccuugcuuggcuuuuggauaggaauuuuugauaaugaucauugguuggguuuuggaugugaauuuuugauaaugaucuuuaccuagugauuaguauuaucucuugaagaaauauucugcuuagucauuuauagauagaagaagagaaaacuauggaaauuugaaaaugcuuuagcagaagacaagcugugagcuggaaauguagcuuggcaguuaagaaagaauauuggcugcucucacagagaagccgggguuugguucccacccacaugguggcucagaacugucuguaauacuaguucuauaggauucaccaccguuuccucaccucuucgcaugcauggacucgacauagcuauuugguuacaugcacauacaauaaacauaagcaccuuggcaaacauuagauucauuuguguguauauauuaggaaaggugaaauuuaacggagaaccgaggacuaagcuugaaccacaggggaaggacgaagugcagugcuuagucucaguugucaggugacaagaucuagacuucuugagaggugggugggccucugggauuugccuauggauggguuuaucuugauuagguuaauuauguaaaagacccacccacugugaauggcccuguucccugggcuggaugugggaaaaaguaagagugugcgggaguuugucauggcucugacugugucugugucuguguguguguguguguuugugugugugugugugugugugugugagagagagagagagagagagagagagagagagagagaggcaugugaccagccacuucaaccccugcucauucaaccuccccaacauaaugggccguauugaacuguguuucaaaacaaauugcucuccccaagcuguuuuuggucaagaguauuuuaucacauuaucugaaaaaguaacuuaccagaugcaaauuaaccucauucaaaaagucaaagccuugauauuaggggagaaagcagcaacugcuggcagaugcacagcaggagcuugagcagugagaagaguacauucuuugacaaacagacgugaugggacucgagcaagauugaccaaaaggaagaacauauucaauaguuuguagcuaucaccacagugaauguuagaacauuuucauuauuucaauccuguacucuaaagcauuuauuucuugccuucuccaaaccugcaaagggagcuggagagccgguccagugauugguuaagugcugcucuuuagacagugacucgguuuggucucuagcaccuauuguuuuccuggacuuuucacgccccugaagcggcuccuuuuuaacucuucauuugcuuccauugauguucugguguguguuguuugucacuucuguaguaugugaguaguaaauaugagaacuccgaccgaguaauuauuaagguuuugucaguguuuuaaauuuauaugaucuaaauuuuacccuuuuuaauuuucauuaagccuguaguuaaaugacucuuaucucaguuuauuaaaauccuuuucuuuuuauuuaaagauucagaauggauaguguagaagaaccucagaaaaaagucuucaaggcucggaaaacaaugagagcgagcgaucgccagcagcucgaugcugugcacagagucaagggggagcugcugagagccgacgggaagcugcugaacgggagccaugagaauggagacuuggaucccacuucacccuuggaaaacacagauuguauucaagaucgagaagaagugaaugguauugaugggauuuguuuucagucagaagaaaguacaacggaauggaaagagaccccuuguaugcccaauguugcuguaaaaaacaaacaagaagauuugaauagugaagcuuugucccccaguauaacuugugaucuuucuucuagaguaaccacugaaccagguucugguaguccagccucugauaacccaggcugugguaccccagucucugauaacccagccuccgauaacccagccucugacaacccagccucugacaacccagacucuggugaucuggcugcaggagagcuggccacuacaguacaggcuacuggugacucugccugugaggagccucccuccagugaucccucuuccagugaucccacuuccagugagcccucuuccagugagcccaccuguagugagcccaucucuggagauccuguuucugaagaagccgccucucaugaucuugucucuggugauuccacuuguagcgagccaguuucuggugagccggugucucaugaagcagcuucgagugagccagcuacaagugagccagcuucagaugaaccggucgcaagggucguggcggccugcgaacuggcuccuggggagucagccuuggaugauugugcccccuccggugauucacagucugaugagccaccuucuagugaggacucccuuccuaggucugucugcagcggacuggcuucuggugagcugacuccuggggagcucucuguggaaccagccaccgacacuguuaaaccaagcucaucggcaguuugugaagcagguccugacccugacaagacagagccgaguagcaauaacagugaugauuguccaggcaagagugaagacgacgaacacuuagaccaaauucaaaguaaagacuccugugaugagggaaauaaagugaacaguaaugucgucgagaaggaagaaccucucgaaacacacagugcaauuauuuguucugaucuaccuccagaaaacacaacgaagauagcggaggaucccaucgcugagccugcucucgaggaagaggccaucuccagcagcauggaaguugaccaaagcgaaaaggaugagcauaaaaguccugcagaaccuguagccgcugucagugaggaccccgccgaggaggacaaggaggauacugucguagacaacacggacuccauggaaacagaugagaucauuccgauuuuggaaaaacucgcacccaccgaggaugaacucaguugcuuuucaaaagcuucucuccuuccagucgaaacaagucaagauuuggaggauaaaauggagggcucuuucggcucacccucgaaacaagaaaguagugagaauuugccaaaagaagccuuuuuaguccuuucugaugaagaggaucuuucguguggaaaagaugaguccgaagcuguagcgcagaguaagaugagcaccccagguuagcugaucccggacuuuuacuugcuuuaauagacuauugaguacaacaugcucaaugaugucaggacuagugauccaugaggaagauuuuauagaaugcagcuagguggguugacacaaggaagugcagaagugggggaccaaggaguugaaaguuaacuuuggcuccauggguagcugggggcuacaugagaccuagucucaacccauuaacaaaacaaauagaaaaaaacuuacaaaaucagaagaacuaaugugucgucguccaucuggggacacgcuguugcauagugcuaaaugauaacuuucuaaaugaugaaaaccguaguuuaaggagacuaagcuaggguuuccuuuucuggggaaguucaaacaucaguggauguacguuuauccuaacaucaguaugcuucauccuacacagucuuuacugcuguuugaucuuuuucuucauuuucagaucaagcccuccagccgcauguacagagcuagcacuuuguuucuucuccuguuaaaagucuagcuguucucaaaccucaccuagagcauuaguccucagccuuccuagugcugcggcccuuaggacacuuacucaggaaguggugacucccaaucauaaaguuauuguugcuacuucauaacuggaauuuugcugcuguuuuucauuguaauguaaauauuuuauaugcagauggucuuagcugaccccaggaaagggucauuugaccccagagggugcagccuacaggcuaagaaccacgaaugggaacgauagcauuugcacuguaguacugguguaaagcuuggaaacuguggggaggagggggauuuuccugaggccauauaguuauuguuauuucuauaggacaacaguaaguaguacugugucagacuuguacucuuuggccauuaaaaggaaaauaacuuauuaaauguaaugcuaucaggaagauauuaaaugcuuuauuugaguucucaaagguuuuggcguuaccagaacgauaagaucuagucaacuaucuuuagugcucuuccagucuagcuuugacagacuggagcgaagcuuauggcaguuagaagucugaaaacacagcaccuuaaugagaaggcugaucuugagacgaacagaggcaucauagcaaccuugccuacguagaaagauggagccgauaagaacugaugggcuaauaggcuuuguauuggaaaugaugcacaaguaguuucuguacaagggcauuugguuauuauuuuauguucgagagauggcucaguccugaauauuaauuugcuacucuugaagaggacugaaguuggguucccagcacccacauggacucucauaaccacccauaacucuagcucuggaaagccagcacucuugucugguucugccguaccuaccuaccuacacacacacacacacacacacacacacacacacacacacacacacacacacacacaccacccacauaaacacuaaaucuucucaaaaggcaguuugcacaaucccuagagacugagcaaaaaguuaaagaaauaugggccugccgggcagugguggcgcacgccuuuaaucccagcacuugggaggcagaggcaggcagauuucugaguuccaggacagccaggacuauacagagaaacccugucuugaaaaacaaacaaacaaaaaaaaacaaaagaaaacaaaacaaaaaaaaaaagggcccuacuuccucauaagauucuguuaacauuuuuugguaucaagaguucuuucuaugauaaaauguaaaacucuagcauacauucuaauccucguaauuuauucuaaaacucaguguauguucuuaugaaucuaguaggcagaugugaaaaaugguaauucagcauaggagaguucugaguuguuuaggguuguuagguggucagcguauaugugagggucgcgauaaugggucacuucuccuuccaccacguacggcuugggaacugaugucaggcuuguuggcaagugucuuuugguuuauuuuaauaacagaaaguaaagaaaucuuuaagauuuauaauaguugcuaccgaugauggaaaguuuauaaguaaaauuguuggcugugaaaucuaguauuuauuauuuccguuuauuaggcauaaacagucugaaugugacuucgcauuuugugcucccucccagagucucuauaguucuuacuuugugacuucagcuuuguaaaacauuugcuuuguagcccgauuggugaccaaaaaugugaauuaaugagcuguuccugauuuccauagaaauaaggcucccuucuccaucuuuguccugacagagggagaaaagagugagaaggacggcaaagcugaggaagaggagcgaguuccagccgaggagcagccaccugugagaaguacguacgguaugcaccagcuccuaccuucgugcgaccccagccaugggcuuccuccugcuucucuccacuugugaauuuaagccccagucccugaugcuguucauuaguagcucagggaucuuugaauguauuauuucaaauguuaaugugcuuacuguauuguuuaugguaaucauucugcagugaguacuuagaccuacacucugaggcaccagugcccuaagcugugcugaggacaggaggguuugccuugcuguaagugaacugcaguacauuucugucuacagccgacgcauagggaaggaaggaaugcuagaaaacugaugccauagacuuagaaaaagcuagacgucaagguuugauuuugguuuauuauaucuacauuaaaaaguuguaaaguagaacucuaugaaagaaaugucuggguggaugugaguaugguugcgcugcucccugccuuguauccugaacguuauuuuacaaaucaaaggaaguagcuucuacuuauggagaggcuuggccauagaagguauggaauaugcugaaaagccaguacaaaauuucaaaugacuucaugaauguuaacauuugaaaaaaauguuuuaaguaagaucuucgaguguguguucugugcuaaauguacuuuugugacacuaauuuugcuauguguaugugucuuaacucuacuuggcuauguuaacuaccucuuggaguacugucacugcucuaaagguugaaugacuugggaauggcgcagucagaaugaaugacugucuuucagcaguuuucgcagaaggaggaggauuaaauaauugagaaugugcauagcuaguagaucucuggggcauagugauggcgguuacauguuaaaguauucccaugugcuguggaauucaguauagcaaagcuauagacagcucucugucuugauguuaaaauguuucaaggaaagaaugcugucuucaguguacauugcuaagcagugggaaguucuguuugucaugcugaaauccuuuauuccaucuuuaaagcugagcguuguaugccugcugaguucuugugaucuugggagugacuaggaugaccgacagaguguggucuuggcugacuguagugugaagccuauaacuuacacagcagacucagcagugcugcuugcuuuguuguuuuucucagaugaguuuucuagacgaaaacguucuaagucagaagacauggacaguguagaguccaaacgccggcgauauauggaugaagaauacgaggcugaguuucaaguaaagaucacagcuaaaggugacaucaaccagaagcuucaaaagguagcacacauuucaugucaaaugugucaagaaugucacaagcugcacgcuuggagauuuucagcaugauccuauuauucuguguuuaccuugacauaaucuagucagcuugaagacagugacaagcuaugaaaucuaugauaaauuuuauuccucuauuuggcuacaauaguuuuauuuuaaaacaugguaguaaauauuaaaauagaaggaagcuaugacauuucucuauuauuauuaaaaaauuaagguuuuugaacauuucuuuuucuauaugaacacuauuauacaaugcagaagaaacaaacuuuauuuaguagacuuuaauuucuauaauauuaaguugguacaaucuaaaacccuuuuucauguuaguuuaaggcaugauagagacaagacuucggauggauuaggaaaagugaauguucagaguaaagauuuuuuugaaacuucccuguauaugcuaugguagcauuacaauauauguugaaaauaauauuguuauauguacuucuggaagugugagaaagcagagaucucucagagggaaauuaguaugccagcacgcggucccaguucucauuggaugcacucauacaagccaggcgugguggugcuucuagcuagggcacuaggaggggaagggaggcgacuucggggucccagaggccaacuaggagagccaguugguauacuucaguaugcgauaugguuucaaaacugaagaaucauggaagauaccaggaauccauggguaaauucaugagcacacauaccugcauguacaucacacauaugcacauuguguucagauaccuuuuguagggagacaaucugaaauuucuuccacggagauacuaguacaagaacaaauauuuaugcuuucuuuaaaaagaaaaauuaagaaacaaugcaauaaaaaugcugccccuaccuagugucuuucucuugugcauguugagguaguaaugagagaauugugaaggagggaggaaugccaugggcugacaucaucucgagaacagaguucacaggggugaaggacgacugccggcucuggcucauuaugggccagauggaguaauaaugcaacuuugaauaagcauuuagaaauauuuuccaauucugauaccgcaguggcauuuuuaauguaucucacacaguuuccaaucuuuaauagguuagaagaaucuuguucuuuuuaacaaauuuuguuuuuaugguuucagcauaaggaagauaagaaaaugcuagagcuucaaaucauuucagaacucugcucucugcagaugucauucuuagcauguacuuuccuuuugggguuguagagaaucuuagcagguagcagugaguuuuggauucuuuaaauuaguuuaucauguuuuauucauugaguuuauauuguuauuagcccuuaauauuuacuguuucuguuuuguuugcugaauugccuuuuuacaucuauggauuuuuuuacuuuuuuaggucauacagugguugcuacaagaaaaacugugugcccuacagugugcuguguuugauaagacguuggcagaauuaaaaacucgaguggagaagauagagugcaacaagaggcauaaggcagugcucaccgagcugcaggucugucccauggacccaaucugcagccuuguaccuggguucauuaucauuuaucuuuugaucgugugcuaccacuuuuauaucuuugagguugagcagaaaguacauuuacauucuauguaagaagaaaaaguguuuguuauuaguuuuuccuggggcugcugugaaaacagagccauaccuagcuggaugcuuuacccaaugaagugauuaucucacaguuggaggugagauggaggcccaggaugaagguaucagcagaauagcuuucucuggaggucuaguauugugaggaaggguacaugucauaucuucucuucucaugguuguugacagcuuuguggagacauccuuuccauucccagcauuaccuguagaagcuauucucuuugugugcauguuguauccaaauuucucucuauuuugaagguaccaguuacauucauuagauuagaaggggaaaucccaguccagcaugauuucauauuaauuacuuuugcagugacccugaguuuguagacuuuaugauaaugagcuuuaguuaguauaguuuaauccauagcagagacuccgaaauuaccuaaauuaguacuuaaguuuuucuugggggugaaggugggggcauuauuuucgcaucaguauacuuucucuguggauauugugccuuaaugauaguuuauuguguuggagagaugacuuggugguuaagagcuuuggcugcucuuucagaggacuuagguccaguucucagcacucacacggucacaacugucugcaacucaaguuccagaggauccaauacuuuuuaacugaucuccuugagcagaagacacauacaugguauacauacauacauacaugcugguggaaacauuuguacacauagaauuaaaaaauaagauguuaccuaauccauauuaaaaguaaauguguuuuucuguauauaguuaagaugaucuugaaguucuggauaccauccccccuccccgaaugcuaggauuacgagcauaucugcuuuauguggugaugggaaucaaacucaaggccuuguucauguugggcaaacacucugccagcugaaccauccccaacugcugcuuuuucacucccugcccaaguguuucuuuauucgaucauuugaguucccccucaaaaaagguuuaguauauuucccaguaauucugcagggagaacaaaaauggagaacaaaaauggauauagaaugaguacuccuuuuaucaucaucaucaucaucuuucuccucuucuuccuccuccucuucuuccuccuucuccuccucuuccucuucaucaucuuuuuuauuccaacuuuggcuuacauucuacuuuaucagauguguagguaccuaccccagcuugcuuucaguuaucauuucuuuggauuaucauuuuccauuuuuucauauuaacuauuuuuaacagugugauguguuucuugcagacaguaaucaguuggauuuuccuucccucuguuuagucugaucaaugagccugucugcaucuuuaaacuggagauuaaagaugauuuacguuuauuacugauaauuauauucuuauuccuggaaaucugucuuugugguccuugcuccucaguuaauuugaacacacuuuuuucucccucaucuuuuuuuugcugguucacuguguuaaacuuguuucauuuccuaguucuguuuucacauauuuucucauggaauucauccuuuucuaaacuuucuucuuuauauauguaggauucucuaauuuucucuaauuuugauuaaguagucaugguuugauuuaguguuuguucaucuuaaaaugucuuuuuuccccucucccuucauuagaauuuaagggauaacguuuuugaauauaauaaccuguuugauaaauaucauucuaugauucccuggccuuagcucuuaacacuguaagaaaauucuaaugaauuuucuuaagauggccuuucacuuuuguaacuaucaacauucuuuguugaguacucuugauaauuuaacuacuaugugacaugaagaauaucuuucugucugaucagaguuguaaauaccucuuauuugugaagguccauaucuuauaaaucagggaaauuuucugcuauaauaugauugaauagauuuucugugcuuuuaguuugcauuucaguuccuuguaccucauagauuuacguuugaucucuugaucagaguuccugaaaguuguagucaugguucauuauucuuuuuuuccuuuauuauuauaugaauauaagaauuucuuuacuuguuuucaauuucugguauucuuucuucugauugacaagcucuuugggugauacuuccuacugagguuauauaauugaccuuuccauuucuaguauuucuuucuuucuuucuuucuuucuuucuuucuuucuuucuuuuucuuuuuuuuuuuuuuuuuuuuuuuuuuuuuuuuuuuuuuuuuuuugguuuuuugagacaggguuucucuguuuagcccuggcuguccuggaacucacuuuguagaccaggcuggccucgaacucagaaauccaccugcuucugccucccaagugcugggauuaaaggcgugugccaccacugccuggcuauuucuaguauuucuauuauauauuauucuacagaaucucucuuuguuaaauaugaauuuguuaucuaaaugcccaauuuuuauuuacuucauuuaacuucauuuuuuuuccauugaggugcuuguucuuuuuuuuuuuuuuuuuuuuguuuuuuuguuuuuuuuuuuuuuugguuuuuugagacaggguuucucuguguagcucuggcugucuuggaacucacuguguagaccaggcuggccuugaacucagaaauccgccugccucugccucccaagugcugggauuaaaggcgugcgccaccacgcccggcugugcuuguucuuuuuaaaauuauauuuuugaauucuuugucuggcauucagucauuuuguuguuuuggauucaguuauuaagaggucauuagcuuuuggagaacucucacacuucuguguuuuuugcacuuuaauauaugcaucucuugguugauacuucugguuuuauguaggauugucuuagcugguugcuuucucuugagguuucagucucuuuuacuccucagagacgagaaagcauaccacaguaacaauugcuauuuaaaaaacaaacauauauguugaaauuuucauuauguuuauuuaguauguauauguaugcauauguguguauaugugggaguguagacaugccacggugcacguauggaaucacaaguauagcuuucuuuuuguucucugguucugccggauuaagugcagguuguugucuuggugggaagugcugagccaucuugcacaacauccuuaaauguaguaaaauaguuagaaacauucggucuuauauucagggugaaagauuuauggcccaggaaaugugugauaaacucaggaguucauuaaagcacaguucaguggaaauagagaacaguguaggaaaggacagaacgagagcagcaacgucaugaaagacagggcggacaggcuguggaagagugagagcuguagugaacaauggcagcacagaaugagugcagagccagaggaccagcagggaccagcugacuccugguuguagagggguuaggagcccucuggguguucucuaagcucauccauuggcacuucacuuuagaaggcccgggaucacugaguuguuuucucugagaauuccagacaggguagauaugaaaggguuuuugccaucuaagcucccuucaucuuucaaggggaaauuuaucaccccucaccugcccaucugaauagagucaguaaagccuuucugaaaaacauuuagaagacuuccauuagaauaugcgcuaagaauucuacuucuguguauaaacagaaaaaaauauucugauaaaacaaaccuaacaaucauagccuuaugugaauagcaaggcacuaggaaacacucaauuuauccaauuuuuaaaaaauuuguuuauaaucagcuucuaguacagugguuuucaaccugugggucacaaccccacuggugggccacauaucagauauccuucauauauuaaguauuuauaauucauauaguagcaaaauugcaguugugaagugguagugaaauauuuuuaugguugggcaucaugacaacaugaggaacuguguuaaaggguugcagcauucgggagguugagaaccacagaucuaggaggaaggugcauggcaaaagagcagucaguuacuaccguacauagauaccaaguaguuucguccaggaaucucuuaugauuuacguggauaccucuauccuauauguuuucaguaaaaacuuaagugugacuguagccauuuugaaaaauagcugucaauaaagccuuacauauuccaaauaaucugguguugagagcaaacacaccaguuguuaagggcaggcuggccuauguguguuuauaccugguaguuauugcaaggaccacaguggguuuccugugauuuuucucuguuuuccaauauuuuauaaccaucuugucuuauuuugcuccggagagccaaagccguauguuuuugguuucuccucuguguagcagacuuuaaagaaugguauaccacuugacuuuuauuuguuuauuuucuaggccaagauagccagguuaaccaaacguuuuggagcagccaaagaugaucuuaagaaaagacaagaaguaagucugucuguuuagucuucaucagugcucuguuccuguaagagacacuaugaugguggcaacucuuauaaaagaggacauguaacuggggcugcuuacagcugagaguuuccuuugucugucuguggaaagcauaacagcagguauacugacugacaggugcugagagaguucuacaucuacaccggcagacaggguuuggggacugcaaaggaggggagacagagacagacacacguaccacuccguguacucugugccuggccugagcuucugaaaccuccaagcucagugacauacuuccuccaaggucacacuccuuggugaccaaggauccuuuguggauaauucuuauuuaaacuacuacauuuagcuacuuuuuaggagauacuaauauuuccuguaucaugaaaguaaaaguugcuuuuuuccuacuuauuaguauaggugguuuuagagcuaaauguuuagacuaauuaguucuugucgauauuagugaugucagcguuaugaaucuguuugcacaugcagauuuucugaagcuguguuucugucuuuaacauuauguuuuaaaaggcugggcauauagcuugguuggugugugcuugacuagugugcaagaaacacuggaacccauccuagcauuacaugggacagggcaugaugcgacagcacccaagaggaaggaggcgggaggaucaugaguuuaaggccuuccuugacuaucgagaguuuuaugagagccuagauuucuggaaacucgguuucacaaaacagaaguucucuuuuggagauuugucuuaaucuuguuuaccucuuuguacguucuugcuagcaucuuacuuucauuuauaguuuuccuuacagucaaucgucuguugugcuguuuauagaaugcagacaaagauuagauuauucuuguugccucuaacaguuugaacauauauaauuuauuuauuuauuuauuuauuauauguaaguauacuguagcuaucuucagauacuccagaagagggcaucagaucauauuauggaugguugugagccaccaugugguugcugggauuugaacucaggaccuuuggaagagcaguuggugcucuuaaccacugagccaucucuccagccccggaacauauuuuuuuaauagaauuaaauauaagcaucagcacagccuuugucugacuuuggcuuguuguucuuucuuuuugguuauuucuuuauuauuccauuauauuuuuauuccuaauucaguauagaaguuuuaaguuuauuuucagucaaguaaauaccauuucuguguuuugauagcuccauuaucugguacauggugauugcuagcagccaucauuauucccagagcccuuucauaauugacauaguuccauaccacguccuccugaaagaccugaguuacuguucuuggugccugcaaucaccguguagugggccugcaucucacuuaggccuguggccaguauacuaauugauggcagcugccuuuguagauuggaagagaaagugccugguuuccuucccugggagaauaauggcuuuucaagagauaauccauguuccccaaacaaagccauuuuuaagguuggcuugaaaaaaagaaaccugagagcuuucgauuccacagaaaaugaagaaaaagcgucugaagcugaguggaucucaaauggaucacagcguugcugccgcuggccagaccucauucugaacuaagaaguuugugagacugaagaaugauugcuucaguagugugggccacacuugaugucuauguuuacuuuaaaacauggagugaccaagagaaugggaaaggaucuuuaccuauccuaaaucagauaggggacuaauauccaauauauauaaagaacucaagaagguggacuccagaaaaucaaauaaccccaauaaaaaauggggcucagagcugaacaaagaauucucaccugaggaauaccgaauggcagagaagugccugaaaaauguucaacauccugaaucaucagggaaaugcaaaucaaaacaacccugagauuccaccucacaccagucagaauggcuaagaucaaaaauucaggugacagcagaugcuggcgaggauguggagaaagaggaacauuccuccauuguuggugggauuuuaagcuuguacaaccacucuggaaaucagucuggcgguuccucagaaaauuagacaugguacuaccggaggaucccacaauaccccuccugggcauauauccagaagaugucccaaccagugagaaggacacaugcuccacuauguucauagcagccuuauuuauaauagccagaagcuggaaagaacccagaugucccucaucagaggaauggauacagaaaaugugguacauuuacacaauggaguacuacucaacuauuaaaaagaaugaauuuaugaaauuccuaggcaaauggauggaccuggagggcaucaucccgagugagguaacccaaucacaaaggaacucacacaauauguacucacugauaaguggauauuagcccagaaacuuaggauaccuaagauauaagauacaauuugccaaaugcaugaaacucaagaagaacgaagaccaaaguguggacacuuugccccuucuuagaauugggaacaaaacacccauggaaggaguacagagacacaguuuggagcugagacgaaaggauggaccaucuagagacugccauauccggggauccaucccguaaucagcuuccaaacgcugacaccauugcauacacuagcaagauuuugcugaaaggacccagauauagcugucucuugugagacuaugccggggccuagcaaacacagaaguggaugcucacagucagcuauuggauggaucacagggcccccaauggaggagcuagagaaaguaaccaaggaacuaaagggaucugcaacccuauagguggaacaacauuaugaacuaacuaguaccccuagucagccaucaguggaaagagaggcccauuagacuugcaaacuuuacaugccccaguacaggggaacaccagggccaaaaagugggagugggggguaggguaugggggacuuuugggauagcauuggaaauguaaaugaggaaaauaccuaauaaaaaauauuuuaaacaaaacauggagugaguuaguugaaagaagcuggaaguucugugaagccacucaggaagagaaguagcucaccauuccccgcugugacgcgcacagagcugcgugccugucacauagcguaagcgucucgauacccgugggcucgcuguccagcaaaggccaccacacagagagagcaccgccauaugagcacagagucccucaggggcuucugagaaacuaucaagcaaaugaccaaguccuaaagagaaggagaguguguggcccugucuccuaaguuagagauaagcaucagaaagaggaauugacugaagucuccagcuggagacugacaaaaugagaaaguucgagguuuaugaagauaaauuaucaagagaagauaggaaaagacaaagugguguugucugaucuugcagugauuucuauuguauuaguuauuaguaaaauaacagaucaggaaaugagaaugccuugaaggacuuauuuuuuuagacaauuccuauauauuagaauuuacuuuauuauuuccccccuuacuucccccuuccagagcccuccaaacccacccauaucaccaggaaagccugccaaugacaccaacagcaauaauaauaugaccuacagguaagaccugugcucucuuuaucuguuguuuaugguggaaagcaagguuaaucuuggcauauaauguagauaccuaggcugcaauacaugguguauuggguauauaacauauauuaggucauguaauuguuuuuucacuucucucuuguaauucacaaaaacaauacauuuucuuuuguuaagacuuaaagcugcuuuaaaagaaaguuauuuguuuauuuuuaggcuuucuguuuuuuuuauaacuuacucuaaauccugcucacuaccccucucaugaucacuaccuuccacaauccuucucccacucucuuucuccagugauugguuggggcccccccccggguaucacacacacacacacacacacacacacacacacacacacacauacacacacacgcacgcacacacacgguacuuuaagucucugugaggcuaggugcauccucucccacugaggccagacaaggcagaacagaucucacauacaggcaacagcuuuugggaaaccgccccccccccaaguuguuccagacccauaugaagcccaagcugcacaccugcuacauaugugcaagggaggccuaggugcaggcuggguauauucuuugauuggugguugagucucugagaucccccagagucuaggucaguugacucuguuggucuuccuguagaguuccuauccccuucugggcugcaauccuucuuccuauucaauaagaguucucaagcuccauucacuguuuggcugugggugucugcaucugucagucagcuguuggguggagucccucauagaauagccaugcuagacuucuuucuacaagcauaacagaguaucaugaauagugucagaaauuggugccugccuauggaugggucucaacgugagccagucguugguuagccuucccucagucucugcuccaucccugucccugccuuuccuauagacaggaugaauuuugggucggaaguuuuguggauagguccuuuuuuuuuuuuuuuuaacauguauuuauuuauuucauguauaugaauacaaggaccucugcuugccccaguuagccccgcuugcucaggcccaaagauuuuuauuuauuauuauaaauaaguacacuguagcugucuucagacgcaccagaagagggcaucagaucucauugcaggugguugugagccacaugugguugcugggauuugaacucaggaucucugaagagcagucagugcucuucccugcugagccaucuugccagcccauuuggguucuguaucugcaguacugauaccccaguucauucuuggguaccucccuuaucuaaggucucuuccuuguccuggagaugcugcccaccucaccugucaguugcagguuucuauucauucucauggccaucuguucaucucuccuguccuuccccucaccugauccagacccuacucccuaccuuuucucuacccaguucccuccccagucugccucuuaugacuauuuuauucccccuucuacgugggacucaagccuuccuuuuugucuagcuucuuuggaucugugcaguguagcaugggcauccuauauuuuuaugacuaauauccacuuauaagugaguacauacugaguauauccuugugggucuggguuaccucacacaggaugauauuuucaaguuccauccauuugccugcaauguucaugaugucuuuguucuuaauaggugaauaguaauauauuguguggacguacacauuuucuuuauccauucuucaguugagggacaucuaguauuugucuaguuucugguuaugacaaauaaagcuguuaugaacauaauugagcaagugucuuugugggauaguagggcaucuuuuggguauauacucaggagcaguauagcugggucuuaagguagaacuauucccaguuuucugagaaacugcaaaacugguuuccaacguaguggauaacuuugcaaucccaccagcaauagacaaguguuccucuugcuccacauccucagcagcgugcuuugucaguugaguuuuugaucuuagccauucugauggauguaacauguaaucucauggucauuuugguuuguauuucccugaugacuaaggacuuugaacauuucuuuuaguuuuucucagccuuucaagauuccucccuugagaauucucuuuuuagcccuguacuccaguuuuuaauuggguuauuugaguuguuggugacuaacuucuugaguucuuuauaaauuuuggacauuagacuucugucagauguaggguuggugaagauuuuccaccccaaucuguaggcugccguuuuguccuauugacaauguauuaugccuuagagaagcuuuguaauuucaugaggucccauuuaucuauugugugucuuagagccugagccauugguguucuguucaggaaauugucuccuguaccauuguguucaaggcuauuucccacuuucccucuaagauuuagugugucuaguuuuauguugagguccuugaaccacuuggacuugaguuuugugcagggugauaaacauggauauauuugccuuccuuuacauguggacauccaauuaguuuagcaccauuuuuugaaaaugcuuucucuuaucuauuguauggauuuuggccacuuuaucaauaaucaauuguccauauguggguuuauuucugugucuucauuuaaauucuauugaucaguguuucuguaccaauacugugcaguuuuuaucacuauuguuuuguacuacaguuugagguaagcgauggugauuccuccuaaaguucuuuuauuguucaggauugucuuggcuauccugaguuuuuuuuuguuuuuccauaugaaguugaauauugcuuuuucuaggucuauaaaaaauuuguguugagauugcauugaaucuguagauugcuuuugguacgauggccauauucacuaugucaauccucccuauccaugagcaugggagagccuuucaucuucugauaucuuucuuaauuucuuucuucaagaacuugaaguucuugucauaaagaucuuucacuugcuugguuauaguuauaccaagauauuuuauauuauuuguggcuauaguaaaggguguuguugccuuaauaucuuucucugccccuuuaucauuuguauaaaggagugcuacuguuuucuuuaaguuuguauccagccacuucacugaagguguugaucagcuauaggaguucucugguggagcucuuggcauugcuuauauauacuaucauuucaucuguaaauaagugauauuuugacuucuuccuuuccaguuuguauccccuugaccuucuuguguugucgaauugcucuagcuaauacuucaaguacuauauugaguagauagggagagagugggcauccuucucuuaucccugauuuucauggaauugcuuuuccauuuuguuacauguugacuaucgacuuccugucuauugcuuugauuguguuucgguaugggccuuaaauuccuggucucccugagaccuuuaacaugaagggaagggguguuggauuuuucuuuucuuucaguuuguucauauagugaauuuuguugauggauuuuuguagauuaaacaaucccugcaucccuaggaugaagccuacuugaucauuuugaugugcuuguagauucaguuugcgaguaccuuauugauuauuuuuuacaucaguguucaugagagaaaucagucugaaguucucuuucucuauugagucuugugugguuuagguaucagggcgacuguggauucagagaaugaguuuggcaguguucuguuucuauuuucuggaauaguuugaggacuauugauauuagcucuucuuugaaagucugguaaaauucugcacuaaaaccgccugucccuaggccuucuugguugggagacuuuuaaagacugcuucuauuucuuaagggguauagggcuguuuaaauaguuuaccugaucuugauuuugguaccuggugucugucuagagaauuguccauucacuaagauuuuccgguuuuguggaguacaggcuuuugaaguaagaccuaaugauucuuucgauuuccucaguguuuguuguuacgucuccauuuucauuucugauuuuguuuauuuguauauugucuaucuugauuaguuuggcuaaggacuugucuaucuuguugauuuuucucaaagaaccagcuuuuggguuuauugguucuuuguauuauuuucuuuguugguaauugauugauuucagcacugauuuugauuauuuccugccuucuagcccuguuugguuugcuugcuucuuuuuuuucucccagauuaugggaucucggaguguugugccuucauuuucauugauucuagaaaauauuuaguuuauuucuuuuuuucuuccgugauccaaugaucauugaguagagaauuguucuguugccuugaguguguaggcuuucccguguugauguuauucugccuuacuccaugguggucugaugagauacaagguguuacuccaguucucuugugucuugaggcuugcuuugugaccagcuauauggucaguuuuagagaauaauccuugagguguuaaaaagagguauauucuuuugugcuugaguacaauauucuauagaugucuguuagauucauaaugucucuuaguuucagguccauuugauucauaaugucuguuaguuucauuauuucuguuuuugucagaaugaccugucaguugauuugaguuggguguugaagucucccaauauuaaugugugggguucaauguauaauuuaaacucuagcaauguuucuuuuacaaaugugggugcauagauuuuuuuuccuuugaugaguauaaagugaccuucccuguguuuuuugguuaguuuugguugaaagucuauauuauuagauauuaaaaaggcuacugcaguuugcuucuuggguccauuugccuggaaaauuuuuuuucagcccuuuagccugagguaaugccuaucuuuauggcugagguguguuucuuguguacagcaggaugauggauccuguuuucacauccuuucugucaguuagugucuuuuuauuggggaacugaguccauucuguugagggauauuaauggcaggugccuguucuuuccuguuacuugcuguuggugguaguaacgugugugugugugugugugugugugugugugugugugugugugcgcgcgcgcgcgcgugugcuucccugaguuuugcugguguggauuuacuuauuucugguguuuuucuugaauguaguuauucuccuuggguuguaauuuuccuucuaguauuuucuauagggcuugauuucuggauagauauuguucaaauuuagauuugucuugaaauaucuaguuuucuccaucuuuggaaauugagaguuuugcuggguauauuagucuagguugacauuuguugucuuuuuuuuauagguugcaagauaucuguccaggcccuucuaauuuuagaguuucuguugagaagauggguguaauucugaggucugccuuuguguguuaccuggccuuuuccucuugcaucuuuucuuuguucugcugauuuuuguguuuugauuauuacguggcagggcuaggaucuuuuguuuuuuuuguuuuuuuuuucuggcccagucugauugguguuauauacacuacuuguauguuucuaggaaucuuuuuguuuagguuguaaauugcuuuuucugucauuuuguuaaggauauuuccuggaccuuggaguuguagcuuuucaccuucuuagcuugggucuuuucauggugucucauauuuucuggauguuuuguguuaggaauuuuuuagaguuaccauuuucuuucacugaugucucaauuucuucuauagugucuucuacgccugaucuucucugugucuccuguauucuguuggugaugcuggcaccuguuguuccuggucucuucccuggguuuuccaucuccaggauacccuuaguuugcuucuaguuccacuuucaggucuugcauaguuuuaucuauuuuccuccaccuuuuuaauuguauuuuaauguguaucuuuaaagaauuuguuuccucuuuaaaaaccuguauuguuuguauuuuccuauauuuucuuaagggauuuauucauuuuucucuuuaaaggccucuaucauuuauaccaugaauauuuaaaucauggauuuaaggucauuuucuugugcuuugguuguguuauaauaucuaggguugcugagcaugguagcuguacucagaagguguuauauuucucugacuuuuguugauggucuucuuucaagggccuuuagccaucuggcuggcuuuuaucccuggauuuucccaugguaguagguauugggaagggggugaaccucaaugguucuaguagggcaggccucugauggguguccuugggcuguaugguucuggcucuacagaucuguauguuucaggagccucaggucugaugaaggugaguagagauguguuugggagacuggagcuccugcuggaguagcaggcugcuuggagcagcuuggccugccuugguggacucagcgagcagggaagaugggugggggaagggcugcuucccuguaugguuuaagauuugaaggucugcuaaagguggguggggaggugucugaaucuuuuuucuuuaguuuugcauuguuaauuauuaaauauauagggcuaacccucccccagacucuauguauuucuuuauaagcagguuauuaguaguuucuaacaauugagaauugcuuaaucagugauaagaaugugccugugccuauauuuaggcuucagguaacauacagaugauguucgaauauagacuaggacucuugugcaaugcuaucugacauggaguggccuguguaccaacuuugucuuagggauaggacacaaaccacaaaugcccuuuccuuccuguccuuugguggaucucuccuaggauggcauaaacacugacuguccauguaucuuuuucauagaaaugcaggcacagugcgacaacugcuggaguccaaaagaaauguuagcgaggguccaccaccauccuuucaaacuccugugaauacagguaaugguguuguuguuauuguuuuugauaccagcauacauuuuccuaagaaacucuaacaucuuugguucuuuuacauucuuuugugguuagaaauggguuagaaaacagggcacuuugguauaaauacaaauauauuucaaaaaaccacuucggacuauaacuauggugcauaugcaguuguucagauccuuagugccggacuucucagacggcccagguuccgacuggcacaguccugugcaguuacuaaaguccagagagguuguugaauuaaacucauugguauuaccaauuagguuaaaauaaaaauuuaaggacuuuuuguucacuuaaaauuaauaauaagccuagaggcaggccauuuucugugaguucaaggccagccaggucuauauagugaguucuaggacagcuuccccauaguuacgucuuguuuaagaaaugaaaaacauaccgaaauauauuauaauaagcuuguaauaugcaugcaaggaacuuguuuuuuuuuuuuaaauagaaaauagaguugcugggcggugguggugcaugccuuuaaucccagcacuggggaggcagaggcaggcggauuucugaguucaaggucagccuggucuacagagugaguuccaggacagccagggcuauacagagaaacccugucucgaaaaaccaaaaaaccaaaccaaaccaaaccaaaccaaaccaaaccaaaccaaaccaaaccaaaccaaaccaaaccaaaccaaaccaaaaccaaaccaaaccaaaccaaagaaaauagaguuaauuuucaaauuuaaaaaugauuagugagaucguagagagcugagcuccguuucuagacaaguaaagguggcccgccgugguguggguggugcccaccgugguguggugcacaccgucccaaugcuggggaggacagcaggcucuggcaagccagccuacacagugacuuccagaccguugggagagccuggcucaacauagaagaaauacaaggggcagacgggugugugugugagugugugugugugugagugagugugagugugugugugugugagugugugugugagugugugugugugugugugugagugagugugugagugagugugugugugugagugugugugugugugugaguguaugugugugugugugugagugagugugugugugugugugugagugagugugugugugugugagugugugugugugacugugugugugugugugugugugagugagugugugugugugugugugagugugugugugugugugagugugugugugagugagugugugugugugugugugagugagugugugagugagugugugugugugaguguaugugugugugugugugugugagugagugagugugugugugugugugugagugagugugugugugugugagugugugugugugugugagugugugugugugagugacugugugugugugugugugugagugagugugugugugugugugugugagugugugugugugugugagugagugagugugugugugugugagugacugugugugugugugugugugugaguguaugugugugagugacugugugugugugugugugagagugacugugugugugugugugugagugugugugugugugugagugagugugugagugagugugugugugugugagugugugugugugagugagugugugagugagugugugagugagugugugugugugugugugugagugagugugugugugugugagugacugugugugugugugugugugugugaguguaugugugugagugacugugugugugugugugugugagagugacugugugugugugugugugugugugugugagugugugugugugugugugugugugugugugugugugugugagugacugugauuaagauacugaagacucugugugaagcuuccagugacuaaagaaacaauauuaaaagaaaaaagucagugguaccagaggaacugcucuccacaugugcaugagggaccaguacaugugguacugcucuccacagaguacugcucuccauagaguacugcucuccacagaguacugcucuccacagaguacugcucuccacagaguacugcucuccacagaguacugcucuccacagaguacugcucuccacagaguacugcucuccacagaguacugcucuccacagaguaaguacugcucuccacagaguacugcucuccacaugugcaugccaugagcauacguaggcaucugugauuagcaaugaaaacuuauauuuacauagacauauuucuugaaaaucauauuugauguuauacaguuaaaagauggcuggcguuuuuuguuuuuuguuuguuuguuuguuuguuuguuuuuguuuuugaagaggguuuuccuguauuggccuggcauuugcucuaaagaccaggcugcacccaaacuuagagauguuccugucucugccucccccgugcugggauuagaggcguguaccaccaccgccuggcaagcuggcuggauucuucugucuguaucucuuuucaaucucuucagucugcugacuuuguacaugaaagaaauacagucucacccaggcagauggaaacaggcugcccuuacauaguugguauccccuuugguaguuucugugagguuaaugcagaacagagucagaaaucauauuaauaugcuuuucucauugguuuucuaagucacuuuuugaagaaaaucagcccugcuaggcaugguaguacaagguaguaaucccggaacuuagcaggcuguggccugcaggugauagagucaaagccagucagcguuuguacgggaagauggccauaaucaaaauggcaguuuuuauugccucuuuauaguuauuuuaaagugaaauuuacuuuucccuaaauacuguaauaagcauuugcuaguucagaguugagugugacaagaacauuuggugcuuugaaaccaccuuauccacgguuuauuuuccauggacuacaaauauuacauggaacacuucauaaauaauucauaucuuuaaucauauuguaauaauuacucuuuuauuauuggguaccuuuuuuuuuuuuaacuaugccgaauccugugccccauaauggcauuucagagaguucugaaugcacaugagacaguuaucuggugagagcauaauggagccaagaaguucuuuaucagcugcugcggccuuagcucucucacuguuguagcucagcauguuacucacguguauguauauuauggucaugggaguagcccugaagccccgggagcuacacagacugcagcaaguaggauuauguaggacaccugacugcaccugugcuacgcuuaguuacacguaucacuagcuuacuguaagcggauaugcuauuuuauccuuguacuagguacauauauuucauauuuacugucccaugacucauggaauggcugacauacccaaucagauuuguacagcuuugcgaucauaccgcauuagaauuauauagugacacauuuuucaaaacauauccauguuguuaaggguuauguggcuacguagggagagacacagugugccugccugcuuugugcaucucugggacugaguacggcuucagauauggaccugcugaacugggccaacaggcauuuugcuucuguccacauagugcaaaugucaaaugucucacuaguauucugcaaauagcuuugacauugcuaacuccacacagggcuucuuaggaaagcacaggugucccucugcguucacugaccgucaucugguguagcgguuguuuugggacgacuagauaugugaacacuucaacuaaguuacaguuuaagccuguucagugagacuaagccuugcagucagcauguguccuugucccucuuaggugucugcuccauuucuuaacucacuccugcugugcuuucuccauaccacgaaugggcugcaggcuccuugaggggcuucucccuguuaguccuuucccaaggaacucggggaaacugucaggcuuccuauaguucaaauggccgacucuuucuacauucuaaguuagauagugcugaugguuuaagguauauuuauaauguugaaaaugagguuuuaaaaauauugguauauuuuuacuuaguuuuuaguauuuuauuuuuucaguuccucugaagugaaugugguaauuucaaaagcuguuuugauauugagagaacaaucuucauauuaacguuaagucaugugacauuucauaaaacaccaaacauauacacauaucuaagcuggccggugguugugggugccuugcuucucagccuggucuacagagugaguucaagacaacaggcagggcuacauaaagaaacccugucuugaaaaaccaaaacaaaugcaaguacuucuaaacauuucagaguuucauacugguuuuuggguuuuuuugguggcuuuucuguguccguguguuaguguuuugugugucagcuaagagaguugucuagacugacuuguguuuuccucuguagugucuucagccagucacgccacuucuacagcaguugucaguagucagccuaaacugcagaccucagcaaccucgggcucucugccggcggcaccucuucuuccugcgcccagcacagccaccguaguugccacuacucaggugccuagugggaccccucagccuacaaucucucugcagcccuugccagugauccugcaugugcccguugccgugaccucucagccucagcuccugcaaagucauccagggacuuuagugaccaaucaaccaucuggcaacguggaguucauaucugugcaaagccaaccuacagugaguggucuuaccaaaaauccaguauccuugccacccuugccaaaccccacuaaaccaaacauuccgucagugcccaguccuaguaguauucagaggaacucuucaaccaccgccgcaccguugggaacaacccuugcuguccaggccguuccaaccgcacauucuauugugcaggccacaaggacuucucuacccacaguaggcccgucaggacucuauagcucuucaagcagucgaggcccaauacagaugaaaaucccaauauccacuuuuagcccuccaucuucagcagaacaaaauagcucugccaccccaagaauugguaaguugguuugcuuuauaacaaaaacacuuuaauggucuauuacucauuaaacucuuucuaacaucacugggaaaaugggguaaacaauuugcuugauuauuuuuaauaauuuuccgaaucccuaaugauacugcuaaaguggagugagagggguuuauuucacagugcuuucuuauggaggcauauuuguagaacuuuaugggcucuuugacaauuaccugaugcauguauacaacauuuaauaaucaggucagagcauugaacucuuuaugugcuucagacaggcauuuuuguguguugggacuucauugcuguuuuuucuguauuucagagaugauuuuggcaaguagguaccuuacugugcccuaugaugcaggcagaacucuuccugacuuacugucucugugccccuuuaccugucuccccucugccccgacuuucuccuucccccguccacccccuuuccucuccccuuccauguaagagaaguuguaauugagaacagaauuucuguuugcuauuuuaguaauuuauuuucgugaguuuuuguacaaucuuuguagugagcauuguguguaauuuguauuugcuuuuaugauagguggaucaggacaauugaguaaauacauuauaacggucuaauuuuagagguuuauuguaagagaacauccauaacaauauauugccaggcugugguugcagugcacagcuuuaauuccagcacuugggccagaggcaggugcaucucugaguucauagcuggccuggccuacagagcaaguucuaggauagccagagcuacacagacacaaaccugucucaaaaccaaaagaauaacaagaacaccgacacccguguaucuucacucuguauuauuuucucugucauauucuguaagacauauuaucuaauuguuguauuuuacuuuaaaauauaaagugaauuuggcugcaacugcuauuucaaauugcacuccucuauccuggcuggccucagagagguccgccugccuuugccaugcugggagaaaggcgcgugccaccucacuuggccacaaaaacauuguuaaugcacacauuucuaagacagauguuuacucauaaucaaaucagaugacaagccagcuaagcuucauuuuccccugacuucucucuucucuucucuuuucuucucuucucuucucuucucuucucuucucuucucuucucuucucuucucuucucuucucuucucuucucuucuuucuuaaaagauuuauuuauuauuauacauaaguacacuguagcugucuucagacacacuggguguguugugagccaccaugugguugcugggauuugaacucaugaccuucagaagagcagucagugcucuuauccgcugagccaucucagcgacuccaccccccacccugauuucuuuuuacaaaacuuucaguauuuuuauuuuuauuuuuuuuuaaacuuucaguauuuuuaaugucagaugauuuauaaucgacuuuauuuuaugugauuugcacaggaucacugaaauuuugaagcaaaguuggcauuguuuuuaaaaucauuuaauucauuuacauugaauuuaaauaaauauagaaguuuacuauaagaccauggccuguaaagaaagcuuuaaagaguauuuguuuaaugcugugaguacuuaucccuuaaauaugcacauuucagauuaucccuucaucaacauguucuuuuaaacaauuuguaaacauuugaaaaugcuauacuacagaauuaucuagcugacggcugcuuuagugucaucagucuguuucagauuugcuuugguauucaguguuuuguaagaugaauuccucacauaaucauugauuaauauagcauucucuuuuugagauaauauauccuuaaaauguuucuauuuuagaguauuuauuugguauauuuauauauaacuauauauaaacuauugaaguuaccuucauauggaauugcauuugauuugugaugaaaaacuaauuucuagcuauuaguaauaaaugugaguggugcauacgguguuggcacaguacucauuaggaagcacuuacgugaaaaccacggccaugccuaauuucagcgaugccauaaugauagcaagaagaucauuuauccuuuuagacuaccuggaauuuaaguggaaucaaauggaaaagcuuugcagaauauaaaaauugaagcuaaauuacauauccuuaucguuauaaauaauuauaaucauauagucaaaaccuaucaugucuuauauucauauacacauaauuaguaaaaauaugugccauauaacuagauuauauuuguacauauuuacaauaguuuauuaaauucuuacuggauuuuaaguaaauaguacuugcuuauaaugaaguagagacucuuuaggcucaaauuguacuuuauucauucaagaaauaauugguguuuguaauuuucucaaguccuacaggcacauagaaacacauaagauauccuccuuuucacuaacccuacagauuaaauaugcagccuugccauuaaauaaguagcuauaaauauaauaaauauuauaguaugcuguuuucuuugagaagauggaaaggaggaggagagccauugaaaggucugaguuagugaacagaaaacgggggaaauuccucauuacacuauuuuuuuaaaggggggggggucuggaggaguauggcauccgugaauauugauugcaguguggaaaaugguuagauagaaauagaaugaaguuguggaugccagcaaugaugcauacaggagugggucauuagauaagauggcaccauaaagagaugcagaggggaaaaacugguguacuugaucguuuguuaauuuaagaugagacagcaagggcuggagagacagcucuccaaacuggcugcuccuccagaggacacagguuugguuccuaauacccaggaaguuguucacaucauuccucuuaucccaggggaucugaugccuuccucuggcuuucuugguuauccaggcaugcacguggugcucaugcagauaaugcaauaagacaucaccguacgcaaauggaucaaguuuuucaaacagagauuaauauaagaggaaugcuaaauuuaaagauuggauuuuuuuaaaaugugcaugucugugugugaggaggacagagugucaucugucuguauaugaggaagaugggggugccaugucaguguauggggaggauggcagugucaucugcauauaaggaggguggggaugagagaugccaucugucugcauaugacgaggacagaggguugugagucugguguaauuagagcugcaguuacaguuaguugugagcugcucaugugggguguugagauuagaccucuggguccacugaaagcacaguaugugcgcucuuauccacugagccaucucuccaguuccugauuuggaccucuaaaauauugaaugcuagucugauuuuuaaaaacccaauguuaaggaguugauuuguaaagaguuauguaguugcguaacauucacuaaacaucucugauuuccagaaguaugggaaaacuagagcuuacuuaacaccaagcaguuuacuccuucaaccacaauuuccuuugaguuucuacaggcuuucuguguucuguuucuacucagccaguuauccagaccuacuaagagaauacuaccacuuucuacuauaaaguaccguggcgacuggaacugcagugcaaagauggcucagcaguuccaagcauugcugcucuugcagaggaucucaguuuaagucucagauugcaaaacucacgagugccuguaacuugaacuccaaaagauugccccccucuuauggccuucagaggcgucugcacacauguguccacgcagacacuccagacaugagcauacgcacacacauaagcaaaaguaaauguaaaccauguacucaaaagaguaaaggaaauacugguuaaaaugcuggucaccccacucgcucagucccugcuugcuccagcccagagauuuacuuauuauauguaaguacacuguagcugucuucagacacaccagaagagggcaucagaucucauuauggaugguugugagccaccaugugguugcugggauuugaacucaggacauuuggaagaacagucagugcucuuaauggcugagccaucucuccagcccuugguuuuuagguauuuauggucuacuuuucauauuauccgagaguuugaaaauaacaggaauaccauauuugaccaagaaauuauuuccagaacgaggauggauguuuuuaauaugagaacacuucugauaaugcaguuaauuauucucagagugaaagcaaauuuauuucaguggacguaauagacuuuuaaguuccucaucuguccauuagaaauuugauaugaacaaacuugcucuucaugcuguucuugaagugguuuucaggucuauacaaucuucccauggaagccugacacaagucaaaagaaaaugaauagaggaaaguaaucuggguaggcagaugaccucaagucaaagucccaacacucagauaaaggucaggccugguggcaggaaucuaaacccgguggaggccucacgcagguggauucaggcacuggccaaccaggcuugcagaggcaguggucuccagguucaaagacggccucccaaaauaagcuggaggggcauugaggagggcacaugaugucacucuggccuccauacauagccaugaacaagcaugugcaucuucacagcacacaaagagcuugaacuaauacauguauguacuucucauccuugcuaugacuuucugcacugaaucuauucugaacauuuuuauguaagauuuuccucaaagacauaugauaggaaagaauggcguucugccuuaccauuuacucagauugaacauucucgcuguacacaugucagguuauauccucagggacuccuuaggguaguuucaguugcucugcaaugaguuauaugaagccugaaguuuuauauugugagggcuggagagauggcucagugguuaagaucacugacugcuuuuccagagguccugaguucaauucccagcacuacaugguggcucacaaccaucuguaauaggauuugauacccucuucuggugugucugaugacagcuacaguguacucauacauacaauaaauaacuuuuuaaaaggaaaagaaaauuuuauaaugugaauuagccuucuaaaacagugaucugugagagaaaccaucuguaacaugcugacagaaaaccauuggagaagaguacagaaauuauguguguaaagcagccuggccuuuuacauauuacgcauguguuaaacuuuucucuuuuuuuguuuaaguuacagaaaaccagacaaacaaaacaguagauucuucuauuaauaagaaagcagccgauagcacaucacagguaagauguuucccuuugucacagcgccaugguaugguuuuccuuccaucauuaauuacagggcuuauuguucuuuuuugagacaugaucuuuuguagcccaggcuagucucaaacucacugaacaagagucuucuguucguuuuccuucuuuccggagggaaggcuuuguugaaggugggauuuugguugcgagggucaaucggcagcaugugcauggccugcugaguguagcagugacucuuugugcucuacagagugucacuguggucuccacagaagugccaccuuaguauucuuucugcuugacguccgugguacuuuucagaauuguagauguuuucaccagguguuuggaggaagguuuuuauuucuucauguacucaacuacucagaccucacuuaacaaguuauacuacauuuaucuguuaggaguguagcagugcacaagcugagauuagaggacaccuacacgucaggucucuggggcuggagcucaggcuuugacucaaaguagcagagccuuugucugcugagccacucacugcacuguccaccauuccucagccagguguuuguugaacuccacuugauauccagcucuccuuuuccuucucucccuccucucccucccccuccuccccccucccucuccuccuccuccuccucuuuuguuucauucuccauuccuuggguggaaaaauucuuuuggucaaacaucauuuucacugagaucaucugcauccuauaacugccuugugcccagccaaaugacuuuuaacauaacauuggauaauuauucuuuuaagaaucuugcacauguauacaguguauuuugaucacauacccuuccucuuccucuaaaugcucccaaacacaucucuucccaacuucacccugcucuuacuauccagaaucguuacugugcccaugugggcacaggcgugggguguaccaguggcccaacccuccugcaacagccaucagcuguuacuaaugccuuagcuacaguaggccucauaaacccuuucuuuaccccugcuggaaucuaacuggcuugaucucaugucguuguggugcagauagucccggcugauaguccaaguucaugacuacagcuucugugucaugucacaggcuccgccccaucccuuggcucuuacuuuguuuccagcuccucuuccaccauguacucagugccuuggaugauaauggugggaggacggguugcuuacagauugucccacuccuggcugagcuugcacaggucucucucagucccugacaacuuuuguacugauagcugcucauugcggagagaagcuucccugacuaaggcaagagcaguacagaucuauggcuggaaacauaaauauuuagaagacagcuugacaacaugauaguuuagcaaacaacaauaauucuauuauuguucuaauaauucuaauaauccuccaaccccagccaugggcuuuggcaagguguacaauaccagacacauucccuucuguggagcagaccugcaauccaauuggaaaggaguuguuuauacccuggcacuaaugucaccaugacaugcuacuauuguaccagugggaaugucacgugacucagcuggcagaucagaacuguugcgugcagggaacaguacuggcuggguaagaccauugauagcuuuccucucccaguggccugcauagugccugccugccauagugcggaagucuccagucagcugcagaaugauuucuccauguccgagacuuuauuuaauaacccauguguccuggaagcagcacuguccacccaugccugccucugcuuccugacugcugggacuaaagguguacugacuucuuuuuuuucuuuuuucuuuuuuuguccaaaguuaaauuccacuuuacuauauaguuuuuucuuuccauguuaaguaauaucugcgauccguuguuucaaaauuuaguagcauuuugaaaacuggaccuuguaaauaauauaguaaguaaauaacuuugcauuccuugaggacuagaaacuuaauuuugaauuaaaccaauuuguguuuguaaaucuguaauuuucuaugaaauuauuguagaagaguuuuacaagauuuagaaucauuaucuggauuuucuaaggucugggaauucuuuucuuaauuauuuauuauuaucauuauugcuauuacacuaaucuauuuguguguaagugccacagaaccauguggugcucagaggacaguucugcauuggguggguccuggaucagucucagccagucuagcucuguagcgaguccucuuccccuguggagccauauuccuggugcaaccucuuucuguaguuucacaagaugacuugaccuuuacagaugagguugcuaauuauuuagauccaaucucagaaugguaugucaaaacagauuauaauuaucauuuauuaagcauuaucauauuccacauguucuauuaggcauuucguauauacauuuauguacacauuuuguauaucuuuguaaugucuuaccugugugcacuauagagauugauucacguaacuuaugaguuggaauccugcugcagaugcuggcucuccagccagugcuguuccuucagccuucugcuacuccugguuuuguuuuugucuuaauucuaauugucuuacuaaugauuuuggacaguguacugaguuuggucaaauuggacaucaccuaaugacauaaaaaugccaccucacuaacuguaacugaucaucuauaacugaucguuuaagaauaagguugccaggauuuucauugucagagaguggauguuuguauuuaaucccauagcacuuaagagaaucuaggcacuuugguuguucuguguaacagacagcuuuauuucuaaaacuaauacaauuucuguggaaaauauuugaaaauuauguuucuuguacuaaugacagucacuauaguuugucuauuuucugugggcacuugcacauaugugugcucacaugccacagcaugcacaugcaggucagaggacaaccugugggagaguccguccuggcugggcuugcagcaagugccuuuuacucacgaguaaacuccagugugcucagcggugugcugcucagcggugugcucaguggugugcugaggugguggccugccacacuguugagauaaagggauuuggggcuuagcuugaaugaggccauucucuccuuugcccuuacuguuaccacauauuuccuuaguagcuucagcuccacugcagaaucaaacaaguuuuauuuuucagaguggaaaagcuucuagcagugacucaaguggugucauugaucucacgauggacgaugaagagagcggaacuacacaagguacccgaacaaugauucuuuacucaugcuucaugaauguuccccuccuaggauuugaugaaacuuucuaguggugacguugauguaucuacaccuccccccuuuuuauuaaucauuuuauuuauuuauauuucaaauguuaucuuccuuccuggucuccccuccaugaaccccucaccccaaguuccuccccuuugccucuaagagggugcuccccccacccacccacccacccacccacuccugccucauucccguagcaguccccuucucuagggcaucgaaacuccauaggaccaagugccuccccucccacugauuaagcaguccucugcuacauaugugucaggagccaugaacuggcccauguauacucuuugguugaugguuuagucccugggagcucugagggguccgguuaauacuguucuuucuaugggauggcaguccuucagcccuucaccaacucuuccaugggguucuugggcucaguccagugguugccaagggugacuaucugcaucugucuuggucaggugcuggcagagccucucagaggacagccauaccaggcuccugucugcaagcacaucuuggcaccaacaauaguguugggguuugguaucuguauaugaaauggauugcaugguagggcugucucuggauggccuuuccuucagccucugcuccauuuuuguugcugcauuuccuuuagacugggacaauucuggguuaauuuuuagauggguggguagcccuaucccuccauuggggccaugucuaucuacuagacguggucucuucagguucucuuucccugcuguugcguauuuuggcuagugucauccaucuccacuggguccugggagcuuccugcauucuuggcuucuaggauuuccuagugguuccucaaguccucccccccaccccccccccccacacacacacugcuacuuauuucuauucguucuucugguucucuggccaucucucuguauccuuuuuagaaugagagucuuugacauuagaauuaaaagcagcagucagcuccugagugagugugagcgggcuguagagggaggcagcagugagaacacaucaccgauggcacauggaaaggagcucuuucaaaugaaaccucguccucauucuagacgugaagcaaguuagcagacuuaggaagcaucagaaucaauaagagacccaggaaucaagacgacgaguuuggugguugcuugcucccuuaaucucccccuucuuucuuuuccucuccuucuccagucccuuucacuccccuucuagugucuguccauuuaauuuucauccuuugaauugcuauauaaauaaaaaucaaaauuuuauaaucauucuuaucaagagucccuaauaauuuucuuaguugcaguauucagaaacuaacuuggauagauacuaaggcauauucugcaguguuucaugaauaaaguuccugggucaaaucuaauugcaaaagugcuaaauuuagaaaaaucaauguuuuuuuuuuuaauguacacuaauuuggccuuuacugugauaauuuguagugugaaugcccagcuaugauucacaguaugauauuucucagauuucuuuggcuaucaaaaugucuuugcucacagacaugggaaagcaugaugaugauaauguguuuaucuaaugcuaauuguuuuuaucuugaaguaagugaacuuacaaagucauguuuuaggguauaagacgguugauuugggagaaauaaaaugaguaacgauagcuaauucuaagcaguguacagaagaaccguaugagcugagguacagucaagacauuuaugcuguccuucaucgcggcugaccucuugauggugugaugacugccaugauugcuauaguggugauuuuaagaguuuuaaaucaucauuuuacuuucaguuuuguuuauucugcuuuuguagauugguuuugcucucaggaauucuuagagaacaaaaauuaauacugaagcaagauucugugaggguagagcuggccaugcgugucccaggcauuccaccugccacugugcuagccucuucaggaugcuuucauugacccacguuugagucauauuaauuuucccauucuaaagaauauugugcuccuauugcaacaaacuaaaggacccagagcuauucaauaggacacaaauggacaaggguccacuccuagagaaaguaguuggcuuaucuucuucagagugcuccaugucaggguuuuuuuuuuuaugguaaagaggccuguuuugacauuugaagccuuuuuacuuuaagaaacagauaaugaugauuagcaagcacuuauauaaaaaucuaagccgggcauguggcgcacgccuuuaaucccagcacucaggaggcagaggcagguggauuucugaguucgaggccagccuggucuacaaagugaguuccaggacagccagggcuauacagagaaacccugucucgaaaaaccaaaaaaaagagaaaaaaaaaucuaagcaacucuuuguaauugagauuuaaaaccuucacucuaugauuugccuagaagaaugucucuggggggcuggagagauagcucagugguuaagagugcugacuccucuuccggaggucccgaguucaaaucccaucacccacaugaaggcucuuaaccauccuuaaugagaucugacgcucuucugguacaucugaaaacagcuacaguguacuuacauauaauaauaaauaaauguuuaauuaaaaaaaagaaaucuugccuuguauaauuuagggaaaaaaagaaugucuuugguacauugauaaauauauauacgugcauuuuuacaaugaaguuaauauuguauauugaguccaaagauuguugauugaagaccaugacuguauuucuauaagagugugaacuggaaucuguuaagauccacuauucuuuaaauagcuccugacugaguuuucaaaucagcaagaauacacauaaugagaacagaaaaacaugguuucugaagaggacaaugugaugugcagguagcaagcagaugaguaaaugucagggaagucaggccugggucaccugugucuucuugccaucacucaugugucucaucuuuuaauuaacagaccccaagaagauaaguccuccuucuucaucaacugugagcacuucucagcccaugucucgaccguugcagcccauucugccagcaccaccucuucagccaucaggcgugcccacaaguggaccaucucaggcaacuauccauguucugccuacagguaaaucuccugagucaccacgcaggaacuucaguaacccauuuguagaacgucuuggucauugucauuagcuacucugaagaacagaaguaauuuagcgcuccagaaaggcugguuauaauaacuguucugaauagaaacaagacauuucaggacuggucaaauuuuguuuuuuaaguuggagauugaaccuagggccuuaagcaugcuagauaagcaaucuauuccuaaggcagggucugaggaucaagcugguuuuaaccaaccuaccauaauaucaguguucuaggguuuuauugcugugaucaggcaccaugaccaaggccacucuuacaaaggcaaacauuuaauuggggcuggcuucuacacuugcuccaaaggcagccaggagacuaccguacuaggcauagcuugagcuuauauaggacaccuaaaagccugucuccacaguagcacacuuccuucaacaaggccacaccuacuccaauguggccauaccucccacuagugauacacccuauggacgagacauucaaacaugaaccugggggggcccaaccuggucaaaucagcacagucaggaagccugugcucauaguuccccuguuucauuucaaacacaguaggauuggguagugucacuccauagccugugucaccugaacggucagauugggucgugucacuccauagccugugucaccugaaugguaagauuggguagugucacuccauagccugugucaccugaacucuucagaagaccuggcuucuugcaggucagguuauuaucuaucgcuuacagaagcacacccuccugagugagcuaaaugacauuucacccaugagaguuacauugccagaagaauuuguggcuaaauuauuuucuaauggcucaccaagucauuuguuaaucuuuaagaucgaucuuggugcaguaaguucgugcaguuuaguguagugccuggguggauuguuugccuuucagauaugcacguccuguugcuuaaacuacuguuuauccuguugccggcucuagccaacaccaugugcuaugcaacuguguucuacauagaaguuuuauuuuggucuuuauauucaaaugccauuuuucugucuaaauagcuacauugcauuuaaugcuuagcaguugugugucucuaccuuauccaaaguuaaagugacagguagguaauuuauaguuuaaaaggaagugucauuaugcaaagagauacauugguaguugucaucagaugcugaagaauucuugcuucccauucugaguacgaaaauuaguaaguaaguuauaaacuauaguugaauguccacuuaaaagcuuuggacuuauaaauuuuugggacugccucacuaaagauccuucuuggaagcuguguuuuaaauguacuuggcaucaaaugucaacucaauguaaaguaggaagcgcugacagguagguaggagauggccucuuuugccagugauuucaucuaccacaucagugaaccaaaggagucaucuuugagaacacuagcgaaaggcaggagcugcuaaaauguugaagcaucagcaccgcaucuuuaucaggccagacugugucugcauugcaaagccuuaaagauucuucaucuuauuuccuuuaugguuccuuuuaugaggucacaacugggagguuaugcuugugccaguucagccauuuaugugaagaacuugaaacaguuuccauuauccacaucagucacccagcaggccuuuagcagaugccuccuacagucaggcugugcugugcacacugcugcagugaccucaggacuguagggacgagcaccagaguggcuuuugcugugguucaaguucaagggaaggaggccacagaaagaaucaaaguuacugaugaccaaggagcaugcuuguuaaguuuugccauggugccacuuuugaguuuugugugugcaugguggaucugaaucagaguaagccaucaucagucaaugccaaguucaccucugcucagcuauuaccaugguaacaacauagagaauucaauaaagaagggacgagugaacugacuuugccauuuuuaguuucuugauacacauuaucauuuucuucuacuuuuauuuguuuugcuuuauuuuggguugugagcuuauccuuugacagcagagccaucucuucaucuucaacucuuugacuuucucuguaagcgagggucucauucuagcccagaauguuccuaaacucauuuguagucacgguggcuucaaacucacuauuaggauugcauaugugagccuuacuaauagugaguuauugccuuacuagaauucugcauuugccaacuugaaguagaacacagcacugccguuagguuagacaugacccacauuccaaguacugaguagcaccgaggagagcaaauguaagcgaaugaguccauucuuggugcugggguggggaguguugugcaaacaaggaucaagguaaagccaccugcugacaggccugacagcucgacuucaguccuuagugccaccagaguggaagaagagaaccaucucacccugauuguugccugaucaucacgcaugcacacaaaaaauaaauaaaauguaaaaacaaauuaaaaguuuuaugucaagauuauaaaauguggcucccaauaaggcuuugcuguggacacuggugcccugagaaaggaaugcacauggagggggagaguaauuucauaccauguuccccccaaaaccaucuuccaacuucaucauguacaauguuaacaucugcuggggcgccauguacagugccuggguguuagaacugugcguuuaguaaccacucucaagguugugcgucagagaccuacuucaagguucucagcuauuacgugcuucuacgucugcagcacccaggaagguuccuggaaaaugcuugugugcuuugaguucagugaacagagaccacaaccaccaaaggugacaguuaagucagggaagacccugcucaggucguccacggggugagacccuggggaggcuccugcacgagggaaaagaugaccucaucagccagccacacacacacacacacacacacacacacacacacacacagccagggucauaaacuccuuggcuguucuuugagcuaugcugcuuuguuucucuucagucugcugagaugaugagucugguugguguuagaugagagacuucagcaggaacuugucccuuauuuguaagcaguggccugaucucccucuuuccuugccauaguuaacucagcuagacagacaaauggagcagggaaaaugcacaugaccuucagaacuggagggagggcuggagaugugugauccacaugugguucugacagcccuuuucuccugugcuuagacuguguguaaugguaauugcugcuucaugauguugucuuacauagaauuggcuacauucuugguaucuuuuguuugcuuccuuuagcuccaaccaccgugaauguaacacaucguccaguaacucaggugaccacaagacucccuguaccgagagcuccugcaaaccaccaagugguuuauacaacucucccagcgccaaccacucaggcuccccuacgaggaacuguuaugcaggcuccugccguucgccaggucaauccucaaaauaguaagaggcucuuuucuuauauauggcuuugagggguauguacugcucuauaugacguaagauuaucauacuaagggacauauggaacagcacacuugcauggaauaauuagcaacaauguauuacauuggaaauuacugauaccauagaucacuggcuagccuggaacucacagagauccacaugccucugucucccaagugcuacgauuaaaggguuacagcacuacaucuagccuuucuuauguucuaaagaaagauauuuaacauguauacuauaaaauuuguagccuuuauaucaucuuuaguuuaacuuuguuauuauaguagcccauaauauuacuguuuuauagauuccuguauaucccuggcugcauaggaguuugcgcuauggaccaggcuggccucaaccucgcagacagcugcuugccccugccuccucucugcugagguuuaaaagugugcacuuaaugaugacuaccuagucaacugaaguuagaaugaugaguuguggcuuagcccagaaaagggaaguuauuguaaggguuaccucaaauauuacagggaaaucaguugauuuagauaguaauuaugcccagucuguauaaaacuagcauguguguauuaauaucauagaguacauggcuuaaucacagaguauagcauagaaaaacaagguauauaaaauguaaagaaguauaauaaaagugaaacacaagugaccuuugccacguuagaaaguacaauuuuauuacucuucugucugucugucccucugccauccucucuuaauugacaucaguguaggagucacuuacauaugcucaucucacaugcauauaaacauagaaugcuaaauguauaguaauguaaacaaagcuaauguauagcugugaauaucuauuuauaaaauaacaaauauagcugucuaacaaaacuauaauuccauuauuaauucuucuaagggaaauuaaaccaaauggcaucuuuggaucauagucugguuuaaguuucucaaguuuguaaggauuuucucuaggcuguugugugauugggucaugaaugaguucuagagcaguccuggcacuuagugugggucgcauacagaaugucugaccagugugauugggacaguggauggcacggcucuaaagucuguacucgguugaacuuugugaugucacugcagucuuccugggcauggaguguccuuagcugcuuagcaguauaaagagaaaaagugggagccccacuaacauaggacugguggcuuuaaaaaaacagauuuguuaaugugugugucugugugugugugugugucugugugucugugugugucugugugugucugucugugugugugugugugucugugacugcacaggccagaaaaggaugucccgcuccgcuccauggagcaggaguugcaggcaguugugagcuggcugaugugggugcagggaaccaagcucagggccuuaugcaagggcaguaugcgcuccucacugcugagcuuugccccaaggacagacugcuuugguaaggagcgucugucugcagauccuuggagccauuggcuccauccgguuuagcugcuguccaccuuggagggcagggccguuggugugggguuuuauuucuagucguccucaggaugaucucugucugugcuguccuugggugucauugucaugucuuccugcuucuugguuccuucccauugcugcauacagccugcagugccacugcgguagugucugugagagguuuggguuuuugaguucuuuaucugauguagacuuuucaguuggaauugcucaucuugaaauuuuuuuaaauuuuuuuuuacuguuuauaaugaccgaacacaaauuuauaguagaauuuucauguuucccucaauuuucuuuugcagguguuacaguucgagugccucagacaaccacauauguuguaaacaauggacugacucuaggcucagcagggccucagcucacggugcaucacaggcccccacaagugcacaauguaaguaucagugcuugccuucuggaccuccucagucacuaagcugcuagagcauuccagcugucuuccuuuccuucccuccucccucucuccaccccuccuuuucuuucaacaggguuucucucuguagccuuggcuaucuuggaacucacucuuuagaccaggcugacauugacccuggaaaucauagagacccaccugccucugccucccaagugcugggaugaaaggccuuagucaccauugccuggcuaccacuuccuuuuuuaaaguaauguuaucaaaggaaggagagagcucuucuucccucuaguagagggucauuguagacaacucgaucuuaucuuggggaaacaguaccggaucgaggacugaugcucacucugaccgacagggugauggcccaggcuucugaggugacagacagugccccaaacucagguguaaaucccucgaguuaugacuuuguauuucuuaaaaucuaacugcuguguugucauuaguuuaucuuaaaugaugcacuggcauuuggaauggauuuuguuacaaaagaacagaaaauaaaguauuucccucuaaauuuagccuuaaacaaagucauacuguccugugagaggauuauaacugguuuuaggaguacuuuagcacauaggugaacauacauaggauguauaagaacaagugccgcucucagagaggugagcuaggagggccgagaguucuccguggcuguucauugugucucuagaaugcugauauccuuguccucacaggguacucuuaaggcuguugcugaaggacuuuauaggcuuuccugccuguuuggaagcugacauucagagguugaguagccaacccaaggcugugugugcugucugcgagcccacacuccccagugcuuauagcuauguauucacuaagguaucuucugaaauuguucuguaauugcuagaaaccaauccaucucuucuucuguuaggagcccccacgcccucugcauccagcgcccuuaccagaagccccacagccccagcgucugcccccggaagcugccagcacuucucugccucagaaaccacacuugaaguuagcacgaguucagagucagaauggcauuguucugucguggagcguccuggaaguggaccgaagcugugcuacuguugacagcuaccaucucuaugcuuaccacgaggagcccagugccaccgugcccucacaguggaagaagaucggggaagucaaggcccugcccuugcccauggcuugcacucucacgcaguuugugucuggcagcaaguacuacuuugcagugcgcgccaaggacauuuauggccgcuuugggccuuucugugacccacaguccacggacgugaucucuuccucccagaacaguuagaccuuggagucguuuagcuucuacuuuugaaaguuucacaucuugggcuuguuuuuaaucuugugcaugaaauccacuguaaaaauccaccuugugcaagaucucccggacaugugacuguauacacuacguuuguuuauaaccggaagcaaaauaaauucagcccauaaagcaagccuucccugaacaauucaaacuucgggguuuugaaauguauauuuauuccuugcuuuuugguuuugaguuuugaaacuggggaauauguauggguguuuguguguuuucuucuuuuguuuugaauuuuuaaauuucuaguuguguguguaucacagugcgaucuccuguuuuccucucaaauuuaccucucuuccagaaggaaguauauugcugagcgaaucugaggugcagagcaggugugauucugccuccagaggaggcuagaaggucaaagaaucuaaauaaaacccgaaggaaggaaggaaggaaggaaggaaggaaggaaggaaagaaggaaggaaggaaggaaggaaggaaggaaggaaggaaggaaggaaggaaggaaggaaggaaggaaggaaggaaggaaggaagggaaagaaaaguauuuagcuuaaaguagaugaauuggagcagaggagauauucccucuguguauucuuugauuucuucugaguugcugacgaggugaacaguggccucaccccgaguuccuaaucuggcuucuccuuuuguguuugugccuuaacagaauccacagaccacguccauugugguaaauuccucuuucagcuucuauugggucuucauugccaccaaaaaccccacacccuuuaagcauuuuagaagcaaacugugaacauguguucucuuccuccgugacaucucucaguaaguugugacuuacuguuauguuuuaagaacauauuuuuauuuuugcccaucuuuuaacucugcauaaaauaggccauauuguuuaagaacaauuuucuuuaagccuguuuaauagccauguuacauugcuaaagaaucggaagggaguccugguucaucucagcacucaugggauagaguccuuucaaaggcagugcacgucagacuccaugaaagaccggggcgaagcacagucuccucagauucucaggaggucguuccugcuuuagucugaacgguuucgguggugccaaguggacucugauuucaucagcucuggguagagccuaaacgcuauccucugggucauuccacacugcagguagaucugcuugcuuuacuaguucuuauuccuucaaaauguuagcagacucaggcucagccuugcauuuccaaggcauggcagcugcagggaaucgaaucaggcagguguuuucgagaccugaggagagggccaaguguuuagggaugagugaggccucuggagucugaaggcacuggugagcugucuucccuuacgguauuuuacguccuugcaaagucuaccuuugcaagcugcaccagccguuuuguucacuuguccugguauuaaaagcaggagcuccguucccugugugcauuugccucuaugauggcuuggcuuacagaaggaaucguugaguuauaaagaaauugucuuugcugacuucacggggugguguucugucaucuucggcgugaacuuugguuaaugaaggaagccugcagcuggcagguguaauugcuccugucacucugagaaagaggagagcacgcgagacccacuucccacaaguugagcuuggggagcagucaugcagcuaggaccucacgggcaugggaaacgguugcccaggucacugcaaaggguuuggaaaggaagaaaugauuucuaacuguacaugagcaccucuguaccaggaguguuucugucauguggguacaguguuggucuucuuuucagcaucauuccugucucuaauagaaagugcauauucaaaauggucuucaccagugggucugcucacucgcuacugaaagucucucuagaugaauauguuuguuuauagucaguaauuauuuuauauuuacuaguucuuuuuuaaaaaguuuuccuaguguuaauauaaucaugugaagaaagcccaauggaauucauauuauuuuauuguuuuggcuuuuacuuggguguuuuuuugucaaaggaaaaaaaaaaaaucccaaauaguggcucuagauguagauuuacuguagaaaguaauuacggaaaccuguuuauuccagauuggaaagaagguauagacagaaacgaguugggaagaggaaaugcacuuguggaucggcuccucagcucaccgagcaggacgcgugccucgggcagcaguggugcuggcuucccggagugugcgccgcuuacacgaggcagaaugugggugcugaggggccuuggcuuuuucuuuggcugucuguggggagagugggggacaguuuccacccugggaucucuucucaaaguguuauaaagaagcuccauugucccauuuugggggauucaaguuugcuacauuuuuuagccugacaauacugguaaguguugucuuagugggaguccuggaaacuucuggaaucuguagaugaagcgacagaugcuucucgaguaacuagcagugacagcugucugucacucccucauuugcacuuugucugaguacuuuucacccuguuuuaagugugaguaagccucuuuauguucuggcgaauggcauacagaagcagcuuguuguagcaguucacuuuacacgguggcucugucccuggcuccaggcuccaguccauccuucuacaucugcagagugcuuucuguacugugugaugcaguaugacuuuaugaaaggaacagagcuuucuuccuuggaaauaccuguugggauagcauuugccucacagagcaguguuccccccccccccaccuaugccagauaaaggauacuuuugcaagcgugaggcaucucuucagagcucucuuccaguguuggacagguguucugggggcuugcuccaaucgcuuuaaauauccucccaguugccacuuagugugacauggcagggaugcccauuucuucccuggugucucccaguacugucugauuuagaaugcucuguguggcauccucucuugacaggcugugauuucaccccguagguaccacaaagaaagccuuucaaguguucuccugacuccguaggccauuuccguauccucaauauggucaaauuuucccacuucccagugauuggguggccugguuggcucucauggaacuacacauguccuugugcuauaggcaauaacuguguaaucaugugugagucugucuuccuuaaucauuuucagggcaaauggcuuuaaaaaaauauuuaagggacacauaaagauuagagcaauuaugagggguuuguuggagcaggagacuaauuuguaaaacucaucgccuugagucagcagagagggaggaggugaagucacugcucccaucugccaaugacugucauguuugagcuuuuguuuuguguuuucuauguuagccuuacucugaauaccuaccuaucauuuaaauauuuaaauguauuuucucucccuucuucuuuuuguaaauaagggaacaaagcaaucaaacaccuucugggggauccuagcuugaggauuuuaucaaccauuucaaauguaaaugugaaaaucagucccuguaggaaacucgcauccgaauuucuguuuguugcaguugaaaauguaaauaagaugcuguaagacccuccuuaaggucuaaugcuaacugggcaguagcagguugguugcccuauuuuuauuagguuuugaagguuuucauuuucuuucuuuccuaaauguacaguagaaugguguccguguguaagugucgacuguagugggguuuguccagcaagccugaacuuuauacuuugaaauaaaugacugaguuuuuaacauucugaguacccugacucauuccaagaguucucaguccuuguguuucuuuaaaaacucccacuuccaucacaaaaaccccuugcucccuguucagugccuuguucagcaguucccucccugguacuccacccagauguugugcccuggcuuugggaaaguaggaguuacacagaacugcuacuugguuagau

SEQ ID NO: 3452 - RNA, 2994 nt, Mus musculus
uaugguucuugggagacagcagagcacaaagagccaggggguggagucuagagcuccgcccacuccuugcuguuuucaaucagguccgcucccaggaaauauaagcucuugcucggcggcggauuacuguaguuucuccugucucuuuauuagguuguuuacuaauaugucaggacgaggaaaaggcggcaagggucuggggaaagguggcgccaagcgacaccgcaagguucuccgcgacaacauccagggcauuaccaagcccgcuauccggcgguuggcucggcguggcggcgugaagcgcaucucgggucucaucuacgaggagacucgcgguguccucaagguuuuccuugagaaugugauccgcgacgccgucaccuacaccgagcacgccaagcgcaagacgguuacggcuauggacgugguguacgcgcucaagcgccagggccgcacucuguacggcuucggcggcuaagcgagcccuccugugccuaggccguucccuuggccggcuucccccauccacaaaggcccuuuucagggcccacaaagcaucagaaaggagcuguggacauuuguaguucucacuaguuaugagcgucucauuacuuuuuguauuugguaugcuuugucuuguaugcaaauugagcugccugggugcacuuuuucauuggaggacuugggcugguggccccgccuaccgccugggaccugcucagaaugcuugcggaguggucugcgugaaugaguuuuuuuaggugucuguugaguugacagccccagagugcuagggugcagccucugcggacgcucuaaaaaggggaaaaaagcuccuguagagacaguggaccugaaugagggcagguguggaggcuuggaaccccacaauaaagucacccuguagcuuaaacuuggcuuucucagcuguagcuguuucucugccuuaagcacguggguuugggggaagaggagcacucggaugucuaccauuuaguucaggcugguauaagucuuucggugguccuucuguuucagcuuccacagaccauaugugucucauuuaagucuucagaguagguuagucacagcccuugcugcuccuucaaaguacuuguauucgaugcuccauacccagauggguuuaacucuggauccaggaagucgcuuccuuaggccccuggacucaggucugcuuaccggcuuucuguacacauuacucaaaacgguaguuuuguuuuucagaucucuagguuuuuacaucugauguuuacgggucuucucacuggcugaagaaauaggagacuguuccuacaguuccuggagcaggaaccuggcauuucauuaagauaugguuaucucguguucaaugcuuucuguguggcagaaacuuggugcggucuuucagcagauuuauuuuaaguguugauagugaguacagcuguggaugagacaacgaaggcuaaaauuuuggagccuagauuugaacucugcucugugcgauuuuacacaaccucguuuuaugugccacugguguuuuuguuuguuuguuuguuuuguuuuguuuuguuuuuuguuuuugcgagagucuucucugccccugugggcugacacuucacuucuagagucugagcauacauaacacugauaccauuagucuagugaacucauuuucuuaaagcaagugaaaaaugagauguuuauuuuucugucuugagaaauauuucaguuacaguuauaugguuuuuauuuucuuauaaagucacauguucuaucaaacuaugaaacacaaaauguaauaauaaugauuaucaccccucuuuuaaucugaguuuugauuauuugagauaaucaaacaucuauaacuauuacuagcaaaaagaaaugaaacaaaaaaaugaaacuuaaauaucauuuauuauuacacaaauaacaacagcaacaaaaguauuugugcauucacuguggaaaucauuucucucaaaaggcuuaaauuagaaacugccaugucaccugcccggauggaaaguuacuuagugguaagaaaaacagaaaucuuacacugacaagaugauggacgggacagaaaucacuauauuaagcaaaauugugugggaagccgcccucacauuugccauuauaagauggcgcugacagcuguguucuaagugguaaacauaaucugcacacgugcaggggcaguuuucccgccauguguucugccuuucucgugaugacaacugggccgaugggcugcagccaaucagggaguaauacguccuaggcggaggauaauucuccuuaaaagggacgggguuuugccauucuuguucuuucucuugcuuucuuguucuuguucuuuuucuugcucuuguucuuuuucuuucucuugcuuucuuguucuuuuucucucucuugcuuucuuguucuuucucuugcuuucuuguucuuguucuuuuucuugcucuugcuuuuucucucucuuguucuugcuuuuucucucucuuguucuugcuuuuucucucucuuguucuugcuuuuucucucucuuguucuugcuuuuucucucucuuguucuugcuuuuucucucucuuguucuugcuuuuucucucucuuguucuugcuuuuucucucucuuguucuugcuuuuucucucucuugcuuucuuguucuuuuucuuucucucucuugcucucuugcacucuggcuccugaagauguaagcaauaaaguuuugccgcagaagauuccgguuuguugcgucuuuccuggccggucgcgaacgcguguaagaaaauuggacucugaaagauuaaaaaaacaaaaagcaaaagaaauguguuuucuucgauguagaguugugugugugugcauguguugugugugugugcauguguugugugugccuguguugugugugcauguguugugugugcauguguaugugagucaugaaacuacaaagaagaugcuagaggagaugaaauaaauaca

SEQ ID NO: 3453 - RNA, 1833 nt, Mus musculus
acagauuuguaauauauucuuuauuuguccuuuuugcugucuucagaaaccaugggggggggaccacguguucgggacagugagaccuagcuggccucauucacagcuguacccucaguuacuagcacgugguguagacgucauaccaauacugggaaugaaauaaauuucgaggggaaauacugcaaaugaagaggaagacuugaacucugacucccccccggggguggaggggaagaacccagagugaaaccuccguagcaugggauguuuuguggcuccugcuaacagaaugaugguuacugagugagcaggaaacggaaugaccaaggcaagaaucgcauuuccagggcccugggguuuggcucuccgcguuacguuaacucacacgacccuuuccuuccuugaggcgccaucacccaacucaacaguuacggaaaagaagaaaccugaucccaggaaagcuaacagucaccccuaaaaaaaaaaaaaaaaaaucgguuuugcuuuuaaguaaaaucaggcugauucucagaaucagugcuggauaagaggcugccaugcagcuaaaacucgaggggagacagaaacauauuuugagacacggucuaauguaguucagaaacggccacaaacucgcuaucuagccacgaaaggcguucuacuucccaaaugcagggaugagggguaacaccaccgcaagcaccaagagaagaucauuuuaggagcugcuaaacauacacuacuuaagaccgagggccccgcuguuacgcaacaccauccagagcgcaaacuucgugacucacuuccguauugcacaaguuacuucauuauaaagaauauugaacacaagugugcaaugugaagauggcuggcauucagaucacgaauacguaacaucuauuagcuuaaauacuaccauaaauaacuagcacccaccaaggaucccaaguuccugucuuuuccaaauggcuaggguacauauagcucaaccuuccuauguaugacaagcgaggcaacuucuuguucacagcucgcaacaccuucccuaccacuuuucccuaagacuggggaguuaggcaaagccaauuccagaguagccucugggcacuagguccgcuucuccugcccacggugaugcgacggggcucucccaauccacccgcuggguuccuccggcucgcacauggccacacagguggccugcgucacgcucaaaguuggaacucguccccacccaacacccccucggucccgcgacuacacagcucucuagauuacucgcuuuucaccgacuuuauuggcugcggacuguggcgggcgggcucugcacccgucugucggguucacuugcucuucaccuucuggcucuccgucuucuugggcagcagcacggccuggauauugggcaggacgccgcccugcgcgauggucacacggcccagcagcuuguugagcuccucgucguugcggauggccagcugcaggugacgagggaugaugcgcgucuucuuguugucccucgccgcguugcccgccagcuccaggaucucggccgucagguacuccagcaccgccgccagguacacgggcgcucccgcgcccacgcgcuccgcguaguugcccuuccgcagcagccggugaacgcggcccacggggaacugcaggcccgcgcgcgacgagcgcgacuuggccuuggcgcgcaccuuaccgcccugcuugccucgcccggacaugcucgaccccgcgccuggaacuccaacaccggcucgcucaguuccgggacgacgcgcgccaccccggaacugccucgccaaacugcagccgcugccg

SEQ ID NO: 3454 - RNA, 14696 nt, Mus musculus
agaagguaucuugguauggaacauuuuauuuguccaugaaacacucaaaagaguuuagcuugugggaaguaacuuuaaucccagaauuguauauuuucuucccacauauccuguuuugaauuaggaaaugauacuguaauccauuucacuacaaggaaaauauuacaaaauauuuacaggaaaauauuaaaaauaacucaaacacaaaagucaagaugaaauaaacuuuuuuccuccagaauucucuacucuagugcccacggcacaugagucaaaaacaaguaacuaagaccucgcugacagaauucccaaaauggagagaggaagagagggaggagauggugaugucacagggagcagggguuagcagcagugcuucacauccuggucuauuguaaagaaacaccuugugcagggaucccagcaggcaaacaugaggaggcuccuggaacuggacuuggaaaacaccugacaguggacauugcucuucacuguaauaagagccucuuguuccacaaaccaguacucugaacagaagccuguccuggcaggaggcccugucacagcagcccuuccaucucuuucauaaaggcuucauaaacaucguccuuaguuuguacugagacagcaacugaaggaccagaucucggggcugcuuuggcaacaggcacagcagagucauccucugaccuucuuuggggaacagcaguagcccccuuauucucucggcguacccucagugcagugggcacaaaccgugugaccucugccuugggauuggugaucuggggcuuggcacugauggucgcuguggcuuucuucucgaugguggcggcacuugcaucauccgccuucggucgcugaaugaggcuggguggggcacucaacaccccuggguugggcaagggagcuggugggaaaaggccaggcggggcagguccaagaggaggaaccaagggugggcgcaucaugccaggacgaggaggagggauaccuaaaggaagaggagagaggaugaguacaagaauuggcgacauuuaacugccacuaaggauguuuagacaugggcuacagggauggcucagugguuaagagcacuggcugcucuucugaagguugauucccagcaaccacguggugacucgcaaccaucuguaaugggaccucuucugcugugucaagacagugacaguguacucacauauacauaaaauaaauaaacaaaucuuuuaaaaaaaggaaguuuagggggcuggugagauggcucaguggguaagagcacccgacugcucuuccgaaggucaggaguucaaauccuaguaaccacaugguggcucacaaccauccguaaugagaucugacucccucuucuggagggucugaggacagacaucuacaguguacuuacaauaaauaaauaaauaaauaaauaaauaaauaaauaaauaaauaaauaaauaaauaaauaaauaaaucuuuaaaaaaaaaaaggaaguuuagacauaggcuaagacugcuuuuuaggcaaguuauuuacaggaauuaaauugaacucacacaaccugcuaugugaaaggcagaaauauauucugauagaaagaaacauaauacuuugaaguuacaucugccuuuagucuugaucccugaacucaggucccaguugaaaacuguaccaucaagcugacaaugccaacugguggcagaugcaguuuccaaucuggaagguccaggaugcuauccuauccuguccuggcugucuggugugaaguuauuaagaucaaggggcagucgauuccugaguacuaguuaguuucuaccacguucacacaggggacagggaaggauucuguccugcucagucacuggaaaugggcagacuauggucagucuuuucaggguuacguaauucugacagcugcaacucauacauaucccgcaucagauugugguuucuucaaaugccacguaagaaucaaaccugcauccagucagaacugauuacguaaacucaguuuuccuacacaaaaccaagacaaagacaaagccccagcuguuguguuuuaaaagcaaucuucggacacaguagaacauucagugugcuuagccaaaaaaucccauuaugacauuugcaggacuaacucggacaauggguagagaggagggaggcucucuugugaucuaacuugaagaugguaauuguguagagcauggggcgcagcugugccuguucucacacagcucagacagagaaccugcucacuguugccagccucaagggaugaguggaaagcaacggaaaggcucgugcagaacacacuuuccugcagacccucugcuagauguccucagagacccaccgagcguacagccaugccuagcucuugucacacugaaaaacuuuaccuggaggugcaggaggagguagccuugguggggguccccgaggaggggguccagggggcagaccuggaggugggccugggggagggccaggaggucggccugguggugguccuggagguaaaagucgugguaaaggcccucggauuccuggcauuccagguggucucaggaauggaggagccccugaaagaagaaaaccaaugucagucagauaaauauuugugguauaaaagcgacucacauaaucauuuuauucagaagugagauggcauuuaaauaaaaagcaauggaaauaaaacucauucaacauauauuugagcucuauaaaaaggccaucagguccguuauaguucgguccaucugguccuucuaggucccagcugugguacgugagacuguauuaagcaacaccaaugcagggcugggcuagucugucacaauaaaguacuaaacaaaguacaacuaugcacaaguguccagcuuacaaaaccagaaauaagagauccuuaagaagaggcgacuguaagaacuccgagcugcuaacgaugcucacagacuggaagggucuuccuucccuuggaagccucaaccgaaagccucagugcugacugacgacacacauuguucugaaggaucccucaccccggcucagagcacgcgcuccucgccccccucaccccggcucagagcacgcgcuccucgccccccucacccuggcucagagcucgcgcuccucgccccccucacuccggcucagagcacgcgcuccucgccccccucacccuggcucagagcacgcgcuccucgccccccucaccccggcucagagcacgcgcuccucgccccccucacuccggcucagagcucgcgcuccucgcccugggggugcuuaccuggaggcggcccaggaggaaggccuguaggugguccaggaggccguaaggguggggcagguggugguccaagagguggugguccuggcaugggaggggcuuguaucugagaagcaggagcagacuguggaggagccugcugcugggaagaggcugcagccgugcugucagaguggccaucgucuuuaugcugcuucugcgacugcuucucggcuucagaaucauccgagucgucggcauccuccuccucugaaaauuccuccacuucccguccuuccucagggauuuccugaccugaaaaauggaaaaauagcugauuucuguuuuaccgcuuggagaacagcaguggccaagaguacaccacagcugggugugguggcacaugccuuuaauccagcacuugggacaagugcaagaugaccugacuucacagucggcuuagucuacauaguaaguuccaggacagcaggguuacacagguagacccugucucccaaaaccaaauaaauaaauaaguaaauaaaaauaagaaaauuuauucuuaaaaaaucaacaauccaagucuuuuuaccgacuauugaaauacacaacggugcaucuuuaacuaguacagcaguauaaaucccaggcugucagacaagacagacuuggaauuaaauagcacucagggcugcaagagggcuugcuaaugagccugacaaccagagcucaauuccugagacccagcagcagccacagaaaagcugacucccacaggcuccauaugccagcucaagagcagaugcugcacagccucccagaacgaguugucucagcggcucacuagccccaaaacucugggcaccccaccaaauggcuccauaucuuaaguuucacagaauacagauuccuggcuuauuucagagcugcugacuauaaauggaagacuauaugcuaagcaaguggcacaaggaaaugcuagagauccauuccuucuugcuucuaaccugccauucgcagcaucauggcuugaagaggagucagcuccuucauguuuuucuucuucuuccuugauuucccaggcauaucagcaaaucugacgcuuagaccuaaacagucaagaaaggaugaaacgggaaagaaucaucaaauguuguaaaaauggucaccauagagcagacgcuguaaguacuaugaaugacuguaacccauuacacgauacaaggcagauguacagggacauuacaggaaaucagcguugugcuaauugguugcuuaugaaauauacugcauuaacuuaaaacuuaauguucagaaaauguuaggauacuuaagaaguauauaaacugaauuagauaauucaauuuuaagcccuaaacauaaaagcugaaacgguaaagauguaucuuaaagcaacaauuuucuuuagcaauucagcaaaacaguaagucacagaaaagaugaaagcugaccaacucaggaaaccagcauacccuauuaaccaacauaaaauauaacacaacugagucugacagugcuggguaaggaaaaucgaucauagcaugcagggugcaccaaaaguacccaaugguuuacacuagaaaauuaguaaucuaaucaugacaaaaggccccauaaaaggugggaaaaucuuaguaauacucuaacaggugauuaaagauuaugaucgguccccaacaccacuuccacuacagaaucuuucaguaacccugacagauacugcacuucugaucuggugucugacaucuuagccaacacuuaaggaagggaauauuuauuucuauguggguucagcuuuaguguaucuuggacuuuuacugcccagaaaaaugccuggcuaugguaaaggcaguagcagaugagaggacgugcagcugggccagccaucugagguccacacacacuggggaacacaacguucaguaggaagcagcagguggacuucagucaguucaaggccagucaguaaguccugugcuagccaaggcuacacagaagacccugucccagcgccaccccccaggaccucagcagcagcuggcagccgcagaguagagagaggaugcagucuuacaggggaguccugcacuuggaguucuaccccacucuccuuucuaagaccaguuccaacuuaugagucuucuauaauuuuccaagaucaggcuugcuccuacaccaauuuaugauaguuuuuugauaagcuuuucuuucauucguaaucaugauuaaggagcacuaaugcauuccagagggcucuggacaacccagcucugagggaucuagugccguguagucuccaaggcacacgcaaguguaggaggcacacagacacacacaauuaaaaaaaaaagagagucacuugcugaucuuauaaauaaaaccacaguauacagaugccguccuggagacuacagcuacagccccuaagaagcuccccggcuacuaggcucugacacacucagugugugcuuggcacugcuuaguacccaaacacagugcuuaaaauuuuugugacaaaacguaacauacagugugcacacaauugaggacacagcagaacugaauauauuuaauauacaucaagucuuaggcuuacuccccagcacuacacacacacacacacacacacacacacacaucuuucugaacggugcuucacagcugacccuuggagaacgguuuguuuacaugcaggccaagugcgcuacacaggugcuuucccaaccagugaccagcuuugaaggaacaggcguaugguucuaaauacaaauacagugcagacauauagaaaaauacacuuuuauacauauacauaguauauaauuauacauguuaauguaauguguguauagacacauauauguauauaaaauauuuaauauauaauauacacacacauauauuauauauaaaauuacaaguauauaugaauuacaaaggucacccaguuuaugaaaggccccaugaagaacagaaaacccagcucccaguguagacacgcacacaagcuuauuuaaaaccaugcauguucuuccuuuccuacugcacguucaucauagaguauauuagcaauuuuugccucaaaguggaauuucuugcauaacuuuuaaaaaacuacauauacuuacucuuuccucacaaacaccuguaagaauaauaugucaaaaccuuucaaacuaucaagacaaauaaauggccagguacgguggcuuauauuuauuucuaacuccacaacuugggaggcugaagcaggagggucaccaugagcucgaggccagccuaauuaacagugauagacacccgucucaaaaccaagccaaaccaaacuggagcuaaaagcugguccugaacuggugagcuggcucaccaaaccuaaucacccaagcugcauccccacccccugugcaguggaucgggaaaaccaacugggacugccacauagaugcucuagcacgcauguacacucgggcgcgcacacacugaaccuaauuaacaaaagccagggcuuucagcaccggggucagcgguguucaucuacgcccggcacauuaacccgcacacaccugacuucuucuccucaguguugucgcgcucacuguccucgcggugcccgaacucauccccgucacucucugcaucugaccugucagugucacuguccucaguacugucaucaugcuuauccugauccauguccucaggauagccgucgucuucacuggugcuggacaugucaucgucaugaccccgcugagcugaugacagaaagagcacgagagucacaugacacgguuggcccucugguauccaaaaauaggcaugccauuuuggcucaacauuacuugcaaaacauuucuauaugcaaugccagcuaccauguauuaugaugacauuugcguuggguaauaguuuuaaauacuuuuuuguuuucuuguaagaagugcaaacacacuguauuagaaacaauuguguaaagucucacacacagucagugacucuugucagcgcugaugaaacugagaagaccucuuccugucuuaugggaacugcagcaacauucuaucuaaggugcuuucaucaggcagaugugcuaaauuauccacagggacacacagcagaagagcacagcauccucauggcguuccuguguucuccguguagcaaacguuaacuauggucagcauggaagcaauacugagaagggcacgggaggaaaccccugccccugccuaccaagcucuggacuauacagcauguccucaucucgccuccgagggggaagaucuagagcgaagcccacuuuccggccguacaucugcagaaccugaggaggaggggggccagguggagggccgggcgguuuucugccagggggcaagcggggaacaccaugucccaggagaggaaggauagacacggcccgagcuggaggccuguggagggggagaaggacaguggcgcugaguggcaggaaccuucuccaggcucucaugucccguccgcucagccacagcaccccgugcugcugcugugcuagccgggccugcuccugcaguccacccuccauuauguaaggcuuccuuacccauacgcugagguuuucuucaggauggaggggggcugugcaccaggaagaggaauguccuggaucaagauguuggaaggagcaugcggcaugucuggcaaagggaugcucucuacuuccacaugcugagcauucugaaacauacagaaacccaguuguauggugcugagccauucaacuccuaggaccaaagucuucggaauuuguuucccaacuaacacuaagaccaugaaaaguggcucaaagccucaagccaacacuucugaauugaaagaauauuaguuuuucuuaaagaacccaaauacagcucauccuuucuccuaucagcucucguuuugaguauaauuugaaccgguugugguuuugaagaaauccaacuguucaaagcaguagcagggcugcccuacuccucgggacggcaaugcacagccucuaaagcccccgccuuucuggaauucuguuuugcgguguuggaaacaccgccuauuuuacaaauaccauuucauuuggguuucugccaugguaagggaaaauuuacagcaaacucgaaaagcucucagaggcggacaucuuucaguccuugucaaccaacugccaccgucuguccgaggcagucagugcuaacaggucaguuccugccgguuuggaaguggaucccuacagagcauuaacaggaaaaacagcagcaccagucugagccucccuccuccguguucuuggacagucagucuccaguccuaggcaagcauuagggggugcaccaccaugucuagcucacagucuccaguccuaggcaagcauuaggggguacaccacuaugucuagcucacagucuccaguccuaggcaagcauuagggggugcaccaccaugucuagcucacagucuccaguccuaggcaagcauuaggggguacaccaccaugucuagcucacagucuccaguccuaggcaagcauuagggggugcaccacuaugucuagcucacgcucuuacucauguuuaccauguguuguuucuacuaucaacagauuagccuaaaaaacaaaccaccauucugaguaguauuugcuugugaaauacauuggguugaugaucugugauccugcuaaggacuccugggcuguuuccagucucuggcuuuuacuguuacagacaauuucucuaaguacaaaggacggacucugccagagcaucaggcgcacacuuaguuuggaaaagaaccaccuguaacgccgccaggccucucccgcccagagccgcucaccuuaacagcaucaaaguacuggcucagcugagcucucuucuguucauauuccacuuccagcuuucucaguucuuuguaaauaucuggguuuucuuuuucauaaaggcguagaaugcguucaaagguuucccgcagcuuuuuucgcuugucuuucaguacuuucucauucaacuguggcugcugcacuggguuaaacucuaggaggagagcagauuuuagaguuguaaaugaggcgucccgucagaaaaaccucuuucccggcuauauccacaucccauauuucauuuuugaguccuaaggggcuauucuccuaguccugcccagucagaucguucccagaagugacccacaggcuaguacuggagcaccuuagcuacagccaagcccucucuggaacugucaaucaagggcaacuuucccccagcagccuugucuccagcugcacaagcugcccaagcucuucacuagcacugugauggagacugcagcacacacacagucuuagggagauuucuagcuuucuccugcaggcagcuuuauuuaggggugucucaacuauggaaaccaggauauacuuuucuauuuuaauuaguuugaaugaaaauuaggccccuggugauuuaggguucuuucuucuuuuucuuaaagcacaaacugaacuaauucuuccccaaaccguccuacuaacuugaugauuuagucaaaccuacaagguauuauugcugcuucauucccaguaaauaaaaauucuuggguguauaucuuuucuuuuuuuuuuaaauuaauauuuuuuauuacauauuuuccucaauuacauuuccaaugcuauaccaaaagucccccauacccccccccacuucccuacccacccauucccauuuuuuuggcccuggcguuccccuguacuggggcauauacaguuugcguguccaaugggccucucuuuccagugauggccaacuaggccaucuuuugauacauaugcagcuagagucaagagcuccgggguacugguuaguucauaauguuguuccaccuauaugguugcagaucccuuuagcuccuuggguacuuucucuagcuccuccauugggagcccugugauccauccaauagcugacugugagcauccacuucuguguuugcuaggcccuggcauggucucacaagagacagcuacaucuggguccuuucgauaaaaucuugcuaguguaugcaaugguguauaucuuuucuuauuccacuaacauaaauguaaagugaaaauaucauuaaaucggaaaaauuauaaagugaguuggccagacaagguuuuguuagcuaguuacaguaauuagcuccuacuaaaugauggugcccucuucuagauuaugaggucucuagcuugcaacagucuaucuuucuuuccauagcauuaaaacaaagugccguaccgauggcagccaucaggguuuuccauuuccuaggcugugcugccucuauacacagcagaccaugacagccuuugcuaagucugccgcuuuccaauacucuuacccauuucauccaauuucuccaugucccggauaauuuguuuggggucuuucaucuucaaaacugcagcccggaccaucaugcgcuguuuuuuguucuuuggaaaacaagagcgaggaagacuacuaagaaagaagcgggcacuccggacauuuuaccuuccuuugccucaagagucuaagaagaaacucaaauuucuccuugguuucuaaucacauguuuaaaccucuagaaacagcugagaauucuucucaguaauguuuaaacuucagugaaaaugaugcacuuuuaaguauuuuuuucuacccaguuauauuguuaccaacuacuuaacaggaaaacuuguuuaaaagggggaggggguaggaauauaguuaaauaaaaaaauacuaugcuagauagggaaaauuugaauuuuggcuaaauaauaaaccaagagcaaaccaacagagauuauagaagauucuucagagagucacacgugauaccaaaugcuccugcuugagcacucugccaaaacugaacaccuaccuacacaugcaaagacacccagcaacgcaagcacugucagucacucaguagccuuaacaaagcaguuacaucuugguaaauaguaaaauaauuaguaugucaagacagggucugacugauguaggccaggcuagcuuucaacuccugauacuuuauccugaucguuuuaucccaagugcuaggaggaacuacaggcaugaauuaccacacucagcuuaagacuuauuuucaagucauucuaacaacuuaauuuuacuuaucaguguguguuugugugaaugcaugggcacgugucuauggauucugguggcaaucagaggacgguguuggauuuccgggagauggacguacagguggcuaugagucacccaaccuggacgcugggcagaaaccucagcuccucuggaagagcauaaaugugcugcuaacucccgagccuucacuucagcccccaaagcauuaacuuaaugaggaaagagaaucaaauagacaaugucguacaagucaccaugaaucaaaucuccagaguuaugucaguuuuuuaccagucaauuuucuggcuuucaucagcaguauagcauaaagcgucuuuccuggcaauauaauuugaaauuucacaaauguuagaacaauucacagaauguuucuaaauucguaccuuuuucaguucucuuuuucgggcuuccuuuccuaaggagagaggaagagaggccauaacucacacuuccaucaccaacauuacuaugagcuacuacaacuguuaacagugucggugaauggaacaaacauggcuuugacccacuagggaacuuagugcuuccaacccucucaacccaaaaugccaagauguguucuuuacagaaaaauaacugaaccacaaggaagaaaagggauucucaaaucacacacuuaaaaacucauuuguuaaaaauucuaacauaaaaaagacuuaauuuucuccugcuagccagucaaguaugaggagaaauguguuaagcagcuuacacucucaacauucuaaccaugaguccauuuuaagaauucuacaugaccucacacaccccacucuaccaacgcugaacuuaggccaccaugaaagagucugccaguuuuaacccuucuacuucuuccuuccguacuuacgggcuuggucugugggguucauaaacuucccacucuugguggaggauguugaucuucgucccauggugacaauuuauaugauuuacuucuucauuaaaaaaaaaaaaaacuggaaagaaaagauauaaagaacucaguuuugcuguauguguaaaaagacuuccuuuuacgaauuugcaucaauuucuguaaagaaauaucccuuugguucucuacuuguaagaccgugcucuuuaauuuugaaugaagcauccaagaaauuauuucuuuaccuuucuuuuuuuuuuuuuuuuuuuuuuuuuucgagacaggguuucucuguauagcuagcccuggcuguccuggaacucacucuguagaccaggcuggccucgaacucagaaauccgccugccucugccucccaagugcugggauuaaaggcgugcgccaccacgcccggcuuucuuuaccuuucuugaccacaaagaaaaggcuaguaucuguacuagucaacacagugagaauaucauuaacuacucaaaaguuuaacccuuuccuauggauuauauagugcuguuaacugaauaaagaaaucaacaagaacuuugcacuuauaaugcuauuguuuggaauauagacugagccauaugagacgaucucaaaacaaaccaaaaccaauugagaaauauucuaacaaugcaaugcaaacccugaggacaucuuuccgaccuguauaaggggauaugaaacaggaguggagauaaugaaucuggguuaaagacaaauacaugcucuuuacuuucuccuuagacugcucauuccacacgccagauggcaaaaugcaauccauucaaacauauuuaucuugauuuaauaccaaaucaaaugauuuaugacucucaaacaaaagaaauaaaaaaugaaguauuagaacuccucaaacuuaacauuaaaguauauucuuacuagcacauaugacuccugauuuauguauuuugagggaauuaaaagugguagucacgguagggaaauauuuuaaggccaggcuuucauuauuaucacuucuuucucuuccauuccaaaugaaugaaacuuccaaaaauuagccuugcccauaguaaaaaaaggaacaaauauuuccuguucaaagugugcgacacuuuccuacaggcuacaucuccuguggcucccccuuuaagcauuaaacaaaucuacuuucuuucuacauuaggaaagggaagaucccgagguaaauuugagacucuaauucccuuggcuccuuaggugggacucuguaaguuguuuuaguuaaugcuuuuuuucaucaagcguucagcuggccggcucccugcugcuucccagauauuucagaacugaucggugucgauuaugucauuacagauguuucucuaucagaaagcagaaggggcaggaguuugggaagaagggaagagaaggguacugacuauagggaacuacaaaaaggcacggauacaacaaauucuauuuuugaucuuuucuuuaguguuucccuucuuaaaccagccucgggcucucguuuugacgccaucccaucacacacaccuaaaaaccaaucagcuacgagucaaggagaauuuuuacaagaccauagugccucugccugcaaacguuggcagagacaaggucaaaagaccaugggaacccaggcagcacaaacgcaacccgaccgguccgguccgguccggguccacuccaggaggccucacagcaacugccgaaaccauagcgacgguugauagcgacucgagcggcuagacgucagcccgccgccaccggucgccgcacucgggcggugggucugacccggcgggagaucccgcccgagaacccgucggacgcagugccaggccggccccgagcccugaaacccgaggcucccgccaccccgggcccagcggaggaagagcgcggccucugggccugguguuucagagaaggcuucgcaggccccggggagggucgcggaaaacggagcaccgaguccccacgcacucacacgacugcgaggcucccgggacggcgagagcagcuagcgggcggucccggaggacucucugcgaaggggccuucaccucugccccucggucaaccacccgggaaccgccaucuugaaaccucgcgccccuccgccagcucacgucacuuccuguucccgcuggccgcgaucucaccgcguugccaggcacugggcccauagagcgaauacaacaacuucagagccagagguacuuccgcucucauucacuauccgauuggauaacuauaggccaagagacccgccucauuccagaguauuguagauugacacuaauauaaccca

SEQ ID NO: 3455 - RNA, 13039 nt, Mus musculus
uaacaaagcagaacuacaggugaguggcuugccaagugaugacucugcccuuggguucuaacauaccaaauauacagcaucaauaaaauguacacgguaccaugaaaaauucgagaacucaagcugcuuuucauucagaaaggaacauguuguccucuacuugcccuggaccugcguaaguacaaagauauccccuuccauggucuugauggauuucuggaggaccuguaacguuaucuccauacucuugacaaacuguuccagcucaucugcggcugcuucuacgggcgugugggcauucucaggacuuagcacaucuugcagcuuccucaagguuuccucuguaguggcuuugggacauucuggacucuuguuuuucucagaugugguggcaucugagguggcaucugacugcucuuuggucuccucucuauagaggucacuuaaucgaagacccaugauggggaacugcaucaggagugagagagaaguuucuagauucacaagcacaugacuggucuucaggaccaaggcagcaccugaugucuggauguuucugagcauaucuuccgcggugugguguggagcaaugguggcgcacuucuccacugcagaggucauagcagucagcaccuuagagcacaacggcuccuucugcauuuguuugugcuuuccauccaccaucaguugcaucucuuugaaauuucugaucauuuguucaaagaaaucuuuaaugcagcucucuucguucagauucaugggaaggaucugagucuucaucgugagguuaaacagcucaacgaaccgauuuaugaaggagaccaggucucguauguggaagaagaauaguuuggcagcuuggaucagucucucuuuauccuuuucugacucagaagacauuucuccaacaaacaacuuucaacccuguuaagcaaagcagaauccaaaugaaaacuagaacuggccaugaagagacgggaaggaugcuauaaacacgccaagcuaagucuugacaagggugacaaaguacauaugacucugggcuuuaaucgaaacaggaacagaaauaaagagaaggauaggauaguaaacgcuccugacugucugccauauacaugcuagguagcuggcugggcauuagcagucuuggaggccacugaaaaccaauccucccucccagucaguggugcaucccaguuuuaguuucccugguaacgcaccaauuuuacgaaaggaaaaauaucacaguuggaaaugccacagaagagggaggaaacaucgaaacugcacuuuaagauccgaacccaugaaaggaggagggcuguguagaacggcuuugcuggugccucauaagagaaggcuauuucaagcugggcauaguggugcaugccuuuaaucccagcagaggugggugggucucugugaguuccgggccagccuggucuacauauugaguuccacgucaaccagggcuaucuagagauaaccaugucucacaaaaagaaacaugggggagaggguaauuucuuucugguaugguaguuuauagacuuuuuuucuauuuuucuugaauuaguuugaucuacugugcuuuaagacuucggggcaaaagaacgaaaugugagcucuacgucuggcccuggacuacaacaggucucuaaacugccgugagaacauaacuuauaaagauguacuuuugucuuuccuuaagaaguaagccacugggcucgucaaucgcuuagauaggacuccucaaagcuggaaccucaagaaauaagccacacuaacagucuuacuacgaagaugucccagcccugaggagauggcugagcgagggaaauuauuuggcacacacaagacuggugauaucaguuugacccucgucccccagaacccagggcagaaggagagacagacuccuggaaguugucuucugaccuccccauaugguagugcaugcacccgcacuaauaagaagaauagaaguaaaacaacucuuuaaaaauaaaaacaugagaggaauacuugauauuuacugauaagagaugcuauugugagaaugaaaccucugcagugggcuacaggucuugaauguuaaaccugcaguguacuuuaggauauguuccuguucuuuccccacuuucucucccccuguucuggauacugaaccagaucuuaauccuguuugucuugacacaugacacucuaagcuuucaauugccuccuccccaguccuccccacucauccucucuacacagaugcucauaaacauauuucuaacucaaaagcaggauccucucucuuccucuuuuccaucaucuccuuuuauuucucuccuguugaugugacacacuucaggggcgaaaccauuugucucagcucacaguucaguguagagcuacuacagacgcaggagcuccacaccccuggccaggguguacccauaaucaugaagcagaaacaaggaaugcaugcaugauuggacucagcucacucucuccacucuuacacaggccaggaucuccucccuaggguaccacccauaguggguggggcuucccacccuaaucaauauaaucaagauaaucccccacagaucuguccaggggaccaucucucaggugauucuagauucugccaaguugacaacaauaaacaucacaucccucuuucuggaagcuggcaagauuuacaacuuguuuucacccuuuccccaccccuuuuauugaacuccaauaaaauuaucuccaauucaauuuccaucuggguuauuuuuaaauuauuuuaucucugaggccaguaacccacaaaaggguucuggcauguuccuugguaacauaugugaucaaaaauuuuguguuauccuaaauauacauucacuuggagaugacaggcaggagcccuaacggagacuaugagacuaacgcaccccuuucuucuucauuccucucucucucucucucucucucucucucucucucucucucucucucucucucucucccucucucucucucucucucucucucucucucuguccuguauaaugccuggagucuggggcuuaguagugugccuagacucccuugaugacauacuaggacaacaggguugugcucaugccaggacaaagcagcacauacugcagugggugccagacaaguccuacaauuagaccgggagguaacucccagauaaauucugcacuuagggccagaggcagcugcauuucacuggaaggccugagccaaauuauaguuguuagaccaacccugugacaagccugaugaauaaaucuguauuccugauucgagcucauuccucagugauaagaacgcucacaaacauguggcucccugaccacuacacacugaggacaaccauguaggcaaccaagauggugguacucacauggcauggccaugguggugcucauaaggauaaugccaccuagggagcugccuccgaucuccacuucuugcagccucuggcuccucuaggaccauuguaguccauccuucccugcacagacaucuaucuguucacucauccuccucccuuuccuuccucgugucaucccugacgucccacugggcacuggaaagagcaggcagaccugacuuggacacagggacugccacagcagcaacagcagcuauugccuguccuguccuguccuguccucacacccagugcaaucucuccaaagacaacccccuuauacuggggcuauggucauggacacauugagacagcugacuuugugacacacgggcucccaaugccugaauguuuaucucaccugcccuacaaagcccaucccuucugugaauggggauuuggaguguggaguccagauaccaaaaagccugggacaggguucaagcugaauacuguccagggucuaaaugccagagaccuugcuaaggaacaaggacaaccugccucugugggggugggaugucacucccucucagaccuucugcacaaaccgguuccauacauucuuaucucugcagugauuucuucugcuuugucacacccuaguguccucaaagcaucccagagaugggcaauacuuucuacuacaguagucccuuggguacuaagacuuuuccuugagccugagaucuaaaggaguauaaggauaaauacccaucuucaguuguaacuuacaaauacagcaucaauagacaugccgggcuggagagauugcucagggguucagaucccugaaugcucuucuggauggccuuguuucaguuacaagcacccacacagcaguucacaauugucuguacccccauuagcaggggauccagugcccuguucugaccucugcaggcuuccguacaugugguauucaccuacacuuaggcucacacauaaauaaauacacauauaauugcacaaauauauuuuuagacaugcaucauuuacauagaagagggaagucucagaggcuuuaggaauagccagacaacaaaggaaugcugagagcugagauggggagagagacuucccagggaggcgaggcugaugaacagccuaugggauauccaauccccacuauggcucagaaaccauaucuauacaagcaaaacuaugaaaugaacaggcuauauuuauauauguaggaguguguguguguaaaacaauuacagcuaaagagaaagaagcaugauuuccagaaagaacaaggagaagugcaugggguggggagggagaggagggagggaacggacaucaggcacagcguccuccggacugguuccccuguuaagaugaugcagugauaaggagcagcacaccuagccugggaggggagcugcugcuuacauuuuggccauauggguuuuguauuuccugagaacugaacaaaaccagcagcagauagaggccacaaugcagaaggagcagaaggaacuguccccagcugaagucaucacugacacugagccagaaggaacuguccccaacugaagagucaucaaugauacugagccggauuuguucagcuaaagaaaagaaaauacaaaaccauuuuggagaguuuuauaaugacuaaguuaauauugcuuaugauuauagcaacagaaacauaugauuauaggaaacagaaguauugugaaaacugagccaggcagaaauggcugugaaccagaugggcagugggacccagcagagagcagaaaaucuccuggcucaucacauuccaccagaagcuuccagaugagcccacgggauaacccuucgacaacacugcugagacacggagagcacacacacuugggaaacccagaaagguaagugauguggagacucagugagcacuagaauacucugaagaacaagccuuaauuacaggcuuugggauaaugccaguugugaguggccauagaccgugucagcuuuguccgaggggcucucagggcaugcuuuggagauucccuccuugaaggcagcagggaaggaagaacucuauugagagcuguaaaacuaagucacugagggagagaggcaaugaacacaugaauguuaggaaggcuggagauggagccaugcuacaugugggaaagugcaaugcgugucuggaagaugcucuguaucuucagugucaugagggacacacauaaauugucaugaaugaauaaagauggcucuuacuugagccaaugaacagcacuugccuguacacgaugaaguuacucauacuuugacacagucugugccucuaagcagccuuuguggggggaaacacaauguuuuucugagaaaugucucaagugcacaacagaauccugugauaaaugcugauggguaacugugacaggcuucauucugcucagaauuaugaagucauucugcucaaaauauuagaggaaauuuagaggaauuuguaucagaaaaaggaccauugcaucaggauucacuaaacacugagcagcaugucuuugauugaacuaagugaagcucgggcuagagagcagcugcucuuuccucugcaaagugucuggccuugccuguauucuguguucacucacaagugcacaccgaggagggagacagcagugcaugagcugagagaacaccucagcucacuguccugugugugugugugugugugugugugugugugugugugugugugugugugugugugugugugugcauguacguaagguaacaccuacuuacuaugugaaagccucagucgauacuuccacggaagcccuggcauacugggcuuacauggaccgugcuucagcccagcuuuagaaaugaucagaacaaggcucauccuaucauucugucacucagaucuacuaugucuuccacuuuacugagauacaaauagcaacagccuaaucaauucaucuuaaaugucuucaguuguauucuuagaaaaacaacucuuuuugaaaugcauccuauguuccccaaguucagcaagaccauagcagacagacaccagcagcauggcauaaaaauuuacugugggugucagcagaaaagcuuuuugaaaugcaauuugaauauuugucaagacgauaaaauauguagucaacaagauggcucaggggguaaacgugugggccaagccugacaaccugaguuugcuuccagaagucacaggguggacugagagaccugacccccacagcugggcuuuacguccaugucacacagcuccuauucuauugccuuucgaccuauuucuucccaggaaagaaugaagaugauggaaaggaaaacaagcuaugcauauaaacauuacaaauacaacacaauuugagguauauugaauuaugauauuuagacugguuuguguaccuaauauacugcuuauaaaauuagaaguauaggaaagucaaugacuuaauauaagaagaaucucauuauugcuacaauuuuauuguuauuacaacguuguaaagauuuucuugcacauagauaaauuuuagauauaaaaacacucaagacagugggacuacagaugucuuucuuccucuguuuaaagguuuauagaucaugguaaugcuguuacauguaagauauuuuaucaggugcuauuuuuaaugucuuaacauuauaaugugagcaucggccaacacacaaaucaccugucacguucuagaaguuuccugcaguccccucaauccuaguuucucucuuuaaguuccuguagcucugggcagagggugcacuguguucucugaaguccccugaaaaguuguauuugaaaaaugacagccaggcagugguggcagaugccuuuaaucccagcacuugggaggcaaugacaggcagauuucuaaguucgaggccagccuggucaacagagugaauuccaggacagccagggcuacacagagagacugucucaaaaaaaaaaaaaaaaaaaaaaaaaaaaaaaaaaaacagaaaaaaaugugacagggaagaacaaagcauaaugauauauacgaaugagagauccaacugaggcacaugacuuggaaugaaaauuguaaauuuuaauuuaaauaaacaauuuaaagaggauaaacaagaccagguaggagagcacaaaccuuuaauccuagcacugagaugcagagacgagaagauuucuaugaguuuaaggccagccuggcuuacaacaagaguucugugccguccaggucaacaacagcagcaauaaugaugauaauaauaauaauaauaauaauaauaauaauaauaauaguuauagauagcugacaaucaguaccccuuccagaaaaccuaaauccccuacacaguaccgugaaacuaucccuaacuuuuagaguaaucacccuuucccuucuucuauauuccuccuuuaauguguuaagagucccagacaugaucagagcugcccuacacgccuaugguguccacugucuccacagcugacauuucugucuacagucuugaauauauauuguuauucugaggacguuuugguuuugaagcaggcucucauuguguugccuuggcuagccuggaacuugcuaugaacuacaggcuggccuugaacucacagagaucugggugccucuuccuccauagugccaggaucaaaggcauaugccaccaugccuggcuggugauggauuauugcacggguguuauuuuuguauauuccuuaauuuaaaaaauaauuuacccagagagguauaaaaugguccuaacauuuagcuccuuuucuaaauuguaaaauuauuuauugggcagggguaaggugguuguuggaggguuccugaauguuguaguaggcauggaagugggggucccaaggagcaaacucagcuuuucaggucugugaagcaaacacugcuaccaacuaggccuccugccagcccuggugugaauauuuuaaauuaucucuaacuuaacucuaacuucuuggaaaauaaucugguggugguagggauugggaaagaaauggcaucaggagcgagucucccaggggcugaggcuguggaaggcuuuccuggcacccaugaaguucuggccuugacccacagcauaaaccaggcaaaaacccagcagaggggugcaggccugcaaucucagcucaccagaagucuaugcugaaggaucagaaaugcauaccuaccuugggcuauaugagauccccucucaaacaagccaacaaaucaaaccugcugaguccccugaggcagucuuuagcuauggccacguugauggcugccuggcuagagucaugaagguacucugagcugauuuccuguuucguuuuucagaggcguacugaaauauggcucagagugacuuccucuacccacaaaacccaaggaggcgacaggaaguaaaccgccuucaccagcagcugcuggacugcuugucugacagcuuccaggucaccaacaagcucacagggguucuuaauacccacuuggguugcaggcuggccuucauugaaaugaaaagcgauggaaccaucaaagaaaacugugacaucauuauccaagccaugacaaaaauccaaaaggaacugcaaaagauugacgaggcacugaaagaccaacuagagccaacccuuuauaggaagcugcaggauauuaaggaaagggagacggagaagauugccaucgugcagaaggucauuucugucauccugggagaagcuacaucugcagccagugcaguggcuguuaaacuggugggcucaagugucacaacuggcauaauuagcaagcuggucucugugcuagcucacaucgggacuucucuccuuggaagcauuggcguugccgugcucagccucgggauagauaugaucauucaagccaucuugggagcaguggagaggacacagcuucaggcagccaucaaaaguuaugagaagcaccuggaggaguucaaggcugccucagcaaaguaccaucaugcuaucacugagguugccacugcugugaagcgccagcuaagaugaacaggcaggugucuacacugggauacuuugugcugcccucucuggcaccaugcuuauuucuuuaggguaauuuuccauuugucuccaacaacguggauacagauaaacaauuuggggugcuugggucuuaggucaacagugaguguccaaaccagcuguaguagacccucaggggauaaagcucuauccaguuuucuuacccuguugucagaaccacugagguguaaaggcaucauagaccagcaggcacaggcuauugcuuccuuguucgcagcaaaugucuucaaauauuccugcuaaauggagagaccauucccauuuccuguuucaaacaucacuuaaugucuaauaagacagacuuaauaacaucugacuagacacagaccugugaccuucaaguaaaacauacauagugcuguuauuuuuacccccagaucaaaaacaguuguuugugaacuggaaaagacugcaaaaucauaucaacauuuucuuccaccagauuaaauacaauugucugccacccggaaaugaaggcagagcaaccucaacaacauuauguuccagaaugaacgaaagccaugcaucugcgagguucuccucaguucaaagcguggcuggauggauugggaaaggaugagauaauaaauguugucuguaaugcagucaauauugaccaccuguuugucaucuaucucuugaguggucaaaguguguggaacauuguaaacaaaacaaggcauaaaaugcagugaucccugcauaaaauauguuagagugaagaaaaaggcucacucccuguuaagaauuuguugauuaaaggaaaguaauuaauuucuauuuuucagggggauaauuuuauuuucaguaccaccaaaaagaggcagcucccucugccccauaaagcauuugcagaccuauguuaauugccuccugaacucaggaaaaggagaggccauggaggccuauugauggaacuuaguuucucuagauacagcauuuguuuucuaaaccuuuaucuaaccauucucacuaagccguuuuuagggucuacuucaaaaaccauuguauguaacaauguugagauaguccugguuauagucguuugguuuuuaacgcaaagacaaaaauaaaucauugguauaaaguauccaguauaucucaggaaaauuuuacaagcagaugaagaauuuuaacuagccacauaacuuuuccaaauguauuaauuucuauguuaucacugguuuuauaaauuaguuucaaaauaucacaauuugugucacuuucuaaauuuauuaccugguuuuuauuuuaugaacuaauaggucuugcuauuacugacacucaaagaguaaucaaaacaagaauuaaugacauucccaggcaucaaggcuucuaacuguaauucaauccaucuaaacaaugagacagagggauagggagaugguggccagcccagauuauuuauugaauacuuauuuuuuuucccacuaagucaaagguaguuuuaguaugguacugauguuacauuguuagggaacacauuuguuuuaauauaaauuguaaauguucuauugguuauuaauucauuguaacauuagugccuaucuacaacauccuaaaaauuaauauacaccucaaucaguucuuucaaaguacuugaugucaaaaauucccuuaggaccuuuucuguuaaggaugcugaaacuaaguugaaaaauaaccaagugugaggguguuuuugguuuuuugauuuguguuuuuuuguuuuugguuuuuuguuguuuuguuuugcuuuuugguuuuuuuucgagacagaccaaguucacacuuuaugaagauuucguuuuaaaugcuuaccuuuaaggggaaaggauggggaggagucuuaaggaauggggauguagaagggaaauauaauagcuauuucugguuaucagcuauaucuagaacaaaccacaauccagaauuggaagguucaccugugauccagaucuugaggcugggaaauacaaguuucugaccuugaucuuggcauggaaaucuugaggcauaguggcuauguauccccaggagaguaagguaagaucucugaguacaaggcccagauccaggcguggcgguacacaccuuuaaucugaaccacaccuucuucuggagaucuauaagacauuggaagauggaaguuuuucucuuccuccucugcuugcauuuacuugccagcccaucaguuggaaucuacuagccuggugggacugagcaacuccuagauccuuggacuucccauucacagcugaccauuguuggggagguggacuacagaccguaagucaucauaacaaagucccuuucuauauagagacuauccacaaguucugugacucuagagaacccucaaaggaagacuucagauaaaucuagagugugcaaugacaucauaaaggaguuuggguugaugcaaaguucauuugaaguguuauguaauaacuucuccucuggaaaaucgacaaauguaccguuucucuuuuaaaauauacauuuucguguagauuuaugagucuccccuaggaacuauuuguucaguucaucacaugcuguagguuuagagggcugauguuugcugagcaccuuagacucggugcccaguguuauuaccuaacuuguuuucuauggaagcauuccugaaaaacagcauccauuuacacacgacaacuaacacagauccaauggccgacacagaagcguacgcauaccgcuaccuaguguguccccagagagaagcaguugcggaaaugcgucagaauucugagaacaauuggccaaucaaauagcagcuuccuuacuuuuuauuucuauuggguuauauuagugucaaucuacaauacucuggaaugaggcgggucucuuggccuauaguuauccaaucggauagugaaugagagcggaaguaccucuggcucugaaguuguuguauucgcucuaugggcccagugccuggcaacgcggugagaucgcggccagcgggaacaggaagugacgugagcuggcggaggggcgcgagguuucaagauggcgguucccgggugguugaccgaggggcagaggugaaggccccuucgcagagaguccuccgggaccgcccgcuagcugcucucgccgucccgggagccucgcagucgugugagugcguggggacucggugcuccguuuuccgcgacccuccccggggccugcgaagccuucucugaaacaccaggcccagaggccgcgcucuuccuccgcugggcccgggguggcgggagccucggguuucagggcucggggccggccuggcacugcguccgacggguucucgggcgggaucucccgccgggucagacccaccgcccgagugcggcgaccgguggcggcgggcugacgucuagccgcucgagucgcuaucaaccgucgcuaugguuucggcaguugcugugaggccuccuggaguggacccggaccggaccggaccggucggguugcguuugugcugccuggguucccauggucuuuugaccuugucucugccaacguuugca

SEQ ID NO: 3456 - RNA, 3405 nt, Mus musculus
cccagccuuccccagcagcauguaggagccucuccccucugcugcugcugcugcgccagacacagaggcagacucacaggacacccgagacaccaugaagagccugcucccucuggccauccuggcugcgcuggccguggcaacccugugcuacggugagaaaccucucucccugcugucuguggguuuucccucccuaccuuggacuucccuucacgcuccucacugucucucuccccuucuuccucaucuuucccguucucuauuacaagccaaaguaccacgaaguagucuucccuguuuccaugaucauugucauuccagcgcauguuuuauauccuauauauuccaaugcaugugagcuauuuuaacagugaaguccuuucagggauaaaucuacacaccuggaaacgaagauauuucagggaugcaucaauuuccugccccuauaaccuuaccuuuaagaacgguuauucagacuugaauauugauggauuaaggguauuuagugaaucgauuacuuuaagaaaguucucacggcaaguguuagagagaguccuuuuagggacagaagaaaauaccaugcauuuaguguguuuauucggccaauuuguuuuuaaaagaaacuuuacagcugaacuuuuagaaaagcaucaauuucacaauuuuuuuuacaaaggaugcauuuuuuucugcuacauauauguuguuacgucauaugugauuuguucacagauuugaagucaaauuguuuacauuggucugcuuaaauuguuuugauuauauuuaguugucuuuaaaaaaucuaaaugguaugaacagcucuaauguuaugccucucgauuuuugaauuauucauaaacuuucugcauauguuuuuugcucuccugucucccuuucucacuucucgggcaggcagacgcuuauaaacacagccucuuauucccgcuuugcccgauguguucaggagagacauagaaagcagaaacauuugcuuugacguucucucuguccuggcuuugugcccaguuuugaggaaggagagggagccagugguuucugaggcugccaauuuaacacccauucuuaagagccauuccgaacccucuuagaaacugucugggucacguagcucaauaaccacccuggagcuccuugccuggagaagccuggcugcugcacacccaccuuuaacucccuugagucuagucucaaacuggccccuggauacauuggaagagagggcacucuggaaacuccaugguacauggaacacuuuaugccugaacauuucagcaaucucaggaaaucuuagcccaaacuggcaacuaccuccaauaucagcagaugggcaaggauagagacacucgaagcaaagguggaaauaaagaaauaauucuuauaugaccauaauuuccugacaacaaccuugcuaaaugcaccccuucccaucuuuuugugucuacauuuagacagugacagcgugugacaaauaagccuaaaaugagucuuucuuuaauuccagaaucucacgaaagcauggaguccuaugaaaucaguaaguagaugccuggcuaccuuauuucaguugcuugcauuaaagaauaccaccccauuucuuuuuaaagcuaccgugcuggucaggucuguguuagagagggaggggaggagugggccucuuugggagaacugaauuuuaaaacucagugacugaaacuguccaaggaaacaauguccaacacuuuaagugguguaauaugacauuaaacugcauccagaacacucgaaaauguuaagcugacaucacaugagccacaugaguggaaaaugaggaguaaugucaaccgaggaggcacagagagggagccgccaucugggagaccacaggcgucggcaucagauugugugccugagugacggacucagaaagucuggcuacacuagguggagaauggcagucucauguuugguuugguugguuaauuggaaggguuuuucuuuuuugguuugguuuucgacucagggucuccuguaacuuaguuggcccccaacucagugcacaacuguggguaauuuuaaacuccucauccuccaucucccaccucccaagcagugagcugacaggugugacccccacgucccccacaucccccacaucuccccuauccccuaccugcccuacagggccuccaucuugaguuuacuuuguuccucauuuucauacgguuuaacuuguuccuaugcugguggugcaaggggugagaacacuucucuuaauuacauuuaaaaacaccuugaguggguauuaccaaaagcagcaaaggauuccacaaagacaaagcacaugagacuguuguggccugugucauaaguccccaagacacauaaacgguuauucauuuccuuugaucaugcaguuuauaacgucugcuuuauacucuuuuuauauuuuugccuagcuccgguuauguaaaacacaggagauuaaugagauuucagauguuuuuggcccucagacuauuuacaaaauacuuccaucagcuguucccaugaaagagcauuuguuuauuuuucuguuuuaggucccuucaucaacaggagaaaugccaacaccuuuauguccccucagcagagguggcgagcuaaagcccaaaagagguacuggaacucgacgggaguagucauuauuuccaggguuguagccuggaucggaacagaguguggaagacgguucaucacuauuucuaugucucaaacucaaagaauaugaaaagcaacacagaaaaaaaccagaacgcuuagaaacuguuuugcuuuggacuuagaaaggagacagggaggaaggaaaaggggaccgaaagaaaacuucuacuucuauucauaaaaauaaugcccaaaucaaaaccugcuugccccuacccugugccugcuguucagacaucucuuguucugggggaagagcucuccagucccccuuuuucugacuguaccauugucuuucuaccauucaauugugucuuauucucuacucuccagaguccaggaacgcaacaagccugccuacgagaucaacagagaggccugcgaugacuacaagcugugugagcgcuacgccauggucuacggcuacaacgcugccuacaaccgcuacuucaggcagcgccgaggagccaaauauuagcgcgaagaaacagucauuugguuguggaguuucguuuuauaucuccugcaguagcauuacugaaguauacagacacgcauguguugcuugcuccuuacaugaucuccuagcuggcuggcccacuccuuccuucugcggguugaaaguaaugaaagaacaguauuaagaaguguguuuauauauaauaaaauucugguuugauacguucacuuugugaagucagg

SEQ ID NO: 3457 - RNA, 18379 nt, Mus musculus
gucauuaauugucaagaaugcugcucagacggcugaucggaagauaggcagagcaggauaucgagacagcccaggguuuccuugucaaguagguuuaaaacauuuuuuccucuucucucucucucucucucucucucucucucucucucucucucucucucucaacuuccuuccuguucugccaguccucagucagaguugagagacagagguaaccuccagagacacagggccgacuggagccuggaauguaaguugaaugccugagguggggaggcugcaggugggcgcagaguccuguaggaaaucucagaaccacccuacugcccuugccagaggagcuguugcuguucuuaggaagggcgguucuuuaaaccgaacuucaugauaagaaagugcuaaagagauugcuggagcagaaaaggggaagucagcccugagaaggggagacaagcugaaggagguaggagagaguacccugcuaccagaauguucuagagaagggcucuggggauaccuggaaugggggcggaguggggggcagcacugggugguuuccuugcuaggcaggagcuggaauuuggcugcgcucaggaaaaggaaaacccuaccucugauacugacugugcuguggauggcggcuugugcugggguggagaugugugguuuccuguuuuugagcacacuuuaaagagacuguuugaaaggagagaaaauauggugcagagcugucaaaugcuaagcccuuagcaaaaaccaggggaauuaaauuccugcagugggcugggcaggaagauauucacugugacugccaaaaaacaaagcagcccuccacaucaaggggaacugaugcagacccagaagauguggagaaaacugugggagaggcacuaggagagucugcgugggcccagcuauaaacguggucggugggccuuccagcugucguggucugaacuuuggccuugcuagaagggcucuaggcaucacuugguaugcucuccucucuuucucagguuuuccagucagcaagugcuaaaugccccauuuuggguaacuguagcaugggucugagaagcucugaguaguuuuucacuaggcggugagggagucagacucuuacaggaaggcccccaaaccaccccuucacaaagacacuaagagccuucugaagucaggcuuagcacacuggguuccccacaugagaacucaagaagagaucagcggugaccugcuggcugggaauuugucaccaacaggugccauuucucucuguggcauuucuaagaguguaccccugcccguuucaaacacagugcaaguuuacugacaaaaugagcuuauucuuuugugaguccuucagguuucugauagaacaugaucaacucuccuuccacguggcccacacucugccagugagaaacaaccaugacuagccggccuaaaccucaugggcaucuucuugcccucggaauuugguccuucaccauuuuggagagugugggucugucccagggagacaggcuuugcucagccgcgcacaguuugguuuccacuggaagcucagaacagcagaguuacucugaggggaauuuacgggaauaugauccgugacaaacuugagcuaacaggaagggagaagaagcccuguggggugaaaacuaagcagagagaaaagacagccaggguuggcucagagcccucuggugugccaagccugguauugagaaacucacgauuuucauacugagagaauggagaagaauauuaaggaaguguucagcaguucauauagugguacaguaaaagaguugauagccuuagacauugucuguggaagaagauuucucuaaucccacauguggaaugucuuuguuugcacagcagccucgcugcugagauggacuacauugguggaugguggguugagucccagguagaguuuugcaggccucgggucuugauugcuccugaaaaaucacugguacuuucauccauacaauaagaucuuaccagguugcccuuuauugauaauauucugguuuccucaacccaagcugacuaaaacuccacaggggauuccucgggggucuaauaaucuaaguucgaguguccaugaaauugucuuugacgucucacauuaauuuagaaccuuggugacugugucuaguuuuuugccuagucauggcuuccagagugcagcugucuuuuaagauuauuuaaagugguauuugugaaagaggaacgucacgcaguguguguguguguggggggggggggaacauagugauucguacucuuaucucuuucugcaccgaaaaacagagcuggaagagcgcgcuuggaaugcauaggcaggaaagaagagucugugguccucagugggaguggugaggcccgacuuuaauuccagcauuugaaaggcagggcaucucugugaguuccaggucagccaaggauacagagugagaccccgucuuuuaaaaaggugggggggaggcauuuuuuaaaugggggggagaagggggagggagagggagagggagagggagagggagagggagagggagagggagagggagagggagagggagagggaggagagggagagggagagggagagggagagggagagggagagggagagggagagggaggagagggagauuuucuagaaccauguccccuucguugcgucauacaagauggguuccucucaaucacuagcuuggaucuucuuguccaguuuuggaugcccaugcggcugccuugguagaaaauggccuugggaugccccagaaagggccagaucuuucacgugacuagaaauacugaagggauuucuccauaagcaagagaagaggccuuguggguguccuggcagacaaucuggggucucuugacgccaggcagcagcagaggcggcagggcaggcugugacaugcgcaguucucagcaagaaccuagcucugggcgcuuggcccuccugugggaaauccccugcuccugcucuucccacccccaccacacacacacacaucucuccaugucuuccccuuagugacucagaggugcaggauaagaccccggccaacccagccuuucaacguagcgagaucuuccugcauuuuccccuagccagaggcaguguguccacuaacugcucucugagcccgcugacucaucucauucagagcgaaccuucugucaggcgaagggucaagaaauaagaucgaaaauagaauuguuaaugugagguauuucaaaagaaaugcaguagucacugucccauuuuugcguuggauuucauuuauaaauaauccucacaaguuccuaaccuucaaggucccguccuuccuccgcagagaaacagacugcauccugaggaggaagggcgcagaggaucaguuauacccaggggaagcacuuccuccucaggacguuaggucccacaaaacacauaaugacagggccacgaaggaaggcaaggaaaagaauuaauauuuauuaaacaucuacuggccaauccagcuuccaauccagccuuuugauaccuugaggaaggcucaguuuuccuacaucucugguggauguuaauagcuugcuuagguccuauaagaaguugguuuuggagccaggcuuugagaccccugguccaccuuccucaaaguucaugcuuugucaaacguguaggucacuuuguuaaauucaccuggggugggauuaauuuccuagaaacguaggaucucauuucuuuuuuuauggccagcaacucguaugaagcuauauuaacagccagacaugugugcacugacucaagguuaagucguauuuacgauuuccuccugucuuuuucuguuccuauaaccuguggcucacauugucuccugcacgguggcuggugauuccuugcaauuccuucacgggaugcaccgagugucuaauuugcuaaguuuugacucagaacaguuccguaacuguuuuaagauagucuugugaugcaaaagguuuagguaaaagaaagaugauuuacaucuuguuggggggaguagguuauguuguguuuuauaaaauugugguauaauaaggugggaggaagcaccuccacgggcccugccguggugcuccccugaggaaucgccaucauaagacaggccuaguaccaaaggaaguuuaccgggggaagggaagggggaccuagaaaagggacagagacagaaagggggcagagaaggacagaaugacagagaagagagaggggaagagaggaagaugccagcugggaacaaguggaggagagggagagagaggagagagagagagagagagagagagagggagagagaaugaaagagcagcauucuuauacaccuggcuccacaggcuauugcuagguagcuguuggguggaaccuaguggaauugucaauaauguaaaauguagcaccuuugagaaaauaguaugaaauuuaaauaauuaaacacuucuacucuucucuuaaauacacuaaugaggcgaaguaacugaacagugacucagcggucacucaccugcaggcagugagauauagagagaggcuggggauggugacucaucuaaagaccaucucucaagguagagaaaggagaguccucguugcugaaacaugugcccaagaguucacugccagagagccagaagcaaccuccauaugugaggggggcucuucaguaaggagaugaucacccccaaauggaguagaucuaaccacuagccacagggcuacacucaaagacacagauaccaccugauauccucugguccugugcauccaacauuucagguggauaauuaccuccucgauuuuuggguucaaaaucucaacgauccagcaaugccucaggagcaagggagcuuucucuacagcaaucaacuggacugcauucaccagaaaguuacagguucaaggucauguuuaaccuuagacauugucuuagacagugauaagauuauggaggacuucagggucugugaaucuguggacuaaagaaagaaagaaucaucaccuuauucuuuuccucuuuggacuaaagacuaggaugauuguuauacuuuuaaagaguucuuuugauuuuacuuuuauguguauggcuguuuugcaugcgugcuuuuguguguagcauagaagcaagaagagagggcuggaucuccuaaacuagaguuacagauggcugugagcuuccgcaugggugcugggaaucaacacugagucccuugggagagcagcuggugcuccaggccaccgaaucaucucuccagccuuugcuuagcagauuuuuaaaagaguccugucaucuccaaaacgugaagaaucaacaaucagaccagcuggaccuuguagaaauuaccaacuucgauuucuucccuggcucugaccagcaacuuaaaugucagcgugcucuggagggagggguuuguaaacucucggagcucaccaaccagcugugaccuuccugcggcuuugauggcgaaucaccucuucaguuauuuuguguuuauuaccguaauagccaccuuuccgcagugagugacuuuggaucaucuggucucauaucuccuucuuaugcuacaauuuuugucaaaucauuguaauguggcucggaaauuccugcuuuuccugcuccaguuccagacaccauacauugucuucuacccuucaacgucuucaaaaaguugucucgguuuuaugagauacuuauaaguuugcaauucauuaugacaauuuaaauaauauaaauuuaaaucaugcauaauuagauuuaauaauaagauuaaaacccggauggaagaauugauuuggcaacauccacacaguuacaaguuugcaaguccuaugucagccucuccucccucuuucucucucucucucucccccuuccucuuuuccucccucuuucucucucucucucucucccccuucaucuuuuccucccucuuucuccugcucuuuucaagaaugagaauccacagcuuuugcagggccaugagaucgugaacuaacgacuggguauagugacaccauccaacagucaagugcucaauggugaacuguuagaauuguguuccagaagguucuguccugugagcugagcugcauuucuccaugccaauagccucaugcucugacggguugguuauggauucuccacucuggcuauccguuaggcugucaugaccaccagauaagaaugugccucaucugauucgucuuuucuaacuuguucugcaucagccccuuaaagguuguccucaaacugcaacauccaccagcugcaucauucuuuauuuuuaccuccaguucauucuauucuuucucugcgugcuguuuggaguaugagcuggguuaguccuuauguuuucccuggugaucuccagagccaugguuguugaucucuggagucuccucuuugagcgaugccagugguuuaagugagacaaggguuaccauagcaacuggccuaucugcuuccuuucuguguaggaagugggccugggcauugcaauguaguuuucagagcuacuagggccuuugguguuuggccugauguuuuguuggaagacaaaugaagaggacccuuguuucucccucucccuuccucugucgcaaccuuucccucaucccaucugcacacuucaccauuucucuuucuuuuguuccguaaguuugcuuuuguuaguuuucauuucuaaauuauuuuccuucuuguugcauuaguaacauuaagacccagaacugcagugacauugguccaugaguuuccucauccccagagaauucccagacguucccagugccucuggaugagaugaugugaugaagaauaucuuaggugugugacuuauaagaaauggaggcuuuggcauucuugccuggauuucaccuaggcagcaucucccguggcuugcagacacaugcuaugacagucgcagcugugucaugaggaaccagucucuuaauucucgggacucaauuuucccagugauucagugagaaggugaacuauuuuaccucuuaaccuugucugaacucuaaaaagcaguauugcuaggugcucaucaacacucacacacacaaagauaauauuacuccauuuccuucucaguguuguuugcacaagucaaguaaaugcagacacugauuagaggaguauaucaugaucugccuaugugagauuuuguggguguguccaaccuuuugacaaguuccacaguguugucacguauaaaugucauguucaagaaucaugccaucaagaaaaaaaaaauuaaagaaaaaucucauaauguuuuaagcugaugauuuugcauuaggccacacucauaauuaaccugaaguguguagagagagcaugagauuacuagaaauacagggaaauacaaaagaaaaaugggaagcuggcugaaggccccuaauaacaaauguguaauuaucaucuugccuggaggaauuugaguccuuugcuauuuuguggcaugacaaaagaacauaagauacagagggaaaggaagcaaucaccgaugauaaucauaaaaugcagagcugugcaggcguuacgggugggguuggcacucaagaagaacccagaacccacccgguaucugcucucaagcuaugauuaacagcauggagcagaaccguucauacccgccaggcaggcauuagaggucuguuuuccccaggguuccccuuuaaggucugauaaguauucaacgaaagaauacauuaauaagaagaaaccagccuuuugaccacagauaauugaccaguguccagaagucagcaaaacucagauugcgcauacugggaauagcaauggggcuaagcuagaauggucgaucgcugggauuguuuauguuaccuuucuucacuguagugcauggcucacagaaaagcuguucauucuuauagcuuuauucuauaagcaaaaauuaagacaagucagagaaaugacuggaaauacuaucuauuucauggaauaucuguguugaggaacaauuugaaaaucaccgaugaauacagaucuccacuaaggugguaccaguagcaaccccagcgccuaaugaaccaucauucucucucugaaauagagagcaaucaagaugacggagaaggaugcacagccacagcuggaagaggcggacgacgaccuggacagcaagcucaauuauaagccacccccucagaaguccuugaaggagcugcaggagauggacaaggaugacgagagucuaaccaaguacaagaaaacacugcugggagaugucccugugguagcaggugugugcguguagggaugggucagggcaaggccuccacggagacaugcaauugcugucacccacagucaggagcaaagggcuuccugguuaggugggugaggcaccaucuguaccugcugccuaaggucauggauuguauaauuauguuuucuuuggagccugugugagagucagaggugaagcagacaaaaauuacccacauggagcauguagaacuucagaccacaacugcacucuauuccggucuccacuagucccuacuuuuuuucucucucuuucuuggacguuucuuaacuauuccucugucucugucugucucugucucucuuucucucucucuagcacacacacacacacacacacacacacacacacacauacacacacacacacacacacacacacugccagaacaagacauggcgacaggccugaauagacaaugucucaguauuugagacuuauaauuaagaugagucugugucuuaguuagcaaguuggagagaaaaguguuuauuugucuuaugcuuccaccaucacagugcaucagugagggaagacaggcugggagcucugggcaaaaaccuggagacagaaacugaagcugagggacauggaggggugcacuggcuugcuccccagaguuuguucagccugcuuucuuauagcacccaggaccacuaacccaggggaaacucuguccauaugagcuggucccucccacagcaaucaucaagcaagaaaaugcacuaccagcuugcccacaggcaagucuggugggagcacuuucucaaguaagggucacucuuccaaaaugauccuagcuugugccgauuugaccuaaaaguagugaacacaauccguaaaugccugaauuagaaaauucuuaauucuuccauuuuuauagaaaucaauaguaaacauagcgagucugccauucuguuuugauugcuacauauuuaaauuccucuuuauauucucuuuuaucauccacagcaugaaacacacacacacgcacauacauguacacacaugcacucauacacacauuuguauguguacacacacacaugcccgcacauacaugcacacacaugcacucauacacacauuuguaucuacacacacacacacacaaacacaugcgugcacacacgcauacucccaugcaugcacucacgagcucuucuccacuuaaugcccuucugugugcucaugguuucuuuugaacccugcagacccaacaguucccaacgugacuguuacccggcuuagccuuguaugugacagugcaccaggacccaucaccauggaccuuacugguaagugaacacaucucuacucuucagaggggucuaagaugucacagggaaaauuugaucuuuguccccaauucccacuggagaaaacuagucagguggcucuuggagaugcaugcacucguaccaggccacaaccauugcauucccaguguccacugcuuucuguauuuaaugaaaaaaacccagcuccugacucaauguaguggaacaauugagaguuggacaccuuuuguggguaagugaguauuugugcacuauucugcuucuguauucguguucauaugaagaguacaugugugcaugcaaguuaaccucgggaucugcuuaucggaugggcuugcucagccuguuuccucaaagcaccaggaccacuagcccaggggaaccauuguccauaugaacuggguccucucgcagcaagcaucaaucaagacagggcaccucgggcucucucacgugagcuagucugccuggcuggugagcuccagggcuccaccugccccccccccuugcuccagagcuagcaugcacagcuuuauuuaauaagggggggauauuguuuguuuguuuguuuguuuguuuguuuauuuauuuaucucagaacauuuuaaauguggguucaggaaauacucgugcuugccuggcaagcauuuuauugaucgugcgaucucuucaagcauuuuauugaucgcgcgaucucuucagccuucaguuacucaguugugcaguauugacuucagaucugugcuuccacgugguaacagaagaaacagcuauucuuguaggagacaaugcagguggaaaugcugugcguggcuagacucgcaguacuuauaugguuugaacaccagcgaaagcgcugaucuuaucccagcuauggccuuagcagaaggcgaggaaagcccagcaccuccugaauaaugacagacacuccccugcuccgcacacccaaagcuuaaaacucuauuccuaaacaauuucucugacaaaaaccccaaaauaauaauugguguuuauuucaccuuuugugacuaacagccaacugcucucauuaggcagaucuugaggagaugagcagaaacugggaaggggggcuucaugggaaaauaaucaccuauuggggguugggaaaggggucauaaauccaaaucaggggcauccaagguagaucugucaccaaagucaaagcuuuacagaagccagaggaaagcacgggucgagagcaguaaguuuagcagcagagcuuccucucacagggcgugugugcuuugccuuauauggauauuucugucaaggggaggaaaucggggccugagaagacaggcuuccuguucaacuguaaucaguagagcaggcacccggcaggcacauaugcauggccccgcccugcacgcacacaugcauggccccgagcugcagcaucaccccagacagaaacucauucucucauccagacucaggccucuuccugcacucggcugugucacguggccagguacaacugucaguuugcaggaguaggucuggcgcugcugaggacaugcccagacaggacggaggaccaggcagaagagcuuggucucuguccuccucucucagaagagaaaaccugcauuucuguccuaaagaaagcgcugagcuaaagucauauaacaguguuuaugaagucaaacacuuucccgaaguauacacguauacauacacauacauacauaugugaacacacaugcacauguauaugcacacauacacaacugagcuaugcaggaguauuuggaggaaagacuaaagaaagcaucgucauagcuucccuaagcagggccuaagaauuaauggcagaucucaggguuaugaacccuaaagcuguuacaauuagaauguucuuccuuaaaaaaaaauguuguaaacgcaagucuagugaguccaaagugagcacuuacuuaaauaauuauaaaaacuaaaaguagcuguuaaagcuaggaaauaccauauauuaucaauuguuaauaucaauuguaugaauugauggagggaaauuuucuugaagccuaucaauucuuugaaagccaaaggcugaugcuuuuauauaucuauauuuuuauaauucuuugaaagaaauccucaugucuccaucuagcuauguauauacaugaaguuuuuaauagacagaauauuagcucaauuucuucuaggcugguugguugauugacacuuuuuuuguuauugacaacaauaaaauauaguuaucuuccugaguacugauuagaaguuagggggggaaaaaagauuuaucuucacgacuauuuauuggaaaaaaacuguauuuuuggcauagacaucaaacuuguaggaaaacccuuuacuauguuacaguuuugauuuuuuaauaacuaauuuguaagauuuguaagccaguauaggguguguguguguguaugucuguguguguguguguuuacacuaaucucacacucuuaugaaucacguaacccaggugggccgagcagaagaugccgaagcuuggcuuucauucuucuuggggauaguaacuuuguaacuccucuucuacaggcgaucucgaggcccucaaaaaggauacauuugugcuaaaggaaggcauugaauacagggugaaaauuaacuucaaaguaaguaucucccccacgggcucuuaucuuuccuauaacccauuucuugcauccuugugcugguauucuguugaugucacuguuguuuugguggugguuguugcuguccuuucuccagcuugguucuggauuaagcuguguccgcuucugagcucuuccuguggagauccaccccuacuucccaucuuuaccuagcagggauaucaucacccuuucucggaacuccugcugcuuacauccaugaggcacacacugcuggguguccugccgaguccuccuuccgcaaccuaagcacccagaggcaggcuaaaguugugugccccucccuuccacuguuucacacgacuuuauaaauggcaggucuucauggguauauggcaagaaauggacaaaacaaagacucaacaaauagaaaaaaacaaaaaacaaaaacaacaacaacaacaaaaaaaaaaaaaacaccaggauuccccaacugcucaauuaccauucagauacaggaacugugcucuuaacaaaguagcuaggaaucucaguggcauuuguggaucaggggaccagauaauagcaaaguuaaacaagacauaagcucacugcucgugaauagacauaugugacuaauuacggaucccgggaaaacaaccuugacuuugaaagcaaauaaguaagagacgcacuguuuugcaucucaggguuuguuugccuuggcuguucgucauuuccacucagucauguucuccagggcuccaccagggaagaccccauaugcucucucugguacacacugggcucaucuuucuacugggcauaggauaugauucaaggugguucgucagccacccucucccauguacuaaaaugccuaaagucucuucauucuggaaauauuuguugacaccaacacagccaucacuugaacuguggauggcuuugcuuccugccaugcuguuuacuaccagagcaacuggaguuugggggagagccucacauuuaaaaugcacagaaaaacuucacaccagucuagaacuuacauuuacacugcugugcugucaguuuagaaaacucguguuuacaaaugaaaucugaccagcagcuuuugacugaauacgaagacgaacagagaucuaugaauaugggugacuccagagaugccuggguagcacaucagggugcauaggagccccugagucaaauccacuucugaaguuggcgucaggcuccaccgagguuaagaccacucugucuguacccaaguaaaccugaaugagucucuagcuugucccggcuuggaguuacaguuagaaggaacccuggucacaguaaagaggaauuaaagagcuauuuaaaccuuuacugacaucucuugacaaauguucaaggauacuacguuuauaauagcaauucccuacgauccuccagcacucugucucucucaggguucuucuuauccuaaaauugacagcacccuagaacccuggacgagggugauucuguggguccccaccccuuguaugcugccucuuaaguguaugaagcauuucugacguccacagcucucagguucauucaugucaucaaaccuucuugcuuugggaguggggguggugagauguacaguagccauauguguguguguguguguguguguguguguuuucugcccuaaauauguuucuauuaagugaaucacuagucacacagcagaugccucuuuuuaaaauucuugcuauugcuggauugucuuuucagcuaugcagucccacugggcccaagggucaggcugaagggucauauaaagaugcauucauuuccucccauucccuuggacuagauguaagagagggggugauaggaaauggggauucauuucaucaccaucucucuguaaggcuguuuucauuccagcugcuuuugguugcuuuaucgcccaugcuaaccuaggugguuuagacucuaaggugacagucuucacucuugggcaauuucaccaucggaagaaugaaggacaacccuggcgguuuggucuuaacuauuguacccacuauguguacagacagcuguaauuauucauggaggacauuauugaagaugcuuucguuccucugcaguugaacguuccccgaguccuacagcuaugagucaauguccuccuuaacuuguuuguauagacaugaccacagugaaaaacuaacagacagccuacuucuggcccagguauaaugagucauggaaaacaaaaugcuagacugucugcaguuccauuccaucugguggauuuucauugagcaucuagggaaaguagcgacagcucagauaacauucauggugagagagucuggcagugcgcacugggcaccaguggacuccauccauuauuaauaggaaaggguguuuuggugacccauaaccuucccucuaggcuccagucucgauuacgcagccucuccuagcugacuuuccauuaccacuucacucccuuuugcuuguuuaucauaggcuagguggaucguuucugaggauaugguguucacagacugacauauaauuuuccauugguauuuucauaaccuucucugaaaugggggccguguuuucacuagcuagagauuauugcccaagccaccaaagaaggagaaauauggugaagaauacugagacacuguuuucauuaacaccguccccaaacgcaguuagauggacaaauauuacaacagucaaggauguaccugcauuggcagcguuaagucuugugauugggucucuucgauuucgguuuagcuagaugggaaggguaggaaguagucaaacaaacaaacaaaacagaaaaaccagaaagagucucuaaucugaauugcuugugggcuucucaccuacaggugaauaaggauauugugucuggccugaaguauguucaacacacauaccggacuggcaugagagguaagagauuggccgcaacuacuucuguuugcuuauaaacuuacaagagcugguauagguacagguacagguacagguacagguacagguacagguacagguacagguacagguacagguacagguacagguagauggcaugucugcuuuagggaaagggagacaggcacaucagaccaagaugcugagaacaucauucagacaaggcaaacuacuggccuucaacauugggaaucuggauuuaaauuuguuacuccuauggagaaauuaaucaagaugaauugaagacaaggucaaaaauagucaucaaaagugaagaaguggaggaagaaauagcccuugguaaagugcuugcaccaauuccugagacuaaggccuuggaaucaacagaagcaagccagccuggugguauacaucccagccuggaaauguggagacaagaggaccccagagcaucacuggguggcuaacauagacuaauuggugaguucagggccagugaaaagggccugucucaaaaaaacaaaacaaacaauaccaagguggcuagugccugggaagaacaccugaggccaacuucuggccugcacacaugcguacuaugugcacacacacacacacacacacacauacaccagauauucaaaagugagagcaguucacagugugaaaccacaucagaaaaacaagaacugggagcccugggauuguguccuaggggugaguaucaggaguuccacgggagcgggaggagcagggagguaauguguugaggugagcaucaggggugcaacauggaggagaggcagagagacagugcucuugucucuuaacaaagaaaugaggagccgggcagugguggcacacgccuuuaaucccagcacuugggaggcagaggcaggcggauuucugaguucgaggucagccugaucuacaaaguguguuccaggacagccagggcuacacagagaaacccugucucaaaaaaaaaaaaaaaaaaaagaaagaaagaaagaaagaaaaaagaaaagaggaacaucucucucuaggccugagaaaaagcaguguaauugaaguauauaacuaaccgcauauucuuucugaugucauucuggacguaucuugggcaggaagguaacccaaacaaucccacaguccucccuggccuucuuacucucugugccagaugcgggaacaauaugacagagcccaguccccaaagccacagaagagccaagggaaguuaugauuugaugugauugcaggacaugggaaccagucuaucaaauuccagagacgauugggggccugagacacacuguuggccuugcuagugucugcucgggugaaaacccagcucaguuuccuacuuccucccagcccagaggcagcgcugacucacgucagcgagcagccccuggcaugugugcaguugucccucuaaagugugcagcaguuagaaggguagcuguacccgccucccagcucucugugccauuuaaaccccagcuguucugaauucacaccccagcguuccccucccucguaaguacaguugguugaccucauguaccaaauucucuguuuuuuuuuaaacuuuugaccaauuugcugaucuccccucucaccuaacauucagauuccuaaauucuauauauccugauccccagaugucacagugacccucucucuaacuaagacauucauagaaugacauugaagucuguaauauagagaaagaaagaacgcccugcaagcugccaaucuugaacugcuucaaaccuggggucagaauguaggucucucaacuuguuugccuaccugacuguccucugucaguuuuuaacggugcaaucugcuacaucucuggaaagagauuucaggcccaccgacuuaagucacgccauacuauggcuuaauaaucagaaucaacucugacacuuuuacugaaacuccaccccccaaguauggggagugaggggcaaaaugagucacauuuuucaaaggaauuuggggucuuaaggaugcuuuaguauaucugucuggagggacuguuugggcucugagacaaggucuccugugugugcaugcagcucgaccuggucuuaaacuuguucguaccuuagcuucccugauacuacaaauggaauugugcacaccuggcuuaguuauaaaaaggaaagaaacggagaaagaaagaaagagagagagagagagagauguucggccaggcuuggacacuugcuucagcuucugcccaugugagcugcguaccaggcucucccauuuuuaguuucuuuucugacaccagacucucacacuaauagcccuuucuuucuucccaguggauaaagccacauucaugguuggcagcuaugggccccgaccagaggaguacgaauuccucacuccaguagaggaagcucccaagggcaugcuggcccgaggcacuuaccacaacaaguccuucuucacggaugacgacaaacaggaccaccucaccugggaauggaaccuggccauuaagaaggauuggacagaaugagugcgucuguccgucccuccugucaccuuccucacccaccagaagaguucucccgaccauguugaucaucacaaacucccuccucccucccuguuccuagcuaggcccuuucucugucacacacacacacacacacauuucaucaccaauauguuuuaucuuaccccaucucucagaguguucccugcaaaugagacuuaaaacccuggcuucucccaccuugaguccugaaggucaagaaaugggcaagcuccggcugacgccuccuuggccuucuguucagaaguuuauucuugccacuggguucuuccgguucgaugaaccccguugucuucucugccaaggggagcucuccuuuugugggagacacuguaaacaacaccaaaggaaaagaauaaaaucguugugugugugacugagaaccucauuugcuuuccuuugcccuuaaauaaauaugguaccagaaagcccacauugugaguugucuuaugcaugggcguauggaugagagccaugguacaggggauauguaugucuuugccaacggguugucacaauauaauggucagugaauguuaauaauacagaggaugaacauucuaaau

SEQ ID NO: 3458 - RNA, 177634 nt, Mus musculus
guuuccuuaugauuucaucuuugauccaggaguuauuuguaagucuguuuaaaucucuuauuuaaguuaaucuuuaggcaugugcuauaguuuaaauuuccuucuaaacacaaagcuuaaaaaaauuaguuggcuaugcuauugauucccaauucuauuuccuuggaacuauagaugaaucuggaccaagucagugaguuauugcuaccugugugucaaaaccaguacccagucugcgcaggguuuuuugguaugcuuguuuuuguuuguuuucccauaguuggcaagcuaagcaugguuggcacauucugaauggaugggaaucucagaagaugaaguguaugggaacuguaggagaguucucauucaugcguacaaauaguuuuauugcaacaccaccaagguaauucuuauguauguggguggcuucuuuugaucuauggaggggcagcaaccagaaaucacuggccuacauagcaaacgcguucacuuucgacagaagcaguuugucagccccugguucagagguacagagccuuagaaacacguuaggagauggugguaguaugauuauuuucugugaguuuggugaaaauuugugucuucguuggcaaaugccauauauugucacauggacauguauaugcacauauacacaacgacacaagccguauaugcauacacucagagggagggcaguauuucucaauagucccauggauuuuugagacacguucccaacuacagugcuuaugugcuugugugugugcaugcuugugcaugugugucucaccagcggagauucccagaaaguaaauucacacaaagcauuuccacacugcaaugaccucaugggacguucucguugcaaucuuacuccgaaaguuuugcuugaggacauuuaaaauuaauauucggccuucuuggaacaauauaacuucagaacaguuuagcagcuaugcucuuuuuaaacucuguguaucucauacuacucauuuuuaucccuuacagauuaaaucucugcaggucagcccacaucuuaaccgauuuucucacaugcuugcugggcauccucugccucugaugcaggcuuacgucggaugcucagcuaugcagugagauugcaaaaagguacccuucacucguucaaaaaugucucauuuuaacuguuaugaaaauauaauuuucugggcauaauauuauagguuggcagugauuuuuuuuacucggcucucugaagauacuucacugucuucugauccucauuauaguuguucauaauucuuuaguuucuguuucuccuggauagauacuuucuucucuuggugcuuuuaugauuaacuuuucccuuugacauauauauauauguauauauauguauauauauauacauauauauacauauauauauauagucagaacucccuguaugugugugugcauacauaugugugugugugugugugugugugugugugugugugugacaacuccugccuuggagguaugccucaaauccaucuuagaaugucaucugcuauucuuucuucaccucuucccugcacuguauccuuuuaacucucagucugagauucugaauagcuucacgcgugugauacacaccucccaaucuuguuuuccuaucucuucacacccccaugcuuugguuggacauucuucucacauguucuuagggcguuuccaacuucagagguuauauuuucccuuacuaguguugggaaggcuucuauuucacgaauccuuauccauuuuaguuggucuucuacuuagaguuuuguuuuuccuuuaacagacccuaguuaauuagcuuuccugaagcauaaauccagucauugucuauuuuugcagccagucacuuugauaaguuuuucuuauaugucuuguacucauucucuaugaauuucauuuaacagacauuaauguaugggaaauucaaggauaaugaagugaaguuuuccccagaaauaauuugcuuguagcauuucaaaaaauuucucuugugugguaaacagauuauugacuacuacaaacaaaaacagauagccaaaaauaaaacuguuucucucauguguaagaaauguaugugcauuuaguuuugacuaguggagucuaaugggugaggcagaagauacacaggacaaugaucugucagugacacuuagcuucccagcauccuuuacacaucuagguguuacacugaagcaaucugaagcuuuagcuucgaagccuuugaaggcuaaacauaacagcgucuaagaacacaaaugcacaugaagaaccauaacaaacaagaaacauaaacaacuaccacaaaauaagaggcaagaagcccaagcagcucuaagugugaagaggucaaaugaccuaagcauuuggugugcucuuucaagugacaaaugauaugggcagugguggccacaggcauggggagagcacuuggcuaccagaucguacuuaggagauugagaucagauacagcaaccauguucuaaacuauagugccucucuccuacaucuguccagagacauguuuuguauuauguguguucacaacucagaacugggcugggauuucaguucaacuaaaacacuugccaugcaugcuccaggccugaguuuaaaauaaucauaccacaaacacaugcacacauacauaccacacauacauagguacauguguguauacagguggauaggcuauaggucuucacauagugguucuuaagugauaguccuguaucagguuauaugguggaauuauggaggaauauuuaaagaaauuugaagaguacuaaacucccccgauaaaguuuugccauuaaaaauuuacacaauaagaaaaaaaaaauuucugccauuucuuuuguaacuugaaaaaaaaauguguucuuagcauuuguauauuuugguagauguauacuucaauguauuaacugaguccaguguuuagcauauacuaccucauauaugugccauauauuugugaugaaauuacuuaaaaucaucucuucuaucuauuuugaaacauuugaaaugaaacuuuuggaauguagcuuuuauacccagcuguaagcgcaaucaacacuugggaugcucaucuauuugauguauuucuguuuauucuccucuacauuuuuuccauaugccauuaacaagugaguuuuuuccuuuugaucgaagagaagagcucuuauaaagcuuaggcuaaccuugaaauugcuauauaacaaaggguggcuuugaacuccuaaucucuguggcuguguuuucuaagugcugcaauuauaggcaugugccaaacaugccuaacaauaagugaggucuucagucaauaaaaacauauaugauagcacucuaaagagcuaaaccaagcuguuaugauggcucagcaggugacagaacuuacuaccaauauccugaguuuaguuccugggacccacaugguguaaggagagaauuaagaauugagucugaaaauuuuucuucuaaucuuuauaggcaugccauggcacaucuacacacucacauucaugcacgcacgagagagagagagagagagagagagagagagagagagagagagagagagagagagaagaaauagaaaucuguuuaaaaaauuuaaacaggaaaauuugacauugagucuuagcagauuauaauccaaauuacucaaaugaaacaaauaagaccuauacaucaaacuuauaguuuaagguuauguugacagcuaauauuucuaugaaauuauacccuaauacaaagauaaaauuuaaagggaaaauuaagguugaacaauauagaauuacagagaguauuaaggucgaacauacaguucaugugaaguucacuuuauccaggccucuucuguuugacucuaggcaguccacuugccaaaagaaaaccagauauggguuugggaugucuugcugggaggguuucuugggucaaagggucagugaugauuuuaguuucuugccgagcgucucuguguguguguguaauuucagagaaaaaaaaaaaacccuaaagcucauuugagucagaaaagaaugguuuugacagauuucucugccauuugaggaccagucaaaggaaaaacauuuugagggcaugucucaaaauaacuagcagaagguucuguugguuauuuguuaaccugcuucuacuauguugguuauuuguuaaccugcuucuacuauuucaagucuuacaauaucuguaaggagcaagauuaauuucaugucaguccucaggguccaucuuucccagucuacaguugaaggagaguugaucugaguauauaaaucuauguauguaagcuguggaguaggcagaccuggauuucaauccuaaugucacuauuggcuuuggcaaaaagaaaauucugaauaacauuuucccaauuuucuaaagcggugauucauuuuaaggguuagagaugguguaaaguaaaauuuguagcuccuggcagagauugucaauuaacaauccuaguuuucuauaccaucuaucaaaaccagcuauuucgaacacuggacaugcucaaguggaugucagucuguugggaauguuggauggaggaagauucuggaugaaggcaguagaccgaacuuaaucauaaaacccaucacugcccccuuuuagucuccaucuuggccugcuaauucacggucucuugaaugagcuuuugcuugccucgcaaagcagguaggcccagcuauuuaagccaaguuuuguuuaauagucugccuuggcuucuuuggaagucaauugccuuggaaguuagaagggccagggugucugggggcguagcugugacaacggagguauuguagaagguaagaaaaugccagguucagaagagaagacuggcagauccuuauuuuguggcuucagugaucgagccaaggagcacugagcaguggugaguaguuauuacuggacuaaagagucucccauacuugaaacuacaccagacucuuggcaggagcuccuaugaaaaaugggauccaggacgccuggugagacaggucugggcuugcuggcuauauccagggacuggaguauuguagucucucuaaaccagugaagcccuuggguaccacuugcauacugcuuugguugaagagagaugguacaggagcagaccaauggacacaggucacaggucagaggcuggggaauaccucuucuugguaguugaguagggcaguaacucccagauuaacacuagucaucaguuguguggcaggaucuggccgcggucaccugagcgcucuuuccgccugcggcaucccccccccccccccccccggcugugcucugcagaccuaggucauuucacuugaggaauuguagacaccacucugaggcugggaucccgggucuccccugcggggugccgugcucgccuugugggaugaagcccuugagauucuauccagagcccuagggucuacuagagacucaacuguccucaagaucuugcaaacggagcccucucccggccgcgcggggcaacgcgcguucccggcucgcugcugggcaugcgcggcgcgcgcuggcuguguccgggagcgagcggcgcgcacacacggcccgggcggcgggcgaagcgggcucccggggcgcugggcgcagggcgcagggcgcagggcgcggggcaagccccagcggcgugucugcagcggggcgcggcgggcgcuccagcuccgggaucuuucucccuccgucaccucccucgcgucuagggaggucguggcacucccugaggagcgcggcugcucggagggcggauccuagguaagagccccccgaacaucagugcggcuccccgggugggauucccgcggcaugggcucccucucgcuuucccauaagggucuuugugagccgucaccggaguggugccaggcucagcggccgcugcgguucacuuggacccuuugcaacuggugugucggcggccaggugugcgcggcgcugccgcccuagcgcguccccgcgcccgcuccgcgcaccccgaagccaggagacccgauccccccgcggccuccuccgcccggguggucgccgaggucccccgagagaccccgcgcuccccugggcugcgcgggcguaccugaguuccgcacaccuggacucccaccccgcccuaacgucuuagaugcagggcuuucggagcgccucucacccagcucaaguggggaccccuuaggaaaccuguuugagauguggacccgcccugguauacacccuccaguugagguagcucgcuguguuugaauaguugugaauucuggaucacuuuccaacaccauuuuacuuuuaggaagauggccucucuauggcugucaguagugcuucggagggcuccacacccaccgagagagacagugaaggcgccccggggucucaucccuuccuuccuuucaaugacuacaauacacaugcaaaaaucuuugcccgguucucugagccauguuguucaaauccuccuccuguagcccccaagugcuguuggcaucucgccggggcaggacgcccuaggguuugggcuuaaaauccauagacauuuggagcagcgaggcauuagaagaggaggucuuccugagccaguguuucagcgaaugcauggcugcuuuucuucuaaagguuucccuucuugccucagacaguaagagaaagagacgaaaaagcgaauaagauaguucagauccaacuugguucagacacguguggguacuuugaaguuuuauuugguuuugccacuuuggggaggagguggaauuacgauuccuggaagacuuuuuuuauguuuaaaaaaaaucgucaaagugucuguguugcgggcuguuucuaauuucucgcucuugaaaggaugccauucuaaggcucccuggguuuuggaacggcugcgcucauuguguagaauuguagaucuugggacagugagucuauugaaaugaaagccaaugacaucucgccucaccuaguaaagauuuccuucuuguuuuguuuuuaaauuggggauuggaggguuuggggcacgcugcuguaguucuuaguuugcuggggugggaaaucugugagugaugagcucgcaccaccugaaaguuaagcuucucuguagacucaucacauagccggcuggguacagugagccacaagcuaguaagcuuguguguguagaaagcccuucccgcaccauaggagacuaagacuuuguaaaauuccgcaagucauucacuuccuucauagcaggaaaagagagagagagagagagagagagagagagagagagaggagaagaaaguaucuuuuaaauccuacuauucugagccaaguguugcucucugaauugggacgucuacuuuguaacuuucacuuuccagugucauugaguaucauuauaauuggcaaaugauuguuuuaauccccuaacaggaaacugguguuuaauuuugaacacuuugcuuauuuguggucagaggcaaagaguucauuuugugugcucauccagcguuacccggauucaguguacacugguuccuucaaccuuggcuucuuuguagcccugugacacaggcucugcucucuguuuaagcaucuuuucguuuaguccucuuucuucuucugaaucuccucuucagucaccugcuuuuaucuuaaaacauaaguucgucugagcuagguuugaauaagaaacuauuaaccccagauucaaaccucuuuaguuccuuaagucuuauuggaugaguuuuagcacuagcuuuguguacauuuucaguuggcuuuuccaaguuguacuagauacauuuggccgcuuugucucagugcaaaacaaccagaggauagcuuauaaacuuucagacaucugcagggguaucagagaggaagggauggaacuguagccaaagugcuauacaguacaucucuccugggaauugccccaccaaaguguuugcagcugcggggaacuggacuuauuuuucuuaagaaacauuguaguggaguccuugcaaacagugugaacugaguauuuauaagaauguggggguucuuuagguccacacuguagcaucugcagucauucucacauacacauccuaaguggggucuuaaaagagaccauaaggccuggagaggugaauaaagugcuugccagucuaggaugaguucagaaccugcguaccccaaaaaaaaagcuggcgugcuucugcagacccagugccgggguacagagggugaauacuagggacuugcuagcuagccagucuaccucaaauggcaagcuccaaagucagcuguguacacacacaugcacacacacacacauacacacaugcacacacacacacacacacacacacacacacacauacaugcacacacacuaaaugaauauugaaagcagucuguaagcuauuuaugugguugguaaauaguucagcaauggucggagaacuuuguagcaacgucuacuaacauguuacuauugacugcaguucaagggucuuauuggugaaguauuguuagccauagcucacauuuugaauauaugucuuuuccccuuuguuuuuuggugauugaacccaaggucucagcacauagcucuaccacugagccacaccccaggcuuccuuagcuuuaaucuaaugccuguuuucuaucucaggaccauuaagucagaacacugguuacauuuaacgguugcaguuucuucugcuccaguuggcucugauccuuacuuccucagcuuuucuuuucuccuuuccuuuccuuuccuuuccuuuccuuuccuuuccuuuccuuuccuuuccuuuccuuuccuuuccuuuccuuuccuuuccuuuccuuuccuuuccguuccguuccguuccguuccguuccuuuccuuuccuuuccuuuucuucccuuccccuuccccuuccccucccccuucccccuucccccuucccccuucccccuucccccuucccccuuuccccuuccuaucuuuucuugacagcuuuggccauuuugaggaguccuggucauauaugcuuuccccuuuugaauuugccuuuuguuugucccaagguuaggcagcaauuaaucagacccuugaucccugcauuaggaaagcucaggcagaaagauggcggguucgaggccaaccuggcuacaugcugaggcccugucaggguuacuggugcugugauaaaacaccauggccaaaagcaagcggaggagaaaaggguuuauuugucuuuggcuucugcaucacuguuuaucuuuuaaggaagucaaggcaggaacucagaacagaccaggaaccuggaggcaggagcugauacagaggccacggagaagugcuuguuuacugguuuguucucuauggcuugcucagccugcuuucuuaaagaagccagaaccaccagcccaagggcggcccugccuacaauggaaugagcccucccagaucaaucacuaauuaagaaaacaccacacaggcuugccuacaacccuaucucauggaggcgguguuuuucacugaggcucgauccucucugauaguuuuagcuugugucaaguugaauauaaacuagcccagacagacccugucacaaaacaaggaagcucagccaguguggguuuuggauugaaagacaaccagggcaaagugccuuacccaucacgggucaccgugcacaccaucaguaggguuaucagacgcaucuugaucacuggcugagauagcaucugucaguuuuuuucugcagcuaaguucccggucuucucuuuuccauucccuccucuugggaaggagucucccagcacagccuggguuuaaggaguggagacuugugacccuucccugucccugagcguguaauaucucucuacagcuauauguuauuuaccauuucaauagaaaccuagccaggucacaucaugucauggaaaaaguaaacucagccaccgugggcuuuggauuggaagaugacggagguuacuuaaccucauccaccacaggucucaguacacacuaccagcaggguguucggacucaugggagaguuuccucuuuuccuucauuuaguuauugggucauuugugucuaaaucugacuccugaguacuucacuguauucuuuggacuauaaucuagcccccuugcagcucaaauccuuacagcuugcuucuugcaucccuuugauagauuccuaucaaucaguguuuuguuauuguugguuguuuguuuuaaagcacgucucuauaagauguacuagguucuuuuuguauaguuccagucucgaauuacucauuucgucuaggaauuggguuggaauuguuuggaacuuuuauuggaaagccaggucugacccaggagugaugcuuguaaucacaauguucuggagguagaugugucagaauugugaguucaacguuggcuugagcuauacuuugaaagaaaccaaggucugggcacuaagcguauauguuaaugggaaugucauuaauuccagccucgccugugaaauaaggaaauacauuguguauagggauuuagaugacacagucuauguguguauauauauuucugcauguguguauaucuauacuaaaguaaauaugaguucauacugguguaaugcugauugugauacauaucguucugguuucuccccaguucaucuggaaacuuccuauagcaaugaugagaaaccucgcuccaucccacuguuugcuuaauuguucguuuccauuauacaaguuuagcaguauuggcauugauaagccuugcuagcaugaacagccacguugccaucuggagucuggugccuauaugcagggccuuuugcuuuaagcucacucuuuacacagccagccagccagccagcugucaugaguugguugcacacacugcuaguuacauucuuaugucagagucugucuuccaucuuggaaucccuuggucuuaggguuuauuuucauguacauauuaagauuaaaccuuggucuuaugaagcucuguggauuugacaugccuauauuggaaguaucauaucaaaugacuuugacacauuaaaguucccuaucuuacccuauuacucucauuaugccuacuuuuuacuuuaaccuuuauuauuuuuauuauuuaaauuggguaucucucugugugucuguguguggguaugugcccaagugcaggugcccguggaagccggaggcauccaucccuuggagugacuuaugcgugguucugaguuaacucaauguuggugcugggaacugaacucugagucccugcgaaagcagcacucauucuuaguuguugagacacccccuucucuuuugccuaauucuuaaugagcuuuuaaaaaauauuguuuagaguucuuagagguuuaaaugguuuaaaaauuuaaagaaauguucauuuuuuuccgugccggagagugaacccugagccgagcauuuguugauuuagucuccacccccuaagaguuuuguaaaaaugagcaccuuucaaguauggguugcaaauauuuucuucuagauugucuaauguuuuuauucucuugccggaggaggugcuugguucuugucuuucuguuuuugcuuuuguuguuguuuucguuuuuaauuuuuuauuauauauuuucuuuauuuacauuucaaauguuauccccuuuccugguuuccccucugaaaacccccuauccucuacccccucucccugcucaccaacccacccacuccugcucccuggcccuggccuuucccuauacuggggcauugagccuuuacaggaccaagggccucuccucccauugaugaccgacuagaccauccucugcuauauauggagcuggaaccaugagccccaccauguauacucuuugguuugugguuuagucccugggagcucuguggauacugguuaguucauauuguuguuccuccuaugggcugcaaaccccuucagcuccuuggguccuuucucuaugucuuucauuggagacccugugcucacaguccaauggauggcugugagcauccacuucuguauuugucaggcacuggcagagacucuaaggagacagcuauaucaggcuccugucagcaagcacuuauugacauccacaguagugucuagguuuggugauuguaugugggauggauccccagguggggcagucucuggauggucauuccuucagucuguuuuacacuuugucucuguaacucuguuuuguuuuuaagucauggucucaauaugucauuuaugcuggccagaacucacuauagagcguguagaaagaaucccugauccuccguuuaaaagacacacgauccagguauuuuauuuacaaaccauaggccuagauagggcaggauuagaguucuacuaacucacuccccagcuauaaggccccuugucacuugcuguuucuucuggccuccggcucaugauccaucuccucuugaggcagcccccuccaccucugucuucuuucuccucuucucccucugccugcaaccccucacaggauccucaagucccaccuuucucccuccacugugcugcccagucacaggcucuaggcuucuauuggccaguuaaauuggggagcaagauucacguagcuucacuugguauaccugaagaucugcuugguuggugugugugugugugugugggggugcauccacaucuugagaagccaguauuuagcauuagcauacaagcagugucauaacaacccacuacaacagugcaggccggauuaaaacuuacggcaauccuccuguugcagccuccagacuacuaagguugcaggugugugcuaccacacccagcuagaugcuuaaggcuuuguaaaugcauuuguguguguucaugcauguggguccucaugccauuggacauacauaggcauacgugugugcuugugugugguggccagagcaugacauagcucuuauguucuggagccuugcccauccccacugacacagggucucccacuggccuggugcccaccagucagacugggauggcuagccauggagcuucaaggacuccuuggaucuugcugucccugccuccccacugcugggaaugcaagugcacacuugagggccugaauuucuuuugucuuuuguauucugugcccuggagacugaacuugcauccucaugguuucaaggcaagggcuuucuuuacugacagaggcauccucugagccccauguuuuaaguguugguaaaguaaaucuaccgauuucaugacuuagugugcuauuuugaagaugaguaccuauuuuuauagaguuauuuuuuuaacauuuaauguauuuguuuguguaugugaggggaaggaacacauacauguacuauggcauacguguggaagucagccaguuuucucuucucaccauaugauuucuggggauugaacuaggggaaucaggccugccaggaagugccuuaaccugcuacaugaagaugacucauuagauggcauauuuaagauccgggagaguguuuucugaucuacaucccacugacagagaugugugaggaguuggaauguguuuauaaaaauuuagauucuccuaaagaggaaacugagcaauuaggaaaaacaaaacacagaaugggagagcuagcuaggcucuguugcucuuucuuuuucgcucucuuugaaucugaauuuccugacgucaaggaucugagucucagcugugcaucuuacaaggcacaugacuaggucaugugggacacacucagagugggaacuacaguaguacuuacugaguguaauuguuguggaggaugguaaguguguguguguguguguguguguguguguguauacacaguguguauucuuuucagugcauaguaacaaaggagaggcucccuguagccaaggacaucagaaaugguucaucgcacgacuucugaaguucaagagugaauguccucgguaggacuccagggcauuccaggcaaagagguagauacauuugaguuggucagagugauggggguguggugggaacuguggacauucucacacccagagcugacagaagaccagacagccaguuaugcucuguuuuuuauaugcagcaguauaaaacuauucauuucacuguacuagggaagaauggggccaucaaagcuguugaagaaugcucuguuaaucacagggcuuucugaaguuuacccuuccuguacagaugagggcccuuucauucccaccauccuccgggauuguacaguacuuaagagugaaguuggggauuucaugucagaccauccuuacaauuaacagcagaccgacuuaaagauguaaugagugacaaagaacguuugauccugcuccacccagcccagaguuuugaacgaugaacaauuucucacggacucuggcagcauaccuaagcacauacauagaguaccuguugaaugaauuccacauuuaauaagaggucagauuuuuaauuguugaaaauuguuuuuaauacaagagaagaaaauagcuuaaggaaaaaauaaugaucaacagaaguuuauacuuaaaagagaaagaaaaccaucuuaaagucucuuacagaaggcugccuguauuuagguuuaguuugaaaauguuguauguaccauuagaauauuguuuaggcugaucuuuaaucucaaaauaugugcauauucuugguuaucugugggccuaauggaacaguguuuccgguguuggaacacacgugcagucauuaaacacuggacucuuucugauugcucuagcaguuauauuugguaacauuguaauuguuguuaguauuuucuuuagagauuaggaaguugaaaacgguuuaggaaaaagaauaaggaugugaggggaaauaacuguaagucugucugucucuuugaaaguacuguguguguguguguguguguguuucuuuguuuuuguuuuucaagucaggguuacuuuguuuaguccuagcuguccuagaaugagcuauguagaucaggcuggccaugaacucagaacucagagauccuccuccugccucuccagugcacuaccaccuucacccagcuacuuuuaauauauauuauuccaguucucucuaaugguccuguuguucacagguaacggcgaugauacaauauagaaugugaugguuguaugugccucaccuuaacguuuuuaguuacguguccuuauuuaugcauaugugugugauuggagauaagaggacagcuuucuggaauuguuuuucuccuaccacaugcauuccaggacuggcgcucaagucaccaggcugcaggaagcacuuacccaccaugccaucucaccugacugcuuguuucaagacaguuuauuuauguagcccugacugucuuggaacuugcucuacaggcuagaccaggcuggccuggaacucagggagccaccugccucugcaccaggcuggccuggaacucagggagccaccugccucugcaccaggcuggccuggaacucagggagccacgugccucugcuucccaagugcugggauaaaaggcguacaucacugcucuccagcuugacuuuuaaaauuuaaaagaaaauguacucgugaugcuagagaaaacacuuaaccuguacugugagcaaaggucugucauauuuaaaaucugucacauuuaaaaucugcuguuuccuuuggaggcuggaggagggguuucgaugccuugaacuucaguaaguggcuucugagagccugugcagacugcacuugacuguucaguccuacgugcaaaguuaaguucuccacugcguugccaugcacuguucuguccccuguaacagugugcucagcugugugcgggcucacaugugaggaaucuccagccccguucugauguguuuuaaaaacguuauuauggcagacuauacacacacacagucacacacauauacacucauacauguucacauacacuuacacucucguucacagacauacucauacacacucuuucacacacacauaugugcacacaugcacacauucacauguacacucauacgugcucacauacacuuacacacauauucacauauauacucauacacacucuuucacacacacacacccuuacacacacacacacacacacacacacacacccuuauacacacacacacccuuauacacauacacacacacacacacacacacacacacacacacacacacacacauauuuuaccuagaagauccuuguagucaggagggaacacugcacuguguuggucauccuuucauuuagcucuucuguggggcuugccagauccugaauaauugaaaagcauuggaauucuuucugugauaaaaaucuggccuuuggaccaguuccugucacguuacucacgugauacgcacccacguaaagcuggagggcugaugcacaugacugggaaugggcacucgauugcauuuauucacugaacagaaugacccuaggcugaguucuauguguguuaacucauggauuugccuagauuauugucacuuccacuuuuaaauguauagagugugaagccaaccccgagcaucagugcuuaaagacuaaagggcaaggggcuggcgagauggcucagcuggugauggagcuuguugccaaggcgauggaugaccugaguucaacccugggacucaccugggaggaaagaacugacucuccuaagguguccucugaccuccacaugcauguugugucacaugaugcagaaagcacagaagcacacacauggaauacauacauacauacauacauacauacauacauacauacauacauacauacgaaaacaagacgaaaguaggcgagguagcuuuaccgaaguucaggaaucauugaauucauuuuuuggguacauuaguguauuugcugucuuuggaaaauuacuggguggguuggaacaucacguuucuuuuuaugguucuuuaauuuuucacauuucuuccccagauaaaguuuaaagucauaguguuguuugauucgacaucuuugcacuuuucacgguccaucuuuauuaucuuaagccaucuuaagccuugcugugucuguggucuugcagagaaagugguccuauaaaaaccuuggggcugauagcugacugugugguuuccugcuccacacuuucccgguaccucagccucaaccgcuggcagccuuccucagcccucagcugacugcagucgaaaguguaacuuuccuaacuuugauaucuuugucuacugcugcucaccucuuucucaggcuuggcgagaccuuggucaugaagaggaccaugugaauaaaggagacauucauggugguugugacagacgaggucauguuuaggcagcuaaggaggcuuggaacaaaggcgugauugaagcucucauuuccugccaucuuauuugggugggaagaagguuauuuugaaaacagcaaagucucauuauaauaauaaguuaaauucugucuagcauaaacauguuagugguacuuuaccagaauggauuuuuguauauuuaagacagggucucccuacauagccuugguuggccuggagcuuauauaaaccaggcuggccuggccucacagagaucugcucaucucugccuuuacgaugcugagauucaaggcuugcaccaucaugcuguguguguguguguguguguguguguguguguguguauguacacuuuuuauaggugucuuuuaucacuguaaggaauuuuagaauuuaaauugagauaugucucaagugggauuguuuaaucagaggauguuccaugauauugggaaagcuuuucaaagaagagugguaaucuaucuuaccuccacaacuugucuucuaccccuguauuucuuaucugugguuaguucuguuuucucucccggucagacaguuaauggaacagcugagaccugauucugucagcucucauuggaccaaaggauggaagaccuaaagauauggagugacuuaauccaauagguaucaguuauauuuuggguuauuuuaugaucuucagggucauugauauaaucaagcuauugcugucuugaaauauaaguuuaaguaagauugugaaccaguaguucaagugggaaugauuagguaaaaacuuuguguagaauaugguagauggagguuuaagagcucaaagccauuuuuacccuaucuugcuguccuugcucugucugggcacugugauuguauguuguaagaaauaguacauuauaugauguaagacuauauuaaauguuuauuuaguaaauaaagacaaaauagcagggcuuuuagacccaagcauggguaucguuguccuuggaagacuuaacaucuuucuauuucugaauaauaaccuugacuuuaugagucaguauggacacugauugcagcugggguuuuaaaguaaaaaggucuugcuuugugugagucccugagcguguggaucugaaucucgggugaaguguugcagguuagcuaauccaaggcugcagcuccucccacccaguuccauggacacagaguuuagguuucugcagaggcuugaggacacagccuaacucuugagaccagcaggacgacguuagcugggacacaguuuuaaaggcuuuuagcugccacccuuucacaccaucuaacuuucuaaauauuccugcuaaguuuuuuaauacuacuuuuucuuucauugucgaguuucauacauguaugcaaagaaacauggucuuauuuacccauuucucccuuccaucuucucuuaagaaguugccuccuuccaauuuuauguccccucuuuaacuuuaaaaaaauaacccacuaagucuaguuaguguugcccauaugugcaugagugaggauuagccacgggauuauggggaaccuaccaguggccacacacgacaaaggauacucucucucccggcggcuuucagauaaaauaucuccagaaaggcuuaagccagaagaacacuuucccaucugugcugaguauuuggcgggcuggaucuuaugccagucuuauacagauuuuugaguugaugacuaugauauccaauaauguucagaaaacagaauuucauuaguugucuuuuuguuguuguuauuaucuuuuuguuugauuuuuuugaggcagggucuggcuggccuggaacuugauauguagaccaggcuggccuugaauucacagagguccagagagucaucuaccucugcuauggaaugguuggugauaaaggugugcucuaucacaccuggccugcuauggcuuuuguuuucaacugguacccacuauuguauaacccugugguauggaugaauuuuuuacauguauuuuuuuuugcuuauuuauuuauuuugugugcgcgcgcaugcauuccauugcccccacguggagaccagaggacaacuuguagaaucaguucuuuccuuccauccugugggcucuagggaaggaagugagggggucaggcucggcagcaagugccuuuacucaaugagcuaucucacugcccaaacauuauuuuaaaaagcagaauuguagaagagaacugggaacaugugugcaugugcgagcauguguguaugugugcauuuguguguguguguguguguguguguguguacaugugcguguuugaaguagaaagaacaagugauugauaccuugcagaauggcagccaugauaauaacaagagcguuccagucuucauaggcagacugaaugguguaagcugcauguggagcgcuccuuuuucaguuguaaugguguuguucuugucagcugggugucacaccucacuggcaauauuuucugugaugugcuuacaugggacaugguagaguaaagauuagcuugguuacugguaggcccauugguuuaguucagacaagguaauuucacuccuguaguuucauuuaauagaaggucguuuugucuugguugaugagaaucaugcaccaauaggagaauauuaaauaauuacauagaugcucagggugugugaugaaggagagaaacaagguuuuugucccaugugacuuggcgugcaguggcagaagcugaugcuucugccucgcuuuuugaggcgaggucuccuguggcuggcaugucaaguuggugacgugguggacgaugaguuugaacuccucguucuccuagcuccaccuucaagggcucagaguaugaguaugugccgccccgccaugucuggcucgacaccaggaaagaagguguagguaugauggcgaauacuuaccgucucagaauuugggaaguugaggcagaaggauaacugugagucugaugugagccugguguacagagagagacuuugccuaaaaaaauuuuuuuuaaaggugugggauuuguuguuguuguuguuugcuuauuuguuuuguuuuugucauuuaagaauuacuguccagguaaauggucaacauuaucgaaaauaaagcauagccuuuuccuggcuucacccuuuuucuccuuaauugguauccacauuuuuuuuuuccauaccaaauaucuaaauaccaggguuugauuuuucuagauguacugauacugcaggcuauaaaaucagaucuuuucuagaugacuuucagauguacccaaaccucacagggagaacuuguuauugaagaucuucaggagaaaugucuuccuaccauuauucuuguaagagcaagcucguaagaccuucaacugcuaagccaguuuguuaucagaggagacaaguguucuggcgucgccuuuuauauacagcauccagauuucuccuggaaaacuuacaaacaaagaagccuuuauuccuaaggugaagcccugccagagauuucaggcugguuggaaaaguguaaaacuuuuggggauagggaaaauuagauuuucuugaaauuugcaugggaguuaacgucaacauggucacaugaauggcaaacuuguaaaaucccuuuugcaagaaagaagaaagagguggcugccuccccccuucccuggagucaaaccuuucugacacaccucucaaauuacaaaccauugaaacauccgauccucgcagugccuuuggcacauguguguuucuaguuagcugccaugaaugaaaggcucauaacucuguuuccaaagcauuuuuauuugcauugcagaaagcuuaauuguuugguaguaggaucgacaauucuuuuuuaucuacguauggauuggaccauguucgauaaggaacuuaaaaaacaaaacaaaaaacaaaaaacccaaaaaauaaaaaccaacccacuucuaugccaggagaagauucuaaaugagcauuuauugacuuauugacugguauguuggccguggcugcauggaggagccugaguuuuuguguguguguauuuuugucucugugaccgaaagcucagcuaaccuuucucuuaucuugccuacugggcauugaucacaauaucacgggaggcggaagucauaugaaguugcuagacagaugguuggacucccuguggcaacccugugaccuaauuucccaagcuucgugcaccuaacuggagaguuccaacccucgcugucagauucaguagguaggcuugccaguugaggcugggaaggagagaagggugaggugguuccggagagcaucucugcaggcgccaaacccauaccauguaggcaucucuguugcaagggacagugggaaggaguccuuauucuucaaucagcguagucuuuccuuauuugggucucacacugucacuuuagagugguuuuuuuuguuuuguuuuguuuuguuuuuuuaauuaacugaugaauugauagugaguuaaagugauuguuuuugaagacuuauauuuuuaauuuuuauuuauuuauuuuaaaucaaaaccaguuuuuuuuuucucccuaugcaaugcauucugauuguauuuccuccucuccagcuccugccagauaauaccuaccuucccacccacaugcuuucuugauuuuucucuuuaggaaacaaacaggcaucuuucaaagaaagagagaggaaaaagagagaaagggaaagagggggagggagagggagggagagagaggagaaacagagaggagggagggagagagaggagaaagagagaagagagagagagaggaagagcgggagagagggagagggagagagaaagagagagggagagagggggaaagggagggagagaaggagggaggggagggaaagagagggggaaggaaagagagguagagggaaagagagagggggagggaaagagaaagauggagagagggggaaagagggagaggaagagagagaaguaacaauaacauaagauaaaaugaaaacacacaaagccaaguagaacagacagacagacagacagacagacagacagacagaaggucaugugcaaauguccuaggagagcuguuggagucauugcuuugcuucuuaucuauaguaaauacauuugucaguugcucaauuacccaaauaagaugaagaagcgcucuuuucauuuaaagaggauuaauaaauacacauaaggauuuccaaucagguuuuauugccucugugauaacacagcauugaagacaggcacugaugggaguucuaacuucgguucggccuuccuguuucuguggccuggcuaaugcccagacgugcaguguucuucuugcacacauuugcuucauuuugugugcuuuguugggauaaugcugcacugauguccuuggcugcucugauaaaaugggcaccgucugugaugguuagauggcuuugaaucacuccuccuucucauaagcauuggucucuagaauaucuauauaucccuaucguaccacggcucucuucccaccucuaagacuuucuaaucucuucaguauuccuugaagggacugcugagcugugugugaguauccgacuugccucccguccagcagagacuuguaacuaugugugucuuuaccaccaaacaucagaguauguguucauuuccucacccugugacugugaccccuggcucuguggccuaagaguuaucuucugguuuuuaggcauagacaggagaguucucgauaaucaaaaugaauuaauaucugaauguaauuaaaacauuugagcuucugucuguuggaaucagaguugguuuaagaugguccuucccuuccaugugaguaagucugaguguacagaaagcuacugaugucccuugggugacacuuugcucuucuggaauggacuucuuucuucacguuccuguguuagucccaccaugcucccagcuuccuaaggagcccagaccugucuccauguccuugcuucuccugaauuagucacccacaaggccugcuaucucagccugugucuccucgguaccugagccguucucagcugcaagccaaagguuuggcuuggugcuuucaccuugcuccauuuuacuauggugucuucuuaagcccuugcucucugucgaauuuccaugauuuaggguugccaggacuucuagaucuguccggugaacuuacgaaugauguaacuauccuuacccuguucaagggcagcguucucucucuuugguacucucggagcuucugguugcuggcucccaucuaccccgcuuauccaucuaugcuuagauguuauuucagaagcuccuuggagagaauggguaucuaagagcguaggggaaugaaacucugccccaggaaguucuaccaccacccgcugauacugcugcagugggugguuggagggagacuuuuuuuuuucuuuuugucucaguuaaugaauuugugcauuaucuaaacguggacacauugagacguuucuggaauucuuaacuuaggccuuaucucauuucacauagcauccucugucucguggucuuuuaagaagaccucagacccacauuguuucaaucacggcgcugacucuguuucuuaucuguagaaucccugagagcugacccuccauuucucacaggucugaauauaggacaggccucuaggcaucauguuaccccaagucaaggcuugaccguuugugcagccugguuucucacuccuuucacucuguccuucaacaugaagcugcuguuccucaaauaacaccgucagguguguggguuuccaagacccggccccuuccuucccccaucaucuguucccuucugugaguaugcagucaccagauccuaucgacucuucugccgguguggccuguagacccuggguugcugcuccacauuccugccaaucgccucacgcuucugcugcgcaggcgcaggugcaggcgcaggcguaggucacugguuuaucauuucuaaagucagugucuuucuuuguggcacacagaggcccgucuugcccggcccuuucuauucuuuuaccuuagucccaugcaucccauaauaacuucagcuuccugaacacacuuagccucguucucccaugacuuuacacgagcuguucccucugcugugacuuucccuuuuuuuuuuuuuuuuuuuuuuuuuuuuuugcuagccucaccaucucaggaguaugaacucuucgccuuagacuuggcuugaagaccacuuucccagaagacauugcucaccucggcuuugugcuaggcagcccucucauccuuagauuguuacugaguuacaauucaugguuuauuuacucguucccuuuccucccauccucucuaaccuaucucuuugugcccgggcacaaugcuggaugcacagcccccacccaggcuuuguuugcuuguguguucagugaacagaugcuucagcgggcuccaggcgcugcggauuuugauccugugucuccuucccagcagagcaugguaggagaauaaucacuuaguuucuuuccgaggcugucuggaggggaaccugcaagggcgaugcagccugaguaguugugucuccagccuuccuucuuuggaauuuugaaccuccugcuccaguguaacuuacucuucuagccaguggcuuagugccuggaggugaaaaggagagucacugucaagugacacucgagguucguguuuccauagacucuuggaugccguccagacucauucgcacuaacucauuucuuaagccaaauaauaauaauaaagaaaauacaacuguuuccuugguaucuacucacugcacagcacuuaagugcguauaaugugcuuggacccuguucuccuccacaucccuuaccuuccugcccccacccuagaccccuagacaauuuugcuucuauuugcaugugauauguacauccucggcuuuaaauauaaccauggauucacaaaugacaggagacaugguaucugccuucuugagguugacuuaauuugucuacugugauacuuuccaguuguacccauuuuuuccugcagauuguguaaauuccucaaauuguguagaguuaguguuuugagauaacguauggcuaaguaguccuggcuggcccagaacucacuguuauagcacaggcugccaucagaggcccuguucuccugcucugcuuccagggugcugggauuacaaucccaugucaccaugccuagugaugaugugucuucccugacccugcucaccaagccuuuauaucuguugguuuucguuacuuuuugaacaagaagcaggcauuggguauugcuuuugugugucacagacgguccacauguguuuguuagauggcaagugaguucauuugggucuugcauauccuaugcugagauuugcaccauuucauuucucuuccaucuuacagucuggacaaggguaagcuaauucugcccacaauucuggcugagccuaaagagagacaccaugaacaaguuuaacugaggugacagugaccacgcaccuauccccaggacacgcccucaggcaagcgugccugguuuuuccaguucucucucuuuuaagugugagcuaugaucacucucuuugacaggucacagguuuuguaaguaaaucauuguuuaaauugacugacucucucggaagccaaacucgauaagaaguuaaugaagaggagacucuuucaacgccugcccuccuuuccugcacaugucugucagcaggagauagcauucaaguuccuauagaaaacaaguuuagaaguaagguuuuguuuguuuuguuuguuuguugagacaggauuucucuguauagcccuggcuguccuguaacucacucuguagaccaggcuggccucgauaucaggaauccuccugccucugcuuccuaagugcugggauuaaaggcgugcgccaccaccgcccagcugcagugagauucuuaugaggacugcuugggcuagcucagagaaaaggauccucaaaagaaagcuuuagcaauuuguuuuaccaagcuucauggaauuuaccaauauuuuaaguaugaauugugauaucuguuccaccaauuuuuuauauuguuuuuguuuguuugagacaggguuucucuuguagaacuuauucuuugcacuacacuaaccucaaacucagcaaucuaccugccucugccuccugcaugcuaggauuuaaggcaugcacugucauuaccuggcuccuccuuuaacucaucuuuccccacuauuuuguuuaaagugggaacuauauucacugucuucuacuucuuaagugauuccucuaucugcauguacaccuaugugccagaagaaggcaucagauccuguuauagaugguuguuagccaucaugugguugcugggaauugaacucaggacuucuggaagagcagccagugcucuuaaccacugagccaucucuccagccagagguuuuuuauggugaauaaagccuaauuaaaaugugaaaacuacaaauagcgauagcauugcaaauaaccacagcauugcaaauaacgauagccuugcaaauaaugauagcauugaaaccaucuuggauauuguucagcugcuaagaauaaaacaugccuaagugcaaaaauuaauaaaacguggcuuuggucagaaguccuaggaaaauuuugcccugaguugagcuuauuuugcucuguaaucagcuucucugguguacgcauccgacaaagggcugaaaacgagguuacuauuuagggaugcccauuguuuggggagcaauucagugggauggugaugauccuggcacauguggaacaacuccaaagugauuguuauaaagcccaaaugcauaugcuaaguaugucugaaacuuaguuuugcuucuucagaugugaugauguguuuuaaagaaacaccuauuauaauauuuggaaauauuaaugucauuugauuauuucuacaaauuuucaguugauuaauaacuuuuaugcuaguuugcuuauuuuauaugauuuagacaaaaaccuaaauauguugcccaaaaugcacuuauuacuuauugguuguuuucuuacauauguauuuauacguguguauauaccaaauguggcguuuauauuauuuuacaauuuuuacuuauauauguauuugugucucugcguauguguaugccgcaugucuuuaugugcccacagaggccagaagagggaucuggaguuauggugaguugugagccagaugacagaggugcuggggacugaacugggguccuuagaaugagagcagaacacgcuucuguugcccaucucuccagccuccguguuugugugcgcgagagucugccgauagcauuuacagaguggaaucgcuauuuugugcugaugguguggaagagccuguaacaugugccugacuggauauguucguguaauguugucaccugcacaucacuuuacacagccaaggauauucaauagaagagcuccuguugcucuuuggguaacuucauguaauauggguuaguagagucagaaaaagagagguuggauuugauuugggaauguguggaaaagaauaggggauauuucuuuaaauguucuuuguucaaaguguuuuuaaauauaaaagaauuuuggacacuucguaagagaaccauuugccacuacaacaaugaacaacuucuuuuaugcucuuuugcaugcccaugugacucuaagugcacguauagcaugcugauggagggguagacggguuaaaguggucuagaagugguuuggguccuuuuuggaggaacaaauggugucuaaacaugggaaaauuucaauguuccagaccccucccuguaucuuuggucauugugguguccagcccuccugguaccaauguuaaggugauuuccagcaacaggugucccuggcguuuaguguuagccugccaccugugcagguagaagggcauccaugcuccuguguccaggugugugcuuaggcaguuaggaaacacugaaaaacucauguuuuuuuuuuuuuuucauuaaccaaacagcuggcaauucuuuaacaaaauauagagaaccuaccuuucagggugauguucuccugugccaauggugggugaagcuuuguguaacuuuucaggcaguuguuaccugagugucccuccucuuagguuucuucaucuuugccugcucacagggcugcucaggaguuacuguuggaacuuaggaaugggaaucucuaagaccucccugcuccaacaguauagaaaucuugguuuucacgucaguccguucucaguagcgaagggacgguaacgugauucuaauuuaccuugucuuuacauugcucaagauggagugaaaaccucauucguaauuuaggaguuuuccaccccuccccccaaauaauaauaauaaguccaugaagguuuucacaaaagguucuccgggaagaguugguucuauaguacuucuuccccacuuggaacuguuuucucuuggggaaacuguaccaaaaaaccuuccagagaacuuaaaacugauaacuaagagcuuuaaucgagaggcagucuagaaggagagaccugggcucccaccauuuuuauuuccuuacuaaaauagaugccauaguuccaacaugguguguuggaugcugggaccagggacuucauuuuaauguauuggcaagguggggcauuuagcaccagacccagaaacagaacuggaugaaauggguggaucccacaagcucuugugcccucugcuuaguaacuaccuccuagacaagggauuuauaucaugcuauccuuuuuauuuaugucuuuguucuguguguggcucaguauaguuuagaacauaaagcaugaacauaaguuuaauagcagaaaaaauauaaaaguuuccuuugucauaaaauuccauugucaucguauauacuuaacaguuaccugucugucccuguggacugccuguguggaacaggucggacuaagcaaugugguucuauuuguaucuuauucuccucuucuuugguagacuuuuuggcagacacaucauaucaauacgcacacacacacacacacacacacauauauacauaaacacaguuacacauaugcacauuauacauguacauguguguguauauauauauauauauauauacacacacacacacagauaucuauaugugugugcacaugugcauacacacaugugcuuuuaacauauauacauauugagauaucuauauacauaucauuuucuuuucuuuucuuuucuuuucugagggcucauguaacccuggcugucuggcugcuuacuguggagccuaggcuagccuugaacucaugacauuuuuccugccucagccuccuggguacuaggauaacuaucauaauaccuaguucguugucagguauaauauuuuaugcccauucuguuuucuucuuuaaccguauaugcaauguuacuuucugaguggauguuagaagagcucauacauuucuccucccugccauugccuaccaggccucuguagacuguuagcuucagcuguuguuuuucugcaucaacaucagcagcagcauccucauccuuaucauccuuaucaucagcaucaucaucacgucaucacaauuauugugguugucaccguauauauuuaaacuccagagauagauauuugaccaauguauaacauuuauggaaaguuugaaauaugagaccuuauguuuagacuuagaacaaugaaaacaguuccugaaucugacagggauuccuguugauaaugauggcaguuuugggcuuuuuaguaagucaguugaaaacacauuuaaaugacccuauaaaguuauauuuuaugugcucugucuuggggacaaaggucuccauguuagcauuauuuccacacuuagcuauauguccccuuugauauuuugagaugggucuccuguagcuuaggcuggccugggucucauuauguauuggagauuggccuugaacuccugaucuuccagcuucugccucuaaggacuuagacgacaagccuggcauuuauuuauguauuuauuuauacugcuauaaguacugaagaacgcucaucucucucuggaggcguuucuacacgcagaugaccaacuaagaguagcacacucugccuuacaggaaccuuuucugucucuucgaccuccuugcagacuuuccgaacgucucccagacuaaccaucccaguccgcucuucugaagaacauggcuccagugccagagagccacuucuuacaucucccuucgcacucccaguaauguccacugucucugagugcgugugagugcagacauggggauacagugacauacuccucugcagaucagagaacauucuugggugaagucccaccucccacuucauuugaggcagggcuuuucuugcucagugugccgggcuagcucaauagcacuuuacccacugagccuucuccucaacacuuuucucuguuucccagacuuccccuugucuccuuuccaucucuccaggaaaggacugcuuuuuccaacccuucuaagugcgugaccacugugagaccugugugggcagugugucagauuuguggcuggcacaggaguuaguggaaauauagaucuauccgugcaucgggcacaucgcuuuuauauucagccacagccgauauucugaucgcuuaugaagcgaagcagcacauugugaggugucagucacaauuugggagaggcuuguuguaauucauggaaguagucuuuugauguucucuaguuagaggaaguuugacugauaagcacuugauuugcaaauuggaaagaaaaugcucaauuuagccguaucucccccuaucuacccuaauuuccaugguaucuuaauuuuuauguuacuaugauaaaauacucucaacaaaagccauuuaagagacaaggguuuauuuggcuuacaguuccagcuuacuguccaaccuugugagggacaucaaggcagcagggacaggagcaauggauuaacaugguagcuuucagcuggcucuguucuuuuuguuuuguucaggacccaggacaagaaaugguguaaccuguauucaaggugggucuugcuauuccaguuaacucaguuaaggaaaucccucacagacaugccccaaagccaaccuacuacucuagacaguuccucguggagacucccuuccaaggugaccgcaguaaaaucuaaccgucauacuugugaacuuuagguugguggugaacccagaacuugaaggguuccuuaaguuaguucaaaccuauagguaucauauaguuuagccuugguucguagaaagaaauguuucugauuuuauauauauauauauauauauauaugugugugugugugugugugugugugugugugugucuauauauauauguauauauauuuguauguaugugugguguguguacauauauguacacacacacuuaagccaggggaaggugggugaucccuuuagagcuggacuuacaggaguuuguaaggcacccaaggugggacagaaguucugguccucugaaagcagcaagugcuaguaguugcugggucguuuguccaguuccuugcuacccuuuaauggaaaaugauuaguguccacugucaguagagacugacacauuugccauagacaauguggaguugcguuagguauaaauauaguuucugaaaaacuaacuggucaccuccuaacagcaccucacgcccuacaaaacaugagaccugagguccuuaccucaaugaaagcuugaaagauggagagaggucaggguuuugauaacauuguugaaacugaacccuugacuccaggauccggcuccuuagaauuacugucaccagacauggacgcugacugagaguagagaauuaagaugagguaaagcgucuucugcagcuugauucacauugaaguuuuaaaauccacuacauuuuuuaaauuuucugugcaugcauguaugugugugcauguucgugugugugugugugugugugugugugugugcaugugcacaugugcacauauaucugcuaugcggauaugaaggccagaggauaaauugugguaauuggcucucagguuaucagacuuggccuugaguaccuguacccacugagucaucuugcuagacuagaaguuuuagcaaguccagaaaauaucuauagggaguguguguguguguguguguguguguguguguguguguauguauguguauauauauauauauauauauauauauacacacacacacauauauauauauacacacacauacauauauauaucuauauauagucuuagacucguagagaagcaaggccuuuacuucccuguuggcuuuaugguuuaugugagauccuucaguguucugauagcuuucaucugguuuguuccucucucuugggaugauucuuaguuuucuuggcauaggacuucgcaggacccgaauggauugaucucucgagugaggacuugaacagguugucucuuggucuuucauccagcuccuucuagcuuuccugguauaguauuuuauuucuuccugcuucaggcagauacuguggugaacauguuuggaagaaaaaaaaaaucaguccugugucucucagcaggaagagagcuacuucaggagacaacuuuuguguuggauacaguaauagggaauagaaaugaauggaagauauauguaaugguacguauggauucuuucuguuaccgcugcguccuaugcugucuuaugagagggcggugcugcacggaaucugcugcuguucugaaaugggcuagagagaggcaguccacggacugucugcacaccgccuccugagguccacggacugucugcacaccgccuccugagguccacggacugucugcacaccgccuccugagguccacggacugucugcacaccgccuccugagguccacggacugucugcacaccgccuccugaggggcuucugcuuucggguuuucuaguugaaagcagugcagcccacuuuaaguuuaaggaucuuggggauuuccucugggaggaaaaagaagccaacacagccuggaacagugggguacacugccuggcuugucaccucugcuccucacugcuucuccuuagcccaaagaucaauauuaggccauuaaggcaaaagucagccucugccuccccuggucaggccaguuucuguguuuagcuuggaagugacccagaugucccuucgauuguuuugucuucauuggccuuaggaaaucaacucugagggcuuagcguuugaagccaggcagcucauccauacagacucauucuguuuucuauccaaauaugaccaugaccugucuuaggaaaagcaaauccaaaaucaaaacaaauccccccuauuuuaaaacacaguguaagccaguaacagaaaugucuagcaauauuuuuuuuuuuuuuuuccuuuuuuuuuuuuccauuuuuuauuagguauuucgcucauuuacauuugcaaugcuauaccaaaagucccccauagccacccacccccucuccccuacccacccacuccccuuuuauggcccuggcguuccccuguacuggggcauauaaaguuugcguguccaaugggccucucuuuccagugauggccgacuaggccaucuuuugaugcauaugcagcuagagucaagagcuccgggguacugguuaguucauaauguuguuccaccuauaggguugcagaucccuuuagcuucuuugguacuuucucuagcuccuucauugggggccaugugauccauccaauagccgacugugagcauccacuucuauguuugcuaggcccaggcauacucugacaagagacagcuauaucaggguccuuucagcauaaucuugcuaguguaugcaauggugucagcauuuggaagcugauuaugggauggauccccggauaugguagugucuacaugguccauccuuuuaucucaacuccaaacuuugucucuguaacuccuuccaaggguguuuugcucccacuucuaaggaguggcauaguguucacacuucagucuucauuuuucuugaguuucauguguuuaggaaauuguaucuuauaucuuggguaucuuagguuuugggcuaauauccacuuaucagugaguacauauugugugaguuccuuugugaauguguuaccucacucaggaugauucccuccagguccauccauuuggccaggaauuucauaaauucauucuuuuuaauagcugaguaguacuccauuguguagauguaccacauuuucuguauccauuccucuguugaggggcaucuggguuccuuccagcuucuggcuauuauaaauaaggcugcuaugaacauaguggagcauguguccuucuuaccaguuggggcaucuucuggauauaugcccaggagagguauugcuggauccuccgguaguacuauauccaguuuucugaggaaccgccagacugaucuccagagugguuguacaagccugcaaucccaccaacaauggaggaguguuccucuuucuccacauccacgccagcaucugcugucaccugaauuuuugaucuuagccauucugacuggugugagguggaaucucaggguuguuuugauuugcauuucccugaugauuaaggauguugagcauuuuuucaggugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuuguccuauugacggugucuuuugccuugcagaaacuuuggaguuucauuaggucccauuugucaauucucgaucuuacagagcaagccauugcuguucuguucaggaaucuuuccccuguacccauaucuucaaggcuuuuccccacuuucuccucuauaaguuucagugucucugcuuuuaugugaaguuccuugauccacuuagauuugaccuuaguacaaggagauaaguauggaucgauucccauucuucuacaugauaacaaccaguugugccagcaccaauuguugaaaaugcugucuuucuuccacuggaugguuuuagcucccuugucgaagaucaagugaccauagguguguggguucauuucugggucuucaauucuauuccauuggucuacuugucugucucuauaccaguaccaugcaguuuuuaucacaauugcccuguaguaaagcuuuaggucaggcauggugauuccaccagagguucuuuuauccuugagaagaguuuuugcuauccuagguuuuuuguuauuccagaugaauuugcaaauugcuccuucuaauucguugaagaauugaguuggaauuugcaauauuuuuuuauugugcuuuuuuucucacuuucaguuuugguuguccagcccagguccugacucacccagggcaaguuugagaacauugagcuaacccugcagcccugauacccaucauguuacuauggaaauacagugggauuucaaaaagccuaaaagccauuucuuaucuauaaaacuuaauuuguagauagugguauucuucuuaauaggcaaauauuaaaugcaguaggugguuauucugauauauuuuuuauucucuaaaaaucagauuauuguugacucaggucaaaguuacgucaguguaggugcuugcugcucucacgccugagauaacuuugguuggcagagguagggauaacacucgccucgugaacuagcauagcagaugugccuuuaaaacucagucaauuaaaauacauuuauuggggcaauuguaguguguggucuauguugguuuuuauaaaaucugaaagaaaauacaagugauauacaauacugaaucaugaaacauuaaagaauaaccuaauuuugauaaugcaguuuacguagaaagugcugucgguauggcacagggaagagagugguuucucugaaucguaaucacucuaaugucugaaaagccaagcugugcaguuucauacagauucuucauauuuggcuuaucuguauuuaggaggcugagucaggagaacugcggaguuugaggccagagugggccacaucgugaguucuagguuucgagucagcuagggcuacauagcaagauccaguuucaaacaacacaaaccacaacuccacaacaccaacaccaaccauugcagcucauuugcaugugucgccccccccccuccaguguacgcaugugugcacauacuuauuuccccuccgcccguggccuuggguaguaaacugcagacucgcaggcauuucuccccuguacauuuccuaagaagaggaaccucgcuugacauaaccacuguagaacucuuccugcucaaaaccuuuuucuuuuuaaauugguuauuuuauuuauuuacauuucaaauguuauccccuuuccugguuuccccucugcaaacccccauccuauccucccuucccccugccuuuaugagggugcuccccauccacucacccacuccugccucaccgcccuagcauuccccuauacuggggcaucgaguuuccacaggacuaagggccuccccucccauugaugccagauaaagccauccucugcuauauaugcagguggaaccaugagucccaucguguguacucuuugguuggugguuuagucccugggagcucugggggggucugguugguugauacuguuguucuuccuauggaguugcaaacccccuucagccucuucaguccuuccccuaauuccucccuuggggucuccaugcucaguccgaugguuggcuacaagcauccauaucuguauuggucaggaucuggcaaagccucucaagggacauggggaacugggaguagccacuagaaagucccaggugccaggaaagcaagaggcucccaggauccagugggggugguguuaacugaauaccccacaaaggggagagugaaucuguagagaccauauccagagguuaggcauggccuccgguugagggauggacccacucacccaucuuauaaauauuaacacagaauuguuccugucuaaaggaaaugaaggaacaaagaguggagcagagacugaaggaaaggccaccuagagacugccccaccuagggauccaucccaucugcagacaccaaaccuagacaccauugcugauguuaaaacucuuaauauauagauuuaauacagccauuuuggaauucccuuagucaugugauggcuguccuuuuguguugguuccuguuagcaugucaucuucccaaggcaaacauauaagcauuuguucauggucucuccaggacaggcuuccuuuagucuuuacugguguuguccaguuugguaccuguuggucacuuggggucauuuaaauaucaauggauuggaauguagcgaaguugaaaucuguguccaucagucauaccagccacauuuggaguacuuacugucuacguguggcuaguggcugcucgguuggauuguaccaauauagucucuucccauuaucacugaagguucuguuggauggaucuagaacuuuccccacgcuuucugucuaucacgaagccaguguuuugaagagaucaguccaguuguccccuuggauguccuguguuacagacuggucuuguuccaucaugacuucaauuuagaugguggccgauuuuucuucccaaagauaacagcacuaauacaguuagccuggccgcaucuauuuuauagugugugaaaccugcuccaacugaggcuggagggaucucugcucacccucaauucaggcaagggcuugugacagccggcagggaggagcaagccauccacugggauuuaagauggauccuuuauuaccuagagcuucacucugcagaugcccaggccgggacgguagaugaggaugcugagcugacagccaggggugcuucccaucucccagcaugcacuucucucaguugaggucaaaccucugauggaguauacaagcuguaccagcugaggauugucccaaucuugaccagaagcgagcuaauaaauaaccacucuuucaaacuuguaagaauuggagaguuuuugauuccaucguaaauaaaugaugcacaaguuaaacaaauaugccgaaaguacaaucuaaguuaguuagcagcagggugacuguugcuagugaugguggguuacuugguuaggguaauggcaacagaucucccuaucgucaagaaaaaaugcucuucagugccauuucgaaguaaaauaaagggacuugucacuuugagcagaacaggcuuccacagguacaugucaacauuuaauucuccaucauauaaaauuauccauccuauguguuugcacuuguguauccaugugaacacacuggugugagcacagguggaaggcagacauugacgccggauaucuuccuuaauugcuugccaucuuaauuuuuaaauucuauuuuuauuuuucaaauaauuucuaugaauucuuuuggaaugucaaaguacuuuuuucucauccaauuuauuucuuguaaucuuuaaaaaauaauaauuacauacuuucuccuucccuuggaaccuucccauguccaccccccccccccuucucagaugcuuuuucuggacuuuuaggccuacugagccuguuuaguguugcuuguguguucaugguuucagggcugucugcuuggcaucggcucacugauuuauccuuaugugugugcuuggguugugcaugugugccacaugaguguguaguacgcccauggaagccggaagaaggugucagauccccuggagcuggagucacagguagaugugagcuguuuuaugugggugcugggaaccgaacucagguccuuggugagagcaggagaugcuuuuauccacucggccaagcucuccagcccagaacaaacccugccuugugguugcuguuauaugauugcgaagaugcaugauuaaguaggacuuuugaauuuugucugccgauaagaaccauagaucucugauaaagggagaaggcaccacuuugucucauuuggauuucacacugggcacauuuacuuagacucuuuaaaaucccaaauucuauuuaaaguucuugcugcgauauauaauuuaagacaaacgagaaggaaaauuccuaugcacauugcuuguguauagcccuuugacagcuuuucagggcucaggacuuuuaauucucuuaugaggucuguggcuucccugauagcugcucuugacagaguauuuaggaguauuucuuccaagugacuuuuaucacaggacagaucucaggagagaguggauggaucaguuaacaaguucauagaacaaaucagugaagcauccugcuaagucgugcucucucguuauccagagaauuguggccagggaacugggaaucccaggauaaaugagcccuggccaguggaaaguuaguagggucagagaaagauggugacuugcucagcucugggagggcgagcuacacagcaguggauccgcuucgucuggaauucaucuuucaguguccgcagagacuacuucaguuugcauuucccucgaagucacugaaguccgugaaggucaaguguguucucuaaaacgcugugagguuuucuuguagccggcacauacaccuuaguauccucuaggucaucuccaauuacuuauccuaccucacagugucaauguuguguaagcagcugauaggcugccuuggcggaggaauaaggaccagaaacauuagucaggauguuguuugcaacaauguacuuuucaaugucguuuggaucugugggggguggcugcaucugagaaauggagcgacaggcugggggaucaugggagaagaccugacugcugcucagcaaugaaggaaaggaaaggacggagcccaaggcugugacauugggaaugaacuguggcguuggguacgcaggagagacugguuuaagcacuuuuggagcagagaauuuaagagaagcuaccacagcuguucaggugccuucgacaugacaagucuuaaaugucaacaaggaaugccugaauuccuaaaaacuagaaaacaaugcauugacugaaagucccagaggguccccugugagggccucccucucacacacgccccuguaagcugcaauuugcuacaggguuucuuucgccuggcagcuagccacugggaucaggcugagcugaccuccacaggcugauggacuguuuugagagccagccaguggugauggaauggagcugcauccccaagggccuaaggugccagaagagggcaacaucccuuaguacuuauagagcuuagccaucuuggaacucugacuuaacacugaaaauggaaaacacuaauacugaugcauuuuguuugaugacgguuucucucucucucucucucucucucucucucucucucucucucucucucucucucucccucccucccucccucccucccucccucccucccucccuuccuuccuuccuuccuccuucccucucugccucccuccuuuccuucuuuucuuccuuaccccguccucucuuucucccucccuuuauuuauuuuaaaacaaguuauuauauagcacaggcuagucucagacuuacuguauagccgaggauagcuuugaauucccgacuuuccucucucccccucccagguguugaaauuuuaggcauaugccuuggccuggccaacuaauuucauuugaaaaauauuucucuuuauguuauguuugugaguauuuaccuguauaucuggguguguagcacaagcaugcaaugccuguggaggccaggagaagguauaggauccccugggauuggaguuagagaugguuguaaauuguuacauggguggugggaacugaaccuggguccucuggaagagcaggcaagugcuuucaaugguugagucaucucuuuagccuucuuucuaucuaucuaucuaucuaucuaucuaucuaucuaucuaucuaucuaucuaucuaucucucaucugugugucugucugucuggcauuuauuuguguguguguguguguguguguguguuuguguguguguguacagauaguguggugugcaugcagaggucagaggacaacuccauggaguugguuuuuuucucacagcauuauaugaauccuggggacugaacuccagucuucaggcuuguucagcaagcacguuuacccacugagcuaucucaccaguucuuuuuuagcuaugucuuguagucggcuugcuugggaugcaugguguagguguucagggagggaaguaaguaccagucgugggaaaaguuauuaguuguuuuuguuggugguaacaaaugugaucacuguuguuuucugacauuuucuaaagaugugugcugcuucuaauuccucuaugacuaguuagccugucuagccuuugcucagcucagcuacugagcagagcaggaggcaggagcauuauucugugacuuacuguccuugagccccuuucaggguuacaaugcuguagggugggggcuucaggauuucuauucuuguucuucacucugcugccaaguucagaguccugucaguuccaccuugcccuucaucugccuccugcuuggguuugggaguuuacagaauauaaaucguuaaaacccuuuccccccaaauaggacaagugucuuaauugaggucaggcuaacaccuagagugacagaaucuucccccagugccccguuggcacacagagagaacucacacagccaaagaauggugugaaacuguguccccaaaguguguccacugggauaaggcauaugcccaguuggacgcccagggcagcagcucucuugccaacuucugguguucuguuuggucucaggccagauggcaacauagcagcagguggaccaucaacccaggccuuucuucugccuccucagggcuaggauaaaaugcccagcugucucuucccuuguaggagugagccugugcaaucacuaauugcccuuacuguuacuuaauauuuacauagcuuuguugacauuuguaacuguaguaccacugauauggauguauuuggauuauaaaggcuuugaguugcuugguuagaguaaguggaacccauuuaccagcaagucggcaagaugaaagggcuuccugagugggcauggaggagguggacagaccuguauuagacugaaccaguagacugugaugguuagacacacccuuacugagccuguaugaauuaaauagucucuggaccuguuaucaugcaccuguuuccugacagucaugagacaggagcacacaaaaggcgcucccuugagucuaaauguaucccccaaaucucauaauucuuagauguuuuugcuuggauuauauuauuauuacacuggauuacacuaacgguaucuauagcuggaauacauugacuucuggucucacuguagucagggacacacggaaagucaucaagaagaaauccugccaaaagagccaagaauguuagugacacaggguuccuucauguaggucuugcauccccaagcaguagcuuggguuucugcgauuugauauaaguaccauaaggcuaagugcucucaguaaauggugguguauccugcacauccccuuugucccauaaugcagcccaaaugacacagcuucuguugcugugcccuuaggaagguguuggcuuuugccgucccuucccguggggucuuaugaagaaaggagauccaaauucuaaaguauuuaaagccaccaggugccaacaaauucaaaaaacaaaagugggagagagggccaaacauuaagguuuugguaaaugguuauaauuagcuaauuaucucuucuucugcauuaaugucauuauuaacaucaccacugcuaagaccauaaucgcuugggucaucacacuucuuguagccaugccugugagcuccugacugugaggaggaaaucacaccucacugcugggaugcaggguuuucuucucuuagagaaucugaaaccucagcaaugcuccuggcuccacagccguaaauugcuuuucuuuuacuacugggaguauuuaguucuuguucaaagugucagaccagguuaugggucccacuccaccugugggggaauuuuaaaugcccaauuaagaguuucuuuucuuuuuuuuuuuuaaguauguguaugccuguuuuuuuguuguuuuguuuuuucuguguguugaucuguguaccauguacaugugcaugcaauuucugaagaggccagaacaggguuauaacuuccugggccuggaguuguaaggugccacgugggugcugggaauagaaucuggguccucugcaagaccaaccagcucuugauccuaauuacucuuaauuacagcaaguucuuaacuacugagccauuuugcuccaggagcuucugucuagauaguuacaguggcuguugcugauugguuauuggccuccugucuggaucugguuccugggucucugucuuguuuacuugauggaauucugaacuguacuguagaccuaggcaggucacgaauucugucuguugacucuuggucuuggcuuagaaaccugcccagacucccuuaguuccuuuugauuuccuaggcuucgcuacccacugccuccuuccccaccagacacuucagauggaagcccuugagccucaguuucuccaacagccaucuugucaguuagcaucugcauauuaucugaacugguauuuaaguggaauuuuauggaguaacacugaggagggagaaggaaaaaacaaagcauaagagagauuggugugugugagguuaaucuucauugucaacuugaugggaugcacaaucaccauggaaacacuccuggcuaugucuauggagguguuuucagaauuuuaucugaucagagaagacuucuuagucuaggcugggguccuagacugaauaaagaagagaagaucaagcuaagcaccagcauucuucucccuuugcuuccuggcuaugggugcagggugucccgcugccuccugcucucccugccuugacuuccggcagugguagacugugucacuuugaacuguaagcuggaaagaaaucuuuacauccuaaguugcuucuugcgaagucuuuguucauacaaacacacacacacacacacagacacacacacacacacacauacacacacacacacacaguauaaaaaguggcuggauucaugagacauguugucucacuuggacuauggcucuguaacuaguaucugaagaugugucugcauuuagauaauguggguacauacuugcugcaugagaaugaggagggagccugcacuaaugggucugaugguuugaucagagggauguggaaugguugucagugcauacauugcugcagccccacuuaugaucggcugaagaaaugaauaaauauugggaaggcucgcuccuuguuuaaagauugaaucuuuucuccucuuccugucuguucuuggagugagcacucuuauuuaaaaaauguagaucuuggggaggggggcugggauggaggguucuuggagaggaaauugggaagggggauaacauuugaaauguaaauauacaaaauaaccaauaaaaacuuuuaaaagagcaggucuuuuuaaaauauaaggcacucguuuucugauuaaaguccagggucugaauuguuggauaugaucugacauaugccucuaaaaauugcuucaguguauagcuggcaugcugacccauggaugcuggagucugcuucuacucaaugccccuugaauagaggucauggucauaaguacccacaggugaaauacggccauggguucguucuugagguuaagggguuauugcugcuggggcuucuucagugccgaacuccaggaggcuuucuagguggcagacgcaccucugugugugcuugagguucugugcuguagcuuggcccauuugauuuauccauacuuuuuuaaaauuauuauuauucauuaauuaauuugagacagggucuuauguagcccagucuggucucacacuagcuggucuugaacuucuaaucuaguuaccuccacuucccaaaugcugggauuacaggcauagaccaccguguccagcugacugggucuguuuuagaccauaaaagaaaauguuuacuuuccaaauguugacauuauaggaaaguaaaagguacuuauaaccugauccaugaucaaaucaagggggagcgcuuaucuccaaggacaaaugugaagucauuucacuuuuauguuuauauccaucaacucuuugaacuucuuauggaaucauauccuaccagauuauaaugagaauuguuucauaugaaauagaaauuguuuugggguguguguguguaugugugugugugugugugugugcgcgcgcgcgcauauauauaugcauuuauguuugccauugaaggcagaguguaaagccaggccggcuaaucaagaauguuucugccagguaugaacuaacacuggaguuggaaucagggcagugccauggcacacacacauugugacagguggguucucuacgggagggaggccauggucagucguggcucuuuggcgucuucccaucucuaucuaagcacccagcagguuggagucagguguccccagcaggaagcaucagaaggugauuauuaucugaaaccuuggaccuacagggaaaagcuugcaguuucugaaaugcaaaaaaaaauuccuagaggaacagcauagcugaccccuauacacugucggaaggcaagaaauaaaggagacuauagugacuuacacucuccauguguaaagaugaccacgucagaauucuguguucccucugaugaugagcaguguguuguacgcugccugggucauguugccgguaucauuauugucauugucaaacauuuacugagucccugcugugagcacagcucgguuccaggaaacagagaagauaaauaagugaaagauaugguuucuuuuggggaggauguuuuguguaaggacugaacuuagugcuagcaaaguuaagugauuuagucauucaacacgugugcgacugcguauugaacacuaagugcuaggugccaggcucagcaucuuagaaagagaguugaauguuuacuucugcuccuuguuaccaucaggaauggugauggugagucaauuggcuucuuuuuuuucauugcuuugaccaaaauacaugagaaauaacuuaaauagggaaggguucaugcuuuucaagugguucaagaggaugcaaucuguuaugguuuguauaugcuuggcccagggaguagcacuacuagaagguaugucccuguuggaguagguauggucuuguugggauagguguaucauugugggugugggcuuuaagacccucauccuagcuguauucugcuaacaaccuucagauggagauguagaacucucagcuccuccugcaccaugccugcauggaugcugcuuugccuccugucuugaagguacuggacugaaucuuugaaacuguaagccagcccuaguuaaauguugccuuagucauggugucuguucacagcaguaaaacccugacuaagacacaacaaccugucaugggcuugggcuuggugugacagcaggagguacagguguuuggucacauauaauugggaagcagagagcagacaggaaguggagcuaggauauaagacaucaagacccacccccaaggaccaacuuccuccagugaggcucuaucuccuaaagguucuacaacuuucccaaacagugcuaccagauaggaauuacguguuugaacauaggaggccacuggggacauuucacagucaaaacacaauaagcagaugagaauuuugaggcuugugaugcgugaccugucaaugaaauacaacaggcagaaaugaugcuaguaauauacuguauugaaauaauggaacacuguuagaaccuaaauguauguguguauguauguauguauguauguauguauguauguauguauguauguauguaaaugugugaguguuuaaaaaaaucucauuuauaaggacagcuccaugcagauucaggugugaguguguaugcgcggggguguugugugggagugugguuauaugugcauguguggagucuugaaauccacauagaauuucuucuucaaugguuugccccccuuaucuuuugagaugaaagcucucauugaaccuggcaguuaccacuggcuagacuggcuggcugggagccccuggcaucccccugucucugccuuucaucccuggguacagguggguacugucacaccggacuccuuauguggguggagagaucagacuuagaucucauguugucacgcaaacccuugccccuugagccaucucuccagcuugaaugaugcccuuucaagcacuuauuucuuacguugcuugucuguggcagccuugggucuuaucacagacagacauacaauccagacgguccauaagccaugggggcccuugcgauucaucucuuccaaaggagcacagauguagagcugggaauggacuguggacuuuaccuucucuuucugggcuaggcaagagcuccucagcauuggcucuccucaggagcuugacaggacccuaacaagccuaagcaguacugaugcucugcgugacggaagaaaaaccaucuuacauuuuugguaccaggugucaguguuaacauuucaucgugaaaauugggaagucagauuuuuuuuuuccuuuuucaggcacuagguauuuauacuuccucaaggagaaaauuugaaagaaagcaauaauggagucugccguguguuuuaucuuuacguggcaugaacauguugcaggacaggaucauguaucuaguguuuuaaaccugcuggaggugguucuuuuuauuaaacagagauaauaucaauaacuugccuauuugcuuauucuugauuacaauguucaguuccagaagcaaaaauaccaagggagcuggggaucuuuccucccuggagaucucuguaaagagguguucaaacacuuagcugccugaaauaauuguauaguguucugugugucucacuuaaacaaaacaaagcaagauguauggaaacuuggaaaguguacuguaugguggaagauaagucuuuccuucugcucugagcaucuccaguucacccacuguguagauuacuuugauaauagaaaaaaaaauccuuagaauugguuaacauuagacuuuugacucuggcuuacauaaugucuccauuucuauuugugugguggcacguugcaguuuuugaaaccuuguguauugucaagccacagugggcuugugacagugacucgaucgauggggacuuccagggggaggggucaugagucuugguguuaacuauggguuauucagugauggaauuuggaacaggcaucuuaacagcaaguuccgugccacccugggcgucgugagugaugcgcuacagccuuuccuuaaauaucaucauuuguccugcccagcgugaaaaucgggccccugaaggcucuggauugcuagaugacaccucucuuucacugauucuucuuaauaauaaagcuacugacuacuggggaagagaacauaguuggggggcucuccccugguaauucucucucucucucucucucucucucccuccuucccucccucccucccucccucccucccuguuguccuuccccacucaucuuuauauuuaaaauuuuugauuugugaucauuuagcuuuccagagccaucuaugugaccacuggauugcaggcccucugcugaagccugguggggucaccaguguguacagcugaaggcagugaauccucuccuugaaucuauguguaggagauaguucacaagugagguggggccgucugaggucuuccuccauccuugcaggcuucuguagccacaguggguuugugauuacagaggcuugcucagaacauggccuuuugcaaugcuucuccauaccguuuggcccuuuccugcuuuuuagcccucuacuguaguguucucugagccuuagcagggauggugucaaugucauugucauaguuacuuuuuuguugcugugauaaaacacuauaaccaaggcaacuuguuauagaaagcauuuaauuugggacuuagaguucuggagguuagacuucaugacugucauggcugggaacuuggcagugagccagcaggcaugguggucuugcaggagcugagagcucauguuuugaggcacaaccaugaggcagggauagagaaaggugcuaaucuuuugaaaccucaaagucuguccccauugaugugcccuccuccaacaaggccacaccuucaccaacaaggucacaccuccuccaacaaaagccacccuuccuccaacaaggcuccaccucuugcaacaaggucucaccucuuccaaaaaggcuaucccuccccaacaaggccagacuuucuauuccuucccaaacaguuuuaagugaccugaaggccaaucaucaaacggccuacaggaaccauuuucauucagucuuguuuaggguugagcacucaggacucaaccucagcagccuguggagccccugcauuugccacccuucggcuccucccauucaugauggcugagcacagcaguucauuagucuggugccagcugcgguguucauggagagccacucucuuaacuaacauauuguuguucacauagaggggaguucucagcacaguuccucacaaagauaauuuagccuacaacacuucuaaauugguaccuuucaaauuaaccagcuacugcuuuaaaaaauaaaacguguuuuaauguuuaaaaaugaucagcgugagcuuguccgcguacuaagaguacguacuuuuacauaaccacgccaacuccguucauuacccacuucaauccagcguugguaaauuggucuguguacuucagagaaucagagaaaaucacuucauuagccaagcucuuacaucagaaccggggagcuuuagaguuagcagaaccaaauguucagccgucgaaaaucucuaugaagaaaaugcuacugugguauagaaaguuaccagacuagguagaagguuaccagacuagguagaagguuaccagacuagguagguuacuagacuaggcaucacuuguggaggugaacuuugucagucugauuugggaagcuacauucuuuguuucucgcucuaaccagugcaggcagugcugaagagaauagcccuguuaacccagcugucugaggauuuuugcugcaggaggggacuaggggcaagcuguuuccgaacagaguccacagugagacugaccgccuugauacaggagcuccugacaguagacagagagggccucagguuggucucacgggaggcugagaagccagauucugugggcuucaggcaauuucagguccugcuccauccgucgcuccagaguguccgagucucagaugugcagggauccagucauuuuugccaucugaagggaauagcagagagaaucaaagcaugcaugcugaguacucggccugaacucauuuacugcuacacagacaugagcccagggaaugguaccacccacacuaggcuuguucucaguucaacucaauuaaugaaagagcuccccccauccagcgacuaaucuauccaagcaaccccucauugagaaucucugucugggugauucuagggugguucaaguuggcaauuagaacugauugcucagggcuagauacuuguuuuggcucagaauagggcucucuagaaagcugggugauaauuuaaucacaaaaacagugccaucuuguuuuauuauuauuauuauuauuguuguuguuguuguuguuguuguuuugagacagggucucccuauguccguauguagugauaugaggcagcuuuccagaugccaaguuaggcuuugcagaucagaucacaagaccugccuagaaggacagugugccaugagcaacaauaacaacaacagcagcaacaacaacaacagagacaacaacagcaacaacaacagcagcagcaacagcagaaacaacaacagcaacaacagcaguaacaacaacaacagagacaacaacagcaguaacaacaacaacgacagcagcagcagcaacaacagugacaacaacagcaacagcagcagcagcaacagcagaaacaacagaagcaacagcagcagcaacaacaacaaaccccuucacacagccucgagggacaguguaauucuagaaagucuugcuguaacugaugcuucaagaaaaaaauaaaaauaaaacccagcuccaacaaaacauucuuagcugugucaccacaugagaucccugguuaaggaacugguacagacugguuuaccucugaaagaccuuugcuggccuuguuguaugauguugauuuucucccaauaaaagugccagcaggcuuugcaguuccaucagucauggccaugguggcuuugugacaugguauaacuugagcacauugguugucaucacuguagugcgguguagcagggucagccaauucauuugucgcagccguucaucauuuguuguuuuaaaguuauauuucccauccuucucuuccuccuuucuuuuccuuucucucccuuccuccuucccuccuccacugccucuuccuuucuccuauucccuccuccucucuccuccccccucccauuguccccuucucuuuuuguccccaaccccagaagugguuuacuuucuuuuauuuauuuauuuuauucucauguauccaaggcuggccuugaacucucgguguaacccagacucacagccauuccagccucagccuccugugugcugagauuauagguagacagguccacacccgacagcugaaauugagucuaacagcaguugauguuucucuugaaccagagccauuuccguguggucccugaaaacuuuaggacuggaauaauaacacuauugcaaucuugugcguguguaaggguuugaaggugacuaacuagaacccuguauuuuguuagcaguauugcuaagcagccuuguuuuggggcuuauuaaaagaucuccuuuguagggcaccuagucacaaagucuaagcucugaguggcccaugaggucuaacacagagagugugugccauuuggcucucuguccucguuguaacuccgccuuggcccuuuguggugaggagggggaauuuccaugcuggagguuccacacuggagugagauggucaauccugaugucuuuuauggcugugugugauagagaauaucugcacacuugcacaggugagcuuccuucuucuaggcuguucuuagacaaggacuggagcacauugaaugaugaacagccuguggugagcaguuagguauuuugcugaaaggacccagauguagcugucucaugugaggcuaugccagugccuggcaaauauagaaguggaugcucacagucaucuauuggauggaacacagggcccccaauggaagagcuagagaaaguacccaaggagcuaaaggggucugcaacccuauagguggaacaaaaauaugaacuaaccaguacacccagagcuugugucucuagcugcauauguagcagaagauggccuagucggccaucauugggaagagaggccccuuggucuugcaaacuuuauaugccccaauacaagggaaugccagggccaagaagugggaguguguggguaggggaacagggcaggggaggagaguauaggggacuuuugggauagcguuugaaauguaaaugaagaaaauauuuaauaaaaaauuggaaaaaaaagugcguacuuaaagucaguucuugaggcagguagcauuuucuucuauauguacuauuuaaaauagugaauggcucaguuguuaauuuaguccacagaugauccugugugugugugugugugugugugugugugugugugcugcucauccuuaagugcauagacaucaggggucagcauugugugacuuccuucaggacaccaaacuuaguuuguuuuagacaggaccucucaccgaaccuggagcuggccauuuuucugcuacacugccuggccagagagugcugggggucuuccugucucuuccuccccaggguugaggaucugggcaaguucccugugguugcuggggauccaaacucaguuucucaugcuugggcggcagguacuuuaccuacugagcacccccccccuucucucucucucccucuuccccaucccccucucccucccccuccccccucccccccucucacacacacauacacacacacagcaguauuuacuaaaaccauccauugucacucaguguggggggaucuuccuguacccuagcugucaguugggucuuguuuuuguaaugaucuguccaaguuucaagucaccggugaguugcaagauauggaagucuccuuuaguuuuucuccucuccaaaagagaauaguaguaguauuuaucaccaugcauuuguaagaaguuaaacuguuaaguauguaaaguacuuuagaaugagccuggcaucuaacaacacuacacauuagaaaaggaaggagggaauuugucuggcucuugcuguaagcaguaccugggcucagcaaguacucggguacuagccuguacuccacuggccagcaucaccaacucuccugcugauggugugcaccuucaguuaauuacuuuaagggcugguggaaugaggaggaauuagagggcguccagguuacuucauagggagaaacaggaagggacguuucugugagugaccagcucuguguagggacaccuucaucuccuuggucacuaagucuuaauguggaucaucccugugucacaauguaaugagagugguuugauuggucucugucuagagcugcucacaguuucccauggcuuuuaccuuggaaguugauagaugcuaaguacacaccucucucccauugucaucacagaagaaaugcuuaagcagucuacagaaguagcagggcuggagcaaaaugaaaacacacagagcccaggguaagaaagucauucucuuauguagacugacaaccaagcuuacugguggccaaacuucaaauaacagcgacagaauuuccuggggaucugaauugggggugucaagagaacuucccugagaccuccacugugauauuucauuucauuguucccuuuagagagucaccuagaugagccaucuccagggguguccuuaagaguguccuguagauuuaauuccauaggucauggguggaagacaguucagcucuucuacuagcucugagcuugagagccucucuccccuguuaacuugcucgucugguaaacacagaggccucugaauauauuuuuaaaauguucccugcuuuucugugcuguggcuaugcuccuguugguugcagacaaugcgcuguguuaccauacuucucugcaucuucccauauguggggugaccccaucuauucuaugugccugggaauggagccucggcgugcuauuagugggcuuccuaaagucaggcaguaguugacagaggugagauggaaccugggaaagacugguucacuucugagcuuguguugcuucacccaacauuagccagaguucuggugggcaucuagguccugggguagcuuugucccucaccucagcaguuucuuucuuucuuucuuucuuucuuucuuucuuucuuucuuucuuucuuucuuucuuucuuucuuucuuucuuucuuucuuucuuucuuucuuucuuucuuuuuguaauuacauauuuuccucaguuacauuuccaaugcuaucccaaaagucccccacacccuccccuccccccccccccgcuccccuacccacccauucccauuuuuuggcccuggcauuccccuguacuagggcauauaaaauuugcguguccaaugggccucucuuuccagugauggccgacuaggccaucuuuugauacauaugcagcuagagucaagagcuccggggugcugguuaguucauaauguugcaccuauaggguugcagaucucuuuagcuccuuggauacuuucucuagcuccuccauugggggcccugugauccauccaauagcugacugugagcauccacucauguguucuauuuaguuaauuuaguguggguucuugugugugaccuacaggguugguuuuuuuuuucagcauuaauuuuuuauuuguaauuauguaucucugugcagguaugugcacaugacugcaguuuccugcagaagccagaagagagugucugaccccauggaguuacaggcuguaagaucucugacauggguguuguccuuuagaagacagcaaaugcucuuaaccuuugagccauuucuccagccccaugaucuacaguuuauaagacuuacauagauuuuagucaguacuagaucuuuauucagugaguucuauauccacuaauuugaguuuuuuuaguccuuggaucccaggguuucuuccuuugaacgcgauuucuauccccauccuagcugcugccugagagccacaugugcugacucgaguucucugugugucagagaaccgagaaggaagacugacagcucccacaaggacaccaacauugccuuuuaaaagcucauuaaaacacuuaaagugaccucaggggaccuuuagcggcuuuugugacaagcuuuguuuacugguaauaccgcugcauuaggagucuccagagagaagcagccaagagagcuacagagacagaggcagaugagaagggauuugucucacaaggcuggaggcugggacagcucaccgugggcucuccuuguaucagagaaccaaggacaucaguagcugugaccguccagguccagaagccucagcauuagggaagccguugauguaauucucagacuaaggacugauuccugagagccugguagggaaggcccaaguuucauucugaaagccagagaacauggagcucggccaugcacaggcaagagaagaugggcauccuggaucuggaagagagagcaggaacggacucuucugcuaccacaguguuccauuugcaccuccaguugauuggagggugacuguccacagucagggaagauggaccccacucggcagacugaccuccagaaucaugcucacuggcauguucagaaaugcuuagaaauguacuccacagcuaacuagguauccccgaauacagugaagccgaugccuacaauuaacaguguucucccggagauggagaccgggaacucuauuguuauucagauccuguucaauaacuuugggacuuugaacagguuuuaugaccuccuuagaccucagcucuucacuacagcaggagaguacuauauacucccaggugacagggugacuaagacgaugacacgauuuaaaaguaucaugugugugauguaauacccaggguauaaaaugcuacgaugaauuagcagaucagacauaauggccugaauaagaccugcagaggauaaagccaggcaacauuaugugguggaauggggaggggcccaugagccucuaccccagcugaggaucuaaugacaguugaugacuuaucuggggaagggagucugcuuucuuuaagggcguggcuccugcuaaauguaugaugcuacagugcauggcuccacacccucaauaugggcagcacauuuuggacuugcugggcuauuaaaaaauaaugcaugaaguugagaggaggucacaugggccuaagauggcugggaaugaaggagaucacacuaacacauuguaugcaugugcgaauaaacugaaaauauucuuaaaaaggaaaagcaagcguaaguacugcauuucgaaggcucugggacugggaaacuuugacuuuagauuguucugggugggaauuagcugaaaaaaauguggccucuguggauggaggggcagaggugaaacucgggugaagaucuucugagauucuagccccagauugguggauuuccacaaggaauaucuaauagugcgccaccuuaugauucuguguugugacuuuucuaaugcuuaaaauaaggucccugggcuuagacaccuuauaaauaaagagguuuacguaguucaucauucuagagacugaaaguucaaggugggauagcccccugaucuagccccuggugagggacuuaugacaaacuguguuacaaugaugggaggauuugagcaggacagggaggcagagagagucaacugucacacuugcucauuuccugagaagagccagcuuucuucugacaccagcauuaaucucugcugaaggcaggaaucuccccccaccccacugaccuaauuaacuuuucuaaacucuuaaaggugaaccaccaaaccuccgucggugagcauuuuggagacacggucagaccaucuccaagccauagcagauuugacccacaaguccugggaguggauguacucauggguggaucccccaagcauuuguuaaacaccuccugcuaccaggcauucugcagggacuccuaucacaguaaaacaugucugugucuugcucucuccuuuuggcauguguaucugacuaugagacagaucuguaaacaaauguugcuaccacaugauagccaugccccuagaagucaggucaagugggcucagagaaagcugguuuuggcugauacuuuguuucugaaggugagggauuucuaacaauaggaggcugaucacuaaguacaaagaauuauuuggauauguuuucaucuaggucccuuagguccucugaaauuguaacuuugggcaucuggaagaauaagccauccuagcuugcuuugcuguugcugugauguaagacacugaccaaaagcaaccaggggaagaaaggcuuuaguuggcuuagauguccgauuauagucugucauugaaggaaagcagggcagggacacaagcaaaagcugaggcaagaaccauggaggaaaucugccuggugaccaguucucucuccugucuucucucuuccucuccccuauucuccucuccuuuauccucuucuuuucugcucagauaacuuucuuauacagcucaggaccaccagagugggcugggcucucccacaacaauuagcaguaaaggaaaugccccaaagaaacucccacaggcugaucucucauggagacaauuccucaggugaaguucccuccucugaguugugugaacaugacagcuaaaucagacaucacagaagucugucuuuaaacuuuucuagugacauuuaugccuagacuacaauuuagagcaguaaaauuacagacaaaaucuugcugguuacugaggagucuacucuaggcugcaauaugaaaaaggacuucagauguguuucuugauguucauuuacaaccacgguguuguucuugacauuuuagaagugagucuguaguuagcuggcauaaaaauaauguuaaauaucagaaaaauaacuaggugcugacaauuagaaaauuugccacuagguauuuaacacuaggcacucagaauaauguacuguauauaaaauauuaaaauaugugagaugucucauacauagaauacauucuuaagcaugaccacucgccagauggcaagaauucugcugcuggccucugaaugcagacuuaccaaaguggaugcuaccuugccacacuggcugaaagaaagguuuuuguacucacuuucagauaaaggaucuagaacuugcuugauaaaauaaaaagcucauagguaauaaaaccaaaauugaucuucaaagucuuuguuuuuguuuuuuuuuucuucagcaauuuaugcccaauucuaccuugucaccugaguguuugaaauaauuuaacugacaaguccaucaugaagucuugaagaauguaagccaucauuuaccaauuaguucauccuguguccuucaguaguguaucccaugccaagaaaaagugaauagaaacuuuggaaguaaaugaccuccacgggagaggggggugggguggggggggguugggggggucaggaauacuugcugcauuugcagaagauguaaguuugguuccuagcacccaaauuguguagcucacaaccaucugugacucuagcuucaggguauccagcgcccucuucuggccugcuugaguaccugcacucacauaggcacauacugccauacagacacacaugcagacaucuggagaaacaauaaaaacaaauccuuaaaaaaaaaaacagugacagaaccaagcccccagagccuggcaauuuucugauaguuuuaaacaauguuuacuuugcagagaacuugcuauuuugguguauuguuauuaccaguaaaggcauuagcaguuaauagcaaaugaaauggaucuugucaagccagcuauugugagaaaugcuguguuucugaggcacugguugcuguugcuauuuaaugaacacaaguauguuaccuucugggaucaguugguuacauuuuaaauuaguaauuuuuuauguuucuauuguaauacaaaaggcacuaguuuugacauaauauuuucuuguuuuuaaaaguauaucacugaauaauucauauauauauaugaagucaagcugauuuuaauccuaacaacauuaaauuaaauacagugucuguuaugccccauauauuaaugcuucuaagagauuagacuaugauuuccuugucauuacccagauauauauaucagaauaauauaacagacccaguguaaucauagcuucaguggcugcuaauccuuggcccaucuugcuuuguuccuuuucugcuucagguaguugcauuguuuguguaugcgucaaggucucaccauguagcccagguugggccugaccuuaccucgcacccuccaagugcuggaauuauagccacgugcgccauauauauauuuguuauacccucccuuaugaagucaagucaauuuuaauccuaacgacauuaaauuaaguacagugucuguuaugccccauauauuaaugcuucuaagagauuugacuaugauuuccuugucauuacccagauauuacuagauauucaguuagugcccaguguguuaguagucucacagaggucuuuuuggcauugacuucuagucaaagucucgauaaagaagcucuuugacugauagaauuuucaugucucccugcauccccaccccucaguucugcccacauucuccuugcugaagcagcuucacuugcccuguggcauuucccaacaggaggugacuccagucuccccuugaguagcuuagugugucccucugucuuguguaaauuugugcacguggguggggaagugauagaaagauccagaauugaaaccaaauuuggauuauuuuuccuuccucuuuguuuuucuuccuuuccuuuccuuuccccuucccuucccuucccuuccuuuccccuuccucuuccccuuccccauccccuuccccuucuuccccuuccccuucccuucccuuuccuucccuuuuccuuuuccucuuucuuuuucuuuuuucccuucccuucccuucuuccuucccuucuuccuucccuucuuccuuuacuucuuccuucccuuuucccuucccuucccuucuucccuccuuccuuccuuccuuccuuccuuccuuccuuccuuccuuccuuccuuccuuccuuccuuccuuccuuccuucuuucuuuuucuccauauugcuucucuuccuccguuucuugcauuguacuguacagcagaugccuccuuccccagugagaaauaucaggugagguugucuuucucuaucagacgcucucugcucuucugccuaaaaaacucaggcuuuggggguugcacauuuuuaucuaguaaucaccaaaauuuauccuuuuuacuuggauuauuuucauaugagaccuuacucuuauuuauuguuuguuucagcaauguguugcuuauaaagaaggaaauuuggauacaugcuugauucuuucugaguuuuuaaugguaggaguuguuugggaaauguugauguauuuaugagaaguacugguagacuacagagucauagugaaauucuguauauacguguaucagcaagugauaaaacuguggaaaagcaugggcuuugaaggaacgugaaaucaugucaauaauagcucauuagucaacuuguuguguuuugaggaauucagcuucugaaaaugcagugacccugucauuuacuuagcccuggaccaccaugggagcaugcgucuguggacagacucugcugccuuugguucugcagugaccacugccgcuuuagacaagugacuuaaugucugugugccucauuuugacuucugucacuuugggcuaauugaagagccgccugccuaggucuguugucaugguugguugagugagugcaugugcugggcccacacagcgcaugcgcuggucuguacccccauggcgcaugcucugcucuguauccacaucgcgcaugcuccgugucaguugcuuugcaggguaaacagagagagccucugaggcuuguuuauuauguuccagccugauuaauguuauugcuuugcaauccuugaauugaaauguguagacauugcguaucaguagcuguuaaugucuuggagaggccaaaucucaugcagccucuugcugauacucuguuauaguaccaagaaaaaugaacauuuaugucugucuuugacagcauuucucacugaauugugagcuauuugaugggaaaaucuuacaauauaaaauuacuuauagcauauugcugauucuauuuauugggcuugagucacuaauauuuucacuagcuauaauaacguuucauuuuucauuuagucuaguaauaugauuuuuaaauucacaagcagguagauuuuuuuagauaucuagccacacaaaugaaaguacaguucugaaaugugagacuuugaagaugguaaauaucuuuggaugugcccguauggcguauauguguguguaguguauugcgugccucccuuguacacucuaucuuguuuuucuacucagagauccaggacuagcagcuccccgagucagggagacuggcugaccagcaagccuuucucuccguccccauuacugaggccauuggcauugcccagcucuuaccuuggugcuggggauuggacucaguccuucauguuauguggcaagcauuuuuaucaacugagccaucuccccggucucugaaaauagguuuuauaauaucauaaguacagcaacaucagucauuuuuauaacaugaaaauuuaaaauaaugcucuauaauuuaaauaacuugguugcuuuguuuaucuaaaggccuugagucaaauaucccuguguaguuguacauaggaaauauguaaacaggccucuuucacuuauagaugauagaaugcuaggaaauacuaaaauaugcuaaauagaauaucuguugcauuuaauguuauacaugcauucagucucaccuuaaauauuaguuugugcagagccucucagauccuguaaggauuaaauaaagagugaauuguugugugauaagcugagccuggcaccucacucuuugugcuuuguccguugcugugaccuuuauguugaauuuagauacaaagagaagcaccaacgaaccguuuguaugaugaaaagcaauuauugcauggauacuuucuuucaaagugaguaauuuaccauugucguauguuucuaugcaggcugucuauaugugauacagcacgcacugcauugaaguggcagcacaagaaucggagauuauuuucaucucugaggugagucuucuugcagacuuccugcuaguuacuggagagcuuccuuagcaugcaccaagcccugaauuccuuccccggcacagcauaaacuagguguggugguaaauacccccucccccugaacaguaaggagguggaggccggaggauuagaaugcuggccacuaagaccugguugcccaccccucugcuaugaauagauccucaugcacaccaagugauguuauguaaaccuugauccccaauuuaaagcuauugguuaaaauaaaauggcuacagccacuuaugggggugcaggaauaacagagguggaguuuuacuuaguggacugagggucacaggucaggaaccacgagaaaaagaaggaaggcgaagcgaacagaaggucuccauuagaaaugaugguccaggagcauaugccugagggaaauggacccugaggacaggcugguagagaagaacagccuaggagaaacacaaacagcaaguauuggcuuaguacaaucggggacauagacagucuagugauagagacuuagauaaggguaauuugcccaguaauuguacugaagcuaaaccaauaaaccaucgcugacucuuauucauuuggaagcuaaugggguuagacauaauuuaauaaucuacaaucuuuggcuacauagaaaguugggcucacaggagacccagccucaaaacauacgagccaccugugauuucuuucuguguauguguuuugaaaucauggaugcuucuuucaugaauuugaguuauuuccacacucccguuaccugcucucaucccuucucccucucccacugaagcccuucuucacacaaaccccccuccuaccuucaugaucuuuugugugugaaucagugucacuuacgugaguguggauuggaggguacguacuagagcaugagcaauuaccacuggcgacaucauugaggaaggugacaccucuuuccugccagcagccaggagcugcuccccuccccccacucccuuccauccaggaggaaguguugauguugauggacccagacuuuuuuuuccuaaggucuuugaaaguuucauacauuuauauaauguaucuuggucauagccacuccuuucucuucccuagcccuccccaacacacgugugucucucucagcaucauauuuauuuuuauuauauucauuucauuauucuccuuugauuauuuuaaugaggccaaccagcauggcacagacagccuauuagaugccacagccccaaaguaaaguggcugucccuccaucaguaggcauuaacuaccaagagcucuucaguuggguggggccuuguaugcuccugcccacuccaugcugggcuguugacaagcuuggucuuguacaggucuuaugucgguauccaugguagcaggaguucaugcacacaacaguccugucguaucuagaaggcuucucuuugugguguaccacccugucaucugacucuucuguuccucuaccccuuccuuuucugugacaucugccaguccuuaaacugcuuguuauuuccacaagcucaggagugcauuccgauuaucuacaggaugcccuuaugugaugcuggugagaucugcugcaggguggggguccggagcuccucauuaguaacugccugguugccucagaugcccucggcuguugucaucuggggucugaguaucuuugucucacugugccucuuuuuaacauaggagagauauggacauuuccccacuuaccuugauaauacuguagaauaaacugauauuuugcaucugaaaaauugagaggucaagggguuaacauugugaauuaccacaggggaucaaaugagaguuagcgauuuuaugcagagacucuuuuucagcauggagaaauucacaguuauuuuagccugacaccccuggacuaguagugagauggagcuugagaugccuguggcugaguaaaugugcagaaugaaagaagucagguguggagcagugugagggcaggggaagaggcaaguguggagcagugggaggggggaggaggaaucacuugaauggucgugaacgcaugcaugucacuccuggaauucuguuaguaggaaguacuuaagggaacuaucaaccuauagguuaugaaaaaugaucugauaaagcuauacucaugucauuuuuagugguuuucauucuucugauguggaaaaacaguuucugucuuugcccuucucuagucugagccauucaucuggaugccucagagcuccacuacgaggcucaguaggaccacgcaggcguuccucaucaccaucaauauuuaacuuccuuuacuccuguugcugcuccucagcccacugcgcacaugugcuccccugucuguguggcucaggauuucacacauucccacgcuuccucgcucucuuagaagguaugcuggagacuuuuuuuuaaugugccagauucuauuuagugagcaggauugcuguauuucuuucuucuuguuuguuucacaaauacuggacugauggugguaagauuuuuuccugaggcuuugcauuccuuuguagguaguugguuuggcuuucuucugucuaauggguugugugacuauuuaugggucuggaacaaaaugucauauuguuuccacaguuuaccugguuccucucuuagcaacugaggaguagcacucagguuguaagcaaugaucaacccgacauucuuuauaccagagcaggcucagugguucugauucuuugcccauugacccuguaaccuacugcuuggcuggcucaucugcuaaauuuugugucuucuuucuaucguugcaaaccagauacuuuugcgucuuuuaauaagcacugauucucaguuuugcuuuguguuccgucaaccccaaaagaaauugguuacuucagaauaacagcuguaaaguccuccagacauugccuuuuuauuuagauaaugaguauagaauggggggaggccagcuugauuuggggagggggccuugugugcuucucuauuagacacuuauucuucuucauuacauacuaagaaaccuucuggugugagcuuauuuaagccugugcagucauagcuguaagaugacgucauguggccuuguuuauaaauuguuaggguuuaaggagauguguggagaggggacagagcgcgagugucagguaaggguuacuauugcuguccgucuucucuccauagucacccuugccacagucacaugggggaaguucaaaggaaguucuguucaaguggguuugcuccaaaugaaugugauuuaaucaagaccuguuaguacuguaggucauccugaaagacucuacaugguaggugugcuaaucucauuuguuaagaugagcaaguccaggcccggccacgugucaccuuaccugacugacgauacugccucuucagagaaaugaguuaauuggucacuuaugagcuguguuuguggaucauguugggauucuaugagguacacagcuugaccuuagguuuacaguauuuuaguucaacuuuaaaaaaaaaauagcauuaccacuuuaaaagaaaagaaugaacuuuccagcucauguuucuuuuuuauucacaagaugaacauuuccaccucaacgucagguuguuaaagaguagcuacgaugggcuccggauguagcugacagggccggugcuugcuuagcucgcgaguucccguucucauccugagugcuuugucuccaaaaauacccaagcaacaacaacaacaacaguaaauccaggcuuauggugauuaaucaagcagcuugcuuuguguacacacaaacacacguacaccauuuaucucucucuuguacuucagacucugagaauacaggccguagggccagauaaaacuucacugcuggggaugguugauacuacugcucuaagacaaaaugaaauaguuuuagaaagaauauuagagaaaaaaaaucacccuguucuauccagaaaacaguuuaguacuuuugaguuuuaacaggacguucauucacauaaaucuguaaaaaggcuggagucagcaaaaacaguuuuuuaaugguagaaaaacugacuuuuggcucuguuuugaguuuaacacuuaaaaauaauuauuuuaucuuuaagauuacaaauguccuguuuacaggguuugguaaaaguagcaauccaaccaaccaaccaaccaaacaaacaaacaaacgaaacccaaaccaaauccauguuacacuuguuagaauguuuccaauuuucuccaaaagguuaauuuccuugucaugugaagacaggccuuuaaaauccugugauguguauuguccacagaucuuccugucugagaguaaauaggacauacugccugcuguguggaaacaugucauucaugaauuaauuuuagaagccuuagagucuuaugcaggugaagauuuucuuauuucuaugcagauaaagaacaauccacaguuugucuccacauuuuuggucacauggguggucaccuguuuucugaagacaugaaguggauucggacaggauccuaagcugggaauaugauuauuauggggaguuuguaauggaaacaaugacaggugccuauugaugaggagcaggggccagcccucacagguguuaaucagcacccgucugauuguaaggucugugauguuccuuagcaaccaagguagcaaagguagagaacacucagggggagugaacuuuccgucucggaagaguucauaguuucacacucacaaucaggauucuuuuugucucagagcuuugguucugaagcggcuccagguuccugugaucuggagccagcugaucuuguuaaaguuuuauuuuucaaauugucuuggaaaacgugcuguggugguacuauaaacugcaacauagaagccacugcuaagcggcaaagcaguguuuaauuuauuauucucauggugucuggccgcagacaucuuacaguuaucaaaaucugaacuugaagccugccucugugugccccuugggcaaggagcaagcauuccaagcaguuacuucauuaguuguaaaaaaaaaaaaaaucaagaucaucauaccuauacauuuguggaauggauauaugauugaguauuggagcauguauagucacagauauuaauuaaaugauaguuauaauugucgauguaauuuucaacugaaguugaaaaccauaggaaaaaaauccuguuaugaacaggucauuuuuaucauagguagauuggcucuuacuuugggaaccaaacaaaauugaugcuguauuuuauauaguucugauaaaaucagaaaauggaaaguuaucuuaaaugaacuauuauucaauaaugaauagggccugguguauagaugcuggaaauuuaaauuccuucagaccguagugugaagguucaauacagauagauacuuaguguauauugcaaggauauaugugcauggugggacucaggcuccuggcaagugcucucugagcaguagaaguguccuugggauuuuaauggaaagaaugaaaagugagcuaggccuguaaaagacaagaggauaggaaggaagauguggauaggaaaaaagugggagggagggagagggaaggggaggggggagaggagagagagagagagagagagagagagagagagagagagagagagagagagagaucucauaaccauagccauagggagcuacuuucagaucuaggccuuugaaaauguacuauaagucuugucuugucuucucuucucuucaucuucuucuuccuccuccuccccgacccccagacuugagacaggaucucacucuauagcuucuaaugaccuagaacucacuauggagacugugcuggucuugaccuuauacugagucucccgccucugucuugaaugugcuaagauugcaggcaugcuccguugguccuggcccuggaguaauuuggaaacaauuauacaagaaggggguggaguugcacaaaccuggggaguuagucauaugaaguggagcuuuaaguaaaugccucuauccaucauauggguugggaucacagagaauguagucauugaguagcaaggaacugacuauaaaucaacagggcaaagacgacaggcaagccuccaaaguccuaggaauaagcaacacacucuaauaguuuuuaggguaaggagaaauucuggagaaauaaguaaacaugagcuggagguggcuuagucgguacucauggcauaugaacacaaagccccaggaucagaucccccagcauucaaauaaaaacugagugcgacaguguaggucugcagucccagcaauagggagguggggauagggacuuauuagagagcccuggcuagccagcauagcugcgaagaugagguccaggguuagagagagaccuugucucaaaaaauaaggcggagugugaucaagaaagacaccugauguugaucucuggucuuccaauacaugaacacacccaugagcauacacuccccuucuauacacacacacacacacacacacacacaaaugcacacuaaaaauacauuaaaccaacuagaaaugaaagcaggaugugccaaaauuauccaacucuguaggauauaauuaaagccgcguuagaaguaacaaaaacugcuguaucagaaauacucugagccuuugacuccuuugccuccagaaauagcagccgagggaugaggaaagaacccuuggacuugaagaaggaaauggaaacuuuccaaaccgagaagcaaagaaugaaaaagcauugagcagaauaucuaaaacuucaagacagccaggcggggcguacucuauucauaaugaaaauaccguaagaaaaggaagaaaucaaaagaaacaaaaucaaaagaagggagaaguaguugagaauuuuccaaaauuaaugacaaccaucaaagaaugggguacacucccuagcacccacagauaguguauauuccucaagccauaggaauccccaaaacaaagagaagaucuuaaaaggagccaaagggauaggagauuacgucgcuuuagaaggacagagugagaauaucauuccugguguuuuaagaagcucugaagaucaaucaguguccuauagugucagaaaaaccaagcuggaaauuaguguccagcaaaauuauaccucagaaaugauagaggagugugaagucucucaaggggccagcagguuguaaucugaccuccacaucugugccuuaccugugugucuuccuaugugcacacaaccaaaguaaauauaccugaaauuaaucucuagcaaagccucucucaaauagaauaagaagaguccagcugggaauuuuucacaaaucgggugugugccacuuuggaggacaugcugaaggaaauaagauuugugcauauuuucuuccauucuagcccuuguuuguuuguuuguuuguuuuucuuaacugaacauuuugugcccauuuuuauuuacuugaaauuuccuucaaaagccugauaucaaaauaucccauauguauagcauuucugcauacaucacuucugcagcagacgugauggccuucuggaaucucagacauaaaacauuauuugcauucagaauaaacucaggagauagaaaugcaaacagcagaaccaguguccuugggcuuuacguuuuguaagaaguucuguguucuucucugagugcuccucccagugugaguugucguguggaccuucagacccuucaaguuuauuggaucagugugucacucagcagggcguucccaagaaucucuguguuuguaugauauucuccaagucuuucuagaaaagaacccucuuuccguacaccaggaccugagauugcuaaagggcuacuccuauggcuucuucaacuucaccuccugggucgucaguaguuuggcccaggacacugggugaauuccacacacaaacacacacgcaagucacccccugguuucaaaauggcacccgugagcuggcuucugugucuguuucugagcuuguuaccauggcaaugaauugucugucuaguuuuguaguuggcaugauucuccuggcuuagggcaccuguguuuucuuacuaccaguugaucacauguuggacaacagguuaaauuucuaucacaaaggagcaggggggcagagggcaaaaguggggauuuaguagaauuagcuaccucaaugcuccuaaguucccgauuguuuccuuucagugggagcuagcagaagcuucuccacgucccaugguuccucgccccucagaacugguagagaaugguuauuccuacugccgacaagccuuguacuuuggaggaccauuauggaagaaguaaaucaaagcugacgauggcauuugagacaggaaacucacuugcccguccuuuauuuuaaugagucaacacugacauuuuuuugcuuuacuguauguaagcuguaaccaugaguaacuuguuuuaaaguucacaucuacaaccuuaaaacaaauguuaaaauaugauguaauaucgggggauguaagaggugaaaauaaaaugaaaugcugauguuaggagagaugugcauuccaugugcccaaaggaaaagaugcccgaccaggucuucccccgagacacaagcuaagcugcggagaauccuagaucugucuucagucagauauuaagugaucccagaagcugucggcagcaugggggaugugagcaguaugggcgugguuggugaagggugacucagagugaacugaagaaaugaaaagcauuuguugggugcgauggugauuuaagggagaucaugaacuuugaacgcaggaaaaaaucucacuugcugaauuacggccauuguugucucacccguaagucugucacauaugacaacauucauuuuaguccacuuguggaugugacacaucaccucccgcuugugacucagcgugcacagagggguguugcaguucuccacacugcguuacacaguauccacccucucaccuucacuuccgcaucauucacggaaggcacagucauuucugcaucuaggcugaccacgugacagcacagaggaccguuucucaggaggcaggggggacaggggagagcuugugaccagcuagauuuacaaaaggguagaaaccgccaucacaucacacuuggucacagcggaaggcugagaagugauauugucccuuggaaaucugcuucuuguuuccauccugcuaugaggauaacuuucuaugucugugaugugugugucaagaaaacauuauguuguguguauuuguguauuuucaacauuugcugagaucugaggggaaucuaggguuuugccaaaaacccuucccuuuuuuaauacuuuuuguuucugauuuguuuugcuuuuugagacagauucucacauagcacugcuuggccucaaacuuacuaugcagccaaagguggccacgaacucuugaucuuccuaccucugccucccguguaaugggauuauaggcauguaccacaccacaccuggcuucuagaccauucuuguaagccaucuggcuggugucagcacugugggacuuuacucagaauuuucuccgggaacuuaggcacaugucugagcucuguggaguuuguauugccucauccagggaucuguuuauaaggcuuucugucugacaaccacagggacugacucugcucuccucaaagaagaggagagaacuccagauuccucuacaugugaguccaucacugguggucccuguuucuguuguccuuauuuaucaacuuuucugcuuuggcuugguucuucaacauggacuuccuacaaaagacauuccaagcuuucuggcuucuaucguccuuucauuucguuugggagauagccagauaccaacucccuccagagcuuuccgaacuguaggagagaaggcagcuggcuuccuggggccagcuugacugcccacuuagguuuuacuaccagcuucucaguagcuacuguguugaagccacuucugcuguauccucuucuuguucuuccuccuccuccuccucucucuccuuccucuccuccuccuugagagccagagucuuaccagguagucucucggaugaccucacauuucugggcaucuucuugccuuagucuuaaaaguguggugacugcaggcacuugucacagugcuaagaggaaauuucuucaccuuuccuuauuugaagauuaucuuuaugugugugugugugugugugugugugugugcguguguccacacgcacacaugucacauguguaggcaugccucuggaggccuaaagagccagcuagagugauuaugagcugccggguauggaugcugagcugaacuugggucuccuggaagagaagaaagcucucuuagcacuggacgaccucuuuagcccugccuuacaucuaagcaugguuuuguuagacugauguugcaguuacuguuuauggugucugcuguggacaugcugcuuguauguucuaugugucucucuucaucuguguuuuuguuuuuccuaaagaacagauuccacaucuuuuugcuaaagcagacaucccacucuuaggaaaaucucggcuaacacguaagaugccugugugauaaauacacacuacuccgccuuaauuaagggagcuguauauuugcuuaccaucuccuguccuugcaaaguguugagucaagccugcugccauaagaucuuugcagagcugaugaacaaagccagggcuucacagcagugaaucacugugugaguaaaggucccagugcaggccuguuugaugaggcuacuaaauauacgagaauaaaaaauaaucaaaauguggggauugagcuauagcucauugaugaagagcugggcggcauggcagucucucaacacacacacacacacauacacacacaugcacacacauacacacauacacaugcacacagagugcgcgcacacacaugcacacaccaugcacacacacauacacacacaugcacacauauauacacaugcacacauacacacacaugugcacacaauugcgcacacuuacacaaacacacacacauacacacacauacacaugcacacacacaugcgcacaccaugcacauacauacacaaacacauacacacaugcauacacaccaugcacacaugcacacacaugcaugaugcacucacaaauaauagaaaggaaaguucuguauacacuccaagccuuguguccacacacgcacagcuuuucuugagcccucugagacuuuguaaauguauucuucucucauauauuauauccugacugcacccuuuccucccuccacuccuucuacuaccccaccaccaucaccauccuucucccccaaaccaauugcucccauuucccuuuagaaaagaacaggccucccagggauagcaacagaauucuacauaaguugcaguaagucuagcuacacacuuccauaucaaggcuggaugaggcaacccaguaggaggaaacaggucccaagagcaggcaaaagagucggagacagcccuauucccaugguuaggaggcccacagucagcugccuaaccauaauguguacgcagaggcucuagccagacccaugcaggcucauggcugccaucucagucaagcccugcuuaguugauucugugggcaguguccuccuggcauccuugaccucuguggcucagauaggcuccauagaugaacagaagcuggcuuaacuauucagcagaagagaucugccaccuuauguuuguuuauuagaacggaucugaggacaguacuagccuacuggaaugaagcauuugccucaaaguaaacaccguaaauuuaaaaagcccgucuccugagagagcacuggguuguggguugucaucuguggauggugaguuuuauuucacuguuacgagugacagugacuggagaugaacuggagagcaguuuauuuucaugccauucuuaagcccccggagacaagaacuuagaagauugauggguuuuuaaaaauaacgcaaucugcauucuuuccaaugcuguggucucuguaaacacacuaccuugcaaagcagagugugccaagagaguugugugggugucaugcauacauacguacggaacagaagaaagagucucgaaaaaucuacacagaguggccauuucauaaguacccacacacacagcgggcaaccacauuucaaaauagaauuaucacugauuuagauuaaugccuguauuauuuaaaggcacaggcaacuuuggcaacgcuuggggguuuuuuuguacuuaauuuuuaagacuguaaaucuuacauuugucaagucguaauaucaaugaaaagaaauguuuugguggcguuuaaaacuuuauaauauaggacugacuguugaaaguucauaagccugaggauugacuaacuaauucacgaacaauauuuugauuuuaaguuauaaaacauuuauguuaagucagcaaagacuagaacacucaagaggaaauaaaagacaguguggcuggcugaagagauggcucaguggcuaagggcacugacugcucaucuguguuugcagcacuaagccuagaucccagagccuuuguucauguuuuaccauagaauguacucuuccugcauaguaagaagauagugugaccaccguguccacugccacucucaagugaagaggacuuauggugucugcugucucauuugguccuauguaccacccaggcuaaggaagggggaagcacagagauguguggucuuuguuacccagguaaccgggcacugcacacugcuucucaccauguucuuccauucagucuauguagaagauacaguuguuauaaccaaguggccuagagagguaguguggcugacagaagugacagacuugggauuugaaccugucuuugccugugaacccgaguucuucacagcucuguuucagugccugaauucaugauuacugugacccuauaguacacuaaguuagagagccagguuuagguuauaagcccauagcuuuugaucauaggaaaccaucaccugaugaaggcuuauugaacauguuuucuacaugccccgcccaaccccaucaggcgcacagaggaauuggguaauguuaucagaaugcugauuacaggagaauuaccacauaaacaaaggacuugaguucgaaucccuagcauccacguaaucuacacaugccuggaaguaaagauagaagaauccuagggcucccuggccaguuaaacuagccgaauggcugaaccaauaggcugcaguuucaguuacagacccuaccuuuuagaccucauagaaguguggagaaggacaccugacauugacccauguggcugccucaaacaugcacacacaugaacacacacacacacacauucucucucucucugucucucucucucucucucucaacaugaaaaaaauuucacuauaaaguuuuggguuugcaagcuaaccaaggucaacagcugggucuguaagcuaaccaaggucagcagcugggccugcauucuaaccaaggucagcaguuggguauguaaguuagccaaggucagaagcugggucuguaaguuaaccaaggucagcaguuggguggaagaaucaccauuuuauuucccucaaaacaaacuugaaagcaacauuuaauauuuugcugaucgguggucagccuucauuauguuaacuuccagccaauggcuguaacuacguucugcugccugggcaaaucuggacccaccuguguccugucuccuuucaggaccuugccucuccaauuaaagcccucucugacccuuuacuuguuaguaaugcacaagccucagggaccauuugauguacagaucuaaugacagguuuaguuccaaaggacagccuuggguccuaucgucccagccagcuauugacaaagcuuguucuagacuguuacccugaaagcagccaguucauccuauuuauugcugugcuaccugguuuaaccuuucgagaccauguacaugguauuagcuugcuaaaaagaguguauugacaaaaugauauuuuguuggucugugguucgauuaagcuuggguagucuacuuuuucuuuuuuuuugucuucacaggcccuuugugugcucgccaacuggcccgcgcuucuuccuuccucucccacuuccucagugcuauauacgaugcgauuguagacaaaagggcaugaagcuuauguaaugccuuucugcccagauaagaguugagguaaaaauuacuccagaguugauaacccugugagagaugccugcccuccauggucugugcuugaggaccucagaguacgugggauuugaaugagcuaaagaggaagcaucuaucauugcuuaaaagacuuuaucauuuugcugaaaggauacauuaaaagccaucauuuucaacgugauuuaacauggcguauucugucagauggccuuucucuuagccagcugcagggacacgauuguccucuguguccggcgaacugaggaguguuuaaaggagaaguuaaugggcagagaaagcuugaggcuguguccucaaagcuuucauuucccuucucucugaaauccuuucuauguggccuguuuuaucagucuguuuaaauggaaauucucagaggaagugggagagucuguggaaggguuauuggacccuuugagaggugaauuuauacaugccauccuuaugccuuuccucugucagcaauggauucucugauuauuugguuauuucauuuuucucccuuggaaauuacauggguuuuuuuuuuuuuuuuuugaaaagaguaaaaucacuaauuuuugcguuuuauugcgaaaucuaauggaguagauuuucuucuuaaauuugacuugggaaaauuuccuagaguguuagaguuuuaccaaccagucuccuguuucgggggcgggggcuagagagggcaccugcaagguugcagauggcggaugugaaugcuacccugcuugaugcuaaggccucucgguucugaccugucauagucauggaacacagagagggccaagguuuuucuccucuauuuucccuacuuggcaagaguugcuggguuucugguuaaaauuucccaaugagacugucuuaguuaguuaggguuuuacugcugugaacagacaucaugaccaagguaacucuuauaaggacaacauuuaauuggggcuggcuuacagguucagaggcucagagauucaucccaauaucauugaggcaggagcauggcagcaaccaggcaggcaugauacaggaggaucugagaguccaucugaaggcugcuagcagaauccaggcagcuaggaugagggucuuaaagcccacauccacagugacacaacuacucccaagggccacaccuccaaauagugccacuuccugggccaagcauauucaaaucacgacagagaucuuaucauguuggaguuguacugugguuccaaggcugaaggcugaagguucuaaauucguaaguaacuuuagccuguauuuccugguauauccuaaaccuggccaguggaaagugaagucccugcuguguucacuuacggacucuuguaucacuaacucugcaguugagcgucuucaauguuuccgugacuccucagucucaugcuucuguagacaaagauucaguuaugacuccagugugugaggggaacacgugaggagagaugugauuaaccaggaccaaaucccaggaauggaaaggggggcuguacuuacauccagaagggcagguggugacaucgccuacccuuucugcuuggcuguaacuggccuccugucauuuggaucugggggucucaguugucaguucuguagcuugucuugugugccucuauaauaugauugcagaggaggaaguaggcaugguuaccaguaaaggcgagugcagucauagcacuuucuagaaggaagagaaccagcacuaaccaagcccgugccauuccaaguacaugauacggcacaggaugacuucugcucaacacuuuuguucuagaaaggugaggaaggcaguaauacccaugugccuuagauuugcuuauggcaucagccaucucagcccacaaaggcgacuuaacaauggucccagccucugcgguuuuuacuaguguuaggaaaaugauagcuguaucccucucauccaccuuuacugacacgucacuaacuacuuccugcugacucagagcagauagugucccagcauuuugucacguuaacagcaguggauugaucauacguuauuauuaggaaucugcucgucuguaguuggaaacauuucuuuaacuaccauuauuuuuauuuuuaaaugugucuauuucugugccuuuguggaugugcguuugugugucaguuccuacgaagaccagaagaagguguuagauccacuggagggggaguuacuccuugggguguggguucugggaacugaacucagggccucugcaagagcaccaaacgcucuaaccacugagccccuuagcccccagucccuuuucuguuuggcauuugacaaauggaagggccugugagaggguaucaugaaagugucagauuggaauuggguuugcauaucagaucuuaaguaccuuggugcucccagauguugggcugggauguuugccacuguuguacugguccugaguaugucauucguuuuggaguucauugugggauucuaacaucguucucagcaaagagacaaugcugaugcuuucuguuuuccucuacucaauuuuguaacucucauggugaucuguuuuugaaauggauaugaaugugugggauguuuauccagaagggccuuugggauccagucuguggcaaagaaggaaggaaguacuacagagcagggggggcaauugaacuaccauggagugacggccacauccaacccaguguggaucuacagagccgggcuggcucucugucauugucuucauucaguugaagggaccaugucuucauauuccacaugacaaccugucuugauggcggacgagcugucccugggaagggaaagagggcaugaugcugggggggggggggcugcuucaagcaagguuguuagcugcaggcugugugcaggcagcacacggcuucugggggaaugaauucuauccugaaugagaaccuuagaggcucgucugcuucuccuccuccuuuuucuuuuugcaagaacaguaggaaaaaaaaaucuggccuugggcugagccucagcuucuaagaaugaggcgaccaagcagaguggauaggagccgggagcuggugggaggaaaaguguggcguggggcaggccauccagccagcucaacgguggcuuugauugcugcuuucaaaguucugucuguagagauggcaauuuuguaucacauaagccagauaaaacugggugcuccgugcagcaaaauguucuguucuuuaugcaaacaaauccuacucugcaaauaagccuuauucuuuuaguuuucuuuacacaugccuauuuucuauuuuuuauauuguucuucuucuucuucccuaucuuuaguaauuucuuucuuucuuuuuuuaauuuuuauuuuaaacuccagauuuuaccccccugccccguccacccuccaacaguuccacaucccauaccuccuccccacaccccuacccccaucuccaagaggauguccccacccccuaccucacaccccaccagaucucuaaacucucuggggcccccagucucuugaggauugugugcaucaucucugaccgaguccagacccagcagcccucugcugugugugcguuggggggcccauaucagcugguguaugcugccuaguugcuggaccaguguuugagagaucucgggggcggggugaggggaguuaggguugcccuucuccucagccucuucgagcuuuucccuaauucagccacaggugucagcagcuucuguccauugauuggguacaacuaucugcaucugacucuuucagcugcuuguugggucuuuugggggggcagucaugauaggucccuuuuugugagcgcuccacagccucaguaauagugucaggccuuggggccuccccuugagcugaaucucacuuugggccuguggcuggaccuucuuucccucaggcuccucuccauuuccaucccugcaguucuuucagacgggaacaauuaugggucagaguugugacuucgggauggcaacccauuccucacuugaugcccugaguaauuuauucuuuuguugaaccuucauauuaaaaaccaaaaaacaucaggugagggccagccugauggcucacacguuaagagcacuggcugcucuuccagaggauccaacaccuaauuggcagcucauggcugccuguuaguuuaguuccaggggaucuaacaccccacacagacauauaugcaggcaaaacaccaguccauguagaauaaaaauaaacggaagaaauaaaaauucuuuuuaaaaauccggugaauguuaacuaguuugcugagcauuccugucagugcugaagcauggcauaucauugucucacugaguuuuacaaguuuuaaguauauaucuagugacugcuguuugacuaugugucucuuuggcuuuucuaucuaugauugcauguuuauuuaugguguguaacuuugaaauuguuucaccuuugccuuuuggggacagaccugggacucauuuucuccauuucuuaccauggggaguuuuaacuuacuaguauuuuuuuuucaucucauacacauacgguuuccacuuuaaaaugcuuguaccagguucucugccuucucucccaauauucucagauuuaagcaccaguaaaacauuaccaaaacagagaaggaccuucuucuucugucuucucaccacaguuugacugugaauacagcaccucaaaauggcucuuguccaauagauugucuuagcaccaacuuuguaucucauaugccauacaaaccuauugauguauuuacuuauuaucuuuuauauuuuuauuuucugugcauauguguguuugugugaggacaucugugugcaucuccauguguggaagccauagguaacguaacccaggaugacgcuccuugguugagagucacugaauuuuccgaggcagagucucucacaggucuggauggagcugauuuggcuagggugaccccuggacccccaaggaugcaccuguucaguugccucaugcuggaguuacagguacauauucucauaccuggcuuucaagacaaacaaacaaacaaaaaagguuucuuuauuuauguguuuauuuagaagcguaugagcgguuccccugcacucacacaugucugugcaccacaagcaugccuggugcccucagaggcuagaagagggcauuggaucaccuagaacugcaguuauagguuauuaugaaccgaaauaagcgucuuguugcugggaaccaaaauuggguccucuauagaaguggucagugcuccuaguuacugagccgucuauccagcuccugccuggauuuuaaaaugcugauuuugggggccuaacgaaaguccccaugcuugcucagcaaggacuuuacugacugaggcaccuccccacccuguggggcaccagggccauuaugugcagugcagcaggcuguguccuguugggaaggaaagcaaggccaggccuccuguaucaucuuaguccccugagaaagcacucccuucugauccagucugcuccaggagacgugauaccgguuggacuauagauuugaaucuuacauguuccuacaugucgucucucaccugaguccuuaaguggccccccggguggcuccacacagccaccucugacccuuuuuguucugugugcacugcuuuggccacucgaucuggcucugacuuggccccaguugacuuucuucaucauaagagaagccucaugcucacuuuaaagaaaauuuuagugacguguuugugagcauggguucaugcaugugacugucgugccgaaggaucccauaagagggcgucagguccccuggagcuggaguuagaagguggcugugagccucagguuuggcugcugagaacugaaucuggguccucugcaagagaaggaaguacucuuagccauuauugaaaucuccagcugccuugcauuuauuuuuacuacacuugcauuuauuuuuccguguuucuggugcaaagccuucuuccuuagcucaucuaaccuccauauugcuacaccucccccuugguuacucauugacacccuguuccuuagacucugccucuucagcauaaaaguguccauaguaaccacagcuagcauuaaccuagcacccagaccgaguucuccaucaaugcuucccauuguuauuugcugcucuguuagucuccccaccucggggaagggcuuuaccuccucagcgguggugacuuccuuguuuaaaagaggaggaagucuuagcugaggccugggagaguccaaaggagagacuuugaugaguauagcggaacaccgaaacugaagcagucccacccucucgguguaugaaccaaaggucacuggacacauccgugagcagggagcgaugcucucucagucuugccuugacaguugcuuggacgaguuuuaccucagcagugcaggaagguaaguuggagcuugugaauauuuuccuugcuaaugggggcuuugcucaaaggcguuaauuaugacagaagauguguguagaccuugaaaggcaguaguauuuuuagggcaaguaggaacuuucacuuguuuuuuuuaaauucccuucuuggcauuccuaguggcuucuaaaccugguaagaucuugggaugcuuuaguguccacagccaccugaccucuucuuucccuccccuuuuccuugcuuggggaguuaaaggccuuucuuccuaagagccuggugcuuaggagaguaaccucccuguucgucucuuggcuaggaugggaucggaggacuauucauaguucugaagcuauaaaacgaaucguauaugcaaaacaccuugauuaugcuauaaauauuaaccgccuugaauuguuuguacaggguuagugguacuaugaaaauuugcuuauuacucaaauuuaaccuucaaagguuauuguuggcucugagcccacagacugaacauggccaaacuucccugcaaacauuuugcuugggacugaaacuguaguuagauauguguacuuaaaguuuuuguuuuuuaaaucuguguauauuaauggaacuuguaaauauuuaaauagucaauuaguggaaguuguaaagggaacaacuauuuuuaaacuaucuaaguuuauaauuuuggucuuuuaguaucgauuugagcugagagacaagcaaggccaucaguguguagaggucucuauaugccuuuuauuuauuuuugagguccuuguuggauggucacaaucugauugggaaggaaacuuuugcuucucgcucuguuaccagaaguaaaauacaaagcuaggauacuauguaguacuguguaagaacaaacaggaggcccaaucguccaaacagacagcaaaagucaguaucugccugacuuacucuucuggacugggguuguaccuucuucaauuuaagucacgauguguguguguguguguguguguguguguguguauguuuauguguuuaugugagugcgugugucuuauauacacauagugagccuauguguguauggaugcaaauggaaaccagagguuccuaucaagugucuucucagccuuaucuuuggggguagcguaucucacugucucugggaugcauggauucuucuaggcuggcuagcuagucugcucuagagauuccugugucucugccucuucagcccuggagucauggaugcucacugcugccucuggcuuuuuacagggauguuaggucuucauacuugcuuugguaagcccuuuauccacugggucaugcccgcguggccugggugaugcuguugaacagcauucucauguguguugauuuuccuguaaagugccugccaugaagaagguuggcacuccaggcuuugcucacaugacccuccagcagcgcacaaggcuucuaggagcagaaagagacgaaguucguggagauguucauggucuggcuuauuuuuaucuugguuauaaacuuuuguccaaauuccaaagcaaggugucagugucauguggacuuuaaacuccacgcagucucugagaaaggaauguaaaacauuuuguucuuugacccagccuucuccucacuuggaggaggaugugugucuguauaccuuguaccugggguuguuuaaacagaaguuucuguuuuucggcagcuccaucuggaaacaacuuuuuuuucucuucuuuuuuuuucuuuuugcaauuuagcuaacauaaauuguguauuagaagaaauuuccagaugcauggcucgucuguuuagucuccuuucuaguuaagcagcucugaacugaacuguguagagaugucuccucuuaaguuuucuugugcuaacuuugucucucuacucacuugccaugucagugugaaguuuaguaaagggcuugggccaccuuagaguacagugacaaaggacuuuauauaaugucugcugaguugaauaaaaagaguguguaggguuauaauaaagcagauaaccgugaagucuuguguguguguguguguguguacacacacucaagaccaugcagggugucauuuccuaucuuggauuuuugaaacaggcucucucacuggucugggacucauagauuuggcuaggcuggcuggccaaugagcuccagggaucugccuggcucaauuuucuugguucugggaucagaggcacucacugucacacucaacucuuaaacauacaucugaaggcugauguagguccucuugcuuugacaagcacuugacuuucugagccuccacuguaagcuccugggauccuuuaacaaaaaauuuuaacuuaguugaaugacuaaauaggcuuaaaaucuuuuugaaagguuuaauguuacuauuuauauucaugucuaugcauauguguauguaugugugugguuuugugcauaugacugugcugccugcagaggccagaagagggcauagggucuccuggaacuggaguuacaggcaguugugaguugguugugggugcugggaaccaagcuuugguuuucuggaggagcagugugcaauauugaucgcugagccaucuuuccagaucuucuucuccccagucuucccccuuuuuagaguuuagcuuuacauauauccugugugaaugauguaugugugugcaguauuguuuguauuagcauucagaguaauggguuucauuuucuuacacauuccauuuugcuucauuucuaucuguauguuuaaauuguuuaauugaacaagacuuuaaagauuggccuuugagcugcaugcacauagaauuuuguauucagaguguguuaacuagauuuagaaauuugauuagaccuaccuuguggcacuuuuaauuacaauauucuaaacuggcagagugauuuguaagcuaauguuauucuguaauuagugguaugugaugaaagaggauggaaggugaguuucuuucauuugcucuguuacaugucaguaguggucugugaaggcuuugguuuaagagcauggcugugccuuuucuuaguuauucaaaguauauuauggggugcuugagaagauggcuccguugguaacuugcuugccuccuaacaagcacgagagguugaguuuggauuucuccaacccacauacaaaacuaacuguggcaacaggagcuccugagacgugaugggaggcagagccaggaggaucucagaagcuagccuggccgaccugcugauauggcaagccaaugagagauccugccucacacaacagguggaggggaccagggccauuggagauuguucuuugaccucccucguguguguguguguguguguguguguguguguguguguaggcauacacagauacauugugucacacucauacagacaugcauauagacacacagggacacagaugacacaaauacauugugucacauauuuagguguaauucagaauaacauaaacuuugcuaaagauuauaucuaaauaauuugaaguccuauccuuuguauuuguuacuuucugucauugcuuucuaagaaaaaaaaaaaaaaaaaaaaaaaaagccaaagcuuucuacagauaacaccccucuaguuuauauaguuuacauuuucguguacuuugcgaggucacauagcauagagugcacuggaucgagcagugaucaugagcauugaucugcagugagcaacaugaaacccuggcuugggguaggaaagcugucccacugcuccgccuugccgcacccaagacucagagcguaagcucuucaguagcucagagcccugcuuccuucugcccauccucagcugaccccgaagcucaggcugaaugcuaucauggguuucacaguggccacugugugaaggucaucgacugcuaggcuaucuguccuuugugaucacguguuuucuuggccuuuaucauaucucucauccccugccucauuuuucuuacuugaagugugucauuuauagugaccauucagcucuuucuuaaggucugcugaccgucaugguuggaucucucgguccuaucucccacgauuguguuuaauguuuugcacuguugaauuuucuuacugugccuuacauuguguguuuuuuucauguaugcucauguauguucaugagugcucauguauguucauguaugcucaaauauguuuaugcauguucaugcaugcucguguauguucaugcaugcucauguaugcucauguauguucaugagugcucauguauguucauguaugcucauguaugcucaaauauguuuaugcauguucaugcaugcucauguauguucaugcaugcucauguaugcucauguacguucacguaugaucaugugucgcuccuuccaucuagacugacuuucaacagcucacugagcucgcuugcuguuaguaugauggauugguuguaggugguuugcucuggguucuccuguguugccuuacagugcuuagauaccaauggagcacugcuuggaaugaugagucugugagucacugcauagcacacauucugcuccucuaccacaguggacauucgaggacucagaguggcuuucucaugcagagaagcugcagaugaggguugcuccccaccuuguugcauggugccucaggcagagaggaacugagaagucacucaggcuuuguaagcacuggucacaugucugacucacagaacauuuccaugaauuuguaguagacauaaauauagcuaguuacacuagaaaccugguuugugggaaggggccuguccucacaugauuggcguuauggauuuguuucugugacaaaauccugagaaauaccacuuuaggaaaugaggcuccauguuggcucauaguuugagaagagcucaguccaucuugacgagcaugugggugagagaggcucugucuguggcaggguaauuaacuugaccaagguccauaacucauaaaggacagggcuggucccgagucaggaguugucugcgcugagaugucagugggcccauaaggugcuguguggguuacauauuaauaacuucugcauuaucauacucuguguaccguguggguuauacauuaauaaguucuccauuaccauaccccgugcccuugguggcaucacugaccucaccagauggagcaagaaguaagacugaucccgacacccagucuugaguuucccagaggcuuagaagcaaaaagucaaaacaauuuuuuucaagaguuuggaaguggccgggaaugaaacucuaaacaagaagaaaugauuguguugggguguggaggugggagaggguggguuugcaaauaccuagagauugagagacaagagccugcuggugagagcagaaagccugacagggacaggaugacaauacccgaugauaauauagacuauggcagggggacccgcagccccucacauaagcucucugugcuguaagucuggaugaauuguacacuccgaaaaucagagggggaagcaggaagguguguaugaccuggcagggucauccagggcuuugugucaugugucauacggacaauuaugcucucaggagguuaugauggggcugaaugguccucucugucaucaagucccaguauagccuggagcgcaugcuguggugacaguggugugagcaagccugacacacugccaguccuacaggauagcuguacaggacagcuaggcgugugcuguucuccuguaauuccagcaucgaugaggcugaggcaggaggauugccgaagaucugaggccagccugggcuaaauagccagacugucaaaacaaaacaaaucaaacaaacaaaaaaacaacccgaaaacaaauaaauaguacuguguaggugacgggcuacaaagcaggaugcugguuauuaaaugguuauuaacugcaucuguaucuauaguagaccucgcaguuuacuguggagggcacaccuucucuucauguguguauaaaaaguaugaacagaaaggcagccucaggcagcuccucgggagggaccuagaugaaggcucuguccccaugggacagauagucccaugccucuggcuguccaucuagacauuuaaggggacaagaugugaaggacgaagaggaggaaaugguauugguacuuugccccuccuccaguguuuuuaauaaagaagauacucauucaaaaacaaacaaacaaacaaaaaaagaaacacaaaacauagguaaaccuuauggcccauggcugcaaagaaccacuuuaucaagcuguacaguguguuuuagaguaaauguuaauguaaaagagagaaaaaauaaccuaaaagguuuaugaaguagaaaguuacagagacuaguuuaauuuauuaaagaaaauuuuaaaacaauaugguugagagauggcucagcagccuuucacugaccuuacagaggaccucggcuugguuccagucacagaugaugggcaacccucuguaagcuccaguuccaggguccugaugcccccuuccgcugcccuccaugggcacugcacaugugugguucacauacgugaugcagacccucacucaccuauccaauaaacgaaugaaugaaugaaugaaugaaugcagugcagcuuaguaugguguuugcaggcaugugcuaccauaccuugguauauuuucuuuuaacuuauuguuuguuuuguuuuacauuuuaagcagguuauuaaauaucaacugcucuugcagagacccgaguucaagucccagcacccacauggcagcuaacaacacccugugacucuacuccuagggacccgacacccucuucuggccucuguguguuccagaccagacccacacccacacacaguagacagauucgcaugcaagcaagcacccaugcauauaaaaugaaauuaauucaaaagaauaaaauaaaaaacauugcaguucaaucaaaaguaaugagguacacguuuauuuuugaaaaccagauacuaaaaauagauuguuuaccuguaaagucuaagaagacgauuuuauguugcuuaaaaaccagagacuccggucagggaggagcuuucgaaggagggcuuuuaagcugaggcugaggaauuagggaggcagagcuaaagugggugacuguuccaggcagggcagagaguucucaaaaccagggguggcuaaggagaugccacagcgaacaucauugaggcccucacgucacagaacaggaguuccacuugugauuuguccuguaugcccacugcuggaaauacugucucugcugcaaaggaguaaacauccauccaggcuuaauguaaggacaggaauaaguggacauuuucuggggcauuccugguguaacccugaauacaggggucgaucugagaauacugcuccccucccuagaagccagacucauucuuuuaccugagaugacagcuucagguauguggggcgcuugcaguaaccuccugggccuaagcuuuguugcuugcuuuuuuaaagugucuugaguggaguuugccagggagacgggaggcuuagaaaaggcaggaaaccaaaugcaguguggucugggaugcucuggaucugccccgagauggaacuggaguuaguaucugcauugccaggaacaaaucggagauaggaugaggguggccacuccuuucacuaaccaguugcuacaggaaggggcugucacuagaacccaucacccagggcccucuggcugcucccugacagcgagacagcaaccagcaaugguaagcagaguuagagguacuuaaagcuaaagcgcagcugucaggagcgcuucucuuuucaacagcgcgugugagcugaguuaggaugauuucaucgccaucccauccgaaggccugggcucagggaggauuuugucaagaaggacaagaggguugggugugucccagaucugagcaauaagguccagguagccaggagggggacuauaauuuuaaaagacaguugccagugaggcagugguggcauacaccuuuaaucccagcacuugcgaggcagaggcaggcagauuucugaguucaaggccagccuggucuacagagugaguuccaggacaaccagggcuacacagagaaacccugucuccgaaaaccagaagaaagaaggaaaaaaaaaaaaaagacaguuugccacaaaauagagguuaaacguggauuggcaaaauuaaggaaaaagaaaggggguuaguuuagaagaaaaggcaaagcaauuuuugacaaaggaaaagauaauauauucucagugucucuuuuauucaguugauuuagguuuuuuuguuuguuuguuuguuucuuuuugagacaggguuaaacucuauguacuucaagcugaaugugaacucacuaugagucccaggcuggccucaaacuacagcaauccuccugccucagccuacugagugcugggaucgcaggcaugcacaccgccauguauggcgucacuguuguucuugugugugugugauaggaacgcguuugugugcacacaggugugcaugcauauggaccacagacggcaggcagucucaggauuagggucucacugaacucagagcacauccauuuggucauugcauggccagugaacucgccugccucuauucacacaccacuggagcuccaggcacgcacagccacacccagcucuuacaugggugcuggggaucugaacucacaaacucaugccucuacagcaaguacuucauuggcuucacuguaucccagucccugucaccagaugcuuagaggguggccgauaaucaguuuguugcuauggaaacagcagaggggugcauuuuaaaauaauaaauaggguagaauguagaugcucccaccaaaaugaaaagaucagacaaaauuaucucaaaauuagugaacucugagcaccagaaacaauccccguccuggaaauacccccacggauaguuucuuaagcucuaauaauaaauagauaauugucuuuggacuuagcauuuucaaagguguuccccagacauuccacaaggucccucaggauccgucauuaggcauuccuucauccuuuucuucucuugguuccagucguuuccagucacuguuaaagccauacuagauaaacguuugggacaugccugggaugucccaggacugcccauacccacaccagugggccacugcugugccauccaauacuugcuuccucuaggauauugcucugacagcugcugcugggaagacaguuccauaggauguugcugguaucccaaugacaguguuacuaaccuguguuccacuuuccuauuugcauguaugucuugcuagcccaaauguuccuacaggcagugagugaaucguguuugcucuguaugccuucacgcagggcacguguuauaggccauacauuuccccuaaaugagguggguuugggggccacauaguauguuucgcucuagaaaauacucauuccauguauaagcugcuauuucucucauaguugagaauaguugagaauauuaaacaggcauuuuuuuuucuuuuucaguagcucacuacugcaucuguuggaagcauauuucuucuguuucuggggacacuggcuucuuaggccuuugagccccuagaguccuccuauucugguggaauuaucugauaauucuuacuuacauguuuguggcauaauaugugauugcucucaggagcauuuaugguuuaguagugcuuucuggggaacacaacuguuuaacuugaaagaacgaauucauuuccauaagugcauuggcauccacugugcagcuuggguaauggauauguuuuaaggaaccagggugacacuuuguugacccuagaaucacaccaggcaugcuggcugccugguguacauuugcauauuuaguaccuccaacugggaaggcauuccucuuagccugccucugugagggcuccuuaguggaugcauuugugcccauuacacugccugcucggcgcuaaucugaaggucacagugccaggcgcauuucaguucgcguguuauucugccucaccuccucggauuuucucacuucuuuggaacuagaaacacauaaucacagaacacuugagcuaauuccccgagaacuuguuacagaucgagcgggcuucucggcugcugacugguguguaagaggauagucuucuugcugaaagugaaauucuagaggccucagaugucugaacucuuuccaggguggauugcucaagaggaaacaaacugcacgguccuguauaauugcuuguuauuuugaagacggaaauguuauguguauuuuucuuccccaagggcccuguggaggacaggauccugcuaguguuuuuaauagaucuguuugauacugccaauacacagaacucacaaacaagggaggcucauguccauuuggcugaacaaugaaauacugcagaaggacucaauuccuacugacagaaaagucacacggggaguuucagacgaauguaugaaagagacagguagaucuagguugugugugugugugugugugugugugugugugugugugugugugugugugugugugugguggugguggugguagggggaacaugcucuuaacgucuuaguuauccuaaaaggcaaggcucguagaccagggcacacuuggagacucagggcuuggagguuugccuuuaucuaucuguguuaaagucuucaacuguguuuagccugggugaugguggaucagguauuucugugccaugugccucaguuuccuguaaauagagagaguggcacaugccucuuuagaggauuugugauuaucaaccauauugaaacaugcaaagauuucacggcaaugguuggcacaccuguggaccucacucuuguuauuuguugcuucuguaaugggcucugcacaguugacucagagagaacaguugcuuaggaaauaaaggcacaugcuugggggucugaggagauagcucaacuggcaaagcacuugcagagaucucagucugaugccaagagcccguguuaaaacaagcuugugugugcuugucaucccagcgccgaggggcuaggggaggaugggucccucaaacucguuggcuggucaguucagacugcuuaaugaaaaccuacuuuuccuucacacagacacagagacacagacugacaggcagacagguauggacacauguacauaccccccucccacacacacacauucacacauaccccuacacacacauacaucuuccccaaacaaagaggaaaauuuucagagcuaaaagcaauuuaaauuuuggcgguaaagacuaucuggguuuuucuuucuccaugagaaauuauguuauaaagaggaaagcacgugagcacccaguggugugcugucuuaaguauccuuuggccauguguguuuggcugaaagucuucgcccucggaaccaggcauugccuguuugaggaaugcugucugcuuugaaagccagcuccgaggaguucacuugguuuuggccguuuggguuagguucuauguugucuaaucagaacuggauggggauggugccggugugcaacucccuuccaagaaaaacacuggguguuucaggaagugggcgagugagucagcggacugcacuuuuccucugagucagucucggacuugcuggaaacaggcuugacuuucacccagaguucugcuuuuccgaucgaauguuccaucgggguugaccucguaccacgcugacagaaggcuuuguuagugugugcgcucacacggagugucuuagugagugugcccagugaguauuuaaaagaaaaaucucaauucaaaccuacauccuuaaacuaguuucgccuccgugacaguuuugcuucaagcagggucauggagagugguucuucacugcaagauuuaaaaacccuaacuucaugcuguaugguuacugaauggaagaaugagguaugccccaagguauggcugaggugguuguauugaagacaugaaggagaucggucagauguccuuacuauugacuuccuuagggaaaucuuuuagagagagauggaggcagguggagagauggugcagcgguugauagcaguuccuucacuucaggaagaccugaguuugauccccagaaccuacacugggcagcuccugagcucagagagacauaccuggcucuggucuccuagcacugucgcaggaaagaacagagucaguucuuuucuaagaguaaacugcuguaauuugaguccuguaaggucugcaaagccggucagguagcuguggggcuuuguggguaguugucuuaguuaggguuuuacugcugugaacagacaccaugaccaaggcaacucugauaaggacaacauuuaauugggacugacuuacagguucagagguucagucuauuaucauugaggcagggacauggcagcauccaggcaggcauggugcaggaggaacugagaguucuacaucuuucaucugaagucuacuagcagaaaacugacuuccagacagcuaaaaugaaggucuuaaagcccacacccacagugacacaccuacuccaacaaggcuauaccucgaaacagugccauucccugggccaaacacaaacaaaccaucacaugaugugccuacccuuuucauuuacacuaguagacugauaauuuuucuuuucuuuucucuucucuuuucuuuuuaguuuuuuaaucuuaagcacuugggcuuggguuagcuggaggcguugguuuuucuuucuggcgcauagucauuguagguccuccccacacccucccccauuuccucccagucagggacagugcuggcugcuggcuucucugagguuugaacaguugcuucugagauuaagcaccauuccuguaaugugucccccauaucuuauaaaaaucugaaugcugguuuauuuccuagaaaaauuuccacuuuaucaucuuggaauggaaugguuuggcccuuggcagagcaaagaguucucagcuaaggacuuugagaaugguacugugagauucucaugucugccuaggagugaaaguuuuuauaaaacaaaagauagaaucuccagcagcuacacacuguguuauaggcaagcuuuguggagacccaagagaagaaugcaucuuucuauguuuuccccucacuccagagaucaguggacaugcaugcgcaccuccuaccugauguuuuacccugcucucuacuggcagaugaucugugcagguaaacuccugagcagcaagcgaacaacuagguuagccuguggcuuuugcuaggucuaaggaagugugaggcugcagcgcacccuuacagagaggccccagugccucauuugaucagugcucaaugggagccugugaguguaugugacauauccaagagcagagaagggaacucgcugaaaaaccagggauaguguuggcuuccucaccccacauucuuccuaaccccauggguguccaaaaugcccccccaugauggacuggcauauccucacauuugggguucugcugggauuacacauaucaccagacagugaggaaagcuggagagggagaggauauaauugcaggggugugcugguuacucuugagccacggugacugggcuaucccacugaaacuacuuaaggugacugggcuaucccaaugaaacuacuuaaggaauggaggguuuacuuugucucagagucucaaagguuuucuguccacacagggaacgcaugcaggaacaaucgaguguaggagucuguggcagagacuguugauaucaaggagggccagaaggcagagugaaaggcuagaacccggagagauaacagcuuucagauucacacccuuaggcaccuacuccugcuugcuaggcuucaccuccuagcagcucaacauugugcauaugcgcacauauauacacaugcacacacauauacacaugcacacgcauauacacaugcacacacacauguacacaugcacacauacauacauacacacucauauauacacauaaucacaugcacacacauauacacaugcacacacauguacacaugcacacacacauacacaugcacacacauauacacauguacacaugcacacacauguacacaugcacacacauacauacauacacacucauauaugcacauaaucauaugcacacacauauauacauguacacacauauauauauauauacauauauacacauauacauacauacauacauauugacacagcaccaucaaaguuucgagaaguguuaaaaauguaauuuagucaaguaacucauagaaauaauuuucuuuuuucaucuuuuuaaaaauuagauauuuucuuuauuuacauuuuaaauuuuguccccuuuccccauuuccccucugaacacccccccaucccaucccccuuccaccugcucacuaaccuacccacucccacuucccuauccuggcauuucucuauacuguggcccuucacaagaccaagggccucuccucucauugaugucccacaaggccauucucuguuauauauauggcuggaaccaugggucccuccauguacucuuugguuggugguuuagucccugggagcucuggggguacugauuguuucauauuguuguuccuccuaugaagcugcaaacuccuucagcuccuuggauccuuucucuagcuccuucauuggagaccccgugcucaguccaauggauggcugugugcauucaccucuguauuugucaggcacuggcagagccucucaggagacagcuauaucaggcuucugucagcaagcacuuguuggcauccacaauagugucuggguuugguaacuggauaugggauuaauggaaaacuccaacacaaggaggaaaacuacaccuuagaaauagcaagaaaauaaucuucuuuuaacaaaccaaaaagaagauagccacauaaauauaauuccaacucuaacaauaaaaauaacaggaagcagcaaucacuuuuccuuaauaucucuuaauaucaauggacucaauuccccaauaaaaaggaaauguuuucaaaacagcaguuuggggagcuauggcucuguggcuguuuuacuucauuaacuaguaucauaaacguuuuagauacacgcauugcccagaaucacucauuuguccccuugcuuugcaagcacgccacugaaaagcugggaguaaacaccaaggcuaggucaccaagccaccgugcccuuucagaacucuugcucuugugaaaucccaggguccucguucuucaucuugaaccacgccugccuucauccaaauucucuuccuagccauccucggugccccucaccccugcuaugacggaagcuuacacaauccagggcucuagaucgucagacccuuuccaagcagucuguggaaucuuguguguaauaaaugaacccagccucuugugauagucgucugugugguggacugguggaguuuauuccacugcaguguuuauuaguagcuccaggcgugggacuugucacuagacgugggacuugucacuagaagccugauuuacccucugagucuggcagagaugugcuuuuauuuaaugggauuccugugauccuggcagaugaucauacaagugaaagauccucuuccuccucuuccucuuccuccuccucuuccuccaccucuuccuccuccucuuccuccuccucuucuuccuccucuuccuccucuguguuacuuuuguuugcagcacaaguaaaauuuaguucccuuaguguauugauuucauaagccaauuuggcugaaaaucagacaguuuucuuacuaaaugguacccaguucauguagcagacgcuuggaauuaauuuagaaggauuuuuguuuagaaaaguugacaacuuguaauucuuuuuaaaaaugacgcauugccuuuuaaauauuuauuuuguuuuaauuaugaauguguauguaugugucuuaaguugguauguagcacauguguacaggugcccacagaggucagaagagggcauagcaucucccggaguugaaguuacugaugguuaugagccaccauguggguacugggauuaagccgaagucuucugcaagaguggucagugcucucuccagcccugacuucuuauucuuagauuccucacuuuaacuagaacguuaugcauuucuucccaaguucuucaucuuuugccuuuuucucaguagcuuagagaugggaauuauggguauggagagaaagaaggacuugcuuagagauacuucccauguucccuccuccugcuggccuaacauagccugcuuaccccaacaugucggccugcaccccauggacaaaauccacagugugaccugggagcuggccauguauuggugccuuucccucuugcugauccaaacacuguuauuuugcuucuuuuaaaggacuacagagcauugcgguuuugcucuguuaauuccaggugcucagguuuaagaauguaauuucuggcaaauauuucuugagagcuuaugaauugacauggcuucagaguggacaugcugccaugaaaaacagucacauuucugcccgaggggaacaggggcuugauugucuccgccugcuucccgauucgucagccccaggcacacuuaaagcugaugugcucaacguuaauaguucauauuuuacacuagcuuuuuuguaugauuuuccaccucuguuugccuuccucuaauuccucauuuucagauagacaccugaaaucauaacaguguccuugaucuuaguuuugcauacguuuauuugccagcagaguuucauuuuuguacaccaguggagaaacgucaaagacaugacaaauauauagauucuuuaugcugcuuaucccgaauaugaaauggggaaauucugaaauaacauuaucagaauuauggucucagucuccuauauuuuuuuaaagagccuaaacaggccugagucgcugggcauucauauguccuuaccagggauagcuuuuauaauuuucuuuuucuucuaagagaagaagacuauuuguauauucuauguuaguuuauguacuuuaugcugcucuccuacuagauuuuaaguaaagauaggaaccguauuagugaauuuuucauaacucugacauagagccuaagaaaaucaauuuauaagcaagaaagguugcccuuggcccacuguuucaguacaugcuaauuugccucugguucugguggaccugugguacuugaauuagauagguuuagcagugccaugaccaaaacgauuuaagcuuggaaggauuuaucuuggcccacaguuugaagguguugcccaucacgugaggcaggcggggaggcaggugcgugaggcagcuggucacaucguaggaagcagacaagagacaugcugguucucagcacacucucuuccuuuuguuuaguuggggacccuaguccauggaauauugccaccugaguucaggaugggucauucagccuuagguaagccucuuuagaaaugcccccacaaauacagcgagaggcacgucuccuaggugauucuaaaucaagaucacccaccaaggugauguagucucccaucaguuuccccacagacaccuguggcaggaaaugacuauuuccauguguuuuguuaggguuucauugcugugaagggacagcauggccaaaguaacucuuaugaaaguaaacauuuaacggcagcuggcuuacaguuucagagguucaguccauuaucaucauggaaggaagagccaagaguucuacaccuugauccaaaggcagccaggaggaugcuuuggaucacacuggccagauuugagcaucuauaugagaccucaaagccccgccaauaguaccaaaggccggugguguauauacacacagucuuuagggaacacuuaccuaaaccacagcaggaaucauaucuguuuugucuccuauagaauaaauguauagaacugcccuauccuucaugggaggcauuaaucacauuagcaauuuauguuuacauuuaagcugauuuaauaaaaauauaauggccaguuccuggggaaucuuggcuuucuacaucgugagcgcucagcucugugcugagugguucugauguaacggauucuucaacucugagcccgucauuguacuuuaccccggguaaucacagcacucaggagacuaagagaggagacacguugagaguucaagaccaaccuagugaauuccaggauagccugagcuauagaaugaggcucugccuucuaaaacagccacugccaccaccccacaacaacacaggcugggagaaggcucggcguuaagagcaccuguugcucuugcagagaacaagaguucaguucccagcaacaaccucaggcggcuguagaacucagacgggcacaucugaugagugaauggguuagggcuuggguuggcuggugcugaucaaugcuggaugaauauugaguacugauuuaccaaggucauuuugacuuuaacuuuuugcuguuggcauugcuuaagcccuaguacuggauuggccauuagugaaaacaaaauacuaguauuuaauagcacuuaaaagcauaacuuggggcagcccucuuaugggauaacuauuggcaucauggccaagucauuuuaaaauuuuauaaauaacuuuuauaagucccacaaccauuagaauggcaauaagcgguuuuaauggccucuuuaaguugguaagaauuaaguaaaauaacacaauuuaagugcuuggcacaggggcuggcauacuuaaauucuaaauaaaugagcauuacugggauuaauuuaaugaaguggugagcuggaccuaugauuucuucaggcuaugcguguggacguuuucugcuguuguguuaacuuugaaguuuggggaaagguuuuccuucccacaauaaaagccauauuuacuacuauuuauuaagaaguagaauauguucaugacuuaaaagacuuuauucucuuuuuuccuuuagaguguguguguguguaugugugugugugugugugugugugugugauguuugaugcuacauguaugggagucuucaccuggaguuacgggugacuauuacucaucccauaaggaugcuagaaaccaaacucuggucuucugcaaaaguagaaagcacucuuaaccacgucuaggucccuacacaguuucauauauacacaaaacgcgcuuauauacauauauauaguacacauaagcacacauguauauagagaguggcagaagcaugggggaggagagggagagauggagguggggagggagggaaagagaauguauuguauuauacguguucucuauuacucugugguaccucguuucuuucccucagaaccucuucuuccuaauuaguccucgguggcuacaccgucagagaaaauggcaccccuuccuucagugaccauuaacagacauuuacaagagccaggccauaucugggugacagcaucucaugccccucauuucuauucuucaguucuuaguuuccuucugcccugucuuuccugggccguggagcacggugggaggagcacgguggguggagcacaguggguggggugugacgcaucccauuugaggccgugugcucaucggccacucuuuucagcacugacccaauagagucucaccaucaacuaucaucacccugggcacgaaaggagcuuugcagccccaggcuaaagucgcaucagccuguggccaggcacauaaguguuuagaaggcacuuucaacaauagauccuaacuuacuggccuuaauuaacuuuuuuuuucaauuguuaugacugcaugaauaaguaaauguaccuggaagauuuucuuaggacuuugacuagcagugugaaugcagagcuaucuccaugcuuguuuuggguuaacuccuaaagaaugggcuccaaguuuuacucacucccaugggcuuuaccuaacgcaagcaugcaagcaagcaagcaagccaacaacacagcuaauaaucaaaaccguaaauaaccaauucuacacccaagggugaauuucaggcuuccuuuagacuccugcuccugggacacguuuaaagcucggacuuauuuccuagaagaguaucgcaagcugacgcuugcuuccucaugagccagcagcccuguuucacugggguacugcuucacuugggcgcuuuggguauuuccugggguuggagagcagugccuguugacauaauaacacaaggcagcucagcauaugccaacacaucagcugacucugacggacacagauguccuuguguguuccuucacccugguugcuauggcaccuuuauuuuaguauaaacuuguacucauauuucauaguccaccuggguggcucagguucacgguggaggugacuuuucuccugaacuuuccacgaacuaauaguuaauguuuaaacuaccaaacuagagaaaauggcagaauuagggccauaaacauauagaaacccaguagcuagugggacccaagaaacccguggguuuuuacaaucaaucugggcagccaggaauaucuuuuuaugauaaauaaaggagaugacccggaaaauuagauaaagaugcuaggaaauuaaaaacaaaggagaaugcaagaaggacagaugcuuauuccaagagccuuuauuauacagugggaaggguuagaaaacuuaaggaaauaaacaacaaggcauugcauuucagguggaagcuaaggggaaguuguugaugauacccagcaaaaccaagaguggagagagaauauuaaauuacagggccagacauuguaugugaaagaagugucuucacaggaggaaugaaagucccagaggaaaguagacacuagauuuucucugucuaacacaaaaucuuucuaacaaaauguucggaugcuucuaauuguguccgacacgauuuccuuaauucagucucauucaguuuugaucugacugugauuugcucucagugguacuaaucucacguccccugcagccucaccacugaugacuuccuguagcagaaguccuucuucagggaucauaguggaggggugccuggccaucccuguccuccaugccugacucagccucagggccuagggaaggacccagugccuggcccuucccagcuucagggugucgcccugcauucugucugccuguuccggguaccgcuaaccauccuuggaugucucucucccucagugugcauuaugaagucuuuaucuugccugccuucaauucuguugguuuuggaagcuguuuugcuuucuagaccaauucuugcuuaguucuucuugaaucuuguacucugcucucuuugcaguauguguguguguguguuguauguuguguuuuguguauugugugugugucugagugugugugacuguauguguguuucuguauguguguuuaugucauguauguguguuuaugucacguguguauauucacacagaagccagaaaaggguaucagaucuccuggagcuggaguuacacacauugugagaagccuguuuugagucuagaauugguucaucugaaacaaauagcaggugcacuuaaaaaauuaauuuuauuauuuuuaaauauaaauguguauguuugugugugggccgggugguaaguguaugugauuucccacagaggccagaggcaggagguuuuagacaaccaccacccuccccuaaccugaagccaucugacauuugugcugaauguuggcuaccacacucagguccucuggaagagaaggaaacucaguuacgagccaucucucuggccugcagagcccugauaacugcagagacauuucucuagcccccgaauccuuucucuuacucccucccacgagcauuccuucauaagauaagaacauuuuagaggaucuguuggcagcucuugguuagcagcgaauccaggaaucugcuuuagguuugauuugucuucuuaguaggaagagaacuugggccuccccuguaccuccuagccagaguuaaaguggccuuuugcuuucucucucuuucucaguuccuuuuaacugccaguguccuaaccacugaacuuagaggcccucauccauuuuuuuuuaauguauugagcauuauuuuguguauuuguguauucauugacggaccguguaugcuauaguguauagggguauguaugugaagguguggggguguauguacaugccaugguguguguauggggguugggguauagaugugguuguaaguaacaggguguguguguguguguguguguguguguguguuguauguaggagugggguggguauaaguguggauauaaaugugguuguaaguacugggcuguguuuguaugugugugugggaggauguuuguguacaugccgugggguguguauggguaaguaggugugguauauaaggggagagguuauagguguguguguguguguguguguguguguguguguggugcccugacaacucuuggcugccugacaguugucagugcuccccuucccugguguguuccagggagcaaacggaggcugacagguuugaggggcaagcacauuuaccugcugagacaucucacuggucccauacuaauuucuaauagcacacugagacaccuugaugauugaaaauaaagggaaaacauuugaaaacauguauuucugucuuugugaguacaguaucaaggcacagaaugaucuggaaagggagucguccacaugacucaaaaguuucauguuuucugguacuugcugcuguggacuuagaauguuagacauggugaccucagcacacugugauagcugcaguucuguucuccaagugaguggggcccaauacagccacggugccagcagcugucacugugaugcugagaagggacagauuguuguagcuggccacccauucucucagaauauucaguaccucagcaggaaggcaggcaggaagagaugaacccaaaccaugaagacuucucuccuuuugguuuugcagugcuagagaccaaauccaugcuaugcuccuccaccaucagacuauacuccuuaccuggacauagcaucuucuuauaugauacaugggauguguucuggggugaugugcacaucugcauuaggcuucuauauaaaaccuuauuaacagucuuaaaagacagaauuucauuguuuuggcaaaaggagucugugaccuaguaauaagaguuuuagcuguacacugguggaacguuccuuuaaucccagcacuugggaggcagaggcagguagauuucugaguucgaggucagccuggucuacauagugaguuccaggacagccagggcuauacagagaaauccugucucaaaaaacaaaacaaaacaaaacaaaacaaaacaaaacaaaacaaaacaaaacaaaacaaaagaguuuuaaagugaaaucaccuuaggggaauacacuuaggacuuagaaacauggaaagauuucagaacaccagcggcuggaagaugccaggagcucuuuguagguuugaucauuuguaaggauaugcugugcaauccaggugacauaacucacgccuucgaucccaacaguugggggauuucuguagcauugaauucaggauuagccugggcuacauacugaguuucgggucagugugggcugcagagguagaaaacugucgcuugcuuugugaagcacugaugaucacaaggaauugaagcugaauccucuguaguauaguguucaccacuaaugucccuugcucuaagugugggucuaaaccuauggguugugacccauuuaguggucguguuaucagauaaccuauauaucagauauuuauaggaugauucauaacaguagcaaaauuaaaguuaugaaauaacuauaaaauaauuuuaugcuuaggggucaccauaucacgaggaccuguguuaaagggucucggcauuagaaagguugggaacuugugcuaagaucaaucaugcugaaagagaaagauaaccagcaaaugcuacaucucaucuguggcugaagugccucucacagugccuguaaaagccuaggacuugcucucuuagaauccauuuacacaucagaaugggaugcgaauucagacuugucaaucuccuuaagaacuucuuagagcaugaaucgcugccuucccacgcucccuguguccgucagacccggguagcucuucauuugcuugccuuuguugagggaaaauguugaacuguacaaauguagucagugucacugccagggaaaaaaguggugccuaacaguaaaaaauguggcacaugagaucucuggugacauuugauaugcagugcucaaugaagcaagucacuggaggagucucugcaguagaccucauggcuggucaaugaauacuaggcuucaagguugauaacaggaggccgacauugagaaaaaguguugggggaugaguuguggcgaguggggugacuuuccucucuauuucucacuccuaaguacugguccccaguaugcuuauggcuagaaaaugaauugucacaaagucucugcuuugucuucuccugguugacgaagaccacggagaccuccugccuccuuaggaauuggaacagcagaaucuuucuuucacuccuggaauuguugaacuucuuagacgaagcuuccuucuuaaaauucugcucguccugugguagugcucgcugaggucuuuuguucaggguugggucuugcccaugccuugguucuccugacugcuuuuuuuuugaaaauugguauuccgucccuagugcagaacuaaaguauagccccguuccuuucugaaucucuugaaacaggucuuucacgggagagaaauaauuggguuucuagccaauggaucggagcucuuuuuuauucauuuauuuccgcuuaauuaauaaagacacagaauaaagaaagaaaugggugagaauagaauaaucucccacggaagaaaauucuaaaaaucagugaaggcacccccuccuugaguuguggagucuuucugugaagcaagacaguaacuuccuguuacuagccuugaaggcuaguauucaguacucugcuuugacccacagaguggcuacuuuucuagagccacacaaugggaaggagggaagccacuuaacagugggaacccaggaaagauccgaguccaugacugaugugaccacaagugacaaaccacaagccaauacuguugaugugaugagaugaagccaagauggcacaucucugugucuccugugguugagugaagcucuacagacucugaaaggagucagaaaggauucagggucacugggauggguugccauguauauguugccauuuggauaaaugcuuugcaaauguagucaagacgaagucagacuguccgcaugaaccccaacugucccuaaaagaaggggaaaauuuggacacaguguguccugugacagguaaagccuucagaccugucagaggaagcuuagccuacagauagcgcuguuuucagagagucaagugaaagagccuguggugucuuaaggcaguuuguaauaagcuguuucugguagacccaagagucuaauagagucuaauagaguccagaagcuaaggggaguggggagauaucugucuacaggagccaggacauguaaggacuaagcaugacacaaugcugcgaaccuuauccuggaacagacagagagacauggggucaauaacugaaagacccacaacgugaggacucccccacguucugacucaggaggggcgacaccccaaaaucacccacgagaaacggucuugcugcaaauugcaagaggauuuuuauucaagagcgcucucgggcccacggucauacaccacgcagggguagaggaccguggcaccccgaguagcugaguaaggggguauuuaaaggaaaaaaccacaacuuaaggaaguggggagggcguuguuggaagauaccaaagauaccagauaagagucacaaggaaguacaaagucacaggugucacaaggaauaccugguaauuguuaacucucaagacaguuucuaagagccccuaacaauagcacauuugcauugcagcuuccgguaauggucagggugacuuucuuugaaugaauacuccuugaacucaggaaguggguggguggaggaaugucacuaucuguuuuaugauuagcauaccuuggagcacugaguuuacuacucuuucauagcauacucagguuuuggcuuccaugagcaauugacgcugguuugccggcauuuaccaaggaauaugcuaauguaacauuagcaauagggcaaugguguauagcaaaacucuguggacuaguauauuuuauaacucuccuguaaagcaaaacuuauguuaaauauguaagguuuauuuuauaaucacaauaaaucuacaguuuacauagacuuuaaaguucccagaaccuuguguggguuaggcaagcacucuaacaauaacuuacacuccuaacucuaagauuauuuuuuuauuuguuuuaagauagaguauggcuauguuguccacacuguucuugaacugucuagagcccaggcagacuuugaacuuucaguuucccuguauucccaguccaggauucagcuuuuaaguuuuuaguaaaacuguugguggguggugucagaaaguuuugguagaaauugguguagguagcacaugccuuuaaucucaguacucaucagacaagugggucucugcggucuacauagugcguuccaggcuagcagauauagugaggacggaaacaaaccaaaaaccaaaccaaaucaaccaaccaaacaaacaaaaccccaaaguuuuucuagacauuguuccaugucuuuuaguuaaaaccauaaacacugaugacagacccccuucucgguuaugucuucgacugagauauuuaaucacauugaaaucaagauacucuaagauucccugucaaauccagagaagcacuucaaauaacaaagaaggucauggcauuuagagaagcucacugggcuugagagcugccagcuucaucauguaacaagacugaguaggugagauuuuucagucaugacugaaaacugacaccagccucaauggagggugaaggagaggaacucugaaauugaggcuguuucuaacuuaggauucugacaacuuucuacuauggguuuagcuugucuguuucaucugacugcaaccugcucucucuucuuugaguggcguuucuuugacggaaaguggcuuccuuagugaugcucuuuggauuugucccuugucacucuucccuuggcaaucacaagaaaaguuguaacaacuaugacuugagaaauguguuucaugugucuacuuaaucagacacuuggcagcuauugugaugaaccaguuuccuguacccuucaggagaaggacacugguguccuuaacugcauuugcaaguccauagcgggauacugauaguggaaaugaaaacaccucuuaccuaugugagccgaucuuucuuaacuuccaucugggugcuaucuaggcguuagauugagccuaucuuuaaaaaccuguaggaagaacagcaacacgcuguuuucuuuggaacgauagaguucugugcugccuauguuuagacaucugaagcccccauguggaaugccacaugaccacagugacaagugagacuacagcggcccagugggaagacuuucuauauuugaaauucaguuuagcaaauugacauuucucuguccccuucucuaacguccuccaagaaucuuacagacugcucuuuuaaaacagaacacaagccacgcauuuauuaggcuccuaggaagagccaaacaggggagaggggaugcccugggggcuaccacuuuucaguaaaaccagcugcugugguuuugaaaugcaaaccagaucaaaaucugcccaaggcugggagguuucauuuauauucugaaugaagcagucagcugugagagagcaagccuucccccuuucucucucuuucucucuuuucuaaagaaaacuuuugaagaaacuuuugucucucucacuugcaacagcagccccaccgagagaauccucucuguuuagacaggcuuaauugacuugccucuugcugcagccacacuggggggguggggggaggguauuccuguguggcuaaugccccacccucagcccagucccucuagcucugaauugcuauuccgaaccuggaagacaccaaccaagugugcuagcuggugcucuggagucuucugagagcaaacuuggagauacuggggggaguuuugugaauggccaaaucgcugacagcuugggaggggauuuacuccugugucaagguuguauggcucaaaacugaaaacugaaggcaaauagaaauggaaacagauacauagguucaauuuccaaagaagcauacucaccuaauauaggcguaaauauucauuauguguaccagaggguguuugaguuugugcaggcggagggcacaggucacccuccuaugucauuccucaaguaugguguaccuuguuuuucugagagccauuuaacaagccacaggggucugguucguucaccuucccagugcugggauugcaggcacacgcccuuuguccugcugucucucucauggcuucaccugggucuacaugcuugcugggcaagaacugucuggcuuucacuccgcccugcagcacacggugcagaggugguguucauucuguaggggaaccccugcucauuaguccuugggugaaaacucuuggggucuuggaaccaaauuaauacaagagcugaagagcaagugaagaacguaaggguuuuaaaaauaacuuuaagacacccaagguuuccacagaguggagucagaagaagccgacccaagcgugaugcguuuauaagcuucagacagaagaagaccggcaaccuugagcagaaagcugggcaggugugugggacggggcaguaaauuccagugguguaacugagagauaaugugaggcgacacuaacugcuccuuucuguugcuuauuuaaguucacuguagugcccugugucagucucuggugcucaaggcugucccccagccuccuacguuaagaucaccccucccagaaggaagggccgcugugguuugcugcauguaggaaacuguaaccacagggucucccguggaggugacuuccugucaaggauucagcuugugaaugggugugaccguuugcugugccuugagaugccacaccucccacuuucccaguuccucuaucuaaaugcuugucuccaagcaguagacugauuugaaaacacaacugggaagcuggaauucacuuuaaugcuuggaggagccuauaaauucuaacccuuguucaagagcaaagucaagggccaguccuuccuaaaaguguguugugguuuuucuuccacaaaacucuacuggauuuugaguggagcccaucaaagcgggacuuaauuacuuacgucagucuguagaaauuaaugcugucccuuuaagaucacaugcucuuuggaaagaaggacuugggcuucucugacuucuuucuugccuuggacaaguguuuaauggacacuauugagugccaaguguccuccgaguguuugaacaacaacggucucaaacaagaguccaggccuuuugagaaccaauagucuggugaaggcaggaacuaccacacacaggaaaggcuucagcuguugugggguuuguuuguacuguggggaguaucugauaaugcgcuucuauuuacucaggagggucaauaagagcuccacaaggacauugugacugauugaaccgagaugaaagaaugaggaagaauuggccagaaauugcugagucuuggaaaugauuucuuuaauguccuucugaucugaaagauuccccucuuauagacucccaugcuaaccuaaacuaucccucacaacagcaagugcauuuuaggaaucuguauuuauccaguaagggucuguucuuauccccgagcuuguggcuguauggcugaggccguaucauuuguucaccacaggcguccucacaccugccuuaguccuacuaccgcucaguguucuauaacuaucugcauuucccacccagacucuggucucacaguaaagcuaggggcgugggggguguguuuccucccucaagguugacuggaaauagcaauucauugaaaggacacagaaaacaaaaccggaaaaacaaaauggaaaucaggguggguuagugacaauuuuaaaaaauuuauaaauuauucauucuuauucuucuuacuauugugugcauuccauggagaucagaggucaucuuuugggaguuagcucucuccuuccaccauagguuccagggauagaacucugguccuugagaguauauaacagugguuuggguuuuuuguuuguuuguuuguuuuuucuaccuguuaagcuuucucucccacucauuugagggaaaucuguuccacuuaaaaaauacggucaaaaugguuuuugaaguuuaauucuagguauugauuuugacaauuacuuucucaugagaaauaaaagggauguguaaguaaguacugucuuaagauaugacucaaaauguguuaaagaaacaaauaagaugugaaaugugccaugaagggagagagagagagaaaaggagagaaagcuagaugcauggcaaacggcagagccagggcagccaucaaccaggcuuuggauuggucaccucggauuggaucugaugucauuuccguacuagggauugaaaccaggggcuaagcaugaacucuucucaguuaucuuuaaaggcucuggcuuuccucuggguacuuucuguguuuuauacacguuuucauuaaauugagucuacauuacuuuuauaaugagguaacaggcuaacaucuugcagaguugacauguaauauaagcagaaaauagaauuacacacuucauguagaugguuuuggaguccguuguagguuuuucuuuaacucgcuaaauuagcuuauaguuuguauacuagauuuaaaacccagcugcucuucguucaucauguucccauguauuccugugcgucugagugcuugaaggcggagacccuuagguuugccuuucuaggguaacuggcaguaaaccccagauguccugacucauuuauuacccuugaccugugugccuuucuauuuuuagaacagaggcgugagagccggcaugaauggucauaugucuaaccgcuccaguggguauggagucuacccuucucaacugaaguaagucaagaggggcauguguaacuuggggcaggcuuuggcaugcuggugugugcuugcuuuagugagauguucuuauucugaaacacagacuaaccuggaacuuucuguguagucgggucuaacccugauuuuacaauccuucccucccaagggaugauguuucaaucaugugucacuaagccucgcuaguuuaaaacauauuuuuaaugaaaauacuacuuaccucuuuuacaacccauuccuaagucauucagaaguggucuccuuuuuauugcuaacccauguuauuaccaaaaacgauuauuuucaaacacccaggaaacacuagcccugaggaaacugucaugucauuggaagguauuauagguuggaauuuuaugccuugcuaucuuuugucaucaaguauguauuauucuucagagcuuugggugucucuggaacauucuguuguuauuuguauagagcuuuacauuauuuguaaaaguucaagagcauuuaguguauacuauauagguauuugccauuguauacaacaacacagaacaaagacaagaugccucaccccacccccaacccccaccccuguaucaguugaaaucacaggcccgaguugaguggcuguuaccuucuguggccagaacgauauggcuuucucauauccgccauugugacauauacuccacuggacauuuguuagauaauauuuacuguauguagggaaauacauuuaauuauaaaacaggauguaagcggucuucuuuacuucucugguuauuccucuguccugggcaugccacaucaagugacugcuccaucauucucuacucauucuggaguuaguuccccaccuccugguuccaagauugaugcuccaccugccaaccagugucuuccuguucuccugaauucuccuugaaugucaaugugguaggaaaaucuuauauauccugauuuuagaaagaucagugauuccuugauauuggaugucaaguucauuagucuuauucagauauuggucuguugugauucuuccgauugcuugucuuauggguagucccuacccccuccuccuccccucucuguucuaggucuugaaccuuaauaaauauuuacugauuaaacgggaacaaaccaguguuuauaucacauaacaucagcaaaagaggccaguuauaugacaaagcagguuagauuuacaaaugauguuuuauuuagauuaagaaaacaguauuuauucuacuauagcugacgucacggggggaacuguaacaacaaugucagacagaaugggagcaagggucuguauucuaauaagguggaggcaagcccuguugaauucucugcuguaguccugacugggcauugaggguugccugaggcuggcacuguaguccucaguggcaucaccugauuuauauuucuguuuauucaugacucaccugagcagaaacuugcuccuauuggcuagcuacuucagcuagcauaaacucaguauguuuugaagaaaacaguuggugcuuauagcacaucaacauuucaaagucuugguucugaguuucguuaccuacuauggacuuuaccucaugacgaugaacauuuuuuuguuuguuuauuauuauugcagugguuacggaucuucaccacccuauucccagauggacagagaacacagcucaagaacaagugcaaaggcccuuuaugguauguauggcuaugugaugggugcugucuaugucuaacuccugagagguuugcguguuuuaagguuacuguucaagcgcuuaacugguuggaacauuugaaaugacagagcuagcuagguaauggccguuuuagaaucuuuacauaaccagagcuaugagcucuuacuucuucauauguccuguggcugaaacguacugagagcuuuaagaaggucagugcuggguacugaggccucaagugggaugccccucugugcuauuugcgacgugaugugugugcugcucuuuguggcuaaguaggcugaugacugagcgcucccgagcgaugcaccuuuuucccagguggcuuugaccucacuauguagccaaggauaaucuugaacuaugaauccuccucccucuaccuccugaguccuaaccuuugcggucauaugccaccaugucccguuuauuuuguccuuuggacugacgccagggcuuugugcaugcuagacaccacucuacccaugaaccacaaccucagcccugcuuacuauuauuuuuuuuuauagcuaaaauauacuacaagcuacuaaaaaugaaauugaagacucuugaggcaugcacauaggcuagggaagguuauuguuuguagaggauuuguauggccuuuccuuauuguauagcaauaaauaaaucaagauagaaacaugguuaauagccaaauucccuuggucaagcagaguccuaccacagagugacugagugaccuugagcaagugacuucaccugcuuguaccucguuuugcucaucuuccccagguugcuaucuggaaacacuguaaugagaacuaaauaaauuagaguacacuguuuccaaaguaguguaggagcagacaaugcuguaaauauuuccuaucauuaggcuuaucaucauugcuacuguguauuauaggaaaaguagcauuuucuaaauuugggaauuauuauacauugcuagguuuaugaguuuggugguaagacucaccaauccuaaaguuuagugauuuguuuugaccuauauuagugaguugacuuuacaacucaagucaugcauucauuaaauggauuuacuuccacauauaaauguguuuuucagugguuaugauaaugucaguaaugcugcucuuaauuuucuguguauuauaauugagacuuuuuuuauuauuaaguugacucuuugacaguuguguagauguauauaauguauucuggucauuccacccccuuuacccucccaucucuauccuccacacucccuagauguccuuuccacaggucuaugucuuugguuguuuuguuuaguuuauccagagccauucacaugcccagagaauuggaacuauccgcuggagccugcugcagucaccaguggaugugcaauagaaggcaaugacuccacaucuccccagauuuauugggagccagcaguucauuagugagggcugaguucccccgagucccuccuccauccaugccggacuguugacaggccuguucuugugcagacucagugcaggcguuagcaguugccaugagucugugauugcaauggucgugucuuucacaggagauggauggcauuucacagugcuuuucucugccauccacaucuuacauuucuuccuuucccuuccccacaauguucccugagccuuucaggaugugguguaaauggcuuguauaaagcugagcaguagcccauccuugcucucagccccuucagcugcugugagccuauuuauuggaaaaagagguuccucugauuuuucagagugccaugugucugugggcaauaaccacauugggacauuuuuaccacagcuuagucacuuguggcuuguauauagagggugcauucagcaccuacuuauuuugugauaaauauguguucaaaauaggaccaguaguaaugucugauccaagggucuuauaguguggagacuggcuugaaggaugaaaugguuugugugaggauuaaauaaucccuucaaccugacauuucuagauggauauuuauuaaauccauugguaugcuggaucaucaucaucaucaucaccucuguuuccaugaauuccuaacucaguucaaagauaaaugacagauugucacugucagugugaguuuuggugagauagacuagcaggaacuguuucuuaacucauaugaccacauauccaaguugaaccaaggggaugugaacaacggaaccacuuaaauacagacacagacagaaacacacacacacacacacacacacacacacacacacauuuauauggagagagagagggagggagaaagagagagagagggauauauauagagagaggggggcggggaagagaacaaugaguucgaagccauuuucaagucuucaagcagaagagagcccaggaauguauuauuggauucacuucugaguucuauuagcccuuaaaaggcucccgcaugcugccccagaagcagaaagagaaagaacacuaucaaacucuuuuuaugaagucaguauuauucugauaauaaaauuggagaaggacauaacagaaauggaacuauaaaucaguuuccuugaugaacauagauccaaaaaauucucaauaaaauacuugcaaaauagaauucagcaacacagugaaaauaucauaacccauggcuauguugguuccauuucugaaauguaaggauguuucagcacguguaacccauaaacguaagauagcacaugcguagagugggggaaauacauaacuaucucaguagguacggauuaagccuuuaucaaaauccaccaacaucauucacaguaagauaaggcaagauaaaagaaugaagaacauacaugcaaaaggaagaaagcagggaauccuuuugggcugaaaagacccuaaugccucuaacaguaaacucuuacagcaguagaaugcaaaaucaguuacucuucuauacaucaauaaugaauaugcugagaaauaaguugggaaaauaaucccacucacaauguccucacaaauaaaaguaaauagccaagaucacuaaagcaggcaagugagagacuucuacaaugaaaacuuuaagacacugaagaaaaacauugaagacggcauuagaagacauuccauguucauagauuggcagaauuauuguugggaacguagcuaugauaccuagagcaucguugaauucacugcaauccccaucaagacuccaaugucauccuucaaagacauggaaagagauaauccuacgauguauauggaagcaccacaggcuccaaguagaccaagcaguccugagaaaaaaaauccaacuagagauaauggaauccucgaauucaaauuauacuauagagccaugguaacaaacccagacaugugacccaauggaguagaauaaaagaaccagagguaaaucccacagggcuacagugaucugagucucaacaaagauacccaaaguauacauuguaguuaagauagccucuugucaaauguugucgagaaaccugucaauccauauauagaagaaaaguaugguaguaaaggcuaacaaaauauuaauuaaauuuacuacuaaauauacuacagcuguauuacuauauaagauaguauaaauauaguaauauaauauuaauucuagucaaauaaaauacucaugggaauguuuuucaagucuguuuagaugccagaaaguacauagcaguuuugcuugaugggguguggccagcaggggcguggcuagcagagcauggcuagcaggggcguggucagcacggguuucacagagggccugagccuugaaccaugcucugagaaguccauuauaguauuuuucagaugauauaggcgagaguauguggauauuauuuaaaaaaaaaagcagcaguaugaaucuaauguacacaaucaguccaugaagggggcuucuauuugacuuguucaccguaggcuucccugugcuuagugauuagcauaaccgcucauauauaaccucugcucaauaacuacuuguaaaauggauauaaagaaugaaugaacugcuaggagcauggugguaacuggagagugcaaaguaaugccuucagaaauaagaugagaaagaacgaacaccuaccaugucaagaagaagauuccuaauuuguggggcagagccauggcucggcaggugcaagcucccacggccacgucugaggaucugaguuugauccuggggauccacacagugacuggagaaaaugggcuucuccagcuggccucugacuguuucccuugccaccacucucccuuuaugugcacaagaacuuuuaagguuugauaacaauguggggcacuauuuuaaaguagcacaugaccuucaaugucuuucauucacuaaagaugggucacuauguuuuggguuaggcugugacaaagcaagugaaucagaaguuucaguaauaugaacaagguagacgcucuaggacuggaaagguggcucagggaucaagaguacuugcugcucuuacagaggacccagcuucaauucccaggacccacguacuggcucacagccacuccaaugccaagagauccuccucuaggcugugcaggcaugaggcacguaugugguacuguuguuucaccuaugugaaacuuuuccuggggagaugcagcacaugugucuaugcacacuagauagggauccuacgccagaccaaagugcagauacuaccaucgaaauccagcguggggaaccgugaguuuuacugaggccacuuacaggaauaugggugaggggagucauuuacagaagcagaaauaacucaaagagcuuuaucaccaaagcccacaccagcgugcuugacaguuuaccaaggugggaaucuggagcacacugcacagccugcaagugacucaaguuaaaaauguccuuuccucagcugaccuaaaccucuuccgggcaguuuagcuagucucugcuucuuccagucagcuggucuggucucggggcaucuuugcagcucagcuuugcuccccugagagugacucugaaccuuuguugcuuacuuugauagggaggggccuagcaaaucuggucaguuucagggacuucccgagcuuuuuagaguuguuacugauugaauuuuguugcuguugcuaaagaauacagccauauaaacuguagcguuuagcuuuauuuagauaaagacauuccccacagcugcucuuuguuguguuuucugauuaauugucuuacuuuuagagaaugaaaaauucaaaguuuucagucucaacugcugugucugaauuuuaacccuuugaaauguugccaucuagagcaaaaaaagaugccaggaccaaugccaguuuaucugaggaggugcaguuguacaaacuaaacaguuaagugaaacuguaguuucugaccccaaaguuggcugguaguuuguguaagagcauauuagcuuagugcuaagaugaccuguuaagaacuuuucucauugguuauugaaucuaaucugucagaauauguuuugcuccaugggauuaagccuaguagaaaaaaaaaaaagaaaagaaaagaaaaaaagaaauacagcuaguguuauccaaagaaaaauccuagguaugauuuuauuuugagauagagaagaaaguggggccugggggagggggaagaaagcagaaaggaugauggagagaugcuggguuuuguauggggaguugauaaacgcaaaacuccacaccuagcuuuauuuguuggcuaaugugucauuugucuguucuugcauccuaacaugaauggcagcguugacucucggggcacauuguagaugaggugguuuucauggguuguggaguagaagcuuaugucccaggcuccacaucccagaguguccuggagccuuauaaaucccagcggcccgauggacccuagucuaguacaggggaauuuuuaggguggggcccacaaaguggcuuuagcccacagucauaggcagccaaggaucagaaccaguguuagagaaaggacugguuuucuguggcuuccucuugauagcuucauugaaggccuccauucacgcuucucaucucaagcuguuucagagcuuuguaagguuuccagcuuaggagccagaaugcuauuuaccacugaaccuagacgugcauaggauucucaucaaaagacacuaauaauugacuuucagguguguccuuucaaacuugccuauuaaaaauuuaauagugaacuguaucucuugacucuauaucaccagaaugauauucuuucuaaaucguuuuuaugacauuaauauauuuuaggguccuuugaagguacuuuucaguggcauacaucuuauucuuugugaagcaugguuuuaaaaaaaaagaagaaaagaaaaaagcaaguuagaacuauuagggacaauaucugguggucagagggauccguugccaucguguuagucaauuucugcuccugugaauuaugucuucuugggguugagaugcuguguguucugacaccugaggggaugcacuuucucuucuuuuuuguaacacaaaccucaugcacuauucuggcccuucaccuguguuugcuaaucauuuuuaucuggaagacccagucaagcauucgaacaucuuggagccaccauaucaccuagucaccggguaccauggcaaccgaggccauuuccucugcuauccacaggucaaaucagaggacggacgauagcuacucucaugcucuggagcguugagugagaagcugaugaaccugugauuucuaaguaguguccuugccagauguccucaugaguugugcauugugucccauguguaucagaggcuuuucccaagaacagacauccacauauuaguaacucacauugauccucggcgaguagaaaagcuguuugcuuuacaugugagauauaguuacaagggaaggugugggcuucaaaugcuggggaaaacuguaggagaagccagcucuuucuuuugaccacguuauuuugguaggaacagacggagcguacuucuucagaucgucauccaaacaaaaaaagaaagguagccaagguugaauugugugugguggugugcugugugguggugugcugugugguggugugcuuucacuaaaucauuuuagugcugcaauagcaaaaccagaauagaccgcaucgaugcaagcucaaugcgagcugugucaagaggagcacggggucucccggauaaauauaagugggaagauccuuguuuccauauauuuguaaaucagucguucauugugcuuuuaaaaacauuugauucuacuguuuaggaucugaauaucuaauuuacacuuuucugcuugguccaccuucaaguuuuacagacccuuucaguguaggggcgccuaagaguagaaagaaacauguuuauaguuagaaaaugcuggcugauagaaaauacaugccuauuguuuaucuauagauauacauauauuuuauauaugaauauauaucauaaauaugucauaugacaucucuauguaucuauauauguauguaucuauccauccauauauauacauauacauauauacauacauacacauauauguacauauacacacauacacacacacauauauauauguguguguguguguguguauguguguguguguguguguguguguguguguguguguguguguguggauagauaaauacauaugacauauuuuccacauauacacuccuacauacacaaccuaagacaaauguuuacguuugccaaagcuuuaaggcuuuaggguacuuuacacuuaacuuguuuaaccuaguauuuuacaguaaauucuccaagacccggaacauuaauaaucuuaccuaaaccuaguuucuuacuuagggauaaacucaaaguuagauuuagaaacacagaguccccugaucacacaagguucuuuccauccaagaauucugcccgagaagaaauaaagcaauccugaauuuccaaaucaguuccuugcuuggaaauuaacaaauaucaaauauugauaauuuuuuuuaaaaaauuauuuuugcuuuugcaguaucuuaaaaagaaaggccccuucugccuguugaguggguggaugcagccgcugccuccucagcugccuccuuuucccuucuaguuugugucugucauucugagucucucauuuguguauucucuugaugugugacagugcuuaauauugguggccauccucguguuugaaucaguguggaauccccuuucacaucgucccccauuuggaugcugugaaaggagaagguccuccuggugucuguguuagcaaggccauccccuuuaugcaguaugguaacuaugacagcaucugcucuuguguuuugaccuaagugcaacaacagaugaaauuuggaaacuuaaaaaaaaacauuuuaugaauaguagguuccugauuaauaaaacacuauacauuagauaacuuuuuuucucuuagaccacuuauaguauaggagcugcuagagguuuggcuuugugguuaaaugugcgcauuguccuuguggacagucagaguucaguucccagcacuuacauuggacaggucccucccaacugccuguacucgcagaggaugcugcagaggaugcugcagaggaugcugcagaggauccagcuccuccucgggcuccgacacuuaugcgcauggauucucucacacacaccugcagacauaaaauuuuuuuaaaaucuuuaaaaccuaggaaauuuauaaucuugaccuuucgaacuggaggauuuaaguugggcccaaagguuccugcacaccguuaguuuuucucaugaccuugggcuugccugugagucaugaguacuuucagacagaauucacaguggggacuugacagcuaccgcauucauaugugagauagacuugcuucagaggugccgugugacuccaaccuaugaacucaagccaugaguagauaaauaauggcuucucaaaacuuaccuuucagaacaaaggaagaacuaugcccgagacagugucagcagugugucggacgugucccaguaccgcguggaaguaagaagcuuugcucuugccaauacugauugugacucuuaaggaacauacaaauuaggagcgaaauaagagcuguguuucuuuucauuuaaauaggauguguuuucaguuguguggccuuccuuuaagauguuuucuaucuuuugugaaacugagaugcuacaggcgagaauuuguguuucaaaauagauugaaauaauaacguauucgcuggccauugugagcccaauuaaaacaggagaaaggcuuccguuucacacugucauuaagcuaugaugcaccaagcagcucuguuuuauauuuaguuuuaucuggugucaucacuagcuuucauuaaacccuaguuucuauuuuaguuuguaagauauuugcucuuaauuggaaucacaacgaccccuguuuuuagcggaaaacauguaagcagggacgucaucuuuaaguugcuguuuucaguuugccgcucaucucaagcaugcuuaauuaaaacugaaccacuguuuuucaguaaaguguuuucaggagagggcaaacgggucaguuguuagagaccagaacccuaccugaggcuccgaguggcuguccagguuguagcugccucuggaaaugcugcucuccugugcagcauugaaauagcucucugaguaacagggguggggucauuaauguaaggaaaugcuauuuauguuucauugcuaagaacuugucuuaauacuaugcuguugcagccccacgugacacagcacgacacagguucagggaucauacaaaucaaggcauuguuuucuguguucaacaaaaaaaggccacucaacuccacccugucaguggaguaacugagguuguuguuguguguugugucaagccuuugguucuucuaacugacuucuguuaugcaaauucuuccuccuuuugaaaaauaccuauggagaggguuuuauuuguguguucaaaguuuuucuuuuccgcccuuuuuuuuuuuuuuugaacaucauaagcacuugaccaccuucgugcuggaucggaaagaugcaaugaucacugucgaggacggaauaagaaagcugaaguugcuggaugccaagggcaaaguguggacucaagauaugauucuccaaguggaugaccgagcugugagccugauugacuuagagucaaaggcaagucggggagguuuaugccacuuuagucuuaagaguucaccaccgauaccaacgugugcagucaggacagagucuugggacacaagugaugguuugacacugucaaauauuuacucauuuuauacagaaugaauuggagaauuuuccucuaaacacaaucucgcauugucaagcagugguacaugcaugcagcuaugacuccauucucgccuugguaugcaaagagccaacgcagagcaagccagaccuucaccuuuuccagugugaugagguuaagguaagagugccucagccucccauuaauucuagugggguguguguguguguguguguguguguguguguguguguguguguacacgaaugcccaaugaggucagaagaaggugagcugggauuauaaauucgagaagccugaugugggugcuuggugccaaauucccauccuuuguaagaacagcaaguguucccaacuacuaggcaaaucucaggucccuguuccucgcucaacccucuagagcaauauucugcaacuuucaaucuugauuauaaagcuaucaguugcuagaguuuaacauuuugagaaugugaugaagaaaaucaguaccgaagugucuucuauaaauuuccaaucagguaaacaaaagaggaaauuuuauuauuauuuuuuuaacucaagguguaguaagauggguccuacuuguaccacucaggagggugaggcaggaggauugcugcaaggcagaagccuguucaaaaguaucaaacaaacauagacacguguuguuuaucuuguuugcaaaguguaccgguguaugaaauucucaucaggggcucuguguauauaauuuaaaaauagaucauuaaaaaucaugcauuaugcuugcuucuguggcacauauacuaaauagacagacaguaaguaugcuacaauucucuuuucuuccuuguuaaccucgaagcuuguaucgauuguuucagugagauccuugcaaugccccaugguauugauaggaagauugccauuuaauuaugggacuuggaaaguuacucaggguuugugaucccuaagugccaugagaaauagcugggcagaguuagcaagaauaauaaacuugagaccccaaaaucuauguuucacaguccacguaauuuaucaaugaugauaauuuauugaaccuuagaauuuaucuccaacauuagauagcuuuauuuucugagcuggugucucuaaaagagaaacuuccuuugguucauuggcgccugucuuaguuucuuuccuguggcuguuauagaacacugaccaaaauccacuuaggagaggaaaggguuuauuugaguugauaaauccagagggacaggagucuguccugguggguagucauggcaacacacagcaggcaugguagcaggagcguggagcagagagagccaacugaaaguggccauagacuuuuaaucucaaagcucuuccccagugagcaccucugguggggggggggggaacgggacccaguguucaaacacugggaauggagggacaguucucacucuggccaccuuuuucuccuccuagagcacugaguuacuugugacuuuuaucuuguaaagacauuuuagaccagcacaagaaacccacuugaucucaucagcguuucuuugacauuaaaccauggcagaugcagauuaucauuaacaauauaguuuguaaucuuuccuaauuucaauguaucccacagaugauuauaauaaaagucuuacuugaaagaacugugcuacuuaaguaacuuauagcuugaaauucaucagcuuuuuacagacuauaacuuuucgaauuccuuaauuauuuuaaugauuuuugaggauuuugauauguuaaagcaaaaaaauggugaagugaauauuucgcucugaaaaaaaguaaaaucuuauuaauggauuuugcuucuuuaauuuuuguacuuauuuauugaagagggauaucauguacggaggucagagggcaacuuguaggaauugguuaucaccuucuaccaugggaauuccagggaucgaacucagguccugaggcuuagcagcaaguguccucaaccacggaggcgucuuguuggcccaguucagagacuuacaaaccaaugaaaaauacugagucaaaaggcauuuaaauuuuguguuuguaucccugcuuuuaagucugacuuaaaugugaguuacuguccugaguaaagguuccagacgucagccucugcguuauggaaugaagggcuuuccuucucuaggggaccgugaccaugaugccuccacaugaauuuccuggacaaugcucuguacucaccauagcucagaccacuaaaaaugaggaaagccacucacccuggccagugccacauuucuuuucaugaggugugcauuccuugcuaauuuaaaaaugcaagugccuugauacugugauuuguaacuagucugugugcagaacaucuugcgauaacaguuuuugaguguaacuuuuuaucaugggaugcuacauggugcguuugccuccuuuagcgauggcaacauuuuucauagaaguucaagguucuagacaccuccaguuuuaaucuucuauauaauagaggacuuuggccuuaguugaccaucuggaauguguugggcuagacuguucuaaggaugcacuguacugggguccauugcaguguuaccucacccugaacaugaugcaggccaggcuacuucuccuaguuccccucagagaauuaacuagaaaggagacuaaacaagggcuggggagacuguucgguggaugaacugcaguugaaauccccagaaccuaugucaagccagcugugaugguacguaucuaucauccucacacagcuccagagagauggaaugcagagacaggagaauuucucagagcuccagaccagcuggaccagcuuauguagggguaaucagcaaagggccuugccuccggcaaggugaaagguggaaaacaucaccugagguuguccucugacuuccuuuuauguaaucaguguucauauaugggcggucacaugugugcuuguguguguccgugugcacgugugcacuuucucucacacuccaugaucuugaggucucccaucaguuuuuauacucaccagugcugacuguuaaagaauacgugacucauauaucugagaaaaauguauauaauuacacagagcacacaagcccaaaaauaggagauaaauacaugagcaacauccucauauacagugauaauuacaggcuacagauaaauuucauaacaaagaaaaauugacaccuuaucuacaaaacucacuugaauucccaagaaaaucuaaucguuggucuuguugggaacauaaugggaaaauuugugguggcagauaguucauuuuuaccugaaauggaauaauaaagugauuaucaaaacggauacaauauagaauugagacucagccugugaauguacugcugagugaguuuuccaucccgguggcaaaccaucgagcugagcaacuugcaaagagagaaggucuguuuuccuaguggcuucggaggcuucaguuccaugguuauuugggacauugccuuugggccugcagugggaaaguccaugguaguaggaagagugugguagaauugcuguuugcuucuugggaagcaggaagugauaagagacaggcaggaaguaucuggcaauccuagugucauguaagagcaaagcgcaaugucuuccuuccacgaccucccuuuugaaggcuggaacccggccuucaccaugcauccauucagggauacugcagacacuaaccuagcagaaggugugccuuaaggucuggugccucuguagggccgggugauugcuuggugaguuaauagguucccccuguggaaagggaaagggggaagggucccccagcccugcacaucaucucuuauauccuuccucugugacagccgagacacucaccuguguccucucugcaguugccuuucucugcugggcucuuggggaggaauguuuaaguggaaucuggacguagauuaaccuuaaaaaucaacauuuguaccgggcagugguggcacacacuuaaccccagcacuugggaggcagaggcaggcagauuucugaguuugaggccagccuggucuacggagugaguuccaggauagccagagcuacacagagaaacccugucucaacaaaagagaaaagaaaaagaaaucagcaugugaguuccaucauuauaaaauacaccauugaaaacuagagucauauuuuuacgguagaugcuaaaaagucuuucuauuuauaucacaccaagauacuuacugaugcaaacagugaauauaaauuauauuuucuuucugucuuaaccuuuauaucaaagcucagacaagccuauggccuucuggauaacucaucucuccuuucaggcaaaccuaauuagugaagauaucgaaagugcaaucagugacaguaaaggugggaaacagaagaggcggccggaggcccugagguaagagcaucaaauggcauuagcgccaugggauuggauaguaugccuccuuuuuuuuuuuccuccuggagguguagggaaguuauuuucaauggaggugaauuauuccguuuucuaaauugcaaccuuuaaccacaacuuaagcucugguugccuugccaguccaugucugccccuucuuguuucuccaugugucaacucugucucccacacagcuucucagacaucugcagaugucccagagaguuauaagaaaaaguggaguguuuuaagagaugacccaaggucuccccauaggcccacaagcuuuucaaauaucaugugaccuagagaaaaaaaaucaauguugcuucccagggauuuuaauuuuucugugucucaggaacuuaccagcagacacagcacagcuggucaggaauucugauuucccugacaguuacuucugagguugaagggcaaauggcaccaguggguugcaccguuguuagcagacguggagaugguaacagcccaguuggauaauuuguuuuuaauuuucaggaugauugccaaagcagauccuggcaucccuccuccucccagagcuccugccccugugccaccagggacugucacacagguggacguuaggagucgcguagcagccuggucugccugggcagcugaccagggcgacuguaaguacccagcccuagcccuucugagcauccacgagagcuauggugucaguccuccuuucaaguccucaugguaauuuguagauuaaaguucacuuuaaagaaccaaaucuuagauguuacagaguuaagucuuggcugcuguuaagguuaucauccacgagaauucaugccaaccauuuaauacucuaugaggacuacacucauuucuggcugguuauucguguaaugucuaggugacuuuugcaccagaugccacguuggucacugucacuuauagagucacugcuggcaagauuguuuucaacaucucuccuccagcagccugaauggcaccuucugaaacuauacauucugcggguagggacgaaucuuccagcaggguuucucuaugaugccuuaugcugaagugugcagugucuuuaaugauagggacuuuuaaucuugugagcuaaaaauugagaccugaaauaagaccuggcucugucuguccauaugaccguggaaggucaucccuuugugcuuuggucucagcuguaaagugcacauaaugacccccagguuucugugaaugcuaaagccggugaugcugucacugucacagucaaugaacgcugaugaccucugcuuuaggcaucacaugcguuuccaccaauuuucuuuguaaauccaaagguuaaauaacaugauuuuuugaaagacuaugcuauaucugugcuuauugugaacccgagguuaguuuuguugguaucguuuugguggagggggaucuggauaguuguuguuauuguuguuguuguguguguguguguguguguguguguguuagagaggugucaaaacugacuugaugugaagagaagauggauugaguuagagauauccugaauagauuuguaggaacguaugugaaaucuaauaucauuuuacaauaaaagaauuuacacucagguauuucugagcucuuacuagauuuuguguaaaauacuccuggcauugccaucuguuacaauuacaaggagacagacuucuagcuuacuaauuguucaaacagaacucaagacauggcacacaaaguucugugugagugccagagggucuuaguugggaauguccuaaaggaggcucucucugcucccucugaggguuucgucagcucugacugcagccccuuagaacucugagguggaguaaccccgacuuccaaaagugaguguagcaaaaugguggugguaguagccaggaucccaaaaugguuuggaaauaaauaucuucugcucaguaugccccagaagauguuguggggucucucagagacaccuauuccuccugugaggcauagccuuccuccugugaggcauagucuuccuccugugaggcauagucuuccuccugugaggcauagccuuccuccugugaggcauagucuuccuccugagaggcauagucuucuguguagcccuggauguuguggggaucacuauguagcccaggcuagucuggucaccccugccucagcuuccagagugcugugauuguaggcaagaggcccuacacuugaugcccuuuggaguuccuaauggcggguccuaguuuccuucccugccuuccaugguccacuguaccaagcaagcagcagccacguguaaaauagcagccaacugucaagcuuggcuccgugcagacuugugagcuugaauaguuauagcuaaaacuggaguuucagguggcuuagcgauuccuuuuucuuuucgcccguguuccacgucuggacaauguuggcauaaaggaggaauugggauuccgagcuugcaguguguuuugucaguucucugcacuaaaccucgugagucaugaugaugucucaugaguucucccuccacuccuugugaucuauugcuccugccccagccauaugccuuugcauuuaauguacucugaaauacaucgcaccagcugcccacguuaccauagugcugacugacucaccucaggaaggaaucugcgauggaggucucaugauuaacauucacaaucgagcuuucuugacauuuugaaugccucugagacaugcauucaguauuuaucucaaggcauaugauuuaagaucagggagccaaaggcugcggguuuuaugcugacuuacaacggccauugagaaaucacugcccucuuaggacugcaaagcuuuuauuguggucacaggguuggaauguggggguggggggugacuagcagcccaggcuguggagauggcucaguuggcauagugcuugccacaccagcaugcagagcugaaucgcauuccccgugcccagguaaaacaaccaggaagaaugaauaguccgugucuguaaucccagcucagggagagggaagacaagagauuccuaaagcuugcuggacagccagaggcauagccuggcaggccaguccaccagcugugcccagugcuccugguaacuguggcaaggauguaccucaggggucaucaguaucguuuuggcuuguuuauuccagagagcucccugcucagcaacuggaauuccuuucucauugucuucucauuuucauuucuguauugauaaugucuuaacaaacauggaaagucugacaauucucuccuuuccuuucagucgagaagccccggcaguaccacgagcaagaagagacgcccgagaugauggcagcccggaucgacagggauguggugaguaccgccugaaucagguuuagcucacuggcccuucugcuuugggaggaggaggaggaggaggaggaggaggaggaggaggaggaggaggaggaggaggaggaggaggaggaggaggaggaagggaaacaggcauugagaugaaagggauuggcaaaaauggcugcaaaaguuuucuuuucucuccucaguguucaguauuuccuuuuaauugccccuuaaacacuuaucccuccuuccuaguguuuagcuagaugugaucuccuauagaacacuggcaacuuggccaguuuacaggggaaauggaccuaaaaggccaauggucucugcuuuugcuguuuuucauguuuuaugauucauaguugaggugucuuuuuuaauguuuguucauuugguuuauuaagauauuuuaggacuggggagauggcucagugacugcagggcuugcaucaaaagcccaaagacuggaguuccuaucccuagaguggaugggugucggcagcccaucacuagguagaagggcacccauucuaggugcagggucuagguuucauuaaggaucuuucccuuauuguugaaguugggagaggggcagaggaugaucugggacaucagaacugggucuacacagguaaucacaugugcacacacaccaacaugcaagggaagccgcauguacccguucacacaugugccuagucacaugcaaauguggacacacauacacacacauacaccauacccucgugaaaauaaaaacauccuuuagaacaugucaaaaggaaaaguuacgugauaauuuaaaguauaaauauguacauauuaauguuuuauacagaggagugcuguacuuaaugucauuuccuuagaguaauuaacuugcaggguuaauugacaguuaauggcuauguccacuguauuucaaauaugugauuuauuuaccuuuuaaacuauaaacauucccagguucuuuugaaaguaauuacugaaaggaggcugacauucagaauuaauuuuuaaaagauuuucuuucuuucuuuuuaaauaaaggcauacugaaaucaggaaugugcauaguccccuuuuaaaaacaaucauuuaauuuauauugaauacacuguaguugucuucagacacacuaagaaagggcauccuauuacagaugguugugagccaccaugugguugcugggauuugaacucaggaccucuggaagaacagucagugcucuuaaccacugagacaucucuccagccgaacauuuucauucuuaaucgugugugugugugugugugugugugugugugugagugugucuguaugugugugucugucugucuaugucuaucugucugugucuugugugugucugugugugucugugucugucugucugucugucugucuguguaugucugugugucugugcagaugcccgccaaggucggaauccagcaucagauugcuugaagcugcaguuggaagugguugagcuacuuagcauggaugcugggaacugcguuuuagaggucuauaaauguaaacuaugcuccucaccacugagccaucucuccucuuccagcccuagaacuuaaguuuuauaucacacuauacuaucgcaaaacguuuaucaaguccuccuuaauagucuuauaaugugaagaacccuucauuuuagacuagagaaagcugaaaguggaguauaagagcuaaucgaagucuccagcacaucuuugccugcuccuuccgcucugugguguggucaucuccaugccuuuggguggacaugggcuggggggucuuuagguucuuauggcacucuacagggaggacacaggaacuuugucacucuacagggaggacgcaggaacuuuuggcagagccuuuacaggacagauaacugcaaaacaaaauuaugcggugcacuucuaacaaaauguaucucugaaucccaaccccagcuuuauguggggaacacugugagaaaauuagagcaauuuaaaguaauuaauaacugauuauauauugcgaaugcuucccugauaacauugaaaaugcagcaaaauuaagcuuaaggaauagagaugagacuguaucuaucuauaucuauaugaaguuuccaugaaaguggucauuuuucucuucucaucuaaagccucucuccuuuacuuuccagcuaacagcuagaaccaaauuacuuaugccuuuguuucacaucuugcucuguuauuuuuaauuccagcaaaucuuaaaccauauuuuggaugacauugaauuuuuuaucaccaaacuccaaaaagccgccgaagcguuuucugagcuuucuaaaaggaagaaaaguaagaaaaguaaaaggaaaggaccuggaggugagcgagcgagcgggcaggcgggugggcgggcacaagcagacagagggcuuccucauucuaaggcuguuagacuugaggauaaauggguuuccuuacccuaaggcugucagaccccaggcaaguggguuccuuacuccaggguuaucagacccacagugagcguggguugggggcuuccuugcucuugagcagucagacugcaggugaguaagguuccuuacucuugggcugugagaacuacagggcuagaugagcuuggguccugguaaccagcuacguugcccugaacaaaccaaggcccuguaguuuugggcacuauuggaaguuuguuucaagcuggcuguaccuuuaagucaugugacucugagauuguagccaacugucugcaguuuucacaaguacuuaaauguuaguuucugcucguaacccugaucuuuuucuguaggauucuuucauuguaaauauggaaccuuuuuuaacauuaaaaauugacuucuuucauccgaguauuuuaaauuaccaauggauuugaaucauauugcaaauccccaaauuguucauucacauucagagcugccuagaagcaauuuugaagcauagugcugaacugcaguguuaaaaaugucuuagaagcugggccaggaaucccagcacucagcaagcugaugcaggaggauuauucuuaguuauggaagauaaccugggauaucagaccuugucacaaaaaaauaauaauacuaaaugaaaacaaauggcuuugaauguauaaaaguauaaacguaaggauaguguuuauauuuccucuggcagaagacacaaauugaauauauaagagaaugguuuguucaugucucguucauuagagcugacuucaaaucuuccuguagccccugucuguauaguaagaguguguggucuucaguguuguccuggcuguagaugcuuagaugguccucuccuccacucauccugaaugaagcguucugugguguuucaaguccccuuuucuguuugcuuaauggacuaugcucuccuccaggcuauccaagcucagaaccaaaccucugccuucuuccuugagcuuacagcuacuuugacuuauuuucccgaugucaucuguacacauuuuuuccauucucauaauuggcaucuaguugaaacggucaucauuuuugacccagcuugaaagcagccuucaacccccuagucuucuguacuguaaggagaacaagucaaucaacuaucaaucaaucaaaccuuugagagagagucucacacagcuggucucaaaguugcuauaaagccagggauggccuugaacuccuucuggcucuaccucucaggucaugggcuuaaggugguuauugccacagccaagaggacacccuugggagaguucuaaguugguguccucauacuucugcccugaagugcaaguaguucuguggacuguugauugcaaugucacuucuuacuuugacauucaaggucaccuacaaucuaaaccaaguguccucuugaaucucacauuucucuggguuuauguugcuuguuuugcauauacucaauuucuguguuauuccaggugucauucuaaucuuaucauguuauuucugcaaacuggaggaaaggugggcagagcuuuucaaaucccuucuuuuuaauuccagcaugcaaggcagaggcaggcugaucucuguggguuugagagcaacauggucuacagaucuacagagcauuuuccaggagagcagagaaacccugccucacaaaacaaaacaacaacaacaacaaaaaaacaacaacaacaaaaaaaaaacaaaaaaaacguuuacugaaaaaacuuucugcuuuucauguuccccauuucccaaacagcauacucuccugucguagcgcuuaaaugcuacaccuguuauacuucugauucauuuccucuguuauuuuucaggggcauuaaaagcagggcuugucacuuacucaauuuuauagccuuuauaaugaccacaagaauuccuggaacauaggaaggcuuccagucauauuuauagaauugaaugagucacugggagugucuaagaguagaggaauccauucaaacuuaggaucuucuugauuuauuggaauaagggauguguuagaaugaaggucuacaucuggaguaauuuuccagcuguggacgcaaauguaguugguuuuuuguuuuuguuuucccaaucaauaaacuuccuugugaaucucuucuuauccgccccugcucuuuuuuauuucauuagagggcguuuuaacacugagggcaaaaccgccaccuccugaugaauuuguugacuguuuccagaaguuuaaacauggauucaaccuucugguaggugcacuuuauugauagauacuagaagaaacagauggaaaaaaaaucaaaguuuagccaaguguuccuaaaaaauuaaauuaagagauagaguugucccuguggauuugugggcguguguuuugauuggccuuucaugauaaccucagauugaaaggcgugcaugacaaagaguuguauuucuuggcugucucuuccccgcauucgcuccaugcugauggagccucucucuaaggagaaguguuaggaaagacgucuccuuccaugccugcaauggacugcucuuugaguauccacccuuggggugacuguguuguggugacauacuuguuuucuuucugucacaggccaaguugaagucccauauccagaacccgagugcuucagaucugguucauuuuuuguuuacuccacuaaauauggugagcauuuaugaaugaaacaaagcaaucguucucaguaucucccauccaagggucugaauuacuuaggucucuuuccuuaauuaccuuacaugggcccuguuuuucuuagcaugcuuguaaacucugaaugugaaguuugacgcacaccucacuuacggcuggggacauggcacacacaugugcccauuagaauagcaucucauccagaacuagcaguguuggguguuucgcuugcaagccucuccucuccaaguucgucgugccacauggccauggugcacuggcgugugugcaugccugcugaguuucuucauaggaagucguggccuguaauauccgcucuuccaaccuaaagggcacaguguucuacuccgucacucuguagucaucucugaauguuuccugccaaugcuuauaaggcagcaaguuaaagguucaguaccaaagcugggcauggugaugccugugccugcaguccagacacucucaaggcugcgguagaggagugaguuccaggcuagccugagguacgugguaagaccuuguuuccgaagucuaaagcagcgagccaaaaaagaauggagccuaucauguuggcucacacugguacuuccagcacaggaagcugaggcaggaggauugcuguaaauuugaggacggagcaggcuccauggaaaguaaaagauggauguagacugcaaggagagaacuggucugaaaaaauccaaaagugcaaaacaaagcagaagcaauagagcaugcugcucuguuugcagacgagucggcaggcacaaagcguuugcaccccaccucugcuucucaguuuucuucuuagaucccccaaaugugucuccugaaauuuaaaguaggggccaucaaggaaaauugaaaaauaagcgucauggugucauguagugugucaguacugugugcagauugagaacagcagguaccaggcaagcccuguuuuagaaucaugcuggcauguaggauucccaaaagauguagcgccugaguuggauucugggugcuggaggaagggucuugaggggaacuagaaaauccuguguuuacagaggcagaaaacagcauggccuccucagagccccugaccugggagaugucucagucuagagccauucaacagaacaaaacaaacccuccuucuuucuacaacacuucucugaggaggccagauucuaacaaacuaucuaucuagccuuucugcuacuagauaaggagccuuccucagccaggacaaggcuccugagaggcgaauguggagcguccuucuaacacacgcuugccauuguuuugcuuaucaaagugugcaccuguuucccguugaccguuaaauuguccauaucaaaucaaggaaauauacuagaauugaauucuggggaguggaggcaccacuuaucacuguuccuucuccucugccccccuccccuucuuucccucucuucucuuuucccuccccucuucucucccuccccucaucucucucccugccuccccucagguccuuuuccgguuuauaaauccucacaggcauagccaacacugcugacugaaggcuucuuucccucaccuucaauacaguucauuuuagacccacaguuuucaauguuggcagaguaguuugccauuuguaauugguauuuuuaaaauaacaaacgguuaagucagcaaauaagggucgccacacugccauuaguauuuuacugggaaauaauugauacguauagccaguauguagaugcuaugauguccuuaaacgauuaacuuuauuuauuaauguacccucauucuggauaacucaguuugagaaacuauuuucauucuauaauguuauacaucaaauuuuaauuugaacauaugcaaacagcacuuuguuuuggaauugauuuuuguguacaaauuucaagaguauacaaauaaccauugucuugcuaaaaucauuuguucuccacccaggugguccaggcaacagguggccccgaacuggccaguucgguacucagcccacuguugacaaaagacacaguugauuucuuaaacuacacagccacugcggaggaacggaagcuguggaugucacugggagauaguugggugaaagugaggugagcacuguagagcucagcauuuaguaccugggaugcucugagcacuccugucugugcacuaaacaguaaggcauuuauguaagauucugcauaaagagcuaugugguagggaauggagaagcugauaucgccggaaagcuuauugucaaguugggcuagcaagauggcucagcagguaaaggugcuugcugccaagccugaccaccugaguugcaaucccugagacccacaugguagaaggaaagaacugacucaauauagugaugcuaugaucuccagaugcauaccauggcauguauaccccccaucaccacacacacguguugacuaaauacauauaauuuuaaaaauaaaaauuaaaagcauguugccaaguagaagaaauauauugugugcagaaggaaggaaugggacauaagcagacccuggccuauuggcauggugacgugaaggaagaagguggagagagggacacacacacacacacacacguaguguaugcuccguggucucccaugcauuuuauagagauagguuuauaguucuguuucacagaugaagaaauaaggcucaaaguggucaacucauugaccuaaagucacacaauaucuuaagugacaacacuccagggucaggguucauaaucuccuuguucaauggccuuucagugggauguguagaguaucuguaaacaaggagcaguugacagagaagcagaaaagaaggcaagcagcaggaagaguucagaguugcaggaggagggagggacucuggguggucaguguggagaaagccuggaagagaaauggugugaaaaggagguaucccaaggagagcaggguuggcugggaaggcuccauuuaagcccuagaucaaaggcaguugaaaaugaccaacguagggucuccucucccacccuucuuucuuucucuaacuuugagacagauuuuugcuaaggagagcccgcaacugucugcuagcugggucccccauugccaaaggcaaaaguagcuauagaugguguagcacaggauccuuaguaauccgcccucucugggguaagaacucucacccacuggaaaaaugauguggggcuaaauuuagagucaucguuugucaauaaagagauggagaaggacaaaccauugcaagagcugacaccugccagccaggguccucggacagcuguuuccagcucccugugaugcccuuucaguguacuuuauuuggcuaaaccuuucuuuuuuccugugcagagcaaaccauucaguguagcgaccauuuaccaguuagucucuggaaguuugccauugucugcccguugggccagucuaaaagauguggaccaauuuaucauuuuuuguuuuuauugaaauacacauaaggcagucccacuggacuguggcuacugcguauguuagaauacaauuuguagucugagauuccuugaagugguacacacuauuuuucauauuguaaauccaauuuguauuuauuugcauacuuaauuuuaauaucugcacaucaguagaucauaaucuauauuguauuaugguauuuauaucuucuuuaaaagauuuguuagguuuuauuuuaugucuauaugugagugccuguguguguguauguaucacaggcuugccuggugcccauagaggccaggaaaagguauuguauuuccuggaacugaaguuacaugugggugugaggauaagccugggucuucuggaagaacagccagugcuccuagauucugagccaccuaccuaucuggcuccuauuuuauaucuuaugcuguauuaaaacgguuuagauauguuuuaaaauguuagauguaugcgguugugauguuaugacaagccuaggcugggguuuuuuuuccuuccguaagacuuauuaaacugucacaucucagaauacaaaaagugcucuggguauucggugacuuuguuuugagcccuaucacaaaaucagacaauuuaaugaugguuuaaauagcugcaucaaaaagaaauauauaguuagcauuuaacacgaggccgcggucacuuuagauccacaucaaggccauuagguaauaaaugugggauuuaaaaacacaugaaagggaaaagguucgagaaagcaccagaucguuugaauaaaaggcuucauuucaucagagcagagccaucccaucagaauacgucagccguggaaaguauggccaggaaugcagacgaaagcaaaacugugaucucugccucugugccuugagaugggcccagagcuucugugaaccggccucucaagggcauuggcugaugacucgugaaggaccaggggcugugugaaccgcccucccgaggcauuggcugaugaguggguguugagugugaccacagauuaguugacguuucuuacagacaguuaagcugguacaucuaauuuauauaaaacuggucaucugugucauguuagggaaauucuguagcuuuggagagccaugcaccuucauaacagucuuggauguuucuauuuucaaagaucccccacugucugacagcucaaagggacugagggagagaugaacacugggaaguuccuuagaugccgcugagccccacacuuuagauucuuacugccuuucuauucucaugcacaaacguuaaacauucuauacccaugcugugcaucagacuucagggagaguuaagaccaugcagagaaacuuggaagcugccgucauacugccggguagaauugcucuuccaguuuauuuguuuggaccacugucauaaauggguuuccucuccucuccugagaaauagaguuguuuuguauagaagagaaccgugacugagaacacguuauuuaacauauaaacucgauguuccccuacagagcagaguggccgaaagaacaguucaucccaccuuacgucccgagguuccgcaacggcugggagcccccgaugcugaacuucaugggcgcgcccacagagcaagacauguaucaacuggccgaguccguggccaacgcagaacaccagcgcaaacaggacagcaagaggcuguccacagagguaaggauccaccacgucugcucucaguggaugcuguaauagccaguggggggucagcacucccugaagaacguucuagaaccaggaacuagauguccccaccucccgcuaucccgaguuaucugccaguucuuccuuguguuugugaccauuggugggaugccucuccuccccuuccccagcugagucucucucugccauguucugguccucaggccucccugucccuuuucucugucaggagcuugcccacagcacugucuacuguguugccuucagaucuuuagacucucaagacaguuccccaaaccuggauccugcugauucugagcaacguuuucguggugccgcgaucccucccuccucccuccucuuccugucuucucucccuacccuuccuuccaccauucuucccucccuuaauuccacugcucucucccucucugccaccuuccucucuuccccugacgcuguagcuacuacuuccagucucuccugcuuccuucuuccguucuaaucuucugaaauguguagaggagccaucuuuguguggacuuuagucuucugacaacaaaugaccacaaccguguugugccugcacaaggucauacuguggacuuuaucuuucaguuauugauuaagcuuuagaguauaacccugucuuuagaccaaaugagaggaaugaaauuggguacacuaucaugugcauuaaaaugacuuuuuguuugugugugaguguuugaacccuuuugaagaggagaauugaacaguguucaaaacugaaccaauugcaaauggaauggauguucaggacucguaaccauguggguaaagacuggcauaaaaggcagcaaggaauggcagcuugguucuucugaaguccaggucauucauucuccuuuuuaaaagucucugaugaguggguuuguaauguggcagacacaauaggaggaaaggcauuagcaaaccacagcacagugaccacuuuuaaggagaacaaacacauaaguuaaauugcuuaaaauuguucccuuggacgggugaugugcuauguagaaaagguacuggacucugugggcucgagagauggcucagcacguacagagccuguguguaaaagcaggaggaccugucacccagcucuaaucacccaaccaucaugauaaaaucaggccugguagugugcaccuggaauccuggagcuggagaggcagaggcaggaggaugccuggagcuagacaguaagguucugguucagagggcaagucugaagggaaacaaacaaacaaacaaaaacuagaaaaaaaaaugguaggagccauaaaggaaggccuugacaucaaccucaacacacauaugugugcacuuacgacauacacauacucauacacccauagacacggcccucacaaacaccgguuuuucucuaaaaggcagucugcuacaauccggaaccuuuauaacuaaaacuaaggagcaugcuuguuugaaguucucuuucugugaaugugacuauuuucccucuggcugccuaaaaaggaagacuagacuucacaccuggccuuuccucuaaaugucugaugauggugaccuccugcuggcugggucgcauaugucccugucuucguuugguaguuuagaccucgugacugugaauuuuccucccauuuagaaagcagccacgcuguuuagggaaggaacggaugcgugcacacagaaaauggcuguucauuugguguugccauaguuacuuacagcuguuuucaagucaugaaacuguccguccugugguauucuuaccuuaugcuggaaaaugugccacuuaggaauguucaccuuggaaauucacacuuuugugaguucuuucacaguacuguuuaaagagggugugggauguguguucugggcugucaguaccuacguaugucuacucugaagacguaguuuuaaaagaauuacugaggggccucccuugucacgagcugucacuuuccugcuguaaaaaguuucccauuuuaugauuuaagugcccauucagaggcuuacaggaaugggaagaaggcugccuugcgugccagguugagaucuuccaugaacagcauagccgauggugacuucaagugcacgagaagugugaacauagcagggagagagacuugauuauauuugauugcuacuggaauaaacguacuugcagcacgucuugagcaaauuuaggaucuggugccuuuguuuguaaucgaaagguguaggugaugauggguguggaugacaccaucaaccucccugccuccucugaccccgcagcgggcugugcggucaccacuuagucacccuccuuccuuaucuccuugcccuuggcauguccagucauucucaggaccugugacuucauccuggccaggagcuguucugaccaagaaacaggcaaaagguggggaugacucuugcaguuucugcucccaguugcucaagacuuugauugauugauauauauacacacauacauacauauauauuaauuaauucccuaauuugauucagcaucucuacugagucccuggggaagguuaguguagcugauggacccuagguauuugugaggaucuguccccccacguauauuccaggugggugucuaacuguggauuuugauauccacacuggcccacuggagacguugucuguggaugaagucagccucauuccuaccagcccuuccguuagaacucgccacuguacuauucaucuucgaugcuucccaaaucuucccagguucagauagguugucccagugaaaccagagauaguagaaacugcaggaaauucuccugccucagcauccaucgcacucucccacauuuuuuuuuaaacauacagaaacaaugugaaagcuguuuugguuguuuuccaucugagcauguggcccccauuccuuuaaaacccccaugcucaaaggucaccaacuucaaguuucccuugggagcagccaauagaucauaauagugucaaccacagcggaaaaacugguuacagaauuaucuucuccaggacucuugacuaacaaggucaaaguuuuuugcguauaucuguuuccuguuauagagauaacaguacagccauuuguaacaauuuaaaaauggugcuugggguacuuuuuaaaaugaaaaaaaaaaguagagugauaugauuuucuuauaauacaaaacaaagaguuuucaugugaugguacuagcuucauaggagugauaaauguguuccuuaaacagggagcaaagguuaaaggucauccucuaauuccacuguucaguguucauagucugucuaagaucaaaaacauuuauuguugaaauucuucgggaaagaacuuccugguuuuauaucuaggauuuucagaauuaagauuacccugaaugcuaacaacaaaaccaaaccacccugugucagcauaauagcucaaugagcaauccugugacaguuuagggcaggguucugguugacugacaggggacucaugccagcagccacuuggugacaguccauguacuucugucuucuagcauuccaauguguccgacuauccuccagccgacggauaugcguacaguagcagcauguaccacagaggaccacaugcagaccacggggaggcugccaugccuuucaagucaacuccuaaucaccaaguagauagguaauacuccacaggcaccauguggagcacucuggguagcugagggugacucuggcuagcgggagugacgggagguggggaagagggugggaauugcuuuguucucucaagguuuugucuguuagugauuggauaagauggccaucauuccuuacagaccugguuuugauaggcaggagaguugggacaucucgucucuaauucucagugccaaugccccuggcuggcuucugcuguuuuaaaaagauacuucugacuguggucuguacaguagaaggaaggagcuguccuugaacuuugcaggcuguucuguuaguccccaccagagaaucucugaagagcuccccuggcugaggacaugauucagugagcagccagccagccugguaugcagugagggacuaguuaugcagugagggaccagagacccuaccucaaucuggaagguagggacuaagcucugugcccaugcuguggcugucacucacccaugcucauucccaggacaguuuccucaaagggugucccagcccaguaacauggaaaagaaacaauuucuaccuauucugcaucuagcaaagacuaaaaaacaaaauauaaaagcuaaacauaaccugucuuguagauagaauguuaguuagagucaugagacuaagccagguguggcagcuuuugccuguucuccuggggcuuggguuggcugaggugggagggcggugaguucaaggacagguaggguguuauugucuagccuggucuaugguguggggcucuguuucuaucucagucccucuguuggucucucucuguccacaugugugugugugaacauguguguuugcccuacauauaauuaacuuuuuaaauagagguaguacaggggagguagagggacacacauucacuuaagauggaaggugucccagggugcauuucuuccuccauaaggagcuucaaugugugauuuuccuuuagaaucugggguacagcugggauggagcucagucuguuuauucuuugcucacccagcaugcauaggguucugguuuuaauccucaguaccacagaaaaccaccaggggcacgugccuguaacccaagcacuuggagguggguccagagggucagaaguucaaggccagccugggauguaugaugcccugucugaaaaacauuggguggagcuuuguuaaggagagcagaggguggucccuggauguuauagagugucccauauuaaacugaguucaaagaaaagucagcagggaaguauguauuuugaaauugccaacuuauaaacaauucuuaauuauuuuuuuuuaaauuagugaauguggagguggcucgguggauaaagcacuugcccugcaagcguggggaagggaguugcgauguuuagaacccauauaaaagcuggguagacauggaggccgcuuauagcucuagcaucugggagacagagagagggaagccccagggcaagcgaggacugaugcgcucuggguucagggagaagcugucccuccaaauguacagugggcgaugauagaugaaaacaccagauauccauacccguaggccuacacacacauguguauuuagccuuccguguacccaugcacugggcuccgucggucuuuaauuagcacaggcuuggugcuuugaauggcugagugacugugucugacacugcaguccccagagucugugagguagaguguuacccaugguuuagccccugcuguggacuaugggagugugacucagcaucuuuuaaaagcucgcccuguuccuugugagcuuuaugggcucagggcggggugggggcaggaggcugugucuuugauuuauucacuugaccauaucuuuaaagauugacucagaaaguuaaaguagcacucuuauuggaacuuaaugaaacgcaauguaaauuuagaaaucuacaacagagacaagaauuguaagaacuuuaaagauuagcguuaugauugaauuccaaauuugccuuugaguauggccccgaguucaaggcuggucuaggauacaugaugaguucagaccagccauggcuacagaaggagauccgaccucaaaagcaaaauuaaaaauguaaugaaaccagugagccaauguagaggcagcaggaacuucagguuucccugccuaaccagccacaccagcuuagucaggcacagccuuucaaaggcaaacaagcccgccuuguggccugaugggugauuuggccaaauaagagguacucacucagcaccuacugcauuucuugcauguaggaaaaaaaucguguuuaaucauaacuguaacaguaauucaggguccuugugcguaucacaucggaucagcauuuucugauggcuuuuguaauaauuacauauuuucuucgcaacauagaacaucaaugguccuagccacagccauccaucccaguuuauauugaucccaacugaguaguggcaucuggauaggccaguuacugacuaucugugaauucuuuauguggucucuuucgaccccucuguagcugcugucucccuguaugcacugccgugguuggcuagagcuuguuaauauacugauucagguagacccagaugguugcgggacguuuucuguucuuucuuagaauacaaucuacucuccccuuaucugcggugguucuucugcagauuauugaagagagaagcagggaaaagaaaggguaaagaguggaaauuacuauuuucuuaacuuuugggguaggcggaucucuuuaacccccccaaauagauucucaauauaauguaaauauauaagcuagcuagcagcagagcuaucacaguagaggaaggaauguagaaucugauaauuuaacuggcuuuaaacuaugauuauuccauaacauauuaauagcauaagcuagguguugugguucauaccuguaaucucagcauucaggagucugagacaagagggucccaaugaguuugagacaauuccgggcuauuuagugaauucuacaccacccuguauuagaguuugagaccuuaucuuaagaaccaaaccaaacauguauaauguauaauaauuagugaccauaauuuuauuuuuauuuuaauauacugaaaauagcugguagucggcacaacuuaaaagucuuccauuguuguagucccugugucugauggaaugagaacccaggauauauugcagaccuguaacaggguuagccuguuucuauagcuggcacagguaugacucgccaugccagaggaccuggcuggaugaccaucuuuagucucacucuauugauuuuuuuucauagagauuugugaggagauguagaaauggauuggaggaggucagaaacaggaucauucagacucugcgugaucauuuuacugauguuacuguugaaccguugugccggagaugagggaaagaugaauacucuuuaaugcuugacauuucauuguacaguguaaaaaaguaauaucaaaugcauuguuaaaucugcuaaugcugauuauuagaaguggcauuugguuuuuuaaagaaaauaucuuuuuaaaaaauagagcccgugcaucagugauuauaauuuuaaaagcuuguagugaguuagaaauugugucuuucaccuuugcgugagaagguugcuggcuauacgcuugauggaccccuuccuuugcucuuuugguaacugggcaagguuuguuuuuuuaauggucccuagacauaauuuuaauguguuaaguugguuaugaaagguugcuaaugggcuggagagauggcucaguaguuaagagcacugacugcucuuccaaagguccugaguucaagucccagcaaccacaugguggcucacaaccaucuguaaugagaucugaugcccucuucuggggugucugaagacagcuacagugcacuuauauauaauaaauaaauaaaucuuaggggggcgcggaaaggaaagguugcuugaaugaguaaagucggcauguaagcgaaguugugcuuugggcguugucucgagucuccuuugacuucccaccuagaaucugcuccuuuugugguagggguacugaccaccgucacccgcgcccauguguucuuucuccuucuuuuugagauggggucucacacaguguaggcugaucucacacuugauguguauguacucuaagaugacauugaacuccaagccucuugucucagccucucgccagcugggauuauaggcauacaacaccaugccugaccuuaguauguguauuaguagacagcuuauggguuuggaguccagcaccaacucacuuugggauuucaccucauucuuuugucugagcaguaguuuguucuaaaaacaaaacaaaacaacuuaugugugcgugcccauucccccacccugauaugugugccagauggaggucaggagauaucagauccccugaagcaggaguuacaagagguuguuagcccccaguguagaauggaccucaagcccucugcaagagcgguccucccucucaaaggcugagccaucccuccggcuccaguuuguuccuuuuaauaguaagaacccuauaguucuuuuuguuucucacauucuguaaaaguccaaucaaacuaagcugccaucugaguguccagaggcuuucugagaggguuggacaggcccucaugucgcuucugcccucaggcuucagaagggcuagcugaaugacagaauucuuccuuucuuuuuauaggaauuaugacgcagucaaaacacaacccaagaaauacgccaaauccaaguacgacuuuguggcgaggaacagcagcgagcucucgguuaugaaagaugaugucuuagagguaacggauucucaugggcuuaguccucuaagaaaguaaauuugcugaguucuucuucuaugcaucugagccuucugaaagagaucccaaggucaagaaauuguuucuuuguacacaguacaccuggguaucugugucucucuagaaguguuagcuacuuaguuuaucagaccccacaacaguguuguucauucaaauaagagauaccuagggcacugugggacaggcaagcacaguucuuggcuugccucauuguccuuucuucugggaucucaguggagaugaauuaugauaguuuaaccaaagaaaacauuuccucuuugaaaacauuugcacaaauguuacuuguacugcauucaaggguacacugaggguagcauuucuuagguccuucagaguucauuuccuugaauguauacaauacauuuugacacaauacauuuuguuaaaaguaguuuccauguuuucccuuucuauuccacaaauggaaacgauagaauguuccagaauggcuaucuuauuuucuuucaaguaccucaaaugaagcagggacauucagaggauguaguacauacuugggauagauuugcccuaagauuuauuuuauucaaauauaaauaauaacaguaaucaacaauaccucuuaguguaauugcucagaacugcagucacucguaugcuuuaucccaguucauuaccagaaguaauuuucuuuuucucuauugaaauugagaaguaaaaguugaccagugcguggcuguauggguuuccuuauaucgaucgagucuccuuucuuugcauauugacagauacucgacgaucgaaggcagugguggaaaguccggaaugccaguggagacucuggguuugugccaaauaacauucuggauaucaugagaacuccggaaucuggaguggggcgcgcugaccccccauacacacauaccauacagguaacuuggguucugggcaaaacuuaauaucggcagauuuccauggacaggaauuccgugcccuuguguguuaaucacuuugauauugaauugcuuuuauuuuugagagcaacugaaaagcaauguggagacaguaacgagugaugcaugguuuucugauucuuuuugugaagaaacucuuaaaguguccagcaauaaguuacugcucuugugaaugcuuuuuucuuuuacaccaauuuguaguauuucugacaaauacagauuuuuuucccccucuuuacucaucaguuggcuccaagacugcugugggggaacaucuccaucuuuccugguguuugccuucagcgucuaucacauguucagucucuggccagccuucaguucacacucagcacaccuuagcacaugcaugaccauaugucccgguguuacaguguuauuccuuuauauuaaaguugcauguaucugugauauagaugaggcaggacagguucuuccucugaucccugaagacuuccagaggcucccacaagccacaguuuaaggauuuuagggguguggucaguuccucuguuauggcagcugcauuuacuugagcuggcucucuggagugaggucgugcaauggggcuagaguggguggagucucuaugcacaaccucugaacccgaguugcuucuuuuccaugucuuaaggacgaaguccuaauuuccaauggugagaaaaaaaacauuccuggcuccauuuuuaucuugaagaugacaauauguucaggccuuggacggaguccauugucccggcugccacacuguuucugagcacugggagucacuuuugacucucaaguguagaauagacccuugccccuuuccagagugauuuggccuuacuagaagccccaagccaaccaaauauuagcaguggguguggaaacacauacccaucuucccaguacugggcagguagaggcaggagcaucaggaauucaaugucaucuuggacuaacaaaguaaggucaagaccagccuggacuguguaaggcucugccugagagagagagagagagagagagagagagagagagagagagagagagagagagagagagagagagagaagacaagacauuggugggguuuguuuguuuguauuuuuuccugacaugacaugcguacuuacuuaugccaaucauuugucauuagcuuuugaugccaaagaaggaauuugaauuauucaagguauggucugcuguguuucccauggauuuuugcagugaauuuuuucugaacuuaauuuuccauaccucuucuuucccauaaguuccuccuucuuuaagugugagcugugucuccucgcguaaugacauaaggcuucucucgggagggggagcaccgaucaucugcuuucuuucuugaaaguuuuuuuuuaaacuuaucuuuaacagugaugucauaugugcuugaagugugugccuaaaaucuagagaggggguauuugcccucugagaaaguauggauuuuuaaacauccuaacuaauaacaaaguguagcuugcacugauucuaaagacuauccuccaggcucaugggcaaauagauccaggaauuucuaaguguacauauuaagaacaauuucucagauugagcuuggcuugcaugauuccuaggaacagauaagcugaaaaugagguaacuuaauuaagcuuacaagucgugugugugaguguguguguguguuccaaaucucuguccccaucgggacucccuaagcaggagucugacuuucacucuuucccugcuugcuauuuggucuugccuuuuacuucagcuaugacuccugccccaggcugugugguggcuucccuguuucaggcuucccucuggcuaaagcgaacccaaaugaugacuacgcgccgcaggcaaggcaaaaauaggacagggagagaacagacacacacaacccacauucucucucucccucccccucccucucucccucccuuuccuuucccccucccccugauucuuuucuuucacauaaccucaucuuuauuuuugucaacuuugacacaaccaagauuuuguuuauucagaaguaccaggagucuauguugaaacuuuguguaaauagcgacguguggucgcugugaaggauugcauguucuggcuguuucucuuuugaacccuuccacagucccuguagaaauugcauguguggaagagagagugcauguguggaagaguguguggggcugugagcccuuuccuuaccccucuuccccccugacccccuucucuguccuuuuccucccuccugacccccuccccauucccucuucccucuccucucugaaugugucaaguuuagggugaggaccuaccauugaaaggaauugaauacagugguuaagagcacucacugcucuuccagacgaccugaguucaauucccagcaaccacaugguggcucacaaccauguauagugagauccauugcccucuucuggugugucugaagauagcuacuauguauucauauacauuaaauaaauaauaaaaguacugggguuuuuuguuuguuuguuuguuugggaacucugggcugaaugcaauagagaguucauaaguuguaauaaacagccuaccugccaugacaucacuguguccuuaccuaucuaucaugauaucacuguguccuuaccuacuugauaugacaucaccguguccuuaccuucuugcugugacaucacuguccccuuaccuaccugcuauaauacacuguguccuuaccuaccugcuaugacagugucccuaccuaccugccauuacaucacuguccccuuaccuaccugcuaugacagugucccuaccuaccugccauggcaucacuguguccguaccuucuugcuaugacaucacuggcuccuuaccuacuugccaugacaucacuguguccuuaccuaccugucaugauaucacugcauccuuaccuaacugcuaugacaucacugcaucuuuaucuguuaugacaucauuguguccuuaccuaccugcuaugacaucacugcauucuuauccauuuuucaugacaucacuguguccuuaccuacuuucuguaacaucacugaauucuuaccuaccugcucugauacacuguguccuuaccuaccuguuaugacagugucccuaccuaccugccgugacaucacugcauccuugcuaccuaccugauauaacaucacaacuucucucaagggauuccuguccuuaaggaacuuguaguaguucugaaaagcauggaguaggaugggaaagaaaucccucagaaacaucccagucaaguaccuaucucuacaccagcaucgcagagagagacuugaucccagaacaccucuccugucuuagucaggguuucuauuccugcacaaacaucaugaccaggaagcaaguuggggaggaaaggguuuauucagcuuacacuuccauacugcuguucaucaccaaggaagucaggacuggaacucaagcaggucaggaagcaggagcugaugcagaggccauggagggauguuacuuacuggcuugcuuuuccuggcuuucucagccuguucucuuauagaacccaagacuaccagcacagagauggucccacccacaaggggccuuucccccuugaucacuaauugagaaaaugccuuacagcuggaucucauggaagcauuuccccaacugaugcuccuuucucugugauaacuccagcuugugucaaguugacacaaaacuagccaguacaucucccaugcacuguguggucagaacagucaccaugcaggcaucguuuuagacuaauauguccauuucuugcauuuuguauguccuuguuuuaauacuuuaggaaaacugugcacauuaugaaauggacuagcaacuugggcguuuuguguguggcaaacccgggcuuggauaugaacuacuccuuucccucugggagugcuuuuuaaauggccacaguuuguccucucauuuucauccccuucccuuuaugcuccugaaggauucugggagcaguuccugguguaggcucaaggacagcucuuguccagggcugcacaccuuuugucugggucuguucuguccgcaggggucuucacgccuggagcugcacagaauagguguugaguucucagcggaaguccccgggguuguuuuguaauccucacuuuuggagugguuuuaacaguucuccaaaggcagauucccaccucugcgcuaacccccauggcuuugccaguuuuuaaauaaaagagguagagaugagauggggcauuuacaaaaguguuuugugugugugcuuuugugauauguguguuugugcaugugaguguguguagacaagugucucuguugugcccaugugaguauaugucuguguguguguguguguguguguauguguguguguguuucagugaagccacagcuuuugaaaggcacagaaaaguggccugccauucuguuaaacaguagaucacccccaagggcuuugccucucuugucugugcaacagauggcccccgacugcuucuuuucuguccagagucuacugccacauaaaguuuuuuuuuuuuuuuuuuacaugauucccaggcuaguacuggucaucuccuaaaaagaucauuuucccauggguccccugcugugucaagaguagaaaugacuuccuccugaucuuauuucuauuauacccacagcugggcuaaacaauguuuuguguauuguuaaauauugaguuuauguguuuauuauuuuuguaguuuuucuuacuccaccaaggaguagggauuaaauaaugaccaguguccaagaaaccauugccaggucuugugaagcccccccccccccauuucuuggcuguuguagaauuguguagaacgccuacuauggaguuggugccaauucucaccuugguucugugaguggccagcugugcaccuuuagacauagaauuuuguuuuucucaguuccugugugugugacuguggaugagagggacauauacaacccccuuauccucuauauacauguuacauugccuuaaacugaaggugggaauccuuugcagaggugacugugagaccaccagcaguauugauucccagcccaucucauucaugucuuguuuaaucucauuccaaaugcugaaauacugcuggacagagaaugaccaucuucuuaacaucacuucauagucuucagccaggccagcuuccuuuuaauacucugguuaaaaguuguuauaaaugauuuacagaggucacugccccauuaguuagagguaggguucuuaagcaaggauggcuaccauuuuuguugaguaagcaugugugcauguuguaugagugcaaauaauguuaaaagugcauacacuauaaaguaaaaucaucacaaaaguaaaagaaugagcauucaugcacacagccacccaucucccgacaagagaagccguaaucugcuccuucagcaaaccuggcucuaauacuccgccucucccacugagcauucguuucucuguuucuacuccaccaucugcuacuuugugucaaaagaccugcaccuccgucuucugugcucaaccccccccccaauccugguaacugcaguuucucuauguuugaaugcuugacccuaaguguauucuuucuaagcugucgauaagaugaaccuguaucauauuguucucuaaugcucuaaugagcagagugggcccugggauaucccgacuguggaauauaucgcugggggugcugagcucgcuugaguugagcccgguagggauuaaucauguauuuacaaacuccuuugcuggcugacuugugggcagguaauuuugcugucaaaauccaguuugcucauguuugcuguuauuugauguaaauuauaauugauauuuuuuucacucccaucucccguguuaauuuucucauuggcugugguuuguuccaucuccuaauagcaauuacuuggcgagcugucagagguaacucacauccguucccuccuggcaauucuuccuccugguuuuugguuauguugguuuuuuucuucuucuuuggauucaguuucuggacuuaacacccuccaaauauuccagcugugccguuuucagcacagaauuucagagaggccaaauuucaagggagaaaauagagaugcuguucagugcagggcaaaauuguaagccaaggaggucucugccacuggcgggguuggguuagacuugcauaaucuucccucugaagcaggacugcacagcagucagguguguuagucuccaucgcuucagugcucgagagguuuuacccaguuuuggcuccuaaagaagacugacuuaguaggaaagugcauuucuuaagaggcagagacauucugagucuucucagagaacgacacaggaugcuuuguguacagaggagcuuggcguuugugagagacggugaugggacucgggaagugacagcauuauacaaacgugggucuauccuagcaacacugggagggcuguggaguuuaguggugauuccugggaacagcccugggccaagauuucucaucagauuggaaccugggccuccuuggggcgugaagaaaaggcuccaagugaacuguguucaaggaagccuucuaggucuugagguguguugcgagucauuggucugugccuccaacaggaagaguccagcacaggagugcgauagcagagagcaggugcuuagcaguaggcagagaggagcagagguguuggggagggacuuagagcauaaggucaagggucaguccugacucagugacuuucagaaugagucacacugauuggaggaucuggcccucucucccuucucuggucagagauuggaggcaugaagcaggcugagaagacugaggggagaggggguacgcaaguaaagauaauuuauggcacagaccaugagaauggcucuacauggcuuucaaagcuuccauucggucuacgcuuuugaccuguuguugagugagguccgaugguacuguugccuucuacagcagcagggguuggaugaaccgggacucgaauacuuggugagccuggcuccaggcuugccugugacacugccaccauguucugagcgucucacuguauuauuccacagagagaaaaacacuagcuguucuuguuuuuauggaagcaggcagaaugaaucacauuguggcacucagagccuguagcacuuuccguuggcauagguuuuggggaaaaaaaaacaaucauugaaauucuggcgcuuuuggaacacugacacgauuucauuaagccaucacgaagugaagcgcaaaggacaugcuugucuagggaacaaaacauauauauuaagugucuuuggugugugcuaaguggaacuuuuggugauguuugcuauguuuggauugcuuuagauaucucuuggcccaaauauaagagaacuaucuuguggguuuguaaugacacaccaaugcuuuccgaggagaugcugggaggaucagaaaccacuuccucuccugcuuaccuuuguggcagucacuuauccaccucccaucucuucccccaugcucucccugaugcuucccuccccucuguaucuagcaacacucucuagcucucuuugagucccccucccccucccaccuucccagcacccccuuccaccuuuacaccaucugcugggaugagucauaacccugaguaacagccacaaagcccaagggucccuuccacagguguuaaguugucuuccugggaaggcaccuuggucagucguugguguguuguuuugagugacaauuuaguuuuaacaucaugugugggguguguuuugaugguuuuaguaucuguggcaaucuggggugggggacacucuugaaacucaggauugccuuauauuugggccaccuuagaagugagacauaaauacugcaagccccagauuuccaaaaggcuuucuuguggauuuuaucccgcuaaccuuaccugcuaacugaaacugugccggugcaguauuuagaugucacuucaccuguaacuuugcaucuuugauucugcaaagaugcaccuguggaaaacuuggaguccuugacauguaguuguuugcuagcuacauuguuuuaucuauauuaaaguuugggcuauuguauugaauaugaaauauacauaaauauuguuuuccucauagcucaauuguacacuuuaccacaucuuccuuugaaaauguaaaucccugcucacaggccuccccugccacccucucccccccuccccuuccccugccuccccuuuuccucccccucccgcugccauuccucuuuucuguuccgaggacaagagggugggcuagagcaucucuguguugggcaaaugcucuagcaccgagccacauccccagcuagaacugggccuuuauccuuaaaaucacccccuccuuccauguguucccguuuuuaacaaagaagauuucuaaugugaauaaaugaagaguaauauggugguagaaagggcuguaccuugacaaaguuaauaacaacugucuaaacuuaguuaauuauuuuaaaagcauagccccuuuauuuuccagauucacacauugcuccuuaacccuccuuguaaacaacggaucuaaagauccuugacuguggccuacguuuaaaacaagagcaagcgauacucaguguuacugacuuucagcaccacugaaguuauuauuuguuuaaacuguaaaauaaucagaguguuucuagccuacauagucguguguaaguucaagcccaaacuuagcuuucuugguguguauuguuaugauauugauuauauuugguuugaacuugacacucuuuaaacucacacauugacuuugaacauggucuuaauaacuaugaaaucacauuggauuaaaaguguauauacaaaccugcauuauuaaggguuggcacagauaacuuuacaaaaaaauaaccaacgauguucugucaauucguacuucauuuuccagccuaaguacacacacgcaggcacgcacacacucauucauauauauguauucacacauauauauuucauguuaauuauuaucuuuuauagaaacaaaggacggaauacggccugagaucagcugacacuccuucugccccaucacccccuccaacgccagcacccguuccggucccccuuccaccuucuguaccagcacccguuucugugcccaaggucccagccaaugucacccgccagaacagcagcuccagugacagugggggcagcauugugcgggacagccagagauacaaacaacucccaguggaccguaaguuuccccgggggccgagcccagcuccacugagucuguucauaguaaauauugugagguaaauaagauaaauaauagcugcuuauacaucacggaugucugccggguuucucuaccucugagugucucugagaagcaggucauuuucucagcccucuaagguauguuguaucucugcacauaccccacugugcugugacuguugaaugcacacuugcuugagcagauauucugggaugcacaucccuucgcaccuacaaacuucaaggcuuuugugagccucuacguauuugagagucuggaaagugagggaaaccaacacuaaucuguuucuuaggacaagugugaagauucaaugagagaccaccugaaaaguagggcacuugggggcacccaaucucucucucuugacaaguuuuuguuugucacaauugagaccugcugcuggcacuucaccaggugugcuugguaauagugugcauugugcaggcagcuggaaaugugagcagugcuggguuugaagacuggcaaugauuuugaccaucguaagcaaguagugagcaaaugccugcugcuaucaucggcgucuccuccucuuccucucuguccucagacacauacacaaccacaccacuuuugcacagucgcccaccaguaucaacaucgaauuuucuucuaacuuugacaucauauuuucacaaauuaaaauggauuuucccaugagaauaguaucuauggggaccaugguaaaauaaacaaaauuaaagaugcuaugauaacauaggcugcuguggcugaggcagagcuguguggauagucugaaagcuaacgguaacccugagagguuuugcuguaccuuguaccuuagggccgucugcuccaugucugaugauguuuguaaagcaccgcaagucaaccuuuacagcucuuuacagaaaacguggaaaaccggaaccaggaaaacauuuccuauagcugaaguuugagaaaaguauauagaaggucagggacauguugugugggagacaucuaccauccugccccagggccacacccaagguccugcgccuuucucucgauaaaugacucuuacuauaaaugaccgauccguuucuauucucuucacacuguuuauguuccggagaccgauucccggcuuagucuuacuguacagucucaccuuugacaccaggugccuguacugaacucucagcuucauagcugacaucauagaccugaugucauagaccugcaggcuucugaugcucagguguuguagaaaucuuugaucuccaccuggggucucuaccccaccuuugacccuuuaguuccugaaugaaagacacauguaacuuauauuuacaauaauuuuauauuuacuagagcugggcagauaucuagccucuaugcuguuaggaucuacuuuccuaugaauaacccugaguuauuacuuacuguguuccaucugggcugcucuaaucggccagcgcucagggcuguguuuuuauggcucaccuaacucaaggaagcuucucuuccuccuccuauaccuucuucuucuccugcuccucuuccgaccccaaggccaggaagccuaaacucuaccuauggcccaucugccuagcuauuggcucuugccaucuuuauuuacccaucagaaauaaguuggaggacucucuccucucugggacacgcaggucuuggagucuugcacuuagcauuacaguagaccacaaaaagccaaaccuuaacacacaggucagacuucauuccuaaauguuuuggugccuuuugaccccaguggguuccagcuccaugugaccuucauuaucagucccaauaaauggaaaaugcuagagaggaaaguagaugcauuacucuguagcuguuauggaaauaguggcuagauguaauaagcacaagccuauugcaggcaugaguuucucuccugagguguaaaugauucagaucaccucuuuauucauguuugaccucauuagaaaaauaaaagaggguccagcaagaugacucagcaggaaagggugcuuaccacuaagccugaccugaauucagucccugagaucuacagggcaaaaggagagaaccaguucucuguguugcccucugaaaacacacacacacacacacacacacacacacacacacacacacacacacgcacacacacacacacacaugcacacacacacaugcacacacacacacaugcacacacacacacacacauacacacacacacacaccccacaccaauaaguaaguaaguaaguaaauaaauaaauguaaaauauaauaaaaaaugaaaaauuggaaaacaacuaauuuagucucggaaaugacuguguaugagugugaaaauauguguaacucugagcuuuuaaagggaugcuuccuuuucaaagauaccagagaaaugguuuucagcugggaaaguucuaugacuauguuucauuucccuggggaacguucccucugagaaaugacucuccuuuucgccuuucuucccacaaguuuacacaugacucugucuaacacgucagcgcagugaucucugacacuguggugggcuguuccaggccuggggucagaguucagaggcauccaguccccuuuuggagcagcgcacggccuggaacagccuguucuuugucccacuugaagaaacucaagagccuacuggggaagaugcauagcuugaauucuuguacaaguaaacucuccugauaauugaaacucaucauuuucaagucagauuuucauaugugaaugugucccagggucuguaaaauagaccaaauuaacacauacgcuugcuucuuuaaccucagauagccucauaauugcucacguaaaacuucuuuuuuaaauaucucaagagugcauuuuggcaauaaauaaauuuauuccuuuguauaaaaugaauauuuccugauagcacauuuuuagagguuuuuuuuuuuuuuuuuuuuuuccugaauagaggucagggcugucucaugaucauuuagcagauggcaaaauuaaguauguguguccacauuucuuucaagauaggguccuugcuacuacagucucuguucauuccccaagcuucugauaaaaaaaauaaaaggaaaaggcuaaaaagugggaacucaagcaaaucucauggcugugagcaagggcaagacgucaaauguccgucugacaauucagcaaaggguggagauggguggaguguuuguccugcacgaaugaggaucugaguucagaucuccagugcccauguaaauagccaggcacggcuaugaacuucauucaggcagagacaggcagaucucagcucucuggccauccagccauggcaacaagcuccagguucagugagagacuuggggagugacuggcaaagacaucugaccuuugaccuacauccaaguucacaugcauaacacacacacacgcgcacacacacacacacacacacacacacacacacacacacacacacacacacacacacacaguauaaccaguggccaaggaacgaacccacaguagaaugugcccucuguacggaucugcuacuuggaggugguuggagccaggcauuguguaagcuguucagguugguccaucagagauccagaaagcauuaccucuugccacuuuugaagaugccgaccugcuaguuugcuuugcauuucuucuucgcuccuuugaaaucuaagcccuuugcaaucagaaguguuacuguagggagagauguguuuguuguuaggagagaacucugaaaauggaaaccaaaacaaggggccuucuagaaagaggugucuuuguaaugcccugagaaagccuaacugugggcuuggggcccucugcaguugagaagaaggcguuuucucucucuuguuuaaggcugaccuaucuccugcucagcauggcauccuaugagcuaaagcagccccuggaacccagguucuguuugcuuucauccauccacaauacccuuucuuccuucaguuuucuuucucuuucucuuuguuaaauauauauauacauuuucauuucuucaaaacauuuccuagaugggaagggguucucucuccaagagguuuugccuucgguggcugcuggggagacaaagucauugucuuagugccauaaccacuggugaaucacagaugcucuagggguuagcuucauacugagccucugugagugggucacaaagcaaacacaacaagaggaccugaaggcaggauggucgcccaaguagaggaugguggggauuaggguaggaggugaggggcaauaaauaugagccaaauauauguaugugcauauauauacaugcacacauauguauguauauaaauaguguauaauauuuuauauauaguauauauuacauauauguauauguauguauauauaauauacauguaucuauagaaaaagagugagagaaaaaaauuguugaagaaugaacuaauuaaaguuaacaucucuuucaaacuugagaccuuaauacaaauuagacucucauagcacuaauuguuucacaguucgcuuacuuuccagagacacuaaacacacucccuggauggcauaaacagcucccucagcugucaggucauugccacuugccaggauaauuaguuaauugguuuaugaucucaguucugaguucuugaaaacagcaacagauagcaauguacggaaauaugcacauggauuuuucaugcauagagguguuaucucccuuuauuucgacccccuugccuuuuuuuuuuuuucucauaacgcacgcucauucauaagcacguggcuaggaguggaggaugcugggacguucaccgaaggucaucucagcgaucuggguauagaacagcucuguucugaaagucagggcagcuggaucagcucguuucuuggcuaauugacagagacacucagacaggucauuucucuucguucuucaucuccugaccuagauaacaugaugacaggaacauggugguuaccaaggucucagggaaaaggugaggugaaagggcaaggugaaugacugucugccuggaugagacuggcagcauggucuggaguuggaggcugagguagcuuuguggauugcaaaugcucuggggaaggaagugaccauuuuaaccagggcuggaggagcugagggagcugcacauggagucagguagguauauuggugagaugagggggauuccaagcaaaagaggccguaauggccaauagcuucagaggcaccaaggaagcaauaccacgucagcuaggguagggaguggaggagagacagauaauuuccucugagagguagagaccaggcagugguuugcagcccaggggcugcaguaucugacaggaccauugcagucugucuguuagcagaggaugacaggagaugcgggggugugauggagagaggaagcagagaccugugguagguugcugccacugaccaagcuggaggcaagcgagagaaagaaguggcaggauuggcgauacauuuugaagugggggaauucaagggaugugcuagucgagucuguccaauauagauugaagggcuacaccaccgggugguucugagguaaauggaaagauggaguugcuguuagagagugaagaaaugugaaaagaaaaccaguaaucuugaugagcucggagcacugaggagaugcugcgaugugagaggauacuuuugagguacauuucggagauuauuauuuacuuacuuuugagucgggguuccuuggugcagaucacacugccaugggauucugugcaguuucugaggcuucuuuugaaaccuccuuaauuuuauuccuaaguuaggaagugagauccucagagugaggaucaaaaauagguuggaggucuguggagcaagccuuggauaugaaagcgucaucuaaggagagagaucauauguggucguuaccuaggcacucggacauccaaggccagacucuuaggggaggcuggcauggggacuguggaguguuugugucccgggugucugccuacugaaugaugacagcagcuuccucccuuggccacccccggcugcgaccaccagaaggacuucuagauaagucccuggaugagaucuuacugguuuaaaggaggauagaagauacucaggaccgcaggcagccuagugggaauccuaacgguaaaucaagcacgaggcgcucagcugcucucucguguacaguagaagaggugcaggcccagccuguggagacggcugagccaagagaggggccgggaagaugcucuaacacuuuaucaugcaguuuauaccguguugagguacaagugagaggagauagcaagaacucuguaacccugggucccaggcuucacaggacuccgaggcugauuagggcugggguucuggacggggacaucacaucagagaugaguaaccaugaccgcucccucuccguguccaggaaggaagucccagauggaagagguucaggaugagcucuuccagaggcugaccaucgggcgcagugcugcacagaggaaguuccacgugccacggcagaacguuccagugaucaauaucacuuaugacuccucaccggaagaaguaaagacuuggcugcagucaaagggauucaaccccgugugagugcccgguguggaccggcugccuucucagcugggucacuuaugugccacucaugacucugauaaguugucggagcccgugcuuugucccguaaugaggaaaugcuggcuaacgcuucaaaggcaaagaagaggaagguagaauugggagaagagagugacaaauuucuaguucuugguguggaucccuuaccagucucuuggacaguuguuaccagcugugaggacuaccggcauuuuauucuuuaucaucaguuaugcagggaagaggacgaugguuucagcuagaccaugccuuguaggacacgccagcaucagucuuccugcggguggauagccugucucgaggcuguaaauccgagggauccuuucugcuuuacaucccugaucuaaaagucuguagauguuuuguguauacucagaaccauccaugaauaauucaugucggaguaaucuuaauauagaaacucacucacuugugaguguaacauaacugccaaugaagugcagucauuagucaccauguuacuagaaagcugucugcugcuguguuugggguaagaaacauaagcccgaggagggugauaauuagaagcccaacugcauccuuuaagaugcucacuggucauucugugugaaaggagccugggggucauggccauagcccucccuugguaucccuuugucucagcaccacagugcuauuuaaggauauggaacacacaauacuggccugugccuguaaucccagaccuggggggguggggggggcggcaggggggggcaggcagggauagugggaagggccugcaguucaaagucaaccugagcuacauagagaguucuaaaccagccugggcuacaugagacccugucucagaaaugaaauaaaaugagcauucaaaaaacagguagauaauagauagaugauagauagauaaauagguagaugauagauagaugauagauagauagauagauagauagauagauagauagauagauagauagauagauagaaagaaagaaagaaagaaagauagauagauagauagauagauagauagauagauagauagauagauagauagauagauagauagauagaugauagacaacagaacuggaaagagaguuuagucauuaaagcuaggcagacccagugaaaacuugaagaaggagagagagagagccagcuucucucuugcugauauucugucccucacaguaauuuauuuccuugugcuccgauuguaggacugucaauagccucgggguguugaacggagcacaacucuuuucucucaacaaagacgaacugaggucugucugcccggaaggugccagagucuuuaaccaaaucacuguucagaaagcugcuuuggagguaagacuuguggaauggagcugcucagagagagagaucgaggacugccacuggcagcucuggaaccaaugaccaugacgauaguggccaauuuccccucgcugaagagaugaauuaaaagcuuggcucaguuuuuccuacucugccacuaaauaccaucaguaacuguuuucaaaaaagauucucuuucaagggcagcuagagcuuuauuuuugagcauugaacaaaagcacggugcucuuaguuuauugcaugggcugcuauaagaacuucaauuuugcuaauagaauaaacccauacccgagugaggaacaguacucgaggccaggccuauauuucuuuauuuauuuuggaaaugucagugcaauaaauaaauaaaacccuagguguggggugccuggagagaacuugcccugcuuuuacagagaggcuuacucacacauauccaccugcaacuccagcuucaggagcugggcacuauaucaggauacacacacucacacacacacacauacacacacacacacacacacacacaucaggaguugggcacuauaucaggauacacacacacacacacacacacauauauaucggggcaacuauguucauguacccacauacauguauaacuacguaaaacuguggcugggcaugucaggggcaaaucuguaauccagcacucaggagguggaggcagaaaguugaguucaaggccagccucagcuauacaaugaguucaagaacugucuggacuccugcaauccuuucucugacaaaccaaaguccuggaugcauuucccaaggcgaguaauccacccacagaaucaucaggaguguuacggaaggucacugggaaugugcagcugagggcuagggagauagcuuagcaacuaagaguagacacuaacgagggcuagagccuccagucccugcaucuauuuaaccaccuaagcaucccacaaaugcuucuaacuacagcucugaggaucugaaaccucuucugggcucugaauaugcacaggcagaccugugagugaacauauauaaaauacauacacauacacacucacacacucuuacacagauauguucuuucacaaacacauauacacauaaauaaaaucuuuuuucuuuuuuuuaaagauuuauuuauuuuuacuuauaugaugguuuuaacuuaugaguacacuguagcugucuucagacgcaccagaagagggcaucagaucccauuacagaugguugugagccaccaugugguugcugggaauugaacucaggaccuuuggaagagcagucaaugcucuuaaccacugagccaucucuccagccccuaaauaaaaucuuaaagaaaaaaauuauacaauugcaagaggaaugauuuagucacacuugucugcauagcagcuggagaguagaugggccucuguuuggcuggaggcauucaaguuauucuguucaaaguuggcucuguaagaguuaaugguuuugugaaaauuauaguuggccucaaauaaaaggauauaggauucaacaugaagcugggagguagcucauuaucccuagcagguauauuauguaaauugaacaguuaaauaacucaggaugaaauagcuuuguguguauaauccuguaaccguucuccaucgagagaaauuccauuaccaugagaacucuucccgacaacauugaucuggaagguuuuauguuccaguuugaugauugcuuuucauauauacaguaugaauaagaaucaugucuucccuaaaguaguuuuauuaccauuauacuuucuaaucuuguuaagaauagacaaauuacuucucaaggguauguuagaaaauucgauaccccuaaguuucuuucguccgggacuuccuguucuucccuuugcccaucccuccugcuuccugcuucugauuccucugggaguugacugaggcaaaaaccugaugcagguuucccugugcccugcgcuucuuggccuugggcccaguuacuuaguucccagcaccccaguuacuuaguucucagcaccccaguuugaucccagaaccuuuagugggcagagagacuaggagaggguacccagggauuguugaaaaagcugagaguggguacgcuggcauggucagaguugucugaagggacagccuuuaaaaaucucuaaguggagaggagugccuugacugacugacaauucucggaaggugugaaaagauggcucgggugauagggcauggguuaauaaugaugaagagccaaguacagauccggaucgcagaucugagaaguaggcacagcugcauaagcccugggggacaggguggagacaagaggauuccugggcuggccuggcuaaccuuagguuuagucugagcuucugucucaaaaacuaagguggagccaagugugcuggugcaccccuuuagucuuagugaaaagguagcgggagaggggucucuaugaguuucagggcagccuuguuuagguagacagucccaggcaagccagagucacauagugaaacccugucucaaacaaaaaggaaacaaaauaaaauaauaauaaugugaaaggugcuagggaagacaguaacauugaccucugaccuucacaugcaugugagcaccuacacauguguaacugaacauaaacacauguaugcaaaggguucuuugauaacugauuccauguagauguacccucuuuguauuggcaggucuagaacauucugcaugcauuauugaucuguccuuaugcuaaacugaaaggcucagucagugacagugaggaaccuguguucagagagcuauucaccugauaugcuacugcagacuagaaacgucaugggcagguagagacagugcucacugacagcuccugcuuucuugaaggaauaguguggggguugaggggcaccauggacuacuccugagcccuucgguaacuguacagccaguacaaccaguacacacaagccagugacucuguugucugcgccauguuuauucuucaggacaguaauggaagcuccgaguuacaagagaucaugcggagacggcaggagaagaucagcgccgcugcgagcgacucgggaguggagucuuucgaugaagggagcagccacugaguccaugaacuuccuuauucuugguguggucauugaacagugauggacaugcuuuguuuuaagaagccuugaagggaaugucaaagcugucgucuugguauauguaauuuaucgccauauaaagaaacaguauaugccugaguaagcagaggacccgcugcuucugugcacauuaguuugauuaaaacugagaagcggguaggugagauggcucagcaaguaaaggugcuugcugccaagcccaaugacccaaguucgagucccugggucuacaugguaggagagagcuggcuucugcaaguuguccucugaucaccacacauaaauaaauaacaaauguaauuuacaaacuuuuaaaagaaaauguaauuuaaaaagccagacguucuagacuguucugggcuugggaaauauuuuuuuucacuuuccuaagauguacuuuccuuugcuacauuaauuaucgcagccuuguucgaugaucuaaguggggauauuugacaauggcagauuuauucauugcaacaaggaaagacacagccauugaugaaaaaaaagaaagucucagcuuucagugacugggauaccuguuguccagggaggaggcucaguuagacuacccucugcuuacuugaggucugacaugcccaaugagaguguauuuagcuuuauuuaaaguucuuaaugccaacaguuuuaaaaaucacauuuaaaugaacuguacaagguagccagaccuugaauguaugaauagacuauauaauauguccccgagaaacuuuguuacucucagcucuguugauugcgaaaucuugcauagauuaugcuuugauuuaguuucuuuucugcuuauuguguaaaauguaauuaaacaugagaaagcacgagucaagaguaaggcauaugcacucacaaucaaucaaaguagcccgugucgguguuuauuacaguauuuugcuuaaugaaggccucaguuauaaauauugauauaaauaaguagucaaagaauaucgggccaucuuauguguuuuaucuguguaacagggacacuuaauuuacauguacuuuaaccccaugaaagagucuagauagagagaagacacauagcuaaccuucaacaaauguuauuuuuggaaacacagguuuugucaugaaacguaauguuauuucacauauauaaaaaaaagauguuauguaagaauguuguauauuuuaacauaaguccauuuagagagauuaucuagauucauuaauuuuucauagugccuuuuucacaaaagucagcuggagagagucugcaauaaacaguauuugcuguauauuaauaaauagcuucuaucucaucaacaccagaauguuugcuugguagaaugagcauuugggucgaacagaaugagaaaaguccccugugaaaggaggcuccagugugugucugugcagagaguggccuaggauacugccccguguuccccuguuuucugucucccuugguuucucaucccugcuuccuaccaucaguucagaguugauaaaaacgagugacaaccaacgcagacugcauuugcuauugauaacugcuagcaacuucucagggccaaguuuccagacgaugaagggcauggcagccuuguuuuccauuccugucuccccaucauccuuagcagaugugagaugagaaagaacuaguuuggaugucuuauauucuguaagcccuucauuaaaagaacaaagaggaaagcucuaaaaggcaaaauaaaauucaaauauuaugauca

SEQ ID NO: 3459 - RNA, 102819 nt, Mus musculus
cucugggcggggacuugacaggaaggaggaaggccaggcccguguggcgaccuggagcaaggguuggcuuucagcgguggccacaauggcugcucacugccggggcacagagcucgguaagggccagcggguugcgcuccccuucgccagguugggggugggggugcccagggcgauccccggagggcggagaccugaacugaggcagaacucggggacagcccugucgccaggcucuaugcagucuuaacccuuuaagcggaagcaaggaaggguuaauuagaucuuugcacuauguagcucuguggucgcaguaaaccaacccgagugaaaagccugccggguacuugugugccauucauuuacugccggacucacguagccauucccaaaguuggcugugcugguggucaucgccgucugcuaaaaaugauuuuaaaugcuuagacaaaauguucuuuuuaaaacuauuuuucaccuuauugauacuaguucagauauuucugggaaaaaaaauuaaaagucuguaauucaaacguagcaaaaacgugacugagccaaaugucaaugacuuaacuuugcauaauagauuguuugcuuuguauccuggacccucuuaggugugugauuuuggguaaauuacucacucugugcuuauauaccggcaucuguaaaguaguuauuuauuaggaagcuacuucugucugaaggugguuuggauagugugaggaggggauacuuggagccgcugguauauuucucugcacuuaguguugaauaagcaacgauaaugagcgcacuaaguucuuuucauagggacugauuuugaguggcugugagugauacacaggguuacucuuuucagaagggacuugccagucuagacuuuagaaguguuuagaauugcaugcuugacagguagucucuguaccagguuaauggcacuuuagucccucucuccaacagagccuuacacuuuaucccugcaguguaaacuuuagcagugacccuggaagauggacuaagggcugaagaugaagcuagucugcaucuuuguacaaggucgaggauguaacauaauucccccccccccccaacagcucuuuuaaaguuucaaauuuuccuuucaggagaugcaauuaagccaauuuuacuccccccccccccccccgcccccagccccuagguuucucuguguagcucuacacuguccuggaacucacucuauagaccaggcuggccuggaacucagaaauccaccugccucugccucccaagugcugggauuaaaggcguacgccaccacuguccggccauuuuuacuuucuuaaaguguaaguccugggcugggugcuauugcacacaccuguaaccccagcaucaguugugugucagguuagccuggacuauauagaaagagcuuucuuaaaaagccaucaaaacacuaccuuucccguguugcaaaguaacaguguagacauuaacagcugcuauuuagaguaauaguuaaugugcacucacaccuccauguauagauuauauuuuccuuacuguucuuguuauaaucacauagauugcaagaguuuuugugugcugugguauuaauccuuaggcgugacacagcuguaaucuaaucugcuaaaguaaaucacgugaauuauauauguacuaugaaaaaaauuguucuguauuaauuucaacauugcuuuaauugaugaguuuugugguuuuuugcugauuaaagacaucuuaauguuuuuaaugaguacuacuuuuuaaaaagaaauuagcguuauuuaaacacauuuguauuaaaaaauuuuuaggaaaaugcaguuaucaccagggagauuguagaauucauuagucauuguuauuuacaauuuuuuucauuuuauuuuuauuuuaugugugagauuuugccuguacacggucuguuuaccauuacacgugcaaugccuguugaggccagaagagggcauccaauccccugggauuggauuucagauggucuauggcugccaugugggaguugaacucagggccucuggaagagcucuugacugcugagacaucuaucucaucagccuuuaagacagcuuuuaaaaaucaaauguauuugucuacuuuguguguguguguguguuagugcugggggugggaauacgcgcaugcacaccucuggagaucagagggcagcuuucacaguuaucucaccuucuaccuuuugacagccaagauucaaauucaggaugucuaaguguggcaguaauugucuuugcccacugagccaucuggcuggcccugaacuugauuuuuaggaugagaacucugcaaggaaaguuucucccagcaggggauguguaaaagaggcuuuccagacagggaugcucugauuguaauagcagaacguggauguccaaccgucugggucugggugguucuggagcacacucaggaaaccaccaugcugguuguuuguuaaucccuccagggucugucaaccaacauguucuagaccuuuccuuaaaauguccauaaacauguuuuuuuuucuucaguuccccaaguaaccuaggcccuuacauguggaccaguggaauacaucuuuacuuacuguuuggcgaaucuguccaugcagcuguguguagacaggagccaugagugcccugccuuucuggguuugaaugucagucaaaggccauuugaugacaucugguuuuauguuuuuauuuuauguauuuauuuauuuauuuauuuuuugguuuuucgagacaggguuucucuguguagcccuggcuguccuggaacucacuuuguagaccaggcuggccucaaacucagaaauccgccugccucugccucccaagugcugggauaaaaggcaugcggcgccacgcccggcuugacaucuguuuuuaaaggcaucucacaguuaugguggugguuuugucuugggauuucuauaacugaggaaagacuaugagcaaaaacaaguugggggagaaagggcuuauuucccucccuguucgucuuugaagcaagccuugagcagacacuuaacuagggcaggggucaggagccaugagaggaugcugccuucuggcuugcucagcuugcuuucuuauagaacccaggaccaccagcccagggauggcaccacccacgguaggcugggaccucccucaucagucacugauuaagaaaaugcccuucaggccugacuccguccugaucuuuguguaggcauuuuuccuccaguugcaguucccccuucucggaugacucuagcuaaugucgaguuggcauaaagcgagccagcgcaacaacuucauuucaaauuugugccucgucagagguaucuggaaaguggggauuuuguacuggggagcauuuucccaaugucuuacuucaugucagacuguuucuguuaagggaaaaguuucaagcagaucuuaauugugaagaaacagggacaguuuaacagacacuguuaguaacaagugguacauauauagcuaugguugaggguguucaaaacaaagaauaaucuugguguagcacaaaggaacacaaggaugaagccaaagcagcucaaaguccacucuuucugcaagaaggguguugagaaaccaaacccugcuagcaggcacccugggcaugacauucccuuggcuuuuauuuuacaaagguggugagugugucuuucccccauuugcuguggucuaacuucaucguguucugagguggcugguuuugggcuuuaugcauaugggugguuuaccugcauauaugucuguaugccauguacauucugguauccuuggaagcugaaagaaguuaucaccucuccuggagcuggcgcuucagaccauugugagcucuuggugcugggaguagaacuuggguccucugcaagggcaggcagugcuuuuaaccacugagccaucuccaccagcccaauucaaaguccuuuuaaaaaagauuauaaauggaauauccauucaucuuuuaccuuugugcacuuaugaaguuauauauauauauauauauauauauauauauauauauguguguguguguguguguguguguguguguguguguguauuucugagaugguauuuuuaaaaauuuuuaauauuaauuuaauuuuaauuuuauuuauuuuuuuguguauggguguuuugucugcauguacguuuauguaccacaugggugccugggugcccuugucuccccugggacugguguuacaugcaguugugaacugacaucuggguacugggacucaaacucagguccucuggaagagcaaccagugcucuuaaccacuaagcuguugcuccagucccugaaaugaucugacauauuauaguuuggcuuagaacauuuuuaggugagugugaccuugaaucuuaauccuccugccuccaccucucaagggcuaggauuauaggaagccuggcuuagacugcucguuaagugaguugugauaacagggguucuggcuccccgaggucaucgucucuuauuuuuguguuuguaagagcuugugugagacuaggagccugggaagcucccuucuccccuccuguguggacucugggcggcuguaugcauggcugcccuccuuaccuauuugggcuuccaugcccuacuuuggucuugaggcugcccuggccaaauguaguggcucagaugcccaucuuguucaccuccuuuccucuuuucucuggugguuuaggacgguuguccaaggaagaaaggcaaaaggagccaaagugcauuuuacaaaagaagucuuuauaggcaccgagaugugcagaguccuguguggaauaccucuuguacuguggcaccaggguacugaucccaggguuagcugaccuguuccgaacucuaagagcacaggccucucagccagaauaucuaggacaauaaaggucacucagguguuggcugagcuugcugucccagugcugugauuggauaucaguacuaagggguggaggccagagggcuaacaauuuugaggccagccugggauaguuaagagacauugucucaacugaauuaagcaaaaccaccacaaaggaaggaacaaaguuguauuugaggggccagaguaaggaacccccccaccuugacugcuccauuaauaaagggaagggucuuauuuugaagagucuagagcagagagagaagaaagccgacuggacauggccagggcuggggaaacgcgagagaagagaggagauggggcaagagcuggaagcuggagcucaggagagagcaggaggcagagccuagggcgagcccauagcaagggagggaggggccagugagccuagcuggauuguaaggaggaugaguagcuguguggagcgaaaccugugagcuggagagaguuuaguguggaggaggugagggggguggcggguguguaugugugugugugccuguguguauaacagguccuugugauacugagggagccuggcggccagugugggcuuugaugugccgagagccauaugucccuucugccaggggucagggaaaugacuccuuuguggcacagaaaaccuguuucacuagcuccugaggaucacuggcuuuuaucugucaaaaauccuccuauuguccagcuugagaucagcucuggauauuugaacugccugagaccugacaaaaaugaccucagaaccacaggaggacaggaagagauggugucccaccugucccgcggaggcuugcuuuccucaugcagucgcucacaggguaguuugugcacaaggaucgagcaaaaagauguuuuuuuuuuaaaacaaggaacccaguguucagauucuaguguaaucuuauuuggcugugguggaagugacuaauguauugaagaagauagaauuaucuaauuguguguauggaucaugcagucauuauggugacuguacauuucugcauuuugaguugaguguccuuuuauggacacguuuauucugcuuuugaagucugcuaucucuuguuuauaagccuacacauaaggcuaucuuuuauuacuguuuugauaaauagaaaacuauaaaauaguaaucagaguuuguuguauaauuaaauaauuaaagguccucugugguugguaccugacacaccgaaacacauuuuuuuuuuuuuuaaauaaaaguaccuaagcccuguggauuuuaauuauuaggaggaaagacaaacuucaagccuucauugaaaaugggacgccucugccuggaaagaaagacuacuaaaugagacagcagacggagcccuuagaggacgcuauugaaacaugucacuagaaaugguuuaaguggagaguucugguccuuucaaaacacugccugucgcuugaggauugggucaccuugaaauguguucaucuuugaauuaaaggcaugaaaaggcacuuugaaaaauuccagucgacuuuggugugugucgcgagcaucuguggguguaccucuccucugccgccucgcugaagcagucgguucccuggaaaccaaaguggucgcaagaggaggauaaauguuuaaucucugcgccaacaaccguacauaguuuuuaaaaugcggagccacucaccucccaacuccuugcucucuuuguauacucgggcuuuccuccuccaaagaaaugccgggcagagaguagcugcugguaauugcucuguaaaaggacuccgaguggcuggugccaggguugucuuagacacuaguuaaugaugccagguuugcucuguaaaggaaggaggaccacugaaauuaucugaucagaauccugacuccggugagcguuuugguugaacaccuccgggucacagugucaggguguguuuguguguguguguguguguguguguguguguguguguguguguguguguguguauguguguguguggggggguguguaguucguucaggugucacagccgagucaagaaguggcccagugacuaacagcacuggccacccgugccucaaagcuuggcuuuaauccuggaaucuauauuaaaaaucccacagagcugggcgugguggcgcacaccucuaaucccagcacuugggaggcagaggcaggcggauuucugaguucgaggccacucuggucuacaaagugaguuccaggacagccagggcuacacagagaaacccugucucagaaaaaaacaaaagaacaaauggaccuuuccucuguaauuuaaugaguguagaagagaguugcaaaucugugucucuauugugcugccuucuuucuguaugggaacuguguaugguucccagauacaggaaggauaaagguggcuuugaccuugaacagggacuccugugcccuggcucguccuuuccugaucuguaagacaagucucagaugugcuaccacugaggcacauguugauaacgcaggaaguuaugcuuguguggacguguggggcaucuuugugccucucgcuguuuuugaaauucuaaagcuacucuaaaaauuauguucgaaacaaaagaaauggguguacagucucucagacuccgaggguucuucugguucugugauccuucaguggucguucaugcagcuaugcaggcugauauucuuggguuugcccuuucuuccucuuguccugcugguggcaagucucucuggcuuuucuuuccagaccggucacuuugcaccucuugcccucugacugagacucuguacuacccugcccuucccucuagaugucuccaaucucaguguugggugucucccucuguugcucuucaucucaccauuucagcuagacuagcggccaacgagaucccuggccaaugaggccagggagccuccugccuucgccuuggguagaauuccacagcgcuaggaugaugugugcaucacagcacucuggucuuuuagguggaagcugagagucuggagucagcgccuggagcuugcaaagccagcgcuucacugaucaauguggagccguccaagcacagagccuguauuuuguauucaucccucuaccagacagggcccugguuauccucuuaauguuugcuuccauuagagaugugcugagggcucccuccccucuuccugcuauucccuggcaugugauacaugguaucacuguguugugagggcuucaaggcucugcaucucaagaacagcaguacaaaugcuuaccugcugagcugucucuccagcccacuccagugauuacguauauaaccaaacgguuauaacuugggcuuucggaaucuagugguucccuuguaccccuggcagauacuaugugaccuugaacauguaacugagugucugggcuucggugcccucaaucuguaauuccacccuggaagacugacuuagguuacuaucaacuugaugagugaucacugccagucauaaauucuggcugcuuuucuauuuccucugaaauaucaacucucgugaucuccacuccucccugaaggcacccuuggucucuuccaguccccugauacucuacucuccggugcugaaguugugugcgugguaaugaaguuuaccaucccagagacgggcucuguucgcuaggucucuguaucacuaauacugcuuacaauaccgucaugacccaacuuucugugugugcccagggacccaugcaucccagauggaccuuguacuggcugguuuugggugucaacuugacacaggcuggaguuaucacagagaaaggagcuucaguuguggaaaugccuccaugagauccagcuguggggcauuuucucaauuagugaucaagggggaaaggccccuugugggugggaccaucucugggcugguagucuuggguucuauaagagagcaggcugagcaagccaggggaagcaagccaguaaggaacaucccuccauggccucugcaucagcuccugcuuccugaccugcuugaguuccaguccuacauccuuuggugauugaucaacagcaguauggaaauguaagccgaauaaacccuuuccucuccaacuugcuucuugguuauguuguuugugcaggaauagaaacccugacuaagacagaccucaagcucuguacguagcugcaaaugaccuagaaguucagaccauccuucuugccuccugagugcuaggauuuacauguucagcaucacauaugugguucauauggcgcugaugucaaacccgugcuuccugcgugcuaggaaggcacuucaccagccgagugacguccccuaucuuucaccauggcuaguguaccucuggcuggcuaguauaccuggauuuuucucuacuucuaugagucacugggacccaccccggcuccucccaccugcucuccaugucacaggggcucuggauacucaggcugucauggucucuggguugauuuugagacuugcugucacaguucggaaugccuagggaccucaucgacucugcuaguagaaccgucacugaucuuggaggucaaacuuaaaauccucacuuugaugaacuuuucucccgccuuccucucaugcugagguggaauccaggacuuccuguaugcgaagcaagcacccuaucugaccuaucuauguccguagcccucguauagagauucaaaccagaaaacagaaaauugcuguaaaauccaaccaauuuuauauuuaggucuuggauaaugugugugugugugugugugugugugugugugguggcauucuguggccacacaaaugggucacccuguuugaaucucuagccaauaagaacuuuaaugucaggugaugucaaggauggcccucaggaguacuguggaguuuuacuucuggaugugacagccucuuguuaucauggacucuucccuccaguaaaggugugggaagguaacagaguguucaguucucacaaaacugugaaagccugacccucuaaagaaagccuuaaacggcagcaaaaguggcacuguagugguacagguuaacauagucaacggaagggaacauguggaggaggggaccccgccggcugucuguggaacaugccguucuuguucuuccucuccacucuucucuguaccccuaaucuuaaaggcuccucacccaccccggcccccccugcuucucuuucuguuucucuggcugcuaaacccugcccuguucacuggagcagguuucucugagugaaacaaaacucagcuggucaugugguucccacccaccuugagggucaccaggucaguggggcuggcagcagggagccagcauccuuucaguuacugucacaauaaggcagggaacuucuuuggaggggacugugcucuaagguuuuugaugauugucacagagccagggaaaccagcccaccuugucacaaaguacuuccuccuaaagagagaucagguacuuugggaaacaggguuuugaaucagugcccagcagguggugauuuccacucuaauucagcccaggggcacacacucacaggcagccuggacugucacuuugcaguaaggcagcaggggcuggcuuguuuguuuugggaaaugauauccauucaagcccugucugcuuguaguugggauguuagaacuuguuggcugccugcuguuggagggguaugucuacaguucuagcuccuucuaccuaugagugugcuguguaugcgugugcauauauauguguguuugcaugcauauguguauguguguacaugcauauauaugcacgugugcaugcauguguuugucuguguguauauauguauguacaugcauguauaugugcaugcauauauguaugugugugugcaugcauguguauggucucuauauaugcacgugugcaugcauauauaugcaugugugcauguaugugugugucugcguguauauguauaugugcaugcauguauguguaugugcauauaugugugcaugucuguguguacauauaugggugugcaugcauauauguaugugugugcguauguguaugugugcaugcauguaugucaaugaguuugaaugcauauauguguuucuaugugugcauauauguauguauaaagugguuauuaauauucuguguguauugauugaagcuggaaacugcuauggcggcaguuauuccuugacuagcuaguucaccaaauuaucacacagagaccuuuuaauauuucaaagcguaggccuuagcugggcagacucucaacuagcccacuuaacccaaccaccuagucccauccagccaugcggcuagcuauaccuucuaggcccauagucaugucugucuccuuugaugucuacuggcgaaagggccuuugucuuucuucucagaguuccuuucuccuucgcaggaaguccugccuucucucucuacugcuuuagccuuuuauugaccuauuaacuuggggagcaagguuuguaaaacaaaagcugguauacaugaggacucacucuucuagaucuaggggugcagaauuuagcaucugaauaaauagcagcaccugaccaacccaaaccuuucccucauuuugucugaauaaaaaaggccuuucucuuacaauaagaagcaacauaaaguaggaacauaaugaaacauuuaugaaaaguauuagguaagaguuacauccauaaauucuagucugucuguauuugguaacuuuggauaaagaauuauaucaucuacccuaucuuggugaauuuaguguuuuguauuuaaaucauuuccugucauaacuugcauugcucaccuaaaaacauuuucuuaaaucuuaaacaacuuaagcuuaguugugagacuauaacuaucuagucuuuaaccacaucagagaccugagaaggaauaaguauuaccugaguaugcaggaagugcagacaagcaacuuccaaaaaugauagaaauggcagagauagcugacuuccuggacagucaggauauucucuauaauauguuaauauucucuauaacauuggagcaucugucuucuaguguucugccccaguauaucugauagacauauuugugaagcagaaauuaugaaggacuuucuuacccaauuuuggcauagcuuggcaguugauuuugccuauguucaaguuuuguccauucugucagcggaugaaguuggggcauuuucuuugccugguggcuagcuugauacaaaugaagcuaucuccaaauggggaccuuugauacacaucucuuuuuacaaguugaauggggugcucccuggagcugucauuucucaauguaaaaaacccuuaaauuaauaauaaaaaaauccuuaaaugccacauuuugugagucucuggagauuuugaagaccacauaucuauuuauagcauaucugaacaagcaagaguugcuuguuuuaagcuauuuauuaucuguucaaccuaggagguauauuucugugaugauauagacuaguaucugacauguccguaaguuugacugacuauuaacuuguauuucuuaaauacccuauacagauuuuaauagcuuuaaaaggccuggaacuaaaaauugcauuuucaaaugaguugcaaagguccaauaccuaauacaagaguugaaaauagguaugcauaauaaguuguaacaaaaauaaccuuaaaauuuguaucaauaaacaaacauguguuaauauacaauaauccauaucaguguaaacaaaaauaaccuuauuuugagaauaacaauaguucuaaauugaagaguagauucaauaaucuaccccuuuuccuauuaucccuguaauauuccuaucuuuccuccuuuuucuucucaagcuucuuuccuuuucuauaugcaugugaaugcauauauguguguaugugaaugcauauauguguguauguguuucugugugucucuguguguguacauacauguuuauguguauauguguguguuucagcgccaaucaagguaugcaagaagagcaugagacuaguaaguuggugucuauggaacauuucauuauuauugguuucuuuuuuuuuuugguuuuuguuuuucgaggcaagguuucucuguguaucauugguugaccuggaacuugcucuguagaccaggcugacuuuaaacucauagggauccaccugccucugcuucccaagggcugggauuaaaggcgugcgccaccacugcccagcuguugauuauuucuuguaaaucauaugguuguggaagacguagacaugccauguguaauggcuguauagucuguccuuugucuuucaguuugguuugaaaggguaauuuuguaccccaguuuaagaacuuguuuguguauuuguagacugcucuacuuuuuuaugaauaaaauuguuggggauugguucuaaugcuuugaauuaaucuagaauauucauguccaaacacuaaagguccuuguccccaauugguuuuugauugaucaguaaagagccaacugccaaugacuggccugagagagagagaggggcggaacuuuuagauugccugacuuaggaacuggaagagaggaagggaaaaucuccagguuucagaggaagacggaucagauuuagagcggcagaaugaaaaucauccaaaaugucggugagaaggaaugcgacccccggcagggcuguccagaagcaucuugggcagcauagacuagggggcugcccagaaggaacaagacaaagauagaucauggauuuagacgguguuuaguuaggaguacccgagggaaaucuaugauagccaggcagaggauuagaacuaccuagccuuugagcuaagacauuucagaaauaagcuaaugugugcgucuuucacuuguggaucuaaagaguuccugggcaggugacuggaagcaugugacccgucgggagcacaaagugguguagccaaagauggcauugaacucaugauccuccuuccucugccuccuucaguggcauagccaaaauuaccgcuacauaaaauguauauuuuguguguuaacucaguuaauuaaguguagccccagccucuguuuugaaaggaaagugugugugugugugugugugcauaagcaugagcauaugcuuauaugugugucucugugugugcauaugcuuguguguauguaugucuaugcguguauauguguguguuugcauacucuugaggaaaugugacuuguaguggauauuguggggcccugcccucuuuuaagauccucuccaucucaggguuuuuuucuuguucaucuacugugugccuuuuacauugcuauggcugagacaccuuggaagaaaccacacaaggcaagaaagacauuuuggcccauuguuaaaguucgccccauagaggagaagaugugacaguguuccuuuguggccccaugcuugugaguuggagcaggaaacaagggugguuguagccuuugaaggccugccuccauccacuuucuucugccagccaggcucuaucuccuucaaaauugcuuuguaaacuggagacagaacacucagaacauaugcuuaugggagacauuuuagauucaaaucccagugugagugucuuugaaaauuagucaauuaucaaauuacaguauguuuauucaguuauauucauugaucccauauugucaacuuuaaagauaaaucaucaguuuagauaauauauguguucuagcuuccuuucuguggcugugauaaaacgcugacuaaaagcacucugggaagaaaaaggcuuauuucagcuuacagauuguagcucaucauggagggauaucaggguaggaacuuguacuggcugauuuugugugucaacuugacacaggcuggaguuaucacagagaaaggagcuucaguuggggaaaugccuccaugagauccaacuguaaggcauuuucucaauuagugaucaagcgggaaaggccccuugugggugggaccaucucugagcugguggucuugguucuauaagaaagcaagcugagcaagucagggggagcaagccaguaaguaacaucccuccauggccucugcaucaguuccugcuuccugcccugcuugaguuccaguccugacauccuuuggugaucaucagcaauguggaaaguguaagcugaauaaacccuuuccuucccaacuugcuucuuggucaugauguuuguacagaaauagaaacccugacuaagauagaacucaagcaggaacuucuaguagaaaccauagaggaaugcuccuggccgguucacucaugccuauguuuagccagguuucuuauauagcccagaaugaucuaccuagggaauggugccacccacgguggacugagccauccuacaucaacuaacaauccagacacucugccauagacaugccuacaagccagucuggucugggaaauccauuaauugagauucccuucucacguaacuauagucugggcaguguuaaguugacaguuaaaguuaaguaggacaugauuacuuguaaacagcaauuugggggaaauaccuaaacagauaugauuucaagaugcaaauaugugaauuucuauuaaaaauaauagugauucccaauaggccauuuaaaaccucuuuguuggaaauaucaggugucagagauaauaugaagucacaaauuuuaggaucuacaaaaugacauccucauaagaucuuauucauaaucuauuauguaggauacuuucauggagguuacacuuugaagugguugguccugagagagguuaugaauuacccugaauucaugguaaagaauaauaggguuuuccugaaaugagauuuucaugggguacuguguagucagaacagguuaaucagugcugcgugguggccauacauuccaugaagaauugguacagacauuaugugaucauuaauuuccaccagcaugcuucugaguaauuucuaggguuuaaaaaaaaagccuaaauagacuuuauuauuauugcuaacccuauucuggagcguuuaaauaggaguuaugcuauuucacagaauuaauucuauguaggucuguuacaguauguaaacuagcuugcagaaccugcagcagagucagcggcuucgugaaugguacacauuggcagacagcauugggaggaggcguuacaaucuuaggaagcuccaucaaguuccauugugcauucuuuuaucaagagggaaguguuacagagguuuucucugaagaauaauccaucagaccuuuucaaaggacugaguguugaaucuuuacacaacagggugccagauccauccauuugaauuucucuguggucuacugauuccuucuuucuuuccuuuuucuuucucuucucuucuccuuccuuccuuccuuccuuccuuccuuccuuccuuccuuccuuccuuccuuccuuccuuccuuccucccucccucccucccucccucccucccuccuucccucccuuucuuccuuccuuuucugagauaagagucucucuguauagcccuggccggccuggaacucgcuuuguugcauuaaacucacagagaucugucugucccugcuucccuagcaauggagaauccuuccugaccacucaaaggauuuaggaccuuggggaaguuccugucaguauuuuuccuagggcacauuuguuguaagauugcauauuuaggcuaggguuguggguaggugguagaguacuagccuggcauaccaaccugcagcaccaaggcaaagccacauuagcaacaaauccuacauguuuggaaauccaaacuggcuuaggaauucuguuucuaacuauuuaucuggucccuggaaaauuagcaauauuuaaauuggucacuuaucuugaugaagguuggacuuaaaaguuauuaucugcuaaaaaugcguuaaauucuuuagacuccagcuugucuuaacagcaaguuuugaaguagccaccuucuuuuucaacacauuaagucuuucuguagucaguguuagcccuuugcuuucugagguacaugcuuguaaaaugugcaaauuacagauaaucaaucuuccugagaaauggaaauuuacaauuacauuuuucauuaaauauacuuuuugagguugcugguaggggugcguguguguacucgauauuggaaagccuggccugagguaacugauugcagauuuacagauggauggaugguaacagcauggccuuuagucugcaaggagucauugugguccuccuucagccuucgagcuuacacuucccgcagcugguccugcuugacacucacugcucagagggggugcacaccucugucucuuguaugauugggcugaggccaggacaggcggucagugcuucuccuguugaggcagugaugguacccugggcagcugcugugacaucuuguuuggacagcugguaaaugcugcuauuguucuaguuuauuauuuauuuacagacaaggucucacauaccucaggaccagagaaaggccuuaaagucuugacccuccuugucugccugcacacuccaagugcugggaugccaggcuugugccacuaugacugguuuuuuggguuacucagauggaacccaggggcacugguguugacuggcuccugucugcuguccuagauugaccuuccagucucugcucagcugugagccauuaacacacugaucuuucuguuccagucagcuagguaaguuuucauuauauauuuucaagugaaaggucuaguaaaagccauggaagcaauugggggaaugcuggucgaaagcauugaucuuccccagguaaguugucucauauugugcuuuccagucuuccucaugucugucugcuucaccgcucuccuguguuucuuuaggguggcgcccccccccccccccccgugugaugccuuguuaggauguguuucucacaucucuugucuggacgcgcuaaaucugugguucccaaccuuccuaaggcugcgacccuuuaaugcaguuccucgugcuguggugauccccagccacaagauuacuuucauugccacuaucuaacuguaauuuugcaacuguuaugaaccuuguaaguaacuguuaugagucuuguaaaaacuguuaggauauuguaaauauguguuuucugauggucuugggugacccucagguugagaacugcugugcuaaauggcgaaacggugcuguucacaggcacucuaguguaaccccgacucugcuaaggagcugugguucuaucuguaaccaacgcuccugcagacucuggggaggucacugaaagagcagucccaaggauccugagaacaacuggaccugaaauggccgaccccauggaaacuauauggaaaaugccagaauaggacagcaggguuuuucagugcccagaacaccguucuguuaaccacugaugauuggacagguggagcagcaauagcuggggguggccaggaggaugaggucucagggacgagaggaggaugaggaagggaggaggaacaugucaagcucaaagaugccgccaggcugggguuaccuugugcuaugaccccgggcuaacuucuacugugacgauauucugaaagugcuauaacccaucuaaguaugguugugaaacacaccagagaugccagcuucaugggagaggacagacaagauugccacagaggcagagcugggagaucaagucagccuuuaucuuggcacuaaccaucuaaguuugauuguuugaaggauauacaauacagauuuauuccucaccagauuuggauugauaucuguaggugaaagugugcucuauagaaauuugagguuaggugccaacagcugcaggccuguauccccugaaaggucccucugggcuguggcgguuugugcugccugguuguggugggguuggguucuuaccaucugauccuuagggccagauuaacagcaggggcagcagaucugccuagaugcccuugaaccccugccuccaagucugauaggugggacgcucucggcggaagacuccugaugggucucaccugcccucagcuaaggauggggcuugcagggcaguuacugaucucuguauuuuggggauagcaacuaggcaaggugaccucuucucauuuacugugcaacuugaaucugacauuagcaguagcauccuggugucuuaguuucuagccaacuuuuuccaaggugaaggucaacggauuagauaaugaucaugagauacuuuaccaguuucaauggccaauagcaacacuagcuugugagaauagaaacgguacgcgcauuuauuggugagcuguuucugaguugaccaccugcacagcugggaggguguggccgguuccugggagggugcaaauuggauuugaaaacaaacaauaccaaaauagcagacagcugggugaguccuacuaggaagggaacuugggagcaugagcuagccuuaaaaugugcaagcgugugucagcaagcaacaaacuugagacagcaccagaagcagguuuagggggaacuguuagaauuagaagaauaugggaaauuuaauauuucauuuauuccacuuugggagggugcugugucaaacaaagcaucaugauucaguuuugccucuuaggaacaaaggcuaaauggacagguuucucauccugucugguuguuauuucacaucguguggguuagggauugugugagggaccccagacaaacaggauaaaagugccagugaggcuagacccucccuguguuuguugagacuggaaccagaagaagagaaguaagagacaugcacuugagaacaaauuaauaaccgaccaaggggccugaacgucaccagcgagauaaucugaggaacacgguggcguuuucuucgccggagcgugagcugaggagcagugcugccuuccaauuaguuucgugucuguucuccccaaagacgugugaacuugaaaccccucuuggccuccgaagcagaagauucuaugguccugaugagaguguguguauuagacucgauucuccuagcaaggagacgcuaaaggguacuugaaugaaauauuaaaaguuaugaaggacauaacaaaggccaaucaguccguccuuuuccccagacccuauaauacgagaacagggguuauuugacgaaauuaaagaguagcaaaugaagugcuaauaaaacgagauagucacuuauauaauucauugccaugggaggucacagaggcaaauucuguggcuggauuaaauauggggcuggguaauuuuauggccauuaaugguauuuuuagcagccaaagcugguauggggagagguaauuucuguuauauucuccaguagauguuucacagggaucuguagcaaauagcaccaugcgugugagcgcagccucauggguuccaacuucagcugcagugcaucggagggcacuuuauaaggagacugugcccagguauccgucugggugcccaucauuuuucucuucugcagauccaaagucauuugugacccggggaggauaggagaagaaggcuucuggacuuggagaaguccuccuuuuacuugaaugucauccaggguccuguacuuugcuugagacuuuaaaaagaaugugcaacuuguaaaccuuagaaaggauucccagagaaagggaccacccguccucugcccuccccucuaguccucucuccuucccuuuccuuucuuuuccuuuuuggcacaggucucacggagcccaggcuagccuugaaucuucuguuuugucugaggaugaccuuauacacuucuguucuccaaggucuagaauuacaaguguauguaccguggcuaguuuauguaggcuuucugccugcuagucaaggccuugggccaacugagcucuguucucgguuccugaaaugagucuuuguggguggggguucguuguuuauagaagguaagggaggaccuucuagguagaaggaagaaacaggacacagaaccagagacagcauaaaacaccaacucgggagacugcugguuguuucgggacacuggagcccaguguuugagggaggggaacgggaggaacggcucucuagaggagagcagaggguugguugguggacucuugagguuuuuuugagagcucccaccaaccguaggucugaggaguggagaggagugaggaucuuaagggaagagcccugggguggcuucagcuucuggccaugagccuuaggaugcuauacaacucuuggcuccagugcuucaaucacuucugcuguuccugaaacagucuuuaccacgcacucagucaccuguugucaccuguagugguggucaguuggccagguuuuguuuuuuuaauuuuaauuuuuuauuuuaauuuuuuaaaccuccccuacauuuggguggagcuagguucuucuaggucuuaaaagaguugugugcauccucgucucuauuuaaucccgcuguccgggacucugccuugaauccacucucucuuugguagggauaaggggcaagaggcugccugacccaggcaucuguuuucucucgaguuggcuucgcgaagaagcaagacaaagugauauuuuaaggagcagaacagauggauggaaauguugaaaaucugcuuuaugaaaugauuucagcugacaaaauaauuuaaucagaaaugaaaaacacaccaucuaaacguggucccuacuuuagcgauauugaaugauagugcuccuauagcucguucuuacccagauuuugagucucuacacuguuagcauugauacuuguaggaauccacaaauuuggaaauggggggggagcaguuuugaugaagaccuauuaauugucuucguggucccagaucucaucuuugugaugagcgaauucuuuaggauuguguuaguaaugagugugacucucaucaggugucuuaguguaaaaggucuuaguguaaaaggguugaugaagaacaguugugugcgugucugugagggcaucuccagagggagguagaucauaaaaucucugaccgaaugaaugaaugaaugaaugagugaacucauucauucccuucauggacucauaauucauaugauggaauuaaugacaggugguaaacgguacaggugggucucccugaaggaaguaggucaccggcagcauugcaucccgccaugcucccccacuuuuucucuuccuuucuuugacugugggguguguguguguccacauagcuaugacuagaagucagaggacauagcuccagaacccacccuccucuccuaccauguguguaccaggcauugagcuuugguugucaggguugguagcaggccuauccuuacccuccgaaccgucauaauagcuucugucccuuuucuggguuauacuuucucugcuuccucguugaccacaaggugaacacuuuuuuuuguuguuguuguuacaagaucccccugaagcccuguuauuuccaaauacacagagacacgugaccaugugccaguguaaauccuccuucacuuagguccuuucuaauaaguaguuagucagagacaguucguguggcgauugucuuuuaagacucuuuuuaaaaaccaugagguuccuggggagggacagugauguagagacaaggucaucuacacaggucaccagauguacaucuagcauuccuggaggccccguggguggagcugauagucaugggcaccagacccuggacucccgagggggagaccaugacucacacugaacucuguacaagaagcaguucucccucuacugagggauccuauccacguucugugguagagacgcauccaagugcugugucuuccggagagcuagcugaccuuccacggggguccacuggcugugcauagcaaggcucaaacaaaauugacaacacagguugggucacacugaagcaguagugccagagauauaucucuugcagcuuugggugggauuuuuuuuuccuucccugguuuugaaugccugcuacacuguuauuuguaguacauuuugaaaaauuuucuuuugaugggcugcauccugucagcaucuagcagauauuaaucuugucgguaagugggucgugaucaaagaugccuuuaaguauucacuaauucacuuaagaauuuauuaaucauuugcucuccuggacuagacucacaaauaagucuucucugucagaggggagacgugugugccagggagggcacacccacugcugugcuuguguguguaauuaaucaauacagcuucuuguaguuucagacgcauuugauguugcaugaaguauacuuugugaugaccaggcuuucuacaagguuguguauuuguuauuguccagauuaucauuuuguguauguguaugagcaggcucaugcaugucacagugugugcgcaggccaaagggcaacacuuguaaugguuucucucuucccaccauuugauuggcucuagggauugaagucagguuuauaucaggcacacacugcagacgcuuuacugacugagccauccugccgcucccaagcccagguguuuuaaaagaggacugauaaugaacgaagcuaugcccuugcgcuagaaaugacaguggagcccuggaaacuuacacgugccgcucuuuccuuuguagaucuuagcuggaucuccaaaguucaagugaaucacgcggcugugcugaggcgggcccagcagauccaggcucgcagaagcgugaagaaggaauggcagguacgggcucucaugagcauucugucccgacccucccaugcacgccccuucccucgaggccacaguauugaauuuugcucaagaugcaucuagacuuaagugauugcagcuguccauagcuuauuuuaauaauucauauaugaugaugauggguuggagaaagauaacgcauuuacccaaacaaguuaagaaucuuaucauucuugaguggccaaaccgcaaaugaauuugaggcaucuuuauucaugagcgaauuaaaucgcacguuuccgcaacacauuuauucuucuucuuagucugcuuucuuuggcugucuucuauuuuaauuuucaagccguaaacaccuacaccugguguguccacuguugaggcccgagguaggagaguuuaucuauuucuuuucauagaucacuuuucaaaauuccaaaacugauguuugguggcguucuuccagucagcacauuccuuagugcacugcagucacagaugugcugugcaggucuaaaaggacuucagaguucauuucacaagagagaaagaacguggugacagaggucucuaaagugacaugucccaucugcccauccugguugaaaagauaaaaggaaaauuuuuuuagagugaguuagagacuaugaggguuggacuaaaaaacaagggacuuaggagauuucagaaaauacugcaucaccuuggguccuggaaaagaagguaaacucacaaauguugugucuuauguuccacacuuguggcuggcucuuuacagaugagcuggaaacgugagaaacugcaggagcgaguggaggcuucaguuggaguuucugauaaaaauagaccaagucugcucuuuuguucuauucuggcuaauguucaucuugauugccauuccuuuaaaaauaauuuaaaauugaaauuguuucuguguguccacaugugugggcaugcauguguauguaugugugugcgcguguugugugccaugugcacccuggaccacacauggaaguagaggagaacugguaggaguugguucuccccuuuuaucguguguccucuggggcuagaacucaggucuucagguuuggcagcaagcuccuuucccugcugagccaucuugcuggccuccguuggucaauuuugagcuccuuuuauacuuguaucagaaagcgcccuaccguagcauugccacuggcugugaacccucccauuugucucuuguuucucuccucucuaacugguucaaggugaauuuucuuuuugauuucccuugcuucuccuucucuucuaggcugcguggcuccugaaagcugucacguuuauagaucuuaccacgcuuucuggcgaugacacguuuuccaacguucaacgacucuguuauaaagccaaauauccaauccgggcagaccucuuaaaagcuuuaaauauggaugacaaaggugaggcugugcacagugcaccugggcuuaccugcucgcagcucccccuggagcucgggggcugauggucaccugccgcugugcugguacaccucugcuucugugugugcagacaggccaaagcuaaagagccgccaagcccuguuuccagaucagguucugcaccuaugaauugaaguuguuaguggaguguuuccucaguucuucaguuugugaucguuucugucuaguggcucugaauuacaggcucggauucccuagccgugagggaaaaggcuggucuugucacuuaaugagcacaucacauauuaagucaaagaaaugcauuugcaaauaaaaugcaaaugggaaguacuguguauuacauuagaauuuaaaacaaaucaaaacaaacaaagaaacaaagaaacaaaaauaacuccuaucacucucuuaguguacacgagagaaacuguugaaaagcugccuugaguuuugagcuuucaaacuugaaagguggaggagacaggcuagugguggugggccaucaaguaggguggcagggguggugguagugucuguuuucuaagugagaaaaccaagaccuggggccccaggagguauugccagggccacagguguagucacuugccggaccaguuuugggaggcagauauccucugcauagauaugugccuccuggcucugcagugccagcugcugugccugcagggaaaggcucugagcuagcccagugcaguuaucacagauaguccuugggcucucagucgaccuaagcaacuccauagcuuuugaaaagcauuauuacauuucuuuccaguugacacuagaacauugccuuauuagagccagagcuguaacucgguguugagugcucaaggccucgguuuccauccucagggcucuacaacaaaacacaaacaccugucuuuuccccuugacugcagccauguggggcaagcauuugucccucucauuugcucucugccaguguugucccagaaaugcuaacugaagguguggcgugcgagccgagcuccacguaaacuaggcugcugugcuuccuacauaggcaucaccacagcugcagucugcguuuaucccgcccgggugugcgacgcugugaaggcgcugaaggcugcgggcugcagcauccccguggccucagguaagacuuuuacucgugauuuuucaacauagcucaaguuuuuuguuuuuuguuucuuuuuagcucaguuggcauggauuaucacccauaaauuuauacugugauugcauuaauuucagaggcuuaguuguguugauucgugauuuuuaaugugugcuaaauuuauguaguaaauuuauauagauauuaaaguaagcaugaugucacacauguagagccccaucucuucaggagcucaggggaggaccuuugaguuuuaggccagucugggccauguaguaagaucucaaaaucaaagagacaaacaccaccaacucgaaaccuugacacauuaaguccugaaaguauagaaccaugucuugguuuuuaugauggccaucagauuuauagucauggagucgguugucucaugcacacacaagucucugcauucugucgcauguguguggcuuaugauacugagcagagaaugcuucccucagccaaggcuggggcugcacaguaaggaucaucccagcagaggugaugggugcacugggcauugagaagggaggggaagcugacaucugcuaaggcagggaaugauagugacauggaagcuagcauagggaaaggcacagaagcagagcagggaacagauaguccgguuguggacaggcagccuuucgaguggaggcugggcaggaugcuaauggcugguggccugggcucucuucugaugacaguguuaguucuggacgguuuuaaacagagcaagacacauucagccucaagguggugacuuagcugaugucaaaaaaacaaaaacaaaccuaggaaguacagagcaagcgagggugaaaaccagggcccuaaaacccagaagggccacuagugagauaaagaugccuauugccaaggcuggcuaccugaguuggaucucugaagccuacacaguggaaggagacagccaacuccuccuaguugucuucugaccucaugugugacacacacacacacacacacacacacacacacgcacauuaaaugaauaaaagaaaaauaaacagaugguuaaaaaagccuccuaaaacaugugucuguggauggacagaugaacggauggacggauggauccauggagacagauaguauuauuagauucgaguuuuuaaaaggcuacaaggauauccuggugcuuucaguaaacagucugagccagguguggugggacaugcaugcaguucuagcacuuuagaggcugaggggaggacugcugcuaguuuaaggccagccuggguuacauggaaaaaccaugucuugaaaagaaaaggaaagggaagaaaagaaaagaaaagaaaagaaaagaaaagagaagaaagggaaaaugcaguuuauaaacaucagcuucuuauugcauuauggaaagaugauguacuauauauauuuuuuuuaagauuuauuuuuuuaugcauauacguuugugcuuucauggguucugcaucaaguccugugaaugugcacaaacgccagaagaaagcauuagaucuucugugugggugcuagcagccgaaguuggguccuucaugagagcagccagugcuuuuaacccuugacccgucucuccaugugcaugucuguauauagccucuccgagagggcucccaacauauuugaagcugugccuccauagaccauaguguuuucaccaucucagggcguucagcccauuacuuacauaacaggaagauguguuuggccugugguagcagaccugauaacugaaggaaagggcaacagacccuguguagaaucagaggugggugaaugaaaaagaaacucagcugauauuuaguuaguugauaguuacucagcgucccaugcaaacaucucugcagcaacuucaccucaggucuuccagagagacauguaucaugucccugaaaauguauguacacucaucccacuacuccaacuuuguccuguguggcgugagucacguuuagguaccguucaugccucauuucucaaagccgcacuuacaaacugaccaauugagguuugucccuuuuuuccccucccucauuuucucccucuguuuucuuucuuugaaaucucucccaguggccacuggcuuuccagcuggacagacucauuuaaagacucgauuggaagagaucagacuggccguggaggauggagcuacugaaauugacguggucauuaacaggaccuuggugcugacgggccagugggaagguaggugcagguccuugcucccagggagccccagcccuuccugguggaucauggggagaucugaacggaacacagcagggcuuaggaaucaaguuccaggccacaagucaauggucagaggaacauggcuaaaagugucccucucgauuuccuuauaagucuaagcccuucucugucuguaggaacagguuacgacucucuguguaguuaggggcacagucaucccgugcaguaaauccaguuuaaaaauuauuaauuugcuucucuuuuggaagaauuccuacaguuuuguacuguuucguuauucaguaaauaggucgcuccaggcaaggccucuaagcaagguuuacucugggacgcuggggagguuaucguuuuucacauuaauauuuguggacggugaggaugugugcuaguauuaagcuuauuaaaugccccuuuucuaccuuaaaugugauuacauagucaucuguagaguuagugucucaccauuauccuaagcugggauaagauagugucuacccuaguagcaggaugcuguuauacagugagguaugaaacaaucaaaugaacuuuaucuguuccuauauacauauaucuuacauccuaaagaugaaucuguuccuauacauacacauaucuuacauccuaaagaugaggauauuaauaacuaaaauacauacaaugcucucugaaaaaguuaccauggcaaguaauuuaacauuuuagaugaaacuaaauuaaugcuaagauaauauauuguuucuugauagauguacauaccaaguaaaacauauuuuuaaguauggggggguucaguagaucacuuaauucauuuguuuacugguguguauguggagggugggacucacaccugccagggcucggcuguggagaucagaggacaacuuuugggaguuggccuccuuccucuaugugaguccuguggaucagacucaggugaccagguuuggcugcuggcauucuuaacccucgagucaucuuccuggccucugugucacugucagcugagacauagccaucugauaacuucggugacucaauaacugugaacauaacagcauagccagcaugcgauuucaccacagcugcccuguaaagccuaugaacaguuuauuucuggaaccuuccauuuaguacuuucagaccuuaaguugauuccuguuaacugagacugcagauauugaaacuaggcaccagagaggagauuugauaguauauaucuguaaacuuuuuuucugccaaaccuauuccacuguuuggccccuauuaacuaauuuuuguuuacuuaugauguaacaaaaauucaguccccagucuagccacagggcauucagagggaaguagaguuaugugggagaccuggaccaauuccaucucccaguucuguaguacgugugucuaccaccgcggcaggaacacaccauugucuaagguggcuuucaaagauccagccuucaccauccuccccaggggaaggaaagaaaggucccaucugaaaaccucugcaucuuguugauugcauccugcuuucuugaacuaagucauuuacauggcuuccaucacuggcugugagugaggcuacaugcuuuccagcuuggagaguuagcaccauuucaugucucucccauuucuucccccuuuccuauguauacuaccguucuugacaguuccaaauaucucuuuuuccuugugcccauuuguauugcugcuugugugugcuuugggcguccuuaauccuucuugaaagucauauuuuauauauguucuuguuucuguguauucugcuuauaagcuuuuggucauagauuuucaguuacgauuucagaguuguggauaauguaaauaugcauauuuuaaauaaauccagaugcacauucuuuaugucuuuuacaagcaggugaagacacaggcaugcaguuuauauuauaacuuguguucuugucucucaagcucuguuaauugaaaagugaaauccaauaggagauggguuuugauguaauuggcucuccuucacagacuuagggauggcuguuucugagauaauaauuuccccaaaguaggcauuuccacaaaauauaauaacacauuuuguccuagaccauacuuuuccauuaacuuuuuucuaugguguuaauaaccuguugacccaaaccaaauggaaaaggaacauuuaaugcuagaaauuuauuuuuaaauaaaagccagcagugacugaagccuuuccccacugcaguauuuugucuuaauuuugauucucagcuugauuuuacauuguguguuuccgugcccuguuuuuauauuagggguuuccugauuaagagccucucauuauuucugugauaugcacuggugggcgugcccagcaggcugucccauuuccugccuugggcccucccuucuaugaguucugugaaguugcuucagggauuauuucauuuucuuuccacugcagcauaacaaacacccagugaaauccccuuaccguaaagacagggccuggccuggcucacaguccauuguggcagagaaaucacagcaaaaucuaaagucaagauuuagggggagagacugcagugcccagcucaccccaaagaacagcuacugcuccccacauccaguguggaucucucaucagucacccaggcucaucagaaguucucucacacgcgugcccagguguuuauuucuagagcgauucuagaucccagccaguggacgguaaagauuaccuguuaacacuuugcaagucacaucagcgguagagcacgucccacagcacagaagcaugugguuccauggcgcucgcuccagauucugugaggagacuggcuaugagcucccuggcuuagucuuguugcucugaagagacaccgcgaccacagcaacucucguaaacaaaagcuggccuccaguuucugagauuuaguccgucguggcugggugagugguggcgggcagacagacauggugucagagagguggcugggaguuuuacaucuggaaccacaggcagcaagaagagagcuacuguacauggauugaacuuuugaaaccucaaagcccacccccagugacacuuucuaaagccaccgcugcugauccuuuccaaugguggcagcccuucagcauuuggaugaaugaauccauggggccauucccauucaaaccaccacagccccacucuuaccuucccguucuuucuauuuuuuaaaaaaucuauauuaguguuuuuuuccugauuguauuugcauauauccugcaggccuggugcccaaggaggccagaagaagaugucagauccccuggaacuagaguuacaggugguugugagccaccauguuugugaagggaaucgaagucagauccuuugccagagcauccagugcucuuagccaucuagccaucuccccagcuccaucuuucauuucccucugaugucucuacuuugucagaugucuggcucuugccuaguccuguggccucagaccuguggucuuuauuguguggcucucggucuuugcugugcgacucuugacugucgccucgccugcaugcccagguccucucaucucucaaguucccagccucucccucucuguccucgccuuuaaguguuucucuuugaagucaucauuccccuucauuaaugacuacaucucccuuuuauccccaucaccgcuggaauccuuaaacaacccacaucucgcuuuggguaggcucuaagggugaggacagcggccucccauuucccucggcccccauguucuucccuuguuuguuaugcgccucuauucaauguuugacuuggugagcugccuuuuccuccuagaacacuugguccuggcugugucugauuucacacucccgagguucccucuaacuucucaguguccucuuuucuuggugccaaguuccugaaugccaguugccuucccucagagguucuguccugcugucacugcuccucauucuuagagagucaaguucuguucuguugucuuccaugucagcuucccgagcucugggcgccagcauccccaucugccuggucccucuguugcucgagacuccugucugcacacucacucaucuccguugcucaucaccauuuucagagaaccagagacucagaaucagaguccccuggacgucagggaaucuagccacguaaggaagaaaugcauuaaaauaauuacuuacgcuccacuaacuuaaggaagucguaguuagauuuagugcauucuugguuauucgggaugcuuucguugguggccguguuauccugaguguggugaggcuuucaggagcuacugaaaucccugagguaacuacccuaccuugagcaucacagacugcuguggucucuauuuauauagcacuuuuuguucagucuuacccuaguccuugcaggcugguccuuuucugcuaagcuucuuccuaucagccauguuuacuucacucacacuguacugcccugagauuacuccacgggcuccuccuguucaugcagccagauguaugucuguuuguccccugagacagagugaagaugguauugauggcucucagaauuaccugacaaguauuuccuaaguucucgauccagaccucuucccacacgguccugggccgauucugguacagccagaacugcgggcuggauaugaugggagcgaggcuccugcuccugugagaaucucuugaggucucuggcuuucuuagugucaguaauacuccuguacuaggguucauguacuacuguggugugugugugugcguguguguguguguguguguguguguguguauuuuaugguagugcugaugccgacaccucucuuaguuugcuuuucugaaaaagcuuuuggcacuuuaugagacuuugauaacugccuaccuacuguagcuaauauacauaggggcggucuggucucauuucugccccacagaggugccugugguauuuaccagugauccggagcaguccuucgauuuguaccuuacucguuacucuacuucugggagccuagcacuggaacuaccuucacugggccuggggaccaaguguccaugggauaccagcgcucaggguuccuaggugguucaaacacuggcuuuuucuggugcagucguucagugaagcaguugugaguguugucugucuccuguggccacagcuucgucaucuccaugucuuuugguugcucaccccugugguucucuaagcuuagauugcagcaggcacacccaacacugucugguucaguucgagagaaugaaaucccaagaacacagccagugugucugucucuccuuuccucaucugaacuggaugcuagggaccugaaaucugggcaguaaucaaucugcuuuuugugauuuacuuauuuuuauguuuucaccgaagaauggggauccccagaaagaaauuauucuuguuuccuuuauagagcuauuaauaauaauagcucaccagaaaagcuauuucuaaaucuauagacauucucaggaauagaaucacauaaccccuuccucuguagcuccucuguucccagguuguuuauaacggagagagucgggagauagagagccacaugcuuuuaugguuuuuauuuuuacgcuaugagucuuuggcacuucaauagugcuggcaaaaauguguguguuuuauuucuucuagguuauuuuacugcugggugauuuaguaagcccaucuccauuuuacccuuacaaguuuaauuaauugcucuggcgaaugaaaccauguucuugaacaucuugugacuuuuuuuuuuuuuuuugguaugaaagguugcugugcaguuuuauauuaaguguuuuacuguacauauaauuaucugaagcauuauuuucaggacauucuuaugcaguguugaacaucucucuggcacucaaaaaaauaauugcuuagauguguucacuagcaauuauuuuuuaaacugccuuugaaucacaggaaacaaaaagacagugcuuuaugacuuuaugacaggaaucacgaugucugaagccuuggggucuuacccacaucacgguuccagaugugcaggucuuacccacaucacgguuccagaugugcaggauacacuagcguugcugucuacagcuagagcuaugcguuuccagaaaauguugugcauucccagcugcugugagauugacacuagaaaagaaaaugcuauaguuccugguggaggggcagggcugggcagggcugggccggccgugcuggggggagcugucuugcugaaauagaguccuuguccuggagcugaaggaaaggcucuucagugguuagggaguuaggagcaggaagcugaggaaguggcugcauggucgggcgccuguagacaacauuuaaguucugcaucucaaaaagcuaaaagagaagauggcaagugucugaggauauagcuaugucuucauggacauaaauaucaaacagaacaugcauacaccaaaauaucucauggcaccccauuaacugguacaguuuuuguauuucuauuuaucgguuugaaaaauagauguaagcaagagaaaaggaaaacaaaaucacccugcagcccaacccucugcuuucugucuaccccuggccccaaucuguagaugcacauaugcaggcaggccucugacugugucuugaugcacacaggccggccucugacucugacuccacccacacagccucaccuguugggcagagguuagguucugacuucuacuucucaccagcuugguggaggugggaggggccccagggccaggcugcagacucccgugaguugugcaagaauauugauuaaguaucagcagugugacauauccugggcuucugguacacccccuucagaauccugaaggccucauuauaagucaaaacauuucuuaugggguuuuaugugacaucacucugccagugcuucugguguguguguuuuguuaaauuuugcauuauucugacuaauuugcagucggggcguuugaauuccauuuucauuugucagucaucuuuuauaauaaccuuccaaauuauuauuuuucugguacguggcaagaaucauucuuuuuuucuuuucucuuuaaaugaggaagucucaguuuuguaauguuugaauuuuuaacaaugaacauauuuuacuuggaagugugugagcagaaacaaauaauaaagacucuaggggauagcaugacgagcugugcagagaccucacuguggggacgucgcugcaggauugcuuaucacggccaaaaacgacgacagggcauugacugaguaaaauuuuacaucuguauaauggaagauuguacggccauuaaaaauuaugucauaaacauaucuaucuaucuaucaucaucuaucuuaucuauguguguguguauauauauauauaugaauauaugcauauauauucauauauauaaguagauuauaaaauaugucccauaugaaacccuguuuuaagaacuuugagcaccauagacuaguugauggucacaaaagccccccugugucagaaaaauacuuagguucuuugcaagccauaaaaaauaucauauguuguuuuaaguuuuaguuuugagugauuuuauuaaaccauauagaaaaucaaaaaaauagugugcagagcucaaguguaugcgucagccagccucuccuguucuaaagguauucuuguuuuuuuggcuuuuuuuguuuuguuuuuuacguguguguguuacauaacuauaauuuuuaugaacuauuugagacuaauuuauauuccuguugacuuauuacccuuaaauucgucacuguauauuuucaagaagugauggcaagaucauacccagccagagcaaagcggucuuucacguccaacauuagaugcagaggcucuguucagaguuuuaggugcccaguggccagguuagaucuacgucagucauuacaccucuguuuuuccuucuuuauuaugaaguagcaccccuccccacccccgacagguuuuuauguuuuguuuuguuuuuauuuauuuauuuauuauuauuauuauuauuauuauuuauuauuuauuugaggaggucaggccuguuguuaguaauuuacaagcugucuuuaaggggcuccagauguagcuugguugguaaagcgcuuguccagcaugcauaaagcccuagcuuugagcuccugucucucauaaaacguggugauuuuuccaugcggucccaacccaugggagguggguggcaggaggauugcgaguucaaggauauccucagcuauauaacgaguuggaggccagccugggcuaccugagacuauuucaaacacauacaccccaaaguuagacuugcuuaguguuuucuucuuuuuagguucaaguuaaguauucgugaauaagcgccugagguuuccacuguucuuugagagucacaagauguuaaucugucugguucuugaggauguuaaguuuuacugagcuaggaugacuucugucaaguuucuacaucauaaaaucagcauuuuucauuuuaauauguaaauauguaaauauagacaaugaauagcugucaucucagacuauguuaauaucccaccucuaauccagcuuuuauccagcauuuuaccauccauugauauucaguuauuauucuaguaguugucuccaaauggcaauuccccaguuguaucauuccuccuacacucguccuccuccugccugcuucccucccuuccugccucucuuucugucccccuuccugucccuucucuccuuccuuuucauaagagcucauagauuucuguugaacuagcuugguaguaaucuuuuacuaucaguuuuuaaaucguuuuugauccuuuugcaguuuuaaaauuuuaauugacauacauaauagugcagguaaaccauggcauuuucauaacacacacauacauacacgcauguacacacauacacacacacaugcacacacauacacacacaugcacacacacauacgcaugcacacacaugcacacacaugcacacacacgcacacacauacacucacgcaugcacacauacaugcgugcacacacacaugcacgcacacacauacacacacauacacacacauacacacgcacgcacacacacacacacauacacacaugcacacgugcacacacacaugcaugcacacacaugcaugugcacacacacaugugcacacauguacauacccacacaugcgcacaugugugcacacacacaccacacacacacacacacacacacacacacacacacacacacacacaccacacacuccccccccacacaguucauucauacugacaaacaguaagcccccguuggccacucccucccucggccucuccucugcucuugggccauggguaugaccaugcagacacccacacauguccuucuccccugcacucucccccgcuccucucucccuccccucacuguugucuuuccauuuccaggucauaguguuguuaucacuuucagacucaagcugucugaaaguuguucaguggaagccacuucagacuggcugcuguguccuuucaauguuccccucguucugcagaacuucuucucuuuguuauaaaagcugauucaggcucgucgucgaauuucuuuaaagccuugagccuggaaacagcuguuuuccaagaagccuggguccucuuaucuggguaccacuguuaccagauacacugaccacuauucagaugcugauguucugugcauacucaguggccagaucuagcaacugugugaacacauucaucgucacaacguucauaagcacauauuuauagcugugucuuaucugucugccugccuauuccucaguguaugugugucugucugucugucuaucuauguauuaccuaucuauccauguauccaccuaucuauccauccauccauccauccauccauccauccaucuaucuaucuaucuaucuaucuaucuaucuaucuaucuaucuaucuaucuaucuaucuaucuuagaggccuuuaauucacaaaaaaaaucuauuaugaucucauaucugagguauuguccucacacacguacccucccauauuuauguccuuuaauguuacaagaaaccuuguucccaugaccuucaguauggccaucuguuuggucaaccuucacauggucagugccauuguauauaacauguuugaagcucuuuggacaucucccuggccuaauacugcugacugcagucaacaaauccuacuggaguucccagaacucacuagguagaguguccgucacucuccauggcaaacuaagucccuccgcauccuucaggugugucccauaccugcugugaaauucuaguuuuccugccugucucugcucucaaggcccuggguaguggggacugccuugugucugccaucucugcagagaucugcuacaaggcaguuucugaguuguccuuccgagccagugcccucaguucuaagacuuuagcuucuagaguaaggcagaguuuaaucuucauuuuccacgugccuguuauuaaagguggaugugagagaagcauaauuaguugauuacccucauaaucauccgaacaauuacuuuuacaucuauucucacaacuugaacaauggcuguggagugaagaaaaauggagcccugggauguucaauagcuuugucaggugacguaacuaauuagagacaggggccugggaaggccugauagaaacucugagcacugcagugcauuguucugccagagggcugcuuccuuaggcucuuuccaaagaggauguguuuucuauucuucagggaauccagauuggagcagaaagagggagggagagcucagacaguaagggcuugaacacaagggugugaguuugagcccuggaacccacauaguaaagcaagccuugcugguccccauugcacuuccagcucuggauggauggauggaaccauguagauaccugggcgucacuggccagccaggcuagccagugagugaguuucaggcuccaugagagaccguguucaucacucucugucuuauuccuuugggacagggucuccacggugcuacauauguacuauguacacagaauaauagaauaaaaccaagcuacagauacuuucucaggaacaugcaguacugcugacaucaugaaauuagcacauugagagugaagggcgcggaugcggagguggccccuuuacaucccuuguguuuggguuaugaguuaaagagcauacccucgugugggucucccuuuccuccggggucgugggccaccagccugugagggcagaagugacaucgugaguguaacagaaggaguuagcuucagugagacagcucuacuucauuuuuccagggcaggguauauaaggcuuuuagggguauggguggaaagggcugauuggccauaacacaacaccuaauuaucgugugggugggaggcuagagcgggacuuguguguaguacgugcagagagcucugcacggggucguucucuggacaaggccccuuguaccugcucagagacacuccagccaaggccaagcagaagaagggaagucccgcugagaaagggacuucucgguuuugcacuaagcucagagagcuaucccuacgugguggacuacaaccucaacagcagggcccccccacacccuccagcugcuggucguaaaccacaucuuguuuuucugguuuguuuacuacagguaaauaaauccaauggucacuaaaagaauugcaguguuuuuuucauaaacaugaucauaaucaauaguuuaugaauuuguuauucagaucaaaguucacugugacaaaagcuauaguuaaauaucuuuaaagauuuuuauccauacagcagaauuucuugucucuucaaggggaaugaguuaggcuaugaaauuagauuugauuuuugucagacaagauggaaacuuauuucaacaagauacuauaauacuaaacuucacaaaacacacacacacacucacucucuucucucucucucucucucucucccucucccucuucucccucucccucucucucucccugucccugucccugccccucucccucaucuucauaauaacuauaagguacauauaagguacucuaaggauaggacugagacugaauacaguguugccugaguccuacaggaagugacacaucugcagucaucuucuguucaccucugucaggcuguggagcagggagcccacuguuacuugcuuaccacagaauuucaagucacagguuaaccagguuagcauucuuggguuuuuagaccacaagucauccugucacuuuuucuagaagaacaauguucucauuagauuuaguuuccagaaagguccuuccacccuagagucaccuuccugaguggaaaguaaauuguuacugccugcuaagggguuaugauuuaagacacuccagugucacagugggcacuuaggucaaauggcuuuuccacgagucagguuacaugggcaggggaagggggguagacagggcugucaccucagaccuucuguggggacaaucugguggugacaaacaccagacauccuguguguaaaaccagcuuccccuaagacacacacaagccacccuggucauuguggcagauuuucugauuccagaguuuggggaaucagauagacgguaggcuagggggagaaggcuaaagcccaugcuauccuugacagaugccucuuaaguagcuuuugaaacacauugauuuuguuuacuaacauuuuugccucuuuacugguauuucuuuucuuuguuuuacauguuuuuaauuuuguguguguuucguuuguguuuuguuuucgaguugguuuucgcuugcuuugguuucuuugaacuguuugguuuuccuucagccgcuucccucaguuuggucuugccaugugucuuugguugcuuugucgacccgacucugucuagucuacuuaccaggcugcucgcaggcucugucuggagcucuggaaggugaaguagagcuugggugauugacagccaccucagugcacaccacuagcgugagcuuuccucacauaccugcagugcaccugccagcccaucaccucauguucucauguacuuacugucuacagugguggccagugagcucuuccugcaucggcauugcucgucucccaggaaaggucugcuuuaaacgcuaacaagagaaccugcuaccucuggaggagaaugaauaggaaccgcaggauaucuuuuccucgugguauaguaacuggaugcuauauguauggcagauagauuugcuuuuauuuucucccucagguccuaaucacguggaaaaaaguagaaauuauuuguacuuugcaugucuucauaaugguauuuaagaggcuuuaugacucuugaccccaggcccagggcuugggaacaguuuuauggugucaaaccaggcacugaaugugaacuguagcagggugcucuaggcgauauuaaauuggggugauguuuaguaaguggcaaaugucuuauguuuccuaaauccgaaguggguucuucuggcucuaaagagccgccaccuuuaccccuugccugcuuuguaacagcugcaaugguuuccuccacagcucucuacgaugaggucacucaguuucgaaaggccuguggcgaggcccaucucaaaaccauccuagcuacgggcgaacugggcucucucaccaacgucuacaaagccagccugguagcgaugauggcagguaagcuucgugucuucagaccugcugcccacugggucgacgguuuuaggagaaacaagggaagacaagcauuuggaugguauugcaagugcuaccgucauccucuuuccagagggcugagaugagauuugugaauggagacuuugggccucuguccacuuuucuguugguuuguagcauuuuucuuuugcugcgcucucccuauguagcaguagauggcgcucuuguuagcaaauugccuuuugugcuaguugauucuuccuccgugugugcuggagaggauuuaguuuagcauugcgucuuucugagaccugucugugcuuucucaaguggccccugcuuuuguuccugcuaauguaaggaagaauccggggggcguucuucuuacuuucagauagagguugaccucuauugaccucuguugcuuugcacagagcagacgcauccgcucagguuggagcuccgccggccucuuucucaccuccacuguaccagggaguggccugcugcaucucucuccacgcugcagcugcuguccugggcaaacccucccgaguggguuacuucagcucaggucuccgucccuacuucuggcccuuucuagucuucucuccucugugcuguuaaauggccuucucagcgcugauuugaucaugaccccacuucuuuacaaccgucccccccccccccagaugcccagauggagugcaacuuccaggcccucugucugugucuucuccugucuccuuccccuucacuccuggacucagcuuccguuguguccuugugcauguugggccccugccucgaaggccucuguccucagcacacuugacuucagcacagccacgccagugucuggcaucacuuccuuccccaccgcuugauucaucuucucgagagcuccauauccuuucgauuaauugauuaauucucuauuagaugacacgccucacugugcugggagugagagcugauuuugagguguccccuaggggcccuaacucugggaugaagaugccuggcuucccugguucaggccauucauuguggucacgcuguagauguuuauacuuuagauauaagccuuggauacucucgugugccuuuugaaugccgucgggccuaguggaugcuucccugggacucuacugagcaucagccaggccacugaggaugauccggccuggucccugcugccggcccuguggguacuuguugcugcuuguguccuuuaaagccagaucccuaaauaucugaggcuaaguagaaauagaguacuuugcacagcacuggggugcuggaguucagcaguccacaguagaaggcucauugugacuuggggugacuguguuaaggcccucaguguguuagcuagacaugugguccccuucugguucuuagccaaggaagagacugcuagucugggcaacaaacgaaaaguugaggccaucuucaaggagcugcagccaaacauggcagcaaccauuugugggacaccuuugaggguguugccgugucagcaugcucgcaaggccaaggcacuugauggggccacaacugagcugcccugaggugucucuuaccacagcuauaacacuguccggaaaaaaguaugggcuuucugaaaggucagccguggacgcucugcacaagcaguucccagagggaaggugguguuaggccgccuccaucugcugugcccagagaaaacuggcuggaagcugccacugcccuugcuuucugugcaguuugcccucugcuguguuuaugggcucugcuucaccauuuaacuagccuguugagccuguagcugugggguacaucaacagauucauucucaguuuggucuucuuacauugcuaguuuagaguuuagcuaguguagaaaaggccagacuuuguggugaagcugcagacgcacgucaccagugagcuccguucacguuggccucccucccuguuauuccuugugguccuccuccguccucacagguggcuucccucugccuuguguguguguguuguauaugcaagaauuacugucucuuccucugaucuucccucccccacauuaauaguuucucuucugauuuuauaggaaaagcauaugacuccacauaggagaggacggguguggccgaauagccucacugugcguguauauacacugcuuucuguguuuuguuuuuuuacaucuagucugacuccagucuuucaguaaacaugaccaugcugguuucucugucugugcuggcuuugauuucuuuggcuguauacccagaagugauggcgcuggacugcacaguaggucuguuuuuaguuuccugggacccuucuuucugguccaucggggccacacuaaguuuucuguuugugugcaugugcacccacugaacaagugcucugucacugaguucuauguccccguugcugacaaauacuuuuaaugucccuugaucuucuucucaccacccccgaguuaauggagauuuucuuaaggucccagagcucgagcaggcccgcaguccaaguuugaccucugcuuggcucacguccacugcagugcggcuucuucuucagaagcagcagcucucaggaaggacguucguugucuuugugaacuuuaugauuuauagcgucuagccugcuucccagucuguauuuauccugcugcuacauauaauggaacugaaguauuuuccaaauucaguggguuucuguauuuuuguuuuaguuuucuauauaaugcacagacuaaucccaaauaaaaauacuuuauuuuuuucugacaaaaaaaaaaaucaaucucauugaguugagcuuacauucauuggaauguguuaaguguccauacggugugagaagcuuagacaguaugcagucaccugcaucugacuacugcagucaggagguaacguugcugucaucccggcagauucugagugacucucuuaguuacuguucuagugccgugagaggaugccauggccacgguaauucauaagacacgguacuuaccugggaaucgcuuacgguuucagagggggaguccacaccugccuuggcugggugugugauggcagcuguggggacagagguccagagcaagagcuuaagucugggccuggcaagggcuugggaaaccucaaaccccacauccaggcacacaccuccuaucaaggcugcaucuucuccuccuuccuaaacuguacgucagcaggggcucaucacugauaucagugaacccgugggaccguccccauucaaagcaccauagacccucuaaggucggugugaugcggucugccugcucgcuagcagcacaaccuggcuguauggacauccacaggcuucgucaguugagaacaucccguaacucacacuguagcuacuguuuuguuugcuacucccccgaaugaauaaccgagagacugcaagcuuucuuacagauauccgcuccauugccacccagaugcauugagcugcuaggauugugguugugaaguuguucauaccgugguccuagucugaugucuguagggucuguagucacagcucaccgugggccuagucugaugucuguagggucuguagucacagcucacugugggccuagucugaugucuguagggucuguagucacagcucaccaugguccuagucugaugucuguagggucuguagucacagcucaccaugguccuagucugaugucuguagggucuguagucacagcucaccgugggccuagucugaugucuguagggucuguagucacagcucaccaugguccuagucugaugucuguagggucuguagucacagcucauucuucacccugaccgcugcuuuuucauuuuuauuuuucccucuccugauagagucuuacaggaguuuugucaauuuuauuagucuuuccaaagaccuaacuuuuuccuuuuguucaccaugagguaaaguguuuucuagcuuccuucauaaguucucuugccauuuagaauguuauuuaaagugucauuuagauugagaucuuuggugucuaaauuuugagugcuuuucugguaacugaacuuggguauucugugagagcaguguauguguguagucacugugacauaucucuugccccuagaacuauuuuguuaagaaauaucugccccaugguaucuggcuuuccuucaaggauccuaagugugcaaguguaagacagacugguauugucccaaaggcugcucaaguccuaugugguuaacuuucaaucaccaucaccauccucaccaccaucaccauccucaccaucacuaucacucuucuuaguacuuuuguucuccaaacgaaaauuaggaauuaugaaagcauguuuauuuauucaugcgccuuauccuuuauuuuguaucucaaguuugcuuuucaauucaccagguaaaauuuaugccaguguauauguugggguuuggaauuuuuguuuguuuguuuuucucuuuguuuauuuuggaauuaucauuuaacuacaacauuucacucuucugcugagcccuugucuuuaaacucacugaaucauauuuccuauguauguaucugaacauauuuacagcagcugauguaaagagccucucaguuaacuugcaaaucugaguuaucucagggucugugucuuuagcucccaacuuuccagugccugaacacaucuccugccauuuucuagcuauaacuaacugguaagcaaguccaucaguacucugauaugucgggaauccuccgucaacagcuuugaccguuacuuuaaacuuaaacuguuacaagucugugauuuauaccauuuagguuauugcagaaacaguucuucuggagaaauggaacuaacuguguuaguguggugcuguucgucauuacaaauaauaccuuagccaaggcauuuguguguuggacagcacugcugugaccuaaaugccuccugucacauuugggcagaaguugaaccuccuagccgcuaguauuaagaggcaggccuuuaagaagcucucacauaggcccuuauguguagauuaaugccauuuucgcaggcaugagcagccugcugugugccugcuuacuuuucuucucugucuauguugccuaugugcuuucugccuugcuaggaagcagcucagugguccucaccaaugcuguguucuuggacgcuccagccuccagguccgugagccaaaauaaccuguauuuaguuugugccgugugcaggaucucgugaugaccucagagagcagagcaagagucgccuaagugacucaaggccuacuuuuguguggcucuuuaguauucagucagaguagucccagugaaggagcgcagucagagaacgauccaggcucuuguuuuucccuacaugaccugaccuugugcaauuaaauucauguauuauccaacaauuaagguaugagaauacauuauuacauaauacaguaaccuugcaagccacugaccucagcaugacucccacgcuauccuauuuuguaagaaaggggacacagcugacucuuccugcuaggcuguggccaguguuguccagagcgacacuuuucagaagcugcugacugaagcuucaggagaugcguaugagaugcucagcugugcucuucuguauccgccccagcgcuuugaggauugaugaaaauguuagaugugaacucacuagaaaagagaucuauaaaaugaaucugguuacgaaucaccguuaguuaucauccagacuucugcacuugcaaaccuaucaagucucuuccucuucugaaucccagaaaugauggcggccguacaagcucuucagacaucugccaaacggaacggcacauagcucucgguugucgggcagcuuuggcucagccgggcacaggacagggaaguggaaauggauuuuuaagaagcaggugaaaaggacaguucguuuacagcugcaccagagguucauugggcccaacccaaggucugaagaugagaauugagggugcuucuggagggggugaugugcggggaccuuugauugaaugagugggaaucuggugagagaagugggaguuaaggaagagcuggggugagggaauguaagaaacaugggagugggggaagaggggcuguguuggcuuucaucgagucccuaaaggauggcaagauaugaagugucaugcuuagagaaaacagacgcaggaagcaagcugaugugcuuaggugaggggauucuggcccagcagcccaugcugcacacuuuucgaaggcggagaugcagaacugccuuuaucuuugggaagcuagggccgucggcgcgcuggcaacagcugacaagcuguccuccagguuauucuagcccuuaucuucagggauaauacagacagauaaauaagcauggauacgcagucguaaagucaccgggcuugaacugcugaugccgaucugugcagagaagcacucguaaaaaccuggggcuggagggacccgggcccacaggagggugcaccuugacggaacgggcaaggaguuuugaacucggccagaauuuugcaaagcagaggaaauaaaaguggggccagggaguagcaggagccagggguuagcugaucugaaauccaaccuacuaagaagagaguaauacggggacagugagaugaagcggagaagucggaaaguaaauaagugaggucauucaaucauaaaagacccgugaaagucccgggagauucacuuggaccacaagaaacaaaaaacaaaaccgugccgugacuaagagccaauuacuaccuaaagcuuuaauaugauucaaauggcaagugacaccagaagauugucacaagccacccugagugccccugucaugugcugcaagucuuccuugcucaaggaguauuguuccagauggugcauucugauccccaugguguaccagccugguuuguuuuaauguccuuuuaaaacaaggucucauguuuccuaaguaaaaguguuuaacuuauaacaagaagaguuguuaaugagccuccaccacuggagaaaacguaagaacagagcaguguuggguuaaaggccgggugagagaggccgggugagagaggccgggugagagaggccgggugagagaggcugggggagagaggcagggugagagaggcagggggacaccggggcagauugcccuuugggguaagagauuucuuagagcaguuauuagugguauggacagacagacagagaacauugcaggggcucacaggacagugcagcccacauggcaggaguugggccuccuccuuguagguuucagaggaaaaguauggucucuguaacagaucacgugauugauaaguagucacgggacagguuaugcccaaaacagcucugggggcgggggaaagaaucuagacgcaguuacuccacauaaucauaauccagggcauuaaguuaccguacuucuggcaauggucacaguuccauuauaauggaguagccuuacauaauggcauggccccggcuagcagccuguaacuaugacccagagguuguauuuccaagacugcuuugaagcacugcaaagcaguggagugucguggaacuuuguaagacuucacagguagauggagaggggaggggagggcaugaagaacuucugacuugguuuuuugauggaaagaaaaaggcucaagcuuaugugugguucagggaagacacagggagagagguacagaggcaugaggggcugggggacugggcuuugaaguguaacuuuguuuacacguccuuaaacuaggccaggaaguuaaaccucuuauagggugaaaaccaaccugcuaucccaucuggggaggacuuuuaaaugcaggcgcgccaugugcgcccugcccgccauguacgcccugccugccauccacuccuacaacaggcauuuccgcagguucagucccacucauuuccuugcugaccuuugcugaaugaaauagggucacacucagcuucccgggccugaccucugccgucaggcaucuucucucugugugccugggccucuucuguggauuccagccagacaacagacacuuuacucagugugcuuucuucuuaaaugauuaccaacucaaccaccccauuuccaaauaagcucaccuucuagaagaggagucuaagguuacaauuuugacuucuuuuguuuggacauaauucaaccuguagcaaaagaaauaggauuucuuacuuccgagggaaacauacggagucaaacuaacaaacuugaauucagguagaaaagauugauuuuuuccccccuuuaagcaauauauguugcguggaauggggaaaucuaguaaacauuaaauauuuuuaucugcagaaagcauuugguaggacucucaaugggagauuaauggcuaaaauaaagaaggaggcauuaggagauaaauuugcuuaugagcaagcgacagagacuuacaggggaaggaaauuccuuccagauuggaaacgagugacguacagccccggccaggaagcaguuuggggaccugugggcuuuucacuuuauuuuuauuggacuuuguaauaaaauacagguccucaaacaguccaagacagagagaauaauacugcgagcaucaguaaucaaaaguuauucuccaucauaaacuaaaugacuggaaauaaauacagacacgagacugcaccacgugcuguaauauuauaaagcggagccagggacucuccugugcucucuuuucuucugcauggaugaauauuucuuuauuugauuucaaagaaaaaauauuugagggcuucuagguuuacuucauaagaacaaauaaaugaagaaagauguaguuuuuuuucuaaaaaauguagaaaguuauguuaacuggaggaaaaacuggcugacacaagccgaagguuguacugccauuucuagaauaaagaagagagagacccucuguauuaaauugcucagccaagccauucagugaaacgacuuagguagugaaggggcauuccggaaauccacaguuucugucuguggcccuggcccuaaugcaagugaauacaaacaaagucaugcaugcuagccgaggggagcugcgaagcagagggagggagguacugcgggagccccuuuucuuuuuaaauguuuguuaacauggcucuuuacaagcccguaaacuucagugaucuccuauguaauuuuugucuucccucgagcuaguuaggcaagugggaaauguggucuucagguuggaaucccgccugccacguuuucuguguguaagucacuaaagagaucuucgcuuacucaucgauuucccuguuacuugccagucaaagagucuaaguggauguuuguagguagaugguggaggccugggggugcagcucagugguggagggccugucuguuauguccaagacccuggguucagucccuagccagaguuaaauaaguagauagagaauuaaugcugaaaugccuagaaaacuauuaggauuguaaacuguuaagcaagcaagcaaacaaacaaacaaacaggggagcuggagagguggcucagccgucaagagagccauuugcuccugcagaggacacuugcccuguugucaggguccacauggcaguuuacagccaucugugguugcaguuccaggggaacugauacuguuuucugaccuccaaggccaccaggcauguucgugguacauagacauguuucuauauccucaugcacgcaaaauaagaaugaaucuuuaaaauggaaaaaugucuaaauaauguuguuuugcuuguuuuuaaagaguucacugaccucaaaccucucacucuaccacaagaaaaccugaaauacaaaaguguccgagcucaggagggacuaaaauaucaagcccguguagauggugaaagugcugcugagagagacagucuaggccaacacucuuuagcgagacuuuuaugaggauuuccucaagagcuucauaguuacaccguugauaaauccaacugucagagaaucaggugucagccgguccuggguggacauggcagugggauggcuaguguuuccuuggguccucggugggcauggccgggugauaguuaccagggugggcguggcagggggugguuagugcuuuuucugaaguacuucagaaauggccaugaguacuucuguuuagcaggcaggacccugaaccgauggucaggacaggacucuuucuuccaagcccugcaguuuaauagucauuuaaaaagagccugacaucaguagaaagagaauuccuugguccugugaaggcucgaagccccaguguagagagaugccagggcggugaggugggaggggaacaucggcauagaagcagggggaggggugugggggagguccagaggggaaaccgggaaagggaauaacauuugaaauguaaauacauaaaauaaccaauaaaaagagaaaaaggaaaaaaaagucucaagcuugaacaggacucucgguagccagcacagaacaaaucuguuguuucacaagcugcuuuuguaaguggccggcuugguaggcugagccgguuuccccugagagaucccgucccgugggucagcuggucucugggccaguccaagggcuuggcccacaucagccaugcuguaguacaguguagacucugaaccacaagcuggcacucaucuuuaccuaguuguuguucuucacugcaauacaaacagaccauggcuuuuucuccugucuucuccauguugggugugggguuuguuugggguccugccccguucugggcuauguggacugagaagaaggcuuaugagagagaagggagacagaaaauggguaaauggagacugggcagccagcacgugaggugaggugguagccaucucuuaggucuuguauacaaguuaaaagcagagagagugguuugcucugugggaagcaaggggagacagggccauuguuuucaugcaucucuuccugcuaacccacugggagggagucagaaggaagaacucacaaagcuguugacucuuaugacucuuguuggggacagaugugaaggaaggccuuuuggcuggaaagucacuggaucuguguugcugagauguacagaggcagcaugucccuccaguguguguggggaagagguggagguguggcuagagagugggaggucagccagaaagcauuuuacaacugagaacuaucugaggagucaggcuuccuccgaguaggggcagggaaagcuuuuagcuugaggacugagcacuggacuagcgagucaucccuccucuguuuauucuuucggucaguggggucuauagaaugucuccugugcccagcaccugggacaaaaaugcaauccccuaacuccagacucuaagugaugguggacagugguugcauuggcauuuuggcagugacguguguuucuguuggagauggggagcugagaaaauggaggugacaguguggcuggccuggagaugaagcuaagaaagcccugcagagcaggagugacuuggggcguuguccugcuuguauuucuguugcuguuauaaaauacccugacagcgaacaacugaggagagaaggguuauucacuuacaguucuaggcugcuguccaucacagucaagaguaguugaguaaaugcaugccgaccuauguguuuacauucccgugugcaguguauaaucaccugccuaggaauggcgcugcccacagugggcucuggcuucucacaucaauuaacaaucaagacaguguuguuccccccccccgcacccccccugacugacaugcccacaggccaacaugagcuagacaauuccuuaagauuuucuucccggguggucuugucaagucagcaguugaaaacuaaccauccaaaacauguuagaagcaaaaacaauaguagcuaggaaugaauggccauagaggagcagaggcaagagagccgagagugauuuguugggacgugggauuugggagaaaccagauuguuuacuaagagccaaggccucugcuuccccauguaagaacauccacggcccauggugguuggguuuauuacagaaugaggcauagacuggcccucuuuuuacuuuucuguuuauguaacaaggaaaaacaauacauuaaaaaacaaauucuagcaaaagccacgaggguaaguaggaggccguuuuucuaguuagaauacgugaaugagguucaccacauacauucaagggaagaucugcugccggggcugaaggaggagggagaggcccgccugguucugacuccaguucucgggaugaugcuuccucacugcgacccagggaugagugugcucauuugcuuuuugugaaaaauuuaucaccaaguggggcaugggaaagucagcuuccugugcuuauaagcugcuaaauugggcagggacagccaaggaggcuccaaagaguccacggguugggagggaacguagaucauguugcaccgaaguggcacaaagcuguuggugggauguucacugucaucacaguuugauauuagcacgccuagugaauaauuaaagugugccuguuuauuuuuuaauagaaaggaaaagcaugcaaguuaccucugcguucgcaaugaucuccaucacuacauccgucauacgccgaggccuuuucuuagcuuguauauuggaugacuagaaagcagucugcuuuauucugcaauacucaauaucauaacgccuuuccaaggcguaaaauaaaaaucuguaaaaccaccuuuagguauuuccaguagaguuggcguguccuaaauugaaaggcuauuaaguauguuuuucugcugguuauuuuugaaguucaguucucauuucauguucuugcugguuccucccuauaaucaaacauacuuuaccauuaaucuuguuuguuccuucaaggguagaaugaaaaagucccaugauuuuuuuucuuuuauugcuguuguuuguuuguuuuguuuuuacuauuuauuuguuuauuuaauccaagacaaauggcucagauaaagagcagcucauacagaggccaggagggaacguguacuuacggacacagggggagacacgugguuugugguagccacaugguuugauccucuuaaaggacccuguuagaggagcucaaggcauucgagaccccaggaacccagcaguuacuagcaauuucugaaugagcugagccugcauguagugcaguaacagcucuggggaaggaggacgaugggguggcuggcaucagagagagaagugccugagaagggccaggcagugagccgagagggucucaaagaccaaguguccaguuuccuguccccagagccagaaauggcuugcaggcuacagaaguauuuguuuugggugauguaaccugggcuggccuugaccucagucucccagaugcuggcauuauaaaucucagaaugucccagcccuagccucguaggagacaguggcuuaacgagcugcagagaugggccugcugacacuccuguguccccaguaaacucuuugucuguccaaaguuuacugggcucagaggccugaacauuccguuggagugaaacuuggguucuggguugcuuggcauuuauugccaaccucagucuggagaaauacauuuugauuucagccaaccaugcauuuaugagcuuuggaauacaauccauuuuucgguuggagaauugcauuauuaaacuguucaauuuaauaauuaaagagaggaaaaugcacuugguuuaucugugcugucaacuagcaguuuaaugcaugcagauaacuuggaucugaguuuaaaaccaaauguucaaagauacaaauagagaaaagauaaaaaaccaccaccaccaccaccaacaauaaaccucacauaauucccccagagaccucacguaagacgaagggcgccacugcagaaacaaauccaaauaaaaucagagaacucuuuucugccuggugacaaccuaguucccaccacaucuuauuuccuccucuccuucauaaacccagaugucucuugcuuucuggaaccauuauuaggagauuauggguaaauacugugaguuuucaucuuuguuaguacauuaaaaagggaacguggaagcuugcaaagaugacagccuccagugucucugcaccaaggaagcagaggaccgucuuccuuggucuuuaucacuagucacuuuaacuucugcugccauacuuguuuuucuuuaaaacaacaggcugucuacaaguguguucugcauaugguaacaaguaguggaacuucccuucauaauaguccuauuucagaaaaucaagguguuuuuuguuuuuguuuuaauuaaagaaaugguacuauaaaugaggauugagcugccucuggagccuguaggaucgagauuugaaccguugguuuauaaggaucgucuccuagcgucucuuagugcaggggacuuuugguaagcuguugcggugcaugaugcuguuuuaggacuuagaguuaaagaagaaacagaagagcugaggguuugguuuccuacucuacggagcucaaauuaaauuugacgaaaagacagaguugaaguugaaguaucagucaaguuucuuucuuuucaucaguagaacacguuucuacaagcuugguauaaagucaauggcauguguuggggauggccuggaauugguuggaggaaagcaaagucaaaaucagagagacucuccugaagcuccgcacccugcaguggagaacagaagcucgugugccuggagugaagugcagugcaguggaggauggaagcucaugugccuggagugaagugcagugcaguggaggauggaagugugugucccuggagugaagugcaguggagaacggaagcucgugugccuggagugaagugcagugcaguggaggauggaagugugugucccuggagugaagugcaguggagaacagaagcucaugugccuggagugaagugcagugcaguggagaauggaagcgugugucccuggagugaagugcaguggagugcagugcaguggagaacggaagcucgugugccuggggaguuccuuccagcuaaaauccauuacuggguuguguucugguaagcaauauuucagcaccauccauucuaacaaaggguugucacggucuaagaacuuugggggauccugagcccugcuagcugggguguacucccuucucugaaugaauguggcuuaugggccugugaaaaggcuuaguggguaaggguguuugcugccaaggccgauguccugaguuuaauccucaaaacccacauauuggaaggaaggaauugauucuugcgaauuguccucugaucuccacaugucugucugagccugucauuccaaacucacauuagacuggcaaaguuucucucauccucauuaauaccagacucaagaggagagcccgagcuuacuaguccugccaggcccuguacacagaugugcuccaugcgaggaugaguguuugagcaggcgccaugcaaugcacucagaacucuuccgaguguaauguggguauacguggguaggacaguguuggaaacucuccccuggagucacuuucaauauugcucccucuuuguguggcuggugucugcagucccacaugucagagccacacaacggaaggcugucgagcuucaccccagcuuggaggagacaccaugcucagccugcgugcauccugaggauagcuuauuaauauuucaauaaaguccacgcugggcaagcaugguggcucagcgcguaaugcuaggauuugggaggcugaugcaggaggauugucaggaguuugaggucaaucugggcuguaauaauuagcucugggucaaccuuuguuacaguuggagaccugucucauaaaaccaaaaucuguuaaguggagagccuagguucugccccuuccugccccuucuucacaucagcaacagacaucauuuauccuugcagugaccacagucugguaauguuaggaaaaggagaacagaaaugauauaccccagguuuguucaguuccauugacuggaucaugaaugcagagucagaacuguggucucuacgugagcaggccugguuguguggccaccccagcccucuucagucaggaacuccugcuggcccugguggaucagaaaccugccauggagucucgacaguggcuccugacuccuccuuuccagcucuucauggccuggcacagugucccucacuugucuccagccagggccagaggcuuacugaucauagugaaguacaugacucaggauguaacagcucuccacaaauccugcuagcaaggcagaggugguccugaacuguccccaaaccuggaauuuccucuugacuacuucaaucuuaaaaugagacuuuccccuuggcugcuuacagacuuuucuaggaagauggcccugguagagccccagaguggcccaggacugcuuuuguuguuguuugaaggucuuucagguuauguauaaagcuuuucaaguagggcuuguuccauaauggaugcugaauauuuauuuaauaaaguaauuaaacaaaagcucaugcuuacggaagugcacagcuggacguauggaauguaggucaggaaguugugucccuuauggccauucgcguuuuaagcugguguaccuggugacacuuuauccucuccaucauuacuguccugucucccucucuuucuaguuccucuccccaaguuccuccugcugucauaugcauguuugauagaugauagaucucucccaaaaccuuucuuccuuucagugcccccucuacuuucagguccugagcacacauauauacaaguauaugcguacacacacaugcacauacacacuugcacacacauagagacagacacaugugcacacagugcaagcacucauacagacauacacaugcgugcauacacacacagacagacagacacacacaugcaugcauggacacacauaacacgcacaugugagcacgcauguacacacaggugucuaaauucaagucuagauacuaugugugaaggaagacaugggauauacuaugugugaaggaagacaugggauauacuaugugugaaggaagacaugggauauacuaugugugaaggaagacaugggauauuaguuuuuccaaguccaucuuucuuggcuuauauaguauugauggaagcccuccccaugugacccauuuagagucucccugugaguuaucacuaagguuauccugucccugggccccuugugugucacagcaggauggugagucaucacuagccuccagugugagguguccuugucucucagcucuuucuggucuaguagcuccucacuuggcaucugcagacuugaaugcacaccguuccuccauuuucucucuucaucagcugcucuguguuucuggaggagcugcccaaaaagagacagagucccuguuguccuggaggagcuguccagacagggauguggaaaugucccuccuugacucuucagcaguuccugugagguccugcugcacuuggcuucuaccuguucuuuuuuccccaauaccauguuagcgcucucacauccacguaccagcauuuccuuccacaguauauuuaguuggaccgugcugcuucuaugauuucccagugaagacagaguggagaguugggggccugccuaggcaugagugaggcagaacaggacaugugugcuugugugugugcuugugcgugguaugugugaauacagucacagaaggugacacccauugaaagugaauagauguagagucacugaacuuccagaucugcagaagaaaaguggacgguccaguagacagucucucaggguuuggugugacacagauccugaccacagcagcuucagagcuagccuggagauggggcagucacuggugcuuugccgugucggguguggcaaugcucuaacucuguaggaaauucucccaugcugguaggugagcugccauaguucuaauccuguguguaugcucacaacugggggagagccacagcaauggcaguuggacuggcccagguagaguucugacagggaaguggggaauaggggcagaguccauacagcagagaacauuucuacagaacagugaguuaucuggcuuacggaacggaaagaaccgugguauuaaaaagccugggugcugcauuaaaaaagccucuguucgaaucucaugacaaggaugcauuguuguucagcugcagugucuggggauguuugcaucuucaucagugaugacggccgagguaccuacaggacuuagugauagauguggaacacgcucagguaaagcuuggcucugaaguagcucucagaagacgcgcauggugugcuacuccuacauauaugacccuuuguguugauaaaucuuggucaccacugucagagcuagcuaaggcuggagaugcuuguugaaacagucaaauauuauuagguggaauucauaucucggacugugcagaccccaggugugugcuuguguguacguguguguguguguguguguguguguguguguguguguguguguugaugaguauacaugcaucugugaggccaugcguuugugugaaggccacaaguaaaccucgaguaucuuccucagucauucccaccauguucucguguggcagucucucauuuucuaccugcaucuucccaggucugcuaggcuggcuccagugggccucagugaucgcucugccugucucugcugucucagcgcugaccuguaggugcgggccuccaccuaucuuacuugucagugugggugcucagggaugagccuugggucccugugccugccugugagcaccucgcugacugagccagccacacagcacagcucacaauggaaccucuguccaucuucuaaugcucaucagagccaucuuugaugcucaucagauuuucauguuuaaaaaagcuuuuaaucauuaguucccaggcauuagauuaaaaaaaaaaaaacaaaacccacucaaggccuuuugugagugaagagcaagucuguggcuuccagauguggggacauuacugcuugucugucaccccaagugccuuuuuuccuuuaugggucuaucacugcaaaucuugcuucccaucucaauaauaaauguaacaauugaguugcuauuucuucacuggguuuuacauguuuaaguccucuguguaugcccuucgggucuugauauugcauaaugucacuuaagugcacaaaacguacucucugaauacaugcaccuuagcgggagagauaaugccugcguucaacagcaguccuuacagguaguuuucacaauauuaaauacauaucagaaauuaacuggaggcuugaaaagaagggaguauugcauccgcuggagcugaguuacagguggcugugaauuccucggcuuggcugcugggagcuaaccuugaggcccugucucuggcccugucuucaggaauugugaaugauccaccugacacacugucucaagcuucaggugaccuuugcugguugcacucauccacuaggugagguuuucagagcccuuccccuucuuucuuuaucugccagccccacuuuuggagaaccauagucgcuggugguagcugagugggcaggaaugcagauaaaaggggguugugaugagccguaggguaagagacaugauucugacuugaaaauaacuugggauuagcauugucucugugaguggcuggugaacaguccccgcagcagauggccaccggggagcucuguacaguaaaggcuuuacacugagagcucugcaggcgucacccaucuccagaucugcuaaugggaggccgacaaguucucuaggugccucagagccaucgcccggagauaaagcuccccacagaaaauuuaacacagcuuccuuugugaaaggcaggccacugcgcaaagcaacucuccagacucaucaucaauuguugggggaaaaaagauuuaugaugacauugagguaugauaaucucaaauauguagugcauuguuuuuaaaagcuuuguguuuaaaauucauagcacuuucuaauccugauaaaguagccuaauuuuccagcuggcuuuguucaguaaaauguauuucuaaauccauuuuaagcagcuauuccuucaauuugaguaauuuucucuggaguuaauagauuccacacaagcauaccugacuuuuaauguuaauauauacuauacauuccaaacucgcucgugacagucgcaagcacaaucaaaaugaaguucagcugucuaacgcacacccugcuuguuaguuuguuaaaaggcacuucucucucacucuucuccgccgaagcauagugauaaccgagugaguuuucuaccuagcauggcgguucccucucccucuccccucaccacaaacaugagggcagagaaagcuuaugccggguauagucuuaucauuuuaagaugucuucagagucaucuuaucgguggggacaucgccugauccagugaguccucagagcuggaggcucagcuggagggauggccagcgacaaagcaugcugacaccggugcuuugcucgcuguaauuugguguaugucgaucagugcuuuuauucucugauugugcagaacacuuugugguuuuuaaagaauguuucucuuguuagucauuuguuuuuauagggguacauaugaguguaggucccgucccagccagaagacagcaucagcucccuuggaguugacguuaacaggcaguugugagugacaagauacaggugcugagaacauaacucagguccuccagaagagcaguggaguacuuaacuacugaaccaucucuccagggaguacuuaaccacugaaccaucucuccagagaguacuuaaccacugaaccaucucuccagggaguacuuaaccacugaaccaucucuccagggaguacuuaacuacugaaucaucucuccagagaguacuuaaccacugaaccaucucuccagggaguacuuaaucacugaaccaucucuccagggaguacuuaacuacugaaucaucucuccagagaguacuuaaccacugaaccaucucuccagagaguacuuaaccacugaaccaucucuccagggaguacuuaaccacugaaccaucucuccagggaguacuuaaccacugaaccauuucuccagggaguacuuaaccacugaaccaucucuccagggaguacuuaaccacugaaccaucucucuagggaguacuuaaccacugaaccaucucuccagagaguacuuaaccacugaaccaucucuccagggaguacuuaacuacugaaccaucucuccagagaguacuuaacuacugaaccuucucuccagggaguacuuaaccacugaaccaucucuccagggaguacuuaacuacugaaccaucucuccagagaguacuuaacuacugaaccaucuuuccagggaguacuuaaccacugaaccaucucuccagggaguacuuaaccacugaaccaucucuccagggaguacuuaacuacugaaccaucucuccagggaguacuuaacuacugaaccaucucuccagcacccaacgcuuccaugucauccagacucuugcaccuguauaauaaaacuguggguacccaggccuuuccuuacaaccaggggguacugaucuaaucacugugacucuuguugccucuucccuguaaugcugugagcucuuuggggaaaaaaaaagauaauaugacagagacagauaaagguucuaucuaaccuaugugguuauuacaagggaaaagacaauguauauaacuugagucaggccaucugcugauagagcagagaucuguaaagaagugucucauggggcuagcaagauggcugagggcguauacaucuugccacacacacagcgugggcuccuggucugggaacccauggugggaagagacaaauagcucucaacguuauccaccaaccuacacacacacacacacacacacacacacacagagagagagagagagacaggcauacaaaguaaguuuucaaaaaagaagauggucuggugagauggcacagcaguuaagagcauacacuguauuuucagaggaccugaguucaauucccagcaccuaugcuggacagcucauacuccuguaacucuaguuccaagggaaucugacacagggcucuguggucacugcacacaacaguuaaaaauuuguuuuauaaaacaacauuuggucuacaugguuuauaauuuguuuaauacauuuguguauuaacuauauagauguguucauuucuacauaaagaaucaauucuccccugaauuaguugacacuguaggacauaagaguauuuguacuggcuaguuuugugucaacuugauacagcuugaguuaucacagagaaaggauccucccuugaggaaaugccuccaugagauccagcuguaaggcauuuucucaauuagugaucaagggggaaaggcuccuugugggugggaccaucccugggcugguagucuugguucuauaagagaacaggcugagcaagccaggggaagcaagccaguaaggaacaucccuccauggccucugcaucagcuccugcuuccugaccugcuugaguuccaguccugacuuccuuuggugaugaacagcaauguggaaguguaagcugaauaaacccuuuccuccccaacuugcuucuuggucaugauguuugugcaggacuagaaauccugacuaagacaguauucuacucuguuuucagaguggaugauguuuugauuuuaugaaauugcagaaagcuguuuacauccauuucagaaauacuuggaaauucuguccuaaucccaagcuaaaauucacuuguucuuuuuuuuuuuuuuuuuuaagugaaucccaggucaucauccaaaacagcuuuuaaaauaaaacacuaaaacacuguaauguaaagauaugcuaaguugacaguuacaugcuaguaaugaaggcagaaagaauauguaaagucuuuguuuucugucauuaagccaugaucuguauauuaagagcagaaacuuugaugccagcagcaaaaccaccaggguucuaaggccagcagccuccaggcuaagccagggucuccugggaaguguuuguuggcauuuuguggugcaacuccaugcacagugcaaagugcacauauuguguguucagaccugaggcugcagugaaguuccaugaugcacugcaggcgcacacugcugggaauacuguagcuucauuacacaacuuauuauaauucacuuuugugaacauauagaaaucugucgacauucagaaaccuuuuguugaugcaaauuuuuauugacuccuauauuuuauuaugcuugguuuccuuuuccaguaccauaugucugcaugguuuuguauguggguagguaggcaugcgucgugagcacacacaucugaaggccagggucucucccauccucuauuacuuuuccaucuuauccacugagccagggucucucagucaaaccagagcgcccauguguggcuaguguagcuagcuggcuugcucuggacauuccccagucucugccuuuggagccggacuaacaggugagcugaccacaugcaacugcacuucuucagcguugcuagggguuugaacuccagaccucacaaucgugcugcccacacuuugaccaccgaugccucucuccaccccucugaccaauuuuaaaccaacauuuaaaggguguuggccuaccguaguagcaaauucuuagccugcagagagaggaaacuucggaaccugccuaaggagcuuugcucauggaacucacuuaggagacucacugaagccuuaggcuaguccuguuuaacagagagagcuauugcaauguguguuuucuguugugccauuaaucaaaugaaaagaaagggcaaauaggaauuaugagacuuuauuuuauuuuuuccaguauuauuacaguucugaaauuuauuucaaacaaccaaaauuucagugaaaagaagcuucugacccaauccccagucuuauuuuagugugcaaucaauuuuaacguuuuuugagaaaaaauuucaguauuuuuuuuuguacuaaauucucccagccccguggauuuuacacucacuucacgugucagcguggaugaacucauuucaaauaacccuagauguggcgcuauugccugagacaagguggcccuuugggccacagaagagugcuaggggacucgcagccaucugucuugagcuggcucugacagguucugugaccaauguugacugucacagguugacugucucuggccaguaggaagcccccacuguugacacccuccugacaggucuuuuccugggagugacaauuguaaaccagccaugacaauaaagcuuaguguguuuacaagauuacucagcugaugucccucccaggacuccacucuaaggacuuacgaaucguguugaaguuucuugcucuaugguaaugcugcggguaguugaaugccugacuuugaagguuguuucguugacuaucccaacaaccagggauagcguuaaaaacuguaugcauugacgucccucauacagugauuagggaggaggccugcauucuggguguccuauuuggaaucaguaggaaauuucagagaauacgagauacaguuuaaaaugugagaucagauaacuauauagcucaucacugugugugcgucuccuuugucagauaguggauacaccccagcucuuccucggucccuccuuccuucccucucucuucagcugguucucacacuaccuaacucagaguagccucaaacaugcaguccuccugccucagccuccugagugugaggaucacagggcuguguaaccacgucuggcucugcaguuaguuuccauugucuccucuuucgucccugugaccucaccguuuuguuguaguccacucggugccuauggcagggccuuuguucuugucccagauguccccauggcucuccuuccucagccucacacaggagagggcaaggagagggcgagacccuaaaaugggggcuggggguggguggguggggacuccaacauuuuaguuuggaaauucuuuguagauuuucacaccuauuuucuggacaacuaacaauauauaacaauagagacuauguacagaaaaguuuaagaccccagacauucacuauugugauucauaguucaaaaugcugaacaaaucacacuggcuacuugaguuaaguaaagcuugucuguuuugaaauuugcaaaccagccacgacaauaaagcuuaguguguuuacaagauuccgcagcugaugucccuccuaggacuuaugcagccgacguucacucuuaggacuuacgcagccgacguccacucuaaggacuuacgcagccgacguccacucuaaggacuuacgcagccgacguccacucuaaggacuuacgcagccgacguccacucuuaggauuuaggcagcagcagacuuuacuugcauuggucacucacuaguuuccaguauagucacaguucuaaaauuuauuuuaaacaaaauauuuuaaauuaaaaggaacuucuggaguauaaagcuaucacugaaagcccccacccccauguggggcaggauacugagauuucauguuagccagaauggcugugaagucagagagggccuucccaugaugcuccuggcucacuucccgaaugcuggagcugcaggugugagccuggccggguguagugcugcugaucacccaugcuaggcagucacuugacccucugagccacgagcccauccagacugcugcugguacggcuccaucuccccacaacacuacugccaguuaccaagaacaaucuguuuugaaucacgcugucuuguauuauucuuugugaccacaucuucaucuuuauuuggaggagaccaacuucaaggcaugugguuuccaugagccaagcacacccuuggugucuuagagacauuucaaacccugacauuguaguugccuucugguucccauucugucuggcuaugccugacuucuuacggugcugccucacucauacgauggacuggacacaggggaaagcacuaucagugcugugucugcagagacagagacagacagagagagagagagagagagagagagagagagagagagagagagagagagagagagagagagagagagagagagaaaagacccucaccucccuuucuuccgcccccuuucucuucuccucgaccuucucccuuucugccugccauccagccugccugccuguccgucuguccaucuguccauccaucuguccauccaucugucugucugucugucucuccagacauuuccccuuuucucccacgggaagacauucuauggaucacgugcccacaucuugguggaacgacuguucuuagauugaagauuugcauuccacugcugcguccaacuuccuucuuuagacauuuuucaaccaugaaauuggaucuuuaucucucacccuaaauuauuuuuaagcucauauggaacaaacgagucuaauagguuuuaaucuggugccucauacuuuuauacauccuguuuauuuuaaaaaguaucucauuguggauuguaaguguaaauuaguguuaaaaaaucaccauuaaaaaaaaaaaaccuuucccacuaccucuaauggguaacuucucagggagucacaggaagcacaaagcuaaugaacagcgugcucagcggcucuuauuguaggguccaugcgacuucgcuuagggacaggcguucuccggcaguagucgaauuuaaacccuauuuuucauuaguaaagcacacauuguuaauaacagcucccauuguguuccccuuugugcauugaagcacauuuuccaugggcacccaggcuuucaggucuuacuagaaacugccuggaucauaaauaagauuuguucaggaaauaaaaauguauguuuucccauuguuaguuauacuuuaaaaaauaaucacaucugaagcuuauuaugcagcaauagcccuaagauauuauuuuuguaaauguacuacuuuggucuuaauacuaguuuuuaaucucuucuuguuucuaugaagucugaaugagauuuugaaaauugaauaauaauuugauccguuaaucuuuugaagcuaguaauuuuauuuuccucccuuugcagucucugaggcucgcaaaugaauagggcuucauuacugcagucugcauuuaauaaccauuauccauuaucuuguaauuaagacucccuguaacgaaucaugaggacaaugcaaaaauacauaguacauuucuuuaaugaacuggaaaauguucgucuuguucuauuuaguaaugaguugcugaauagucauuaaauccacuggagggucgaguuagauggauuuugaagacugucuugaguuugugguuaaucuauuagaauuaaaauuucaucuucuauuuuuaucaacagcugauuagaagucauugucuuugaccaaauugauuagaagaccauauacaggggcagcuguuguuuaauggaaguuuuuaaugaaacaguaccauggagacuuguaauuacaggcugcaggaaagcucugaguagccuuagaccacaagaagagagcugagcuaaaggugccaaaugaggaaaauaagaaauacaguuuuauguaaagcaguguauuuauuauuaauuuuaauuucagcuacucacaguugagcacugguccauugauuggaccacuccugaccgucucaggccuuucccaccuaguguuggcauuagcucaugucauuaaacuuguggaccagcuguaggauagcuuaugcugauggggagguauuuucucuuaagguucuggcuccuaaacucagcaugagggaggucugguuggccagauucauacacgcucugaaguagaguuggcuauggcuagguuuacacuagcucugaggaaggguuggcuguggcuggguuuaaacucacacugagguagguuuggcugugacuggguucacacucacucucaaguggguuggcuguggcuggguucacagugcucugagguacaguuggcuguggcuggguucacacucacucugagguaggguuggcuguggcuggguuuaaacucacacugagguagguuuggcuguggcuggguucacacucacucugagguggguugacuguggcuggguucacggugcucugagguacaguuggcuguggcuggguucacacccauucugagguggguuggcugugacuggguucacaugugcucugaggagaguugauuguguuuagggcuuuugaugauucugaaagcagcauguauuucucugagguaguuuuguuuagcaaagggcaggagaaauaauauuaaaacgagaaaugaaacuaaaguguggcucccuagucucacuggcgaguccaguguucuucggcagugggaaagcacugacaggauguauuuucuaaaauauucgguguaaucaaaucuugauuuuuuuuucuuccugaaaucuaaugaaagccaguuccuaaaugccugaacuguaugcugugugauucucugucauucuucuuccugauuuccaugacagacaguaaaugcagcagcuaaaaacccuggagucaugugaucagaccucaugcugcccucaggacagaagccagauguuugcagguucaaaacccucuauagugauuuaauguaagaaacauaacagaagcuuugaugaaacccugggcuucacauaugcggaguugucccuaggccaauaguagcaucaccuaaaacauacguuuauauaaucacuguguccccuaacagcuuacuuacguggaggcagugccaccucugcuuucagagauuaugucugauggccaggcucucccacagacccuaucuuccaguuucgucugucacaaauggcgcccaugcaucgccccugcaucaaucuaguugaagggauuaauucaaacuuugcaguucuuucugaccaucguaucuaucugacauauuccacaguauuccuuguauauaccauaugcguuaugcauucuaauuucaguucacaccugaugucuaggaaggaaggaccuagcauggcccuuaauacuuccagaucuugcuuuuccaugugacugugacaauagauugauggaugcuucugagacuaaaauguaaagagacagaguccuuaggaaagacaaaagcuccaaaaacguggggagaacuucagaaguuauaaugcugguguaauuccaguaucagaaagagaaagaggauagggaaagggaggaacuguauagagggaauauaauggcuagaaauguuccaaaauuaaggacaggccauaaaucacagauuuaagaaaacuagagacugacaaagaaaauuguuccuagucauggcauauacaaauaggagaaaaucaaaggcagcagggaaccuugaaaaacuaaagccagagaaagaaaacauauuaccuacccaagccaaaggaaaugaccccacagacaaaggaaaugaccucaacagacaaaggaaauggccccaacagacaaaggaaaugaccccaacagacaaaggaaaugaccccaacagacaaaggaaaugaccccaacagacaaaggaaauaaccccaacagacaaaggaaaugacccccaacagacaaaggaaaugaccccaacagacaaaggaaaugaccucagcagacaaaggaaaugaccccaacagacaggaaaugaccucagcacacuucucaucagaaaucaggucagcaaugagugagggaaagaaguucuucacaguggagcucuguaacaguggugcugucccucuucucugaucuugagcagaagccgagggaggcagugcuagaucaucuuccucacaggagguguuuaaggaaggccuuuagggggaaacuccaaacucaugagcaacagcaggacuuugacagacagaagaaacaauuuaggaccucuuuauuaaaaggcaaaggcauaguagugucguguuauuugaagacgggcugggaugaagugaguauuuacuacucuggggcagucucuaaauaggauaugagagaaguaucauugguaugaugagaggaaaugaaauggaaucauguagaaucuucaaagaagucagagaagacccaaaaggggguaugaaaauuaaacaaaaauguaacagauggaagagauauaacaugguagauauuaauccaacagaaucagugaucauuuuaaauguuaauggucuaaauauaucuauuaaaaggagagucuuaaacacacacacacacacacacugagcuccuaaugaauguuuauaagaaauccacaauaaaggcuggaagguugaagugaagggcuccuucauugccaacacuguaccuugcuccuuaucuccccacuguucuuucuucuucccuucucccugcagaucggagucagcacagugagcaagagcccugccacacucugcauguuauucugccucgagauuucuuucaccagaaacaucaggcaguuacuuuggaauucagccuuccuuaggcuucccagacacaauucccaagagucuuugugaccuccaaacccucaugaacacucucuuuccugucuaaauuucucguggcauucugguuuucuguucucccuucagaaugacccauaaucucugcugcuuagagagauugggggccacugcccagaugcuaccacagaggcccuaccuaaggccucugcuucguuuguguguguguaguccuugagggacuugggagcuuuuacauauauuaucccuucugaugccucguguaacucucugaagcaguagggguuuucagacccauucuagaaaggaggaagauugaaguggcauggcuaccguguaagccagagcuggacaccaggcugacucccaacccuugcugucauacuccaggguugccauggcuuuggagggaagagcgaacauuugcuuggacauuucccagcauguauaauaaaggcgugucuaagugagucuuccaggguacagaauagcccuggaaguaucuuuucaaaacaacuauaagggaagauuuagguugucuuucauguucuggcccacauuucuucgauagacuuggagagacucuaauuaauuguaagcauuguugcacagauuccuuggacagagcuggaaacuugcacccaaguguauguguguuuuugucaaagucugagucaguuggucuuuguugggaauccagaacaugggucucuuucaucuaaaaaugcaauucaguuaagaugagacaaauaaacauagaaucaccaugugacauuucaguagucauacuccuugggauauucagaucugugugaauauauguauucagucauuugucuccuggugaaugaaagcauucagagcucacacucuaguuuuuuaaauguguauguguguuuguguggugugugugugugugugugugugugugugugugugugugauacaguauacagcaucgugauugguuuucacccuucuaggaaguagcacccagaacuuucuucucuagccauauauggugguccuauacugugcauggaugaguuggauuuugagcacugcugggcuagguaccaccugaaggaagguguuuccguuuugacuugcuguguggccccagauaaaugggacaauucuaacagauaaacuaagguaaacugcuuuagcugaaaugacucacacacacccauagagaaagggagagagggagggagggggagagagacagagacagacagagacagaaacagagagauagaaacagagugagacagacagacuuuguaccaugugacuucagaagagcuacuuagcuucuccaugucucaguggccucuuugaagaucauucuuguaucggugccugguaacagugcugaggcucugcuaugcuccugacccccauggugcacuggggugcugaucccugcugcuguuaucaugugucuccugcuguuccuggaaacuacacaaacagguuuaagacucaagagaagggaguuguggaaaacaucugccagcuaugaaagggucccuaucuuuugugaaauccucaucugugugggaggucugcugcuucguuaaugcaacagaagucagccggugacaguucuggggcugucacaccugugcugugugugugcucuccuccgagugugagugagugagcgagcgggagugacgaagccacagugccgugggacgugucaggauacaugguagugagcacagggcauaaaauuguuaugcauuaaacaaaccaacuugauuuuaauuagcugugaaauauagaggcaagaguaccagagucuaugagaauccaucgagugacuaauuuaauuuaucugguggugaaagacaaaauucuuacagauuuuuuuuucauuuuauacaagugugugauguauuauuacucuucucuacccuuccuauaccccacccaccuuccuaugcccugccuaccuccuaaacccugcccaccaucccuauaccccgccuaccuccuaaaccccacccacccuucuauuaccugcuucuugcccuauacccucugucaaccaugugcuccucccuuucauacguuagugucuuccagguuuguuugugacccauaaguuuugaccagggucauguaacuuuggguuuagaacugucccucggugccugcugggcucagccauggguguuaaaccaacgacaaugacugcccccuccccagaacugaccagcagcaagaaguuuagcaggaagaguugagucucauucguaacugaggaaugagggcucagucuuguacaggccugggcgugacagcuucugcugcugagggguauaauugccguggcugugugugcccagaagacagcaauuuacaggucuucucccuuucuucuggcuuuuacauagaaacaguuauuuuaaagggagcuuuucauuuuaguauuuucacauaauuaccaaaaaacaaaaguauuccauggugggggagaggguugggggcuuggggggggcguguugcacacaacucauuuccuucagugacuuaaguguaaaaaguaaguucuaauuaaccugggauuuuuccuugcuuuugucuuaggaucagauuuuauuaagaccucuacuggaaaggaaacaguaaacgccaccuucccagucgccaucgugaugcugcgggccauuagagauuucuucuggaaaacuggaaacaagguaaguuguugccagcaaaccuuccuucaaagugaagaggaugcuauuuauaacccuccucacagcucacaggauaacuggcucccuaugccgaagguguggaugagucgccuuuauuaagauaaauguuuaauuuaucuuucauuacaaaagaacaacucaaugggggaaggcaugcgauuaacauagugagugugagugugagugugggcgcacugugugaucaagagguaaacucacucuguguccuuuuauuaacugaagacaguuucagcacugacgagagguuccuaaaugccuucuuuaaggaacuaauugugcagcaacacagagguuuucuggcaaggcguuggcuggcgaaaacagguuaauauagagauuuaacuuccucccggaauggaaagaaucguggaguaacauuuauugaaugauaagcugugguggcgauaggaaaaguaggcaggauaaugggaaaucaucuucuccugucauuauugaaggacacacguaaauugguuuuucuguugggaaacccccgguccagaaaaacuuauuacuuuuaauaauaugaggugaagagaaaauucucgaggagaugaacuuauuaaacagaauaaugaaaugccgcguaacagcagggaaaagcuagcuuccguccuauagcucuugaauuaaauauccauuuuuguguguguguguguuuuauggaagguggacgugcuguuuggaagagugucgagcugaggaggguauaugcuaccuuuugucagcuuuucgaagaauaacacaggauuuuuugaaucguacgaaguaaaaaggaaaaaugcauacgagguguuucuuaaaaacagaauuuggauuuuucacuucaaguugcuugccuagucacaaauuaucuaagaaauuuuuuucauaguugaauaggugucuaugugugcaugcauguguguguguguguguguguguguguguguguguguguguacaugcauuuaauauaaugagacuucccuucaugaggggcaucuuuuaaaaaccaauaucuugauuucugacaccuagaccuccccucaagcagaccuuuaauguuuuaccuguggacagaaugucuuuaugacucuauaagugacuacagcuuagaauuauuuuggaauuagagacugccauggaaugugcuccuugugagaggaaaucucuccuagaauuuauccgcagaggacacugaucccaccugcaugcuacuugguggucuucagcauugauacggaucugucaauuuacugaauguguuccuguuauuguugguuugguuugguuucaaagagaagcuguguaaggagagauucaucuuuccccuucaguuguaacugucaccaccaguuaggcccaugggacuccuugcugaggucguuucacaagcuauuucugcugggucacagaagguuucugauaaagcguuggccuaaggaugucaaaaucagauauucagcuggcuaugcacguggguucccaggcucagccuuagcggccauggggcugcaagauucccucggcguccauguguuuucacgagcgucuuagagguaaagcauauuuuugggaacuaaaggaauaguucuugagugggugaucaugggcgaugcugaccugugguuauucucagguguaaacgucaugucccuucccaggacagcuuucagacagcacaaaacaggcaucagagagcaaggcaagagcuagugguccaggcuggaguugggagagcuauuuggcuugucuuuauauacuuucuuuaugguuguucuugccccccuuaauguuaagacaagaccaagcccaggacacauccaguuugcuuuguaacauucgauaccuagcaaggagaaccuguuuauacaccugggagccaggcauggccuuuaaguuguugacagcaaggcuaagaggcaguguacugugcuucuuccuccuucacugaugcaagcccugugguaugggacaaaagcccaccuucccagucugcacuuggcgcugccccugagaagcuacaguuuaauauuucaugacugaguucaucacagauuuaugcuuucuauauucucucccuuaaacaauauuaacuucuauaagaacuucuuucugaaaacauaacugaacaggguuguugacacuggaauauguuuauagaaaaucucuuaggaggacugcccaaccugcagaaagucuccucugucgccacgugugcugcugucggcucaaggcuucaugcgauuugguuguuugccauuccucaacaauggcuacaagugcccuacugcugagcuagcugucuguguguuacugaggcagggaaccacuucgcuccauucgugacacugcuccgggacaguggucagauucauagggaggcuucugguugcucugcggcaguggucaaguucacagggaggcucccuguugcuuccuuggcuccuuucuccaugcuauucguggugccuccugcuugugugaucuaucugaagaaagccccaguguggcuuggcagcuuguggguauagauuuguccacucuuuuggaugguuauacuccuaggacaggcgaauccagggcaucaugagauuacuauacaugggaccuguucuuuucuuuugcuuuuucuuggauauuuucuuuacuuacauuucaaauguuaucccccuucccagucccacccccugcccccagggaaacccccuaucccauccccccucccccugcuucucugaggguguuccuccacccacccacccacucccaccuccccgcccuccauuccucuacacugggacaucuauccagccuucauaugaccaaggaccucucaucccauugaugucugacaaggccauccucugcuacauauaugcagauagagccauguguacuccuugguugauggcuuagucccuggggguucugcggggucugguugguugauauugugguaccuccuaugggguugcaaaccccuucaacuccuucaguccuuucucuaacuccucuauuagggaccccaugcucaguccaaugguucgccgagagcaccugucucuguauuuguaaggcucuugcagggcaauuggauggaacuagaaaauaccaucccgagugaaagaacaaaaagaacacacauguuaugcacuuacugauaagugaauauuagcccaaaagcuccaaauacucaagauacaauucacagaccacaugaagcucaagaagaaggaaaaccaaagugugagugcuucgguccuucuuagaaggagaacaaaauauucacaggagcaaauauaaagauaaaguguagaggagagacugaaggaaaggccauccagaaacuguccuaccugggauucauccuauaacacaguuagugucuuagucaggguuucuauuccugcacaaacaucaugaccaagaaacaaguuggggaggaaaggguuuauucaguuuauacuuccacauugcuguucaucaccaaaggaugucaggacuggaacucaaguaggucaggaagcaggagcugaugcagagaccauggagagauguucuuuacuggcuugcuuccccuggcuugcucagcuugcucucuuauagaacccaggacuacgagcccagagguggcaccacccauaaggggcccuucccccuugaucacuaauugagaaaaugucccacaguuggaucucauggaggcacuuccccaacggaagcuccuuucucugugauaacuccagccugugucaaguugacacaaaaauagccaguacaauugaccccuugucaacuugacacacaaaaacaucacuaguaagccucaacccuuaguucuuauucauccccacgaucuaaauaacuuuaaaaguuccacagucuuuacauauuaaaaguucaaucccuuuacaauauccaguaucuuuuaaaauacaaaguacuuuaaaauucaaaaucucuuaacugugggcuucacuaaaaaacuuccuucaagagggaaaaauaucagggcauagucacaaucaaaagcaaaauucagucuccaaccauccaaugucugggauccaacucacgaucuucuggccuccuccaagggcuugggucacuucuccagccaugcccuuuguagcacacacauugucuucuaggcuccagccacuuguaccucuguacugcugcugcuguucuugguggucaucucaugguacuggcaucuccaaaaugcugcugucuuccacuguaacuuggcuuuaacaauagccucucauaggcucucuucauggugcuaagcucaaauccuuugcaugaccccuucaguccugagacaucaauugcaacugaggcugcaccuucaccaauggccuucccuggccucucacagugccgagucucagcugcuuugcaugaccccuucaugccuucaaaaccaguaccaccugagugacuuuuacacauuaccaagucccacuguagcacgagggacaaccuugguuaucucuggaacacagccucugugcucucaaaaaacacuucccagaagaugucacuucaaugaugcuggucucuucuuaaucaccacuaauuucuuagcuccagcuaaccagcaucaguagucccaguaaugccaaguuuuugcuuuagcaguucugguaucuuguuaaucacagcugauucuucagccccagcuaaccagaaccacagaaucuucacaauccaaaauagcaauggcccugaaguaagucuuuaauuuucccucugaaauuucacaagccaggccuccauuuucugcacuguucucaacaauaucuuccaagcuccuucacaacaucugacagagcucuuaacaacgaauggaucuucuggcccaaaguuccaaaguccuuccacaguccuccccaaaacauggccagguugucacaggauaccccacuaugcugguaccaauuugucuuagucaggguuucuauuccuacacaaacaucaugaccaagaagcacuuggggaggaaaggguuuauucggcuuacacuuccacauugcuguucaucaccaaaggaugucaggacuggaacucaaguaggucaggaagcaggagcugaugcagaggccauggagggauguucuuuacuggcuugccuucacuggcuugcucagccugcucucuuauagaaccaagacuaccagcccaggguuggucccacccacaaggggcccuccccccuugaucacuaauugagaaaaugccccauagcuugaucucguggaggcaucuccccaacugaagcuccuuucugugauaacuccagcugugucaaguuaacacaaaacuagccaguacaguuaccaaacccagacacuauuguggaugucaagaagugcaugccgacaggagccugauaaccaguucuuuucuaauggauaucagacauaauguagaagcaacuuaaauuggcugauuucggcuaugucuuucuguuuuucuuaaaggauuuaugugugcaugugugcauacauaccugugugucuguaugcauccuguaugugugggugccugaggaagccagaaaagggcuccaguaccccuggagcuagagccccucaacaugagugcugagaacugaaugcacguccuaugaaaaagcauggguucaagaucacucacagccaugaauugggcuggcuuaugaccauccccauauaccuucucccaugcuugcacuaaugguuggccugcucuauagaacuccaugccucaugguacagccucagagaagaagccugcaccucugaagcaacugucaguucuuucugcugacggcugccaguuugauuagguugaccuuguggccacacggaucccaucuuaaguacucacguacuuugcaccuccaggucaaggcucacuggaucaguguagacaggugaaggcucacuggaucaguguagacaggugaaggcucacuggaucaguguagacaggugaaggcucacuggaucaguguagacaggugaaggcucacuggaucaguguagacaggugaaggcucacuggaucaguguagacaggugaaggcucacuggaucaguguagacuggauggacacccgugguguauuuuaucuauugacacuucccuuggcuucuucagauuuagccuagacaguggagguuuauggugugacaugcacccucauucuugccccuucagaagcaguggcccaguucccauuugucuuggaaaaguuauuuugaaguuugcucagguaaggcucugcugaaauaggccccucccuuugcugaggugaaaaagucuaagaaggaaagggugacucaagacacuucguggggacacuuuugaaauuggccuggugacaguggcugcucuucuuuccuccuuaggugggcuucaagccugccggaggcauccgcacugcaaaggagucccuggcguggcucucccuggucaaggaggaacuaggagaugaguggcugacgccugaccucuuccggauaggggccaguucucugcucucagacaucgagagacaggugagugaagacacacuguccuuggaaggaguggaggcugaccacaucagaacugagcgagucuccaccuccugcaagggaagcugcaucaguuauauagaucagguguaaauucugcugaaaggcguacuaacgcaguacggagggaaguuacuauugugcaauaguguaauuacuacuuaauguguaugcuugcuuaauuauuaauuaacgaaacuggcuuuccucacagauuuaccaucacgugacuggacgcuacgcggcuuaucaugaucuuccgaugucuuaggucagcagccaacccagaaaagcaucuugcaacaaauuguucaaaaaaaaauguuuuugcauaauugcuaagguuauguaauuuuggaacagcuaacugacuuuccccauuaaaaucuccccugaaaucaacucaaaacaauaaagggaaacaaaccagcugaaucuaaauguggauucagaucaggaaagguugaaauggucuucguuaccaggaggucuacauuuauuaauuuugugaagauucccucugaaaaaaacucagaauaaaauguuucuaguagccuguacugcagaaaauucugaacguacagugaaguuaaguugccugagaccugagauccuagggcaggcagggcuguggagggaagggugcuugcuaccaaaccuggcacaccuguucagcucugagcaaccacaggguggacggggagagccggcuccaaaggcuggccucugacauucacacauucguguccccuaccucugacacauaauaaauacacuuaaaacugugauaaaaaugagaaugggugcuauagcaagaggauacucugccccccugugcugccuaccaauguggagcccugccccggguguccaccugacucucugugcuauacuaaacauuuaguaauuguuuugcuaaugagauugugauguuguugcaagaaaauguggauaucgcugaauuuuuaaauacaaaaaaucucugugcuuauuuauuuauuuuguuuauuuucggcggugcccugggggugggugguaugggcuggaacuuaaaaaauccuuccagcaggaggagguguugcuaguguugguauacaucuuuaacuccggaguucagguguagagccagguggaucacuaugggaucaaggccagccuggucuacagagaaauccugucucaaaaaaugaaaaaaaaaaaaauucugggagcaucuccugccuggcuugggagcaccuccugccuggcuugggaggaccuucugccuggcuuggaaggaccuccugccuggcuugggaguacuuccuaccuggcuugggaggaccuccugccuggcuugggaguaccuccugccuggcuugggaauacuuccuaccuggcuugggaggaccuccugcccagcuugggagcaucacucugccuggcuugguggucuuuguugucuuuaucucuuuaaauuauuucuuuuaaugaagaaaaauaaaaacugggcaugugguggcaucugccuguaacuccagccguggccaggcaucuuucuuugcagugagucacaggcucuugucuaaaaaucagucagacugcaucuaaggaaggacacaauggcugaccuccgcuucccccacacacauaugcacauauacacacugugugcacauacacagggaaggccaagcuuggagaaguagccacagucuagggauggcacgcuuguguggccugugagagaagccuuggacuuugauacccaggacuccaaaaauaagcaaccagguuaucagcaagcuagaugggaauccugcugcgucggcaguuacuuuugagggucaccuucaugcagcuaggaacccacaaacagcugugacaugugccuggcuucauguucugcaugucccuuugcucugugacuccuucuucccuccagcuuuugucagcuugcugacaucucuaccaccugcagaaccugagccuuggaaaaggagccuuuucauugagucucucugucucucucuccuuccuucccuccccuuccucuucuuucccuuccucaccucccucccucccuccucugaauaccucugcuggugucacgagcagaagcacaccggcuuuggucagucuuguucaucucuccugcacugcugcccagcccagccucugcuucucucuaggaccucaguccagucuguaugcauccuuugcccugugucugccucugugaagggaaggggugagggcagaugacauaacagagcuuucagacccaagaccaugucacccccaaggauaauuagaacaaauccaagaaaauguuuuauggcuagaaagagaaaacacuuuguaccgaucuaaauuagaauuugccucucgggagucaauuaagcaauucccucaaagcaccucacuaacuaaaggaaacaacuaacacaagagcagaaaagaaggccugcuucccccagcaccgaggcggaguggugacgccuggcuugugccuuagcucugagugcugcauccagauucguaauguuccacccggcccuggugcucgcuagcacaguggucagucaccuuuggagaagaaucauuauggaaaauaauuacacccaucaccuucagaacuauucuaauuucagugggguuucuguuuuccucccauuaaacccagcuggucauuuuaguugaucaagugagcgggcaucauuaucuucaauuuuaauuuauaugaggcauccacuggaacugaccccuguggacaauugugaugcaugcaggaaacuaagacuggugugucucucaacccucucugaagcugcugaguauggccugguccagagguaaauaauguuauauuuugagggacaauuuguccuaaggacuuugggacucuucaugagacaugcuuggcccuucuuaccugacugcuuaucgacaugcugcacagaugacuguaaaggguccuagcugacggccguugcuauaaaacacaggaacaggucauuucuaaggugaccauguuuuccuauaaggagaucuguguacuuccgaguacugggaagagcuguuuuacccagggugggaaugacugccauguucugugugaaaagauucaguuuaauagggacaagcuuucucuuccccccaaauggucacaguguugcaguuaaacaugauaggccuaagcuuuacucuuaacacacucauaugaaaugggggcuuaaagggacuuagaaggcauguguuaaugacuucagacccauccuagucuacaaggagacuacacagugagaugcagucuugaguugaagccagaauccacaccagcacaucuugagguauuugacaggacauggucaaguuuuucaaacugaagugcucuucuugucuuuagauuuacccuaccauucaaaauuaugauuguguaguaacuucgguuuggcuuaguguguuagaggccaccucugccuagccauuugauaacaugguugaguguuucuguugauuauaaugucauaauuuuggaugaccugaaguucuacaauuuuuuaagagauuauauuuguuuuaggaaaaaauuauuugaguucuaauuuguguccacauggggagaaaaugacuuguguaaucacagagcgguuuuacaauuacggauucuuggcuuaauucuggaucauuucgacgcuaaugagaaaugcagaugaauuagcuugcaugaaaaaacagaaagcgcugugcagaaacugucagggacaucugggagcguguccacguggcaagucauugcacgcaaggucuugcgugagccaccacuuuacugugucacaaacagacagcuuccagaggccaaaucaguucuuugggaagcggcaaaguacagugggaaacagauauucacacagacggggucuguuuguuuucuguuucucacacaacgcaagcagaaugcaaagcucugaagaagggaauuuugaauagaccuuugccuucacagaugcugagcuauuuggcccauuuugucccuggaacaagcuauacaagaguaaaucaauuucaugugcuuuccuggucauacucaggaguuccaucucccaaaagaaaauaaguauuuuauaaccuccacagagugaucucuuccagaaaugaccacagauaacaucuggcugauacauaaaauaugcaguaaaaauaaucauauuuaauugcucaaaaccugcucaggagagaaaguggaggguauccaucuggucaguucuuauuuaaugggacaaaugagaaccaaaugcuuaaugcaagauaugugaaagacggugaccuuacaacgaacuaaaacuuuuucaaacauaaagcaacaagaacaaagaggaaucuguagaaaagacaggccuaaaauuugauuuuuagaaaauaaaucuuggggcuggagagauggcuuaacaguuaagagcacuugcuguucuugcagaggacccagguuugauuuccaguacccgugucacaagcaccuguaacuccuguuccaagguauccagugcccucuucuggcuucuguggguaccagcauguggcuuccacgugcgcagauacacauuaagcaaaaugcacuuauacauuaaauuuaaaacaaaacaagcucaaaucauuaguuuuauggcacuaauuucucuggaggaauuuugggaaauguuuucaauucauuugaucaguaauaugaugcuguaguaacauaacauuguacuuuacucccaggauugacaggaaugagguaaagcuugaaaaauucacuguauguaaaggaacuggguauguagcccaguugguagugcauuugucuagcaaacauaaaccugugaugggauucccaguaccacauacaccaagaauggugguauccaucuauaguccuagcacuuggggaagaagaggcaagaggaagguuaucuuuggccacauaugggguaugaugcccuccuggauuauaugagacugucucagagugaagaaaaaugagacuucuguauucaacuuagcaaagggaaguuaggugaauugugagccaauucaguccugaaacaugccaucaaggggguguuucaaggugaucuugugcccugaguagaucacccuuugauuggguugcuuuaugcugccaaccuaaagagucugcaguuuaagacuggaaauugagaccuuacaucaagauacagauugggauacuggaaccaugccugggaaggaaugcuuguccucaacucugugagugcauccuugagccggucaaacccacuggccacagggcuguaucccugugcaaccccaggagugugguguguuacucuggucuucauauccuagaguaggagugggaaagaugguagugacaccaucccuuaaucuguucacagugaacuugauuccacuuugggcuuucaaagcaagcguuggagccgagaauaaacacuuuagacgucuuuagaaucauuacccuugaaaucuccgacggauuccagcaaacaagcguggugagacccagcugcacuuccuuuuaccgaauuggaaugcuuagcuuuugaugauucaagugcagucaggugcuuaaugccgagccuuauuguaacagacgccauucuucaacuuacauuugggauagauaacgugcucuagggaggcacacuucacagacaguuggcuuuuuguuugaagguucuguguagggaaccccuagggcuuauggaaauguuaggugcuaaguguguucaagaguuuuacguuuuuugucuuuugcuuuuuaagcgugugcucugccaauacugugcauagccgggcauuaguaacaacaggauucuacccuaguauaugugcagaaagggugcuuaugauaucccgagcauuguacagaauguuggaaguauaggaaggcagcuaagaacacuguucaaaccacuccguaaaacuauagucuugucuugggcacuuggcuccagaacuucugccaugguggcaaagguuggcuuccucacaguuauguuggauaccgaguuucugggucaucauuccauuuguuagggaucgaaucaccugccuguauccuggcaacccaggaguguggggaggcacauucuggcuucuugggggauaaacuacauuauauuucuauugauuaucaacuacaguguagcccugcggugcugggcagagguuuuugcuucuggugguaaaggacuaaguaucacacaguugcauugguguucgcugaagcugagcucucagaccugcccucaucucuuggcccugugcagugaguucaaagaagucuugcggcauccuuugcgaggggacuuuaauuagugauguuuacauuuuuauuucuuauguuuuugguugugagccuagccuuuaacggcugagccaucucuccagcccuacauuuuuauuucuuuacaugacuaucuguuggcuucuaaucaagaguaacaauuuuuuuuucugcaauugcuucccucccgcuccucuuggugacucuauggguuuugcauuaagguuguuugacuuugaagggagcuuuggcuaaacgucaugauuuccccuuaucugaaaugauuuuaucaucuguucuuccagguggcgcuugagucagccacugagucuagccacugagucagccacugagucagccacugagucagccacugagucagccacugagucagccacugagucagccacugagucuagccacugucuugucuucuuuuccucugaaccuuugcuaccauauuucugaacuauuaaaccuuuuaaaaaccuuuggugaugaugguggugaugauuaugaugaugggaagugugugugugugugugugugugugugugugugugugugugugugugugugugugugaugugucuggguacccacauaagaccaggagaggccaucagaucccuuggagcuggaauuacuaaugaauguaagcuaccugaugugggugcugauaacugugucuucuguaggagcagugcaugcucuuaaccacugaaacaucucuccagcccaugcaagucuuuuuuaucucuccccuuuauuauucuuuuguguaaccauuuggucuucucuauguccgacccaguucccgaaugaugacauggaagcuuauuuuauuuacagugcugauggcuuuagcucaggcuugcuccccaacuagcacuuuagugauauuaacccauuuauacaagucuacaucagugacauggcugguuacuuaccucuccuccguuacuuauguccagcuaccuccaugucuaggugaagacucuucccaccuuggacucuuucccagagugccucucucucuggaaaucccgccuaucuucuccugcuuugcuauuggccuuucagcucuuuguugacaggugaaugcucuuacacagugcacaagagacuaucccuugaaggauugucugcgaugguccuaggcucuugugcaccugcuaugagcucuugcucuaugaguaaggcagcuuuauuuggguuuuuguuuuuaccgucaugucaacaaauuugauuuauaauuuuaucuucuguaugaagaagucuuuucuaaugaauauucuuuucccuucuguuaguuucuuauuugauuuucuugugguggcuuugcacagaugcccaucuuuacaggcuagaagucuguguguggaaugcaucucauccuaguaggaagucuuguguacagacauguuccuaugauacacaguuaugugguuuugugcaucccuuccacauuagcuguccccagcugccagagagcggcucaugacuacuuucugacuacccagccauucucaguaacuggcugcucccugcauauacaaacuugcuauuugauuuccugguagcuucaccucucuccuuugaugcuggacugauauaggaaauuucccucugccagccuuuauagaccuagccaaagcagaucugacucgucuucacggugcaugccgucuacugagaugugcuggcuuucuggccauguaguuggaaacugugcugcauuugaauagggggagguuuuauguguuccaugacuaggauuccaguucacuuuugaauagggaagcaacaacaacuccuaaggccaaacauugcuaagaaagggggguuggaagcugccgagccugaaucaucuguuuauucaauaucucacccucagauaaagcuuauccuucccucugaaauguggaggggaauaauaaauacaacugauucugggaaguugggaaaugagugacaagauaaauuucagguacuccccugaccacuuuagaaaaaaaguaaggauuuagcaauaagaaucucuucuaaaaaguauuuuuuuuguguguguguauguguguuuguauguguguguguacguguguguaugugugcugcuugugcaugugugugcguguguauauauguuugugugccuggacauguaugcuugugugaaugugugugcaugcgugugugaauguaugcgcucaugugugcauguguguacacguauguguguacguguauguggguuuguguguguauuaguguguacucauguguguguucacaggugucugugugcaugugaaggccugagguugccuuugaguaacuuucuuagucucccuccaccuuacuuauuugcuuauguauuuagagucuggguuuauuuuuuaaaauaaaccuggagcucacuggcuugguuugacugguccuaacccccagggauguucccaacccaggcuuagccagggcuaagauuacaggcucacacuguacugcuaugcuuagcuuuuuuuaaaaaagcaaaacagaaaacuagaccuucugggaauugaacuugagacuucgugcuugcacugcagcaguuugccagccuagccauguccccagcacacaaauaagcuucuuuguauaugugcacaggcuccuucucagguccuaccugcuggggcuccuugaagcucaucugucagcuaggcagugccagaaaggaagguucaaacucagaaggcauuucucgggucuugcucuauagcaacugcuuaacaccauucucgucauucuuauaauaaaaccguuggcuuaucucuuccugauuccgcguucauuagcaaguauguuauaaagcuacaggaagcaggguggggcagcaucgggcuggauggaguauucuucuucagucaaaugaagggauuucuaaaccacagggcagcaaaucuaggauccuguaguccaguggagagaacgcccaucaguaaggguacucugcgcauguacaggcuaaggcacgugcuuaagggcguccaucaguaagggcgcucugcgcauguacaggcuaaggcacgugcuuaggggcgcccaucaguaagggugcucugcgcauguacaggcuaaggcacgugcuuaggaaugcccaucaguaagggcgcucugcgcauguacaggcuaaggcacgugcuuaggaaugcccaucaguaagggcgcucugcgcauguacaugcuuagacacgugcuuagcguggcuacagauacaaaggaggccaggcuugaaacugagcagucacagaaucagaacuugguugccaguagcaagcaagggaagcgaggcuggucaagcccaggucccagcuuugugcuuucuuccuuuaugggacaccauguuagacccaggcucuaggcagcuccucucuauuugugugccuuuuuggccuauucaaauaugcaguuugccauauuuucauucugauaggaagaugggugggagaaaugguucacuuggccuucuccccacuccuccccacuugcugaucuugcuagaugaauuguaauauauaaaaaaaauguuuggggaaacaguuguauucauuaaaguuauucauucggaugaaccaauaaaaguauuuucugucucucugccucugccucucuuucuuucucugucucucucccccaguguugauucuaugcuuugagugacagcaaaaguaauuguacauuugaaaucuuugaaauaaguuuuaaugcuuuuggaaugacuuaccagcuaaugugcaaaauucaccccauuccaugguuaccuguuaguuucacuuccugagcucuguggaacuccuaaauguuauuagauucugucuuuuaaaccgcagucaguaucuaucugguagacugauuauagcauuuggcacaccuguagcgagguuuugcaaagacaagauauugcaguugugugaaugcuugauuugaacuuuaaaacuuggguaugaauauuugggauauaauauacuagaacuuuaucauuauaauaaaauauugguugguaaguucaguccauaaauccuugcuauucauauacaguuuuuaaaaggucuuuccaguugagcaugguggcuuaugcuuuuaaucccagaauuuaguaaguggaggcaggaggauugcaaacagcuguaucuagcucauucugacugccuacuaaaugcauauuucugguuuacuagggcccguuuuugcuugguagcaacugauaauuuauuguaccugcaguguauggugacuucugcucccugagguucaucuguaugaguuagcugaugcuacagcaaaccugugaggucuguggauuaugaugccacugaugaguugaacggagaaguuaaaguguccucagguggagcugggauuugaggccaguugcagugacagugguguuugugccuucaccucgugucacagacuaugaggcacucacuggagcaauugggcauuauaccacacucccaggacuuguagaaggcaauagccaugccccaaguuagccacuguaauucagucggugagcgcauccucuguggucuggccuagggaggagucauucaugggaagucuguaaugagcuaugggagacaaaacaacaucuuccuugggugucccauccugcaggacccaguuauucgugggugcgagggggaccgcaaaccugaagagaaaugagcgagaaagaagagcgagaccaaggaggauuccugucaaggucucaguuuauuaggcugaaacgccagguuuuaagcacacagcgaagggaaauagggagggguugagggggaauuaacaaagaacaaagaagugggcaucuggggacauaaaggcugaauucagacugcaggugggaggcacuccaaguccuaucuccggaauguagaucccuccuuaacagucccggaugucaggcugggcucagcacagaacucauguccuuagaagucuugggagccaggaagagauaaggaagaggggacuauaauucagcuuuuagggucucuggugccaggaagggauagggaggaggaggugaugaccggcuccuuagcacaaggccauuuggcuuauuagggugggaagcagugcaaggccuacuuucuuaugguauggucuccaacaucuccccccuuugaauuaaauuuauuaaggccacacuuaacugaggugaucaaaugaccuucucauccuuggaugagugggcauuaaccauggcugggggagcauugaccugauuccucccaugggugcugucacgacccacacucauggcucuugguaucuuuuggggaggggaggcagaaccuuagaaagauucuuugguuguaacuggaacuagauaccaaccuccauacaaacugggugugucucucagggaacucagaaacggucuaauuggaccuuccccugcagugcuuagccucauacccacgcuggugcccauacuggauuccuauuaucaggaaccaguauguacaggucugaguccuguacagcuccuaaaggagaauugucaaccuuagauucagcaaggccccuguggacuguaucuaagaauuaugccaguuguaacaccacaauuuguggcucucaggcuauauuaggagcuggaggucacucuccucaucucuauugucuccauggcuugaggaaccaaggggacucugcauuuguagcaaggguggaaaauuggcggccagcaauugcucuuucuacaucgguggaagggagaucuucgucugagucucagauaucuagucgaugguagugaacugcaacuggcuugcuuaaaacagcuucaaucugugacuuaucaaaacugguuaaucuauuaaaggcccaagggccaaaagacaaaagcaacaaaauacccacgaaagguuccaaaagguugggaaguaugguagugagccaaggagaaguagaaaaccaauuuugauaccaauauucuuguuucucucuguuauguuuucuuucuucuaaacuaaucuaacuuugucuaugcuaucuugaacuaagccagucuuaucagaauaaaaacaacauucuucuuugaggacugcacauagcccucccucuuguaggaacacuaaaucaaggccuugucuguucuguaacacuaccucagacagagagaccagggagucuuagauuuuucaagcccuuuuguagcucuuguauaucucuguccacaacaaggcuaagcuggguguauugcuguugggaggugacuagaggcaauuccaguuccugcaccugcggcuccuaagcccaggauuacugccaaggucacugcagaaauaggcucuccuuguagcccauggcagagauaggaaguuucuucaucuuguuugcaaguugcugcucucccugauuccucuuucucugugugaucaacacagcuuuccugucaccaccaucaggacacucaggaacucacaggucagccugucacacaacucauucuggaagcuagcaugcuucugcagcauucuguggaaaaaacagagacaucccccucucucccccauauuaacuuucuguacaggaucaugccaugugccaauaaguugacccuuaucaucucaccuagauauaauuaugucuaguuuuaagauacuauaaggcauuuauuaaguucuuugacauccaaauuucaaaauucuuaaaaauaaaaguaugauuuaaauaaugugcauggggguauaauuucuccccuucuuuguuuuuaagaagauagaguuuuuaaaguuccacaauaccuugucuuugagaauuauuaaauuguugacaaaaccacuuaaauacuugacuauuauagucaguuuuaauauaacaugggcagugacuaauuacacguucaauuguuucucuugaagagagauuguaacuagaaugcuuaaaaaguuauuauagucacauguguauaauuuauuuauuaauccgaaauaagagcauucauuugcagcaauugauuaaguauagguccucaagaauuaauacaauuauguggaaccagguaggaacugaggacaccaggagcaaauuuuuuuuuuacaauuugacaugcaaauucucuaaaaauaucaaaauauuaucuuaaaccauuacuauuuugaauauauaaagaaggagauuauauagucgauguuuuaaaguacgaagagcacauucaacuauuucuugccucaugggguuauaaggaauuccaguuuuauguuugaugccaaauucuuuacaaaaugaaguaaaauucuugcuagaauaggaugccccguuaucugucuuaauaaguuuaggcaaucccauggcauuaaagacuuguaggcaaugaucaguuacauuuuuagaggucucuucuguaugcagagaagcaaaaggaaauccugaacacgugucaauacaaacauguauauacucuaauuuuccagacucugcauaaugaguuacauccauuugcccaauaugauuaggcauaagaccucguggauuaacuucuaaauguggcacuggagauaauguaauacauuuaggacauuguuuuacaauaucuggcucugccaaaauaaguuagugccugcuucuuuccaaggauaaccaucugagcuacugcuucauaauauggcaagauauuauguuuaggagaaauccucaaauguauccacauuagagagacuuuugccauaacaauccuguaggcauaugaaacauauuaaaaauuaacaaguguaaaggcaaagaguaaucuauaugagagacaaauugcucuucaauagcuuuuuccacuuguaaguccagcaaucuuucugagguuaaagaucuaggggagguuggaucagaacucccuuuaagacuaucaaacaaagauuucaacucccuuguaguacacuuuaaauaggggcaaagccaauuaauaucaccuaacaauuuuugaaaaucauuuaaaguccuuaaguugucucugugaauaacuaucuucuagggaaaaacagcuugaguaguaagucuaaaacccaaauaauuauaaggauccugaguucguaucuuuuuaggagcuaucuguaauccuuaucaguuaaagcuuuauguaagccucuauaacacagaagcaaauccugggggucuuuuccaggcaacccaggacaauuucuuaacugaccaaaaacagucuucuuaaaggaacaguauuuuuucuuauaaguugcauaagcaauugcaagcuugaaaauuaauagcgucugagggaugaacaauuuuaagcaauuguaagcucugagauauaauauugacuauuaauauacaacuuaaaguuugauuguucaacauuuuaaaacaccaucuacagcacacaauuuaauuaucugugcugaaacaggaggaaacucaaaagaauaagugugugauccaauucacauauacuuuucucccauagaaaggcuguuuuuaaaacacaguaaaugggaugcaugcaugcauaaaaacaauuuuuuaacuuaucuuuaggauaaugauuaucaauuuuauuuaauaugaugguaugcaauagaucaaacaucaauauucugcaauaaccaaauuaauggcuguuuggaacaaggaacagacauuuagucagguucuuaagacacaauuuuuguuauaguuuuucuaaaauauaugaauuuaucuuacaauucuuuauuagcacuacaguggccuaauaggaugcuaaaacuuuacuuugaggugaagaaggaugauuuuacuacaaugugucucuugccaaagauuuguugugggcacauaaauaaaacgagcagguaauauuuaauuaccauugauuauaauugauaacaauugaucacagaaguuuccucugcuuucugugaaaacuuuuuguuucucaccaguaauuuugaaucucacuagauagcaccuaacaaagguuuaagucacuuuaaggccucaaggugaggucuuagccaacaaacaucuccuggaagcuuuugaaaauaaaauuuugaagcaaaucaauuuuuccuucuuagauuuucuguaccacgauuuucuaauauagcuaaaaacccuaaguauuaaaagauauugccucugaaucuuaucuggaguuacagcuacuccccagaacuuaaaaguucauugugugagagcaaggauuuaaagcauuaguuacuaaaaugcuuuucacuuaggaaacaauauacauauccauauaagcaaacucuguacacuauaacuuuauauaaaguaggcaagucaacucacaauguacugauaaauuccacagucugauugaccuuuuauaaacuuugaauuuagacuuuauuuagaacaacacuggcuaggucugcaacaagacucuuuuuagcuaaaaggaagggagggagagcugaaguccuaggaauuucccuagucaugguuugugaaacaaaagaagugccacacaagccucgcugaggcugcuucccucugggcucagagucaaccuaaaugcaaacauuucucaaucugagcacucugccagaguccuggcccaaugauuaucccuauuuucaaguaucuuuaaagaccuguuuucuuggguacaugacucuaacccugaguuaccaauuuaagcuaacuuucuguuacaagcaaaaggcugccugcccauuuaacagcuccauuugcaauuggcucucagcaaggcuuuuccagcuguauuugacucccagccacagugcaguguaacuuaucaguuucugcugugcaaauugagacgcccuuuuaaacaaguuaaucuaaaucaaaggauggacagccagcagauaaaguuuuaaccuuuuuuucaacaugaaacacacaacaacaaucauucaaacaacaaaacaaaaacaaacauaaauagacauauggacaaauggugcaccaaggacagacaauagacagugaggaaauagaacuuaaugucucaaagggacccagauauccuaacuaagaauaucuccauaggagccagagaggaagcaggacgucucccgauuuccuucugucccuaggagagcucugaaauagcuuauuuucauuuucccucuuuuuuguuaaaagaucccaaacaggggauaacugcuuuucugaaacuuauucucucucucucucucucucucucucucucucucucucucucucucucucucucucucucucucucauguucaaauucuaauucuuuaucuccuucuucugggaauucugccagagaagggagaguaggcacagugguagcuucugauaguuacucccuaauaagaaaagaugguugcagggaccgcaucaggacccucauuagcuaguuuaucauuuaaaucucugccuaccuuuugccauuuuuacaguguaucucugcuccaucuauaauaaaccauggacaugccuggucuaugaaaauaaaaaaguuuaucaaaucuuucuuuuuaacucuaacuccucuuucccugaaagacaucuuuaaaccuuuaaugaaggcugccucuuaagcuuaguucccauuucucaguggagaugaaucacuuaccaaggacgacuuccucccaugagcugugggagugguucuucacuacuuauuuuuucuuggggucgcgacgaacuucucugguggagucaaacuccguaaucuccaccuaaggcaaacgauccgaaccucagccgcauguucaggugucacuugucccauccagcaggacccaguuauucgugggugcgagggggaccgcaaaccugaagagaaaugagcgagaaagaagagcgagaccaaggaggauuccugucaaggucucaguuuauuaggcugaaacgccagguuuuaagcacacagcgaagggaaauagggagggguugagggggaauuaacaaagaacaaagaagugggcaucuggggacaugaaggccgaauucauauugcaggugggaggcacuccgaguccuaucucuggaauguagaucccuccuuaacagucccggaugucaggcugggcucagcacauaacucauguccuuagaagucuugggagccaggaagagauaaggaaaaggggacuauaauucagcuuuuagggucucuggugccaggaaaggauagggaggaggagguaaugaccggcuccuuagcacaaggccauuuggcuuauuagggugggaagcugugaaaggccuacuuucuuaugguauggucuccaacacuuggggcugaauaucacaggaaguuuuacucucuccaugcucuuaggaccuaaaauguaggcuguguuaucuccagauucuuacacaaugaacagcgguacugaaggcuucuacuauuaauauuaaaaaugugaaacacaaacaugcaaaagccuguauguaacuaagagguugaaaauggagucauuguaacuggaagaugaucucugcgccacuggucuggcuggauccugauaggaaacaagagucauucagaaagauuucagagucugagacgagggccacagaugaaggucacauauguagaccaguuucagggauggagggauuuuuguggugguuugaauaaaaauggcccccauaggcucauagggaguagcaugcuuaggagauguggccuuacuggaguaauuguggcuuuguuggaggaauugugucauugggucaggcguucugggucaaaauuggucaagccaagucuagugggcauucauuuccugcugccugccaauagggcuguugaacucucaucuaccucuccagcaacaugguugcuugcaugcugccacgcuuccugccauggcaguaauggagucagccucugaaacuguaagccagccccagucaaguuuuuacuuuauaaaguugcucuugucauggugucucuucauagcaauaaaaccauaagacagauguauauacauuuuucuaaugaaaucacaaucuuugugugccugaugcuucuaauuuucuugaaggaaacaugagaaacaaaaucacaaagaccuucugaaagcagaaacagcaucucauuacuguucauauucuuggugccuugagcgugauggcuuuaaugucacuugaacgccuuuauguaagagauaauacaaggcagggaaauaagucgggaaacugaauauuugaugcuugagcacgacaagagguuccuugggaagggagugugggcuguacucucugugugguugggguaccagguagaaaaagauguaccuugaccaccaugcccuuuccuaugaagggaagccauuacuuuaccacuguuagauauuuuccucccccuucagggaagaugcagggauuuacuuucuuuugggcugugaaaugaggagaauauaaaucugggccuuuguguaauggcucuuacuccuuaggacuagggggauucuuaucccacuaucaaagcuuagcagaaaguugguagauucauuccgggaggcuucuacagugcugccaggaccugggcaguggaucuauagauuccccaugaauagaauguuggaaagcccauugcacucuauaggaagcaacaauucaaaacucagugcuguucacaagaacggugauaugugggucacuacucuuccucuccccuccuuuuccuucucuuuucuucuuccccccaucuuccuucauauucuucuucuucauuauucccccuacccacccaaguucacuuugucucacuuuuauucagggguuugagaacguuauuucuuagugaguuacucuuaacuccuaguagaguaugcuggaauaggcaucguuggaagagaaaauaauacuugggaaacauauagaagugaaaaauuuauauuugaacaggagugggauucugcauggcuuuaagaaagaauaucucuggacagcuaagguauauccuacuaaggguuaucucaccaaaaacucaugauaugccuaagagucagauuucauucuugggaccuggugauucuuaaaaguccagauguuacuauagaacacgaaaaaccugcaaggguacauggcuucuucauuguccuuuauucucucaugaauauguagggagcuuucuagcaggugcacagagcaauagagugaaugcagaagauacaagaagauacaaauguuauauaaugugauaugccucacuauuuuuuuuauaaguaguucucuuucaaaaaauaguuauguuaugaacuagauuuauuauuaguaaaccaaguaucagacuuaacuauacuuuauaaguauguaccauaauuuucagcauauuaauuaugaaucacuaacaauguguuaagcucuuuaagaaguuaugauaccaaaaugcuuagaagaugacuaucauggagagaggagaaucuugggagaucucuuaauaggaaucauaacaacucauauuugauaccuaauucuuucaaucuuacagagaucaccuauuauuacuauaauacuuuccugugaagcuuaugguaaguggauuuugucaaaucuugggaugccuucaagacacccuuucuauuauucuaaugcaaauugcuugucuauuugaaaggaauuaaucuugcuaauaaauguggccucuuugucuaccaccuaacaguuucccuuucuaccaaacugcauaugcuuugcucugcuuucuguucuuaauucuuacuagaaacaugaauaaaugcagucgccacuaacugccacagccuggcucuuuuacuuucuugaaaucuucuccaccaaauuaguccauuacauuuaaaaauuuguuuauuuauauuuuaugcauaugauucuuuguauggauguaugugugccuuguguguacagugccuguggacaccaaaagauggcaucagauucccuggaacuggaauugucagccaccauguggauucugggaaccaaacccagguccuccgaaagcacggcaagugcucuuagccacugaggcaucucuuuagccauaauccauuacuuuggucuugacucagacuuucaggacaugggcaaaauguagguagaguuuuggcuaggcucuacuaagaaugguuucuugucccauucccaauaaagacuucauuuccauuugggccucca

SEQ ID NO: 3460 - RNA, 557 nt, Mus musculus
gaaucuaaauguggauucagaucaggaaagguugaaauggucuucguuaccaggaggucuacauuuauuaauuuugugaagauucccucugaaaaaaacucagaauaaaauguuucuaguagccuguacugcagaaaauucugaacguacagugaaguuaaguugccugagaccugagauccuagggcaggcagggcuguggagggaagggugcuugcuaccaaaccuggcacaccuguucagcucugagcaaccacaggguggacggggagagccggcuccaaaggcuggccucugacauucacacauucguguccccuaccucugacacauaauaaauacacuuaaaacugugauaaaaaugagaaugggugcuauagcaagaggauacucugccccccugugcugccuaccaauguggagcccugccccggguguccaccugacucucugugcuauacuaaacauuuaguaauuguuuugcuaaugagauugugauguuguugcaagaaaauguggauaucgcugaauuuuuaaauacaaaaaaucucugugcu

SEQ ID NO: 3461 - RNA, 1458 nt, Mus musculus
ggccaguccuggcugcauagaaaguuccaagcuugccugcgcugcagagcgagaccuggucucuauaagccuaagacuuccggguuccucccucuggcaagauggcgucguuuauggaggagaugcagaagccgaagcuccgggagcuguuggaaaccggcauacaacuucuggaggagguggaagcugcgacccaacccacaggcuccaagccaauccaggaaaaggugagggaggccuugaagcuccuggagaaggccucggacauguuaucgcagcucgauuuguucagcaggaacgaagauugggaagagauugcuuccgcugaccuaaaguaccugaugcucccggcccugaagggcgcgcugacgcugaagcuggugggcagcagcaaacgccuaggccuccugcaggaugcucgagaacacuucaugaacuuccuaacccagacccacagcuaccauguggcugauuuucagcugcccugggcccagagcagcucaacggaaggcaaccccgcugccaccucugaugcccaggagcaaaaccugguugccauggcaucccagaggcagaccaaaauccagagguacaagcagaagaaggcgguggagcagaggcugucuucucugaaaucggcaguggagagcggccaggcugacgaugagcgugucagggaguauuaccuccuucagcuucguagguggauuagcaucagccuggaugagaucgagaacaucgaacaggagauagagauccugagggaaagagacuccuuaggugagacaucagcaucucgcucaucuccucaggagaggccuccacuaaaacccuucguccucacucgaaguguugcccaagcacaaguguuuggagcuggguacccaagucuggcaacuaugaccgugaaugacugguacgagcagcgccagaaaaaugaggucucaccaacucuucaggaagcagaaaagcaggcaccaccaucugagacuuucacuguaucugagaaggaagagccagaccuggagcaaaaggaagaugaagaugagaaugcccuccacaggaugcaggagugggaugacuggaaggacacucauccuaggggauauggcaaccgacagaacaugggcuaauguccccuccccucggugugaaaagaugaaggagcucucaccuucccagacaaggaaaacccuguucucuucccuuccucaggccccugcuucagaagugugcaacaaaggcagaugcugaaucuugcuuuguauucaauaaaaugccacuaucaaguuuuauuugcacccuaguuaauguccggugcucugguuuaggcauugcucucaccaugguguauugcaguuucuuuaguggauagaaagaguucggagaaauggcuguauaaucauugacuguaugauuucucuuuaaaaaaauaaaauacauuuucuuggaaaaaau

SEQ ID NO: 3462 - RNA, 996 nt, Mus musculus
cagaagggaaauaacugagucaaaggagagaaaggagccgcucaucagccuagggugaacauccgaaugguggguggcauuccgggugcugauggagccugacccucuaauccuggauggcuuuucgaaaggagauggcgaagaaggaacuggacacugaagcggacguucagcaccuuagagaaugugaacgagaccaaaagagcggacuggacaguaccgcguuacugggcggggccgucgucagggcuagacugcuuguugccugcccacgagugaggcuacguauucaaucaccacaccgggacuaaagaaaagacgauggauguguaagacuuucaucgcagccaguguagcucugaaguugagaagggugggugcugcauaaagcccauuaggcacgacgagggugaugggaagagcggacggaaaauggagccgcacugcacuccauuaaagagugaaugcguagcagaggcaauuucuaaaggcccgagcaggaacgagaauccuguaugaucgaauacauuuaaaagucggucugguucauagcccuaagugcaucaagagcaagcaggacgugcaaucuacaggacuugcacuuucacgcacggccacuguguuuuuucuuugguucggugguuuuucuuuugcagggcuagagagggaagccagagcauugaaaugguccggaggccguuccauuauccagccacaccacagggcccaagauaauaauuuuucuauuggaagauagucggugucagaauucuuuuuauugguuguagagcuggcucagcggguaaaggugcuugcugucaagcugaugaccugaguucaagucacaggacccacaugauggaagaccagaagccacucucacaguuaguccauugaucuucgacugcaccuuggccuuuuauugacaggaaaaagguuagccauccguauaagguuaggaaaggaucauuacagauauaacguuuuaaaaacuca

SEQ ID NO: 3463 - RNA, 584 nt, Mus musculus
ggggcuggagagagagcgcuccgucggggguuggugaaguaucccaagauggcugggcguaaacuugcucuaaaaaccauugauuggguaucuuuuguggagaucaugcccccaaaccagaaggcaauuggaaaagcccugaaguccuggaaugagaccuuccacaccagguuggcuagucugucugagaaaccaccugcgauugacugggcuuucuacagggccaauguggccaagccuggcuugguggaugauuuugaaaagcaguauaaugcccugaagaucccugugccugaggauaaacacacagcccugguggacaggaggagacgggggaugugaagagcugugcugaguuugcgucuggaccucagcucaggacccaggagugugagaagcagcuggagaaaacgaggaacacaauucccuuugaccagaugaccagugaugacucgaaugagaucuucccagaagccaagcuggacaagaagaaguacccguacuggccccaccagcccaucgagagccuaugaagcagccugggacggagcccuggccgacaugaaauuaaacauuuaaauagu

SEQ ID NO: 3464 - RNA, 584 nt, Mus musculus
acuauuuaaauguuuaauuucaugucggccagggcuccgucccaggcugcuucauaggcucucgaugggcugguggggccaguacggguacuucuucuuguccagcuuggcuucugggaagaucucauucgagucaucacuggucaucuggucaaagggaauuguguuccucguuuucuccagcugcuucucacacuccuggguccugagcugagguccagacgcaaacucagcacagcucuucacaucccccgucuccuccuguccaccagggcuguguguuuauccucaggcacagggaucuucagggcauuauacugcuuuucaaaaucauccaccaagccaggcuuggccacauuggcccuguagaaagcccagucaaucgcaggugguuucucagacagacuagccaaccugguguggaaggucucauuccaggacuucagggcuuuuccaauugccuucugguuugggggcaugaucuccacaaaagauacccaaucaaugguuuuuagagcaaguuuacgcccagccaucuugggauacuucaccaacccccgacggagcgcucucucuccagcccc

SEQ ID NO: 3465 - RNA, 603 nt, Mus musculus
cuagucaagaacugucugggcuucaacuuccaagguuaaauacgcuggagaugggaggacagcaagggaaggggagagggagagggagaaagaaagagaaagagaaagagaaagagaaaaaggaaagagaaagagagagagaguggguggggaaaaggagagaggggaggaaacgaggaaggaggagggaguguuguguaacaguuuccacccagagggaaaccuuccauccuaagggagagcucuuuaaacagagguaaacaacugaagcagugugaggaagucccccaaacugaccagguuuacccuacccuucccugccagugaaucacuaaaagaugagucugucucagaggagccacguugcaaaggccucucugagcugcuuggaugcaacagaaacaagcugagcugcccggaaguggcauguggaaaggacacucaacuuguugagcuaccuguaggcuuugugguaagcuccagguuccaagauuuugugagaugucccucaagcuggggugaugcagcugucuuugagacacuucggcucccggaaguagccccucacccauauuccuguaacacuaaaaugcauugacucau

SEQ ID NO: 3466 - RNA, 2743 nt, Mus musculus
ucgaguugugaacauuuauguauuuguuuuauugagagcaugccacagcggaguuuggagguuacaggagaacuuccaggcaucaguucucugcuucuaccaugugaacuccgggaaguaaacuguuugucaggcuuggcaguaugcaccuuuaccugcugcgccuugaugcaaaucauacaauauugcuuugguccaagaacuacaagugucuagguaccaaccauggacugaaaguugcuaggucucuugggagccgggaacccuaaaucuguagacaagugugggagccacuacuucugugaguggaucgcuaaacgacuguaaauggcgugacuuguacgcuagccucuuguuccgugagccaugccucucaucucugccucuuugggugagaaccugacaugugagcugcugacuuggggcacugaggguguucuuacacauggcagcccauguucuccaguuccaucucuggaaagaaagcucagccgugucuuucauagccuguuuauuaacgacaggcuggcggccuuggagugacaugcuuugguugccauggcggaucucacuacugaaugugcucugcuguaaagaggucucugggcuggcugcgacuuaaguggaauucucuccuaagggucagacagagugaaaccuuguccugauggucauuguuaaccacucuauucagaaucaugcucucucucucccucccucguuacuggcugaugcccugagggcagagaaguguaaccucugugugcuuguuucgguugaaaugucuacaaauugccuuguugguucuauugaggaaggagggguuacacuggcaggaggacagggaaccaaacucaagucauaaggcuuggcggcaugugucuuuaccagcugauucguucucuugggccucuaagaugugcugaucuuuaccuuacacucagggacuuaauacugcuuucuguuggacaaagggugagcaaggcagcuucagagacuucacucuuugggauaagaaacuggcugcgcuuuugccagcuacagaguacauuucuuuagguguacauuggauggcuaggaaaaugaccaguaauuauugcagggcccuuagagcugggauggaugaagacuguuuaucaccucacuccagauaucauccucuaacagagacaauggccaugcuaauucuccaagucccaaugccaucucaaacguccuccuaccagccucagaauguuucaacgugugauuacccaagcuaguggccaaagcuugggaauggauuaaggaaaucauuauguuauguguucauuuuggggucugucuuucucgaagcccaaccuccacuuuagugaguuuugagucucaaaaugggacaagggguuuugccucuuggcagggcacccucauucuccugacccuuugacuuauauugguugugcaggaucuuguuggguuucaauauccuuuugcuccaaaggaugcacgcuuuauuaaucaucccucuaucucugugucucuaacuugccauuaauugugaugagcaccucaccuuugacagaggcgcagaaacagcuggcuuguguaauuuggggaccauaucacuucauugcuuucagaaccccuaguucucuaacuguccuguguuaucauuugggguucuggauuuauggugcucacuccuuuuggcaaauggagugauucuugagucuuucucuaguuaugcaugggguugugugacuuacagcucacuuaaucuaucaucuucucaaagccugugguuccuuuuaccguuggcuauggaaguucuggaaaguccacuugggcauuugagaaccagcugucagcacguaaacguucugcucaaaggcacuuccaaggaucuuaagucacaugccccacacagagcucacagauuuggcugcccagccaaccccagcuaccuuccugucucugccucccuguuacugggauugcaaugaugccacaaccugccuuuaacacagguuucuaggggaucaaauucaaguccucacgcugugcagugugacuuaagugugagcaaaggucuacucaccagagguuccuuauugugaugauccaaauuuauucaaaagaagaaagcauaggcuuaagagagucucuguuucucaaaaaagcaacugacuagaaaaauauuuccucauugucaacacaaaggagcugaugcagcugaggucccaggguccaagcucauccugagcugguagcagagcuuggcugcauugucuuugugguacuuuaagaaaauauuuauuuguuguguguguguaugugugugaaggucagaggacaaguugcagaaaucgauucuccucuuccaucaucugggguuagggaucauuaaacuuggcagccuuugucuguuaagccauccuguuggccucaugugguguggguuugaaggccugaaugaugcaaggauguaggauacaaagaguggcugacucagggggugguggcugcagcagcgucacgugccuuuaauucuagcaccugggagacagagccagguugaucucuguaaguucaaggucaaccuggucugcaaauugaguucuagggcaguuagggcuucacaaaaaacugucuugaaaaaaccaauauuccuugacuaaguauuucugauguuaggaacuuaguguuaugcaaaguugaagaaagcaaacaaacugacuaucccccuguaccgccaccccucaac

SEQ ID NO: 3467 - RNA, 362 nt, Mus musculus
gauacuuagaaaagacagcaaguacaccuuuuuuuuuuuuuuuuuuuuuuuucacuuuucaggguuuuuaauagucacacgcagagggcuuguucauuucagauccuucacugccaaacccggggguagggacugcuucagcuucucugccuuuuccuugucugugauaaccaggguguaaagguaccugcugcagcgaaccuugaacuucacauuauccuuguucuucuugaucuugacagacuuggcauccuuccgccgggcugucagcagaaaguccuugaucuccucaauuuuccgaggcauggcgacgcgggcucggcucuggcguccgcacagcgaugagaacccgcaaguacacc

SEQ ID NO: 3468 - RNA, 588 nt, Mus musculus
gcucuuccuguucuccaccauggugcaagaucaagaggaaaaggagaaccccaugaaggaacugcgcauccgcaagcucugccucaauaucugcaucccggagagcugagacagacugaccggggcagccaagguguuggagcagcucacaggccagaccccgguguucuccaaagcuagauacacugucagguccuuuggcaucggagaaaugagaagauugcuguucacugcacaguccgcgaagccaaggcagaggaaauucuggagaaaggccugaaggugcgggaguaugaguugcguaaaaauaacuucucggauacuggaaacuuuggcuuuggaauucaggaacacauugaccugggcaucaaauacgacccaagcauugguaucgacggccuggacuucuauguggugcuggguaggccaggguucagcaucgcagacaagaagcgcagaacaggcugcauuggggccaaacacagaaucagcaaggaggaggccaugcgcuggucccaguaugcugggaucauccuuccuggaaaauaaacuuuauccaaaaagccaauaaaauuuucucaaaaaaau

SEQ ID NO: 3469 - RNA, 588 nt, Mus musculus
auuuuuuugagaaaauuuuauuggcuuuuuggauaaaguuuauuuuccaggaaggaugaucccagcauacugggaccagcgcauggccuccuccuugcugauucuguguuuggccccaaugcagccuguucugcgcuucuugucugcgaugcugaacccuggccuacccagcaccacauagaaguccaggccgucgauaccaaugcuugggucguauuugaugcccaggucaauguguuccugaauuccaaagccaaaguuuccaguauccgagaaguuauuuuuacgcaacucauacucccgcaccuucaggccuuucuccagaauuuccucugccuuggcuucgcggacugugcagugaacagcaaucuucucauuucuccgaugccaaaggaccugacaguguaucuagcuuuggagaacaccggggucuggccugugagcugcuccaacaccuuggcugccccggucagucugucucagcucuccgggaugcagauauugaggcagagcuugcggaugcgcaguuccuucaugggguucuccuuuuccucuugaucuugcaccaugguggagaacaggaagagc

SEQ ID NO: 3470 - RNA, 3092 nt, Mus musculus
ugagacaaacaucaguuuauuauuauuugggagagacaaaugacacccagucagucacuauucaagcugagcaagaguugacacuucuuauuccagcaacacuuugaugucauuugaauauacugagcagauccggaauucuuuugcauagacugccaaugaaguuagcaucgugguuuucuaaaugccacauggucacugugguaugugaucaugaaaucauuaauaauggagggauuuuguuuguugugggugugugucacuagcugggcuuccuagcucugcagaggaagcucagcaaauaguagaauuuaccacacauaaacaguaacuguugacuaaggauacuugugcucuggaguuggggagagggauacacuuucccccaguguuccauuugucuugcaggcugucuucuaacucccaacacuuuuccuguuucagcuuucuagaucccgggguuauauguccuggcacucccagauagacuuuuaaaauuacuuaaaaguuuucuuucugccugucuguccuuuuguuuguuaugugugaauaugugugaguacagauaccuguggaguccagaugagggcaucagauccccuggaacuagaguuaaaugcagguggcucugugccaccagaugugggugcugggaacuccuuggguucucugaaagagcaguaggggcucuugauugcugagccaucucucuauuccuuucucaucuuuuuauucuucucacucuauauuuccugccuguaugaaaaacaaacaaacaaacaaacaaaaaaaaaacuggcuuugugcacuagguaacucugagauucuuccauagacuagaauagguagagguagagaaacacuaagaaaagcauguuugggccuucaagaugucucaguggguagcagggaagguguuuaccauuaagcuuaaagaccuuagcuuaguccucugggccuuggaaaggagagagcugacucccuugaguugucuugugaucucucacacagacuuacacaaauaauuaaaauguagcuuuaaaagaugggcguggcuucucuguggcaaacagaccuuccaccuggagcagagugugaaugagccuuugagauggguuuccagcuauccugagggagggcacacucucaugcccaggaucuucuccugguuaaaagcucagacagaagugccauuuuucaagaacaugagcuagcaugcaagcuuucaucccucagagccauccacaaaucccagcaucagggcugccaggaccacccccacccacccccucucuuuagcugguaggacccaucucuagaaauggaguaguccagcccugagcaauaacugccaugcuugagccuagggaguuccuagggaguucccuuaaaacccagcaagaggcagaacuguggccccugcagaggccucucuuggaguuuuaagcacucaguuccacuguuuucucccuugcaaaaacagcagccaccaugcaucaaaaggaaagaugauuauuuaaagaaaaacaagaaaagggccucacuuucuuccuguuccuaccgguuacucaccagcucacggaucucccuccuccucucugauacugcagccucuccucacacuguguucuugggugaaacuuagcaacuucugcaauaggucucaguucuucucucucuccuuccuuccucucucccuuccuuccuuccuuccuuccuuccuuccuuccuuccuuuccucccucccccucucuucucucucucucucucucucucucucucucucucucucucucucucucucucucucucucucuccuuccuuccuuccuuccuucuucccuuucauccuacuuuuugucaugaacuggguagagaggcuggaaggcucugcuuccuaccucugcaaaacaaggggucugcauccuggggcaucgcccaagcucgggguggggguggggugagguccgccaaggagagcaagcgggcgagagagaggagagauaaagaggaaaauugggagagguaaagaaagaaagggggagggggaaaaaggggaggagggagagggaagagucggagggaguggggagacggagggggagggagggagggagggagagagaggggagagagagagagagagagagagagagagagagagagagagagagagagagagagagagaaugaauaagagaauaugcugcggggggggggggagugagggaagggggaaggggaggucagacaccuaccgucccugaacgcccaaggauggccugagcucgcccagugccccagccugccucagcaucagcggucccugagcacucagugaguugagcaaguguuaaaaucccgaaguaggaagagaccccgcaggguauaaacucuggcugaggguggagcggaggacuuuuaagagagaaaggaaaggagagagggagagggagagggagagagagagagagaaagagaaaaggagaggaguggggguugaaaauuccaaggcugauccugcuagcugccaacuugaagucuucagcucgcacucuugaguucucugcaaggcugaaacuucgcguagauccggaagaagugauuccgagagugggcucgagaagagcgcggacgcgcgagugggacggguggggguuguccgcagagcauggcagugcggggcgaggccgcccaagaccuagccaagccgggccucggaggggcgagucccgcccguguggcaagagggaaccaccgccaucguggcgaguccucuccauccccucggggcuccggcuguuguuggagagcccuggcgcugcagccgcuccggcgcucgccucaacucuccucggcgcugugcgcgggcucccuguccgugcugcuggcgcugcuggugaggcuggucggcggggaggucggaggcgagcuggagaagagucaggaggcggcggccgaggaggaggaggaggaaggagcccgagggggcgucuucccgggcccucggggaggugcucccgggggcggcgcgcagcucagcccuuggcugcagccggccgcgcugcucuucagucuccugugcgccuucu

SEQ ID NO: 3471 - RNA, 5731 nt, Mus musculus
ugcacugcagcgacucucugagaagaggaacuggacuccccaagcuaugcucuaucugaagggugcacgugaguuccauacuccuuauucuccucacggagggugaugggagacauccggggacuccuaagagacagggucacagccggcuccaguaaauaauuaggauuucagacaauccagaaaccauaggagugggcaggugggacaaaaauacucugauggccagaaacccucccccaaagagguguuuggggucacuacugugaccuggcacucucgaagcugaggcaggagaaaugcuagcuugggcuaccuagugggcuccaggucaaacuaagauccugucagggaaaaaaggaaaaaggaggagggaggaaauaagaaagagcuggagaaggguucaagaaaggcgaaauaaaggaaaggggggagggaaaagugggggauaagaaggaaggagaggagggagaaggggagggaaugaaggaaagcuggcugauugaauuuagagaacuaaugauugaacaaagaaggugccugguagaggagcauagaauggcaaaagaaguuaggaagggagagaggaagggaagggguggaaggaaagagagaggcacgcgcgaaucccacuggggcugcucuccgaaucgaggucgcaucccuggcgggaacccgcgaucucccugauccuggggucuagcugucugccucaguccuccucgugucccaccccucccccuucccaccccccgcagagggccgccgcuuccucuccgaccagagccguaggaaggagcuugcagaccggccgccuccaggugagcgagcgcugcgccuauggcgggguuccaccugcccuguccccuagcaggcggcuagugagcccggguccccaaacuggcagggucuguagcacagacacagggcagagagaagcccccucuccggguauuucuggaaagagccuugaucuuucucuuccuaaauagcaauugcuacuaaauaaucacuuagacauuucaaguauaucuuucuccuaaaugauuagaaacagccgccaaagguuuuuaaccaaacgcaauuaaguuaaaagcuaugaacgaaugauugagccagguaugaaugacugagaggaggaucaguuuucuuccgggacaaacucuagauaagcuauccaaucucaaguccucagcccuaaauaguuguaggaaacgcgggggggggggggaaucauaaauuacagaggaugcauaagacgaguugggggacagagagaggguggaaacuaugcaaacaguacucaucauguaugaaauucuccaaaaaacaaauuaauuaagaaauagguucaggaacauuuuuuuuccuugaugaacuuaaugacauugcaguuuaaacagaagaaaaaauaaucuugguaaaauuuuguauagaaguaccaagaauaaaagcuauacuuacuuggagagauauucagcacugcuuagcaugccgauagcagaugcuuucagcuuuuguuucaguuccugaguuugcagugugacuggucuuguuuuuuaggguagaauauguuucuucucuuccugcuacuuccgauuaaaacucccagccuguccuagaucaggaccaugucaucugucaacuuaaguaugaaauagacugcagcggcauaucccugugacccaguaaacauauaauucaauaaaagugaaauaacucugacuauuuagccagggucucuucauucaaauagcuaauuaccuccuaugugaccacgauuguaaucgguuaucucaaauugacuuggaagggggaaagcagggagauccggcuccaaugagauauuuuggccaaaacaaccuucuuuaagcugugagaaggaaaaugcacccccuucuaaacccuggcgagagaaagcuguguggccuccuacucaucuuccuuuugcuacauacuccauacucccuagcauucauccucagguauaaacaaauggaaggucacugugguggcagcaagauugaucaucaggcaaaggcaccggccaccaaaccugacucccuaaguucaauccauaggacccacauaugaaaggagagucacacacaugcacacacacacacacacacacacgaaugcacuaaauaaaaugcaauauaaauguuuaauaaacuuuuuuuuaaaaaaaaucagcacauaguauacagaguuuuuucuagucuuguauggcagaguaagauucauguacauggguguuuaguugacacaaauaucugaaugcugaucuguuuacgauguuaaugggcaggaaugugugaaugcuucuuucuuuauaugaauaucaaggcugagcucauuucuguuucuccagaaagacgaaacccagaucuugaacugcugacucucccagaggcugcagcccuguuucuggcuuccuuggaaaaaucacaaaaaggugcaggugugguggcuucucuguauucugggcugagaaccuuuguguccugacugcucccuccccaaacccacagaaacacuuauucaauaaaggccaguuacuucccaguaaaaugagucccaagaauacuaaagcacuaccuugaugagaguggggaaagaaccguagccuauuguuagugauguuuguuuguuuguuuguuuugaauauaaugccuauguauuccaagcuggcuucaaauuccuuauguagcaaaggcuggccuugaacaucuuauugcccugccuccaccaaauaggacuuuuaaaacuuuuaaagcuccaauuggcuucauuguuuuauaacuaaaaacagcaaagccaaaaauacgaaauaaucaaaauccaauugcucaccauucaaaacuaaaccaaaugaaaguucuuauugccaauccuuuuucccuuucccacacagcaguagaugugguucccccuaacagacaggagcagccuugacuacaggccugguuuuuuucaccuuucugcccagcuucuaagccaggaguggauguaaucuucaaacagccauucuaucccugagauuuagaaguaccaagacaauuaaggcaucuuggcaauggaucagcugggucuuuggaacuucauagaccucaguauaaauccaugccacacugagugaggcugucaggggauaaauuuugagucuguuuucuccuuccaccaugaugguuccaggaacugaaguuggguuguuagacuugagagcaggggcccaucccugcugugccuucucacuggcucuaaugguuggcauguucuggguagcuugucucuggagaugcgccaaagaaauugcuucuuuuuauuauuauuaucuuuauuuuauuuauuuauauauuauauaauuuauuauuauuaucuuauuauauguuuuauuauccuaaaugaagggaggaguuguggguucccauaucauaugucaaucauuuucucuaauauuuucauugcagaaucucuagguuucauauggaugucucuuacaucaugaacuuaaauuccaauggaguuuguacugggauguuuuucugucccaccucuaccccuuaggcguguaugugucuguguuuccguccgugugcccacauuuucuuucccucuagagagaagcacguuuucuaauuacuauuuuucaaaagaugugagcaauugggauaggucaggauucaaauuauauugugaguagcugagagaacguugcuuuaucuagaaggcagucguuggaaaauuaaaaucuagggcauguaugcugugucagccacuguucucuaccccacucagguuucaucucuuguaccuuuauauuuaggguccugugaucuuguuacuauguaaucuuuaugagaugcaccaggccuaacauuuuuguauuugcacccagcuaacaaguguguuugccuuuggucucagugguuacccagaagaaaucacccgaugaaggaauaucuucaagugugucccugugucaucuuucccaugagggagcuauaucaucaggaaucacgggccacaucauuuugaugcaaaugaaugguuauaaugucaggugcuuagacuagaggcauguuaaucagagcaagacagucucuauauacuucugccaaacuugccacaucacacuuaauuuauuguagagauuuggauguugggagcuagaauguagcucaguugguagaguguuugcccagcaagcacaaggccuuggggcucaaccccuaguacuauguaaagaagcaugguagugaaugccugugaucccgggagcugggaaguggaggcaggaagaucagaaguucaaggucacagcuacauacauucuggauuuaaaaaaaaaaugugaauugccagccaugauugaguuaguuguugguagcauuggccaugauugagaacuaaaaugucuauuuccugagguucuguuucccccucuaaagccaugacuguguguucacaagaaaagguguuuucuuuuuuucuuacagaugaaggagggaauuuugauaaaagcgaacucuuggaagacagacucuucaacuggugaaaacacaccaggacaccuucaaguguaguccucguugugauggaaaccagaaccacacgaggggcccgugcacccuuccuuccacccgagaaaccugcaccucuagguuuagucccauggaaauccuggcuggaacauuaccacuggcuggaacaucaccauuggcuggaacaucacccaugucuuacguaggcuuggauuauucagggccuuucacgugucaaggcugagaacucagaaauguucuuucuucucccugcagucaggcccugcuuugauuuuggccguuuguuuucuuaucccauaauucccuugccuuuggugccacucagaagcaaauaucgcugucccucaucgucccagccccagugagagagagggugcaccgggaagggaauggauaggaucuccuagauaggaacucgucugcgaggucaaauaaggagggaggcaaggagaagaugccugauaaagcucccaugaaaacacaucucugucgcugcugaaacagggcaccauccaugaugcugaaacugcuggaaggucugugaaaacugaggaccgggagccucuuugugcuccuaggaccuaacugaacuccacauagaagcuuagaccuuaagguuacugacacacaaacagauggugaugucagaguuugcuggagcacacggcacacaaagguacaaaccaguuguucagguucagagguaguccaucuucugugacuuugcauuaagguauucccaugacacaagugagugccacaugcaugauuuacccuuucccaugcacacacaugcacaggcacaugcacacgcacacagugaaggaauuugggagugaaaucccuauaccaaggagacuaacuuauuuggaauuacaucuugaucaccguguguguguguguguguauguguguguguguguguguguguuuaaaaaaauauucaauucagagucauuaaccauaagugcucaagugacaaaguagcgauacuuauuguccccagcuuacaguuauuaccuugaacuauacaguaucuuuauguaaauaccgcuguaaucugauauuuuaacucaacuguguuaaaucaaaaccuaguguauauguuuugccugcuucucaguucauaaauaaacaauaaaacuauauucuaguuaauguac

SEQ ID NO: 3472 - RNA, 17736 nt, Mus musculus
gaaccagagaaaaaggcaggcagaaguaugcugcaauugcuaacuuuauuugaucaggagcuccuagugcaaacaucaaacaagccugggcuuugaucugugagcucauaucacaugucagggaagaagcaaacugugaccuacauacauggcugaagacuaaagguucauggucacauuggagguuuguguucuacagccuagagacuggcagucacaggucuuugaggucuuucuggaugucccacaggguguccgcacucuuccugagcugagcgaccucaucguccuucagcuucugauugaugacgcuggucagcccccgagcauugaggaugcacgggagacugaggaagacuucauucucaaugccguacauucccugugagagcaaagaaagcauccaaugaggccaugagggaaugaucugaagaaucacguuggauccaaacaacuauagcaaguuugauaagcacaaauuaauucccuaguuuucaucuaauugguccauaugucccauaaacuuggguuuugaguucagauuuauauuuauagacugugcaaaccuauucuacgacaaaacuaguuacaggaaaguagucaguauuuaguuuuuaagucaaauguuuucugcuaaaauacaauuugcuauaugaaccuuuccauggcuuuuaacucuuugcucaaugaguaacuuucuaucaacucauuuuaagauuugauugauugauuggugcuuucuggucuaggcagcaaguuccaggacaaccagggcuauacaaagaaacuugucuuaaaaaacaaacaagaucaaaaggauguuuuacuauguaucugugaguuuauguguacuaugugagcauagucgucuccaacggccaaaagagggcaucagaucuccuggaaguagaauuagaauaucccaagagguguuggaguaguuaacuauuuaauuacuaaacuauauuuaauuaacuauaucaaguguucugccacuuuaaaucagggaauugacuucucuauaugacuaguagauuaauuuauuuaacaagcuaucuuaauauuuuaaacuauuaaccucaaauucuuuuguauauacaccaaaguagagaaaauuaaaaacauucuguaugcuccccaaaagucacaauuacucguuuucccauacucgccuuguaaacugucuauagcgcucuaaccuaaacgucugguaucacgcuguccccaacuaccuuucuguaugugugguaugcuugcgugcacacguuucagugugcaugucugugagugugugugaguaugggcgugugugucugugugugagagaguuucugugaaucugugugagagucagucugugggugggagugucuguggguguguguaugcaugcauacaugcagaaaucagguugucaucaggugucuuucaugauagucuccacuuuauuaaggcaggaucucucacgugaaccccauuuagucugcccagccagcuagcuugcucuuggggaucccacaccuacuauuucccaucauccuuucuucacuuuugacaucgacgugugggaagggcucacguguugcguaugcuguucuaauguaacguuacuuuucuucaauggacuucauuccgagguggugaugcagcccaagcucaucucaaacuuccuacacagcugaggacgacuucgaacuucuaacccuugucuuuacauccucagaugacauacagaucugcacaaccacguccgauuuaaacagugcuggggaaucaaaccuggggccucaugcacgcuaagcaagcacuaucucaacagagauaaaucccugcccucggcucagguucuuuuugccucuuuuguaaguuugcuccauaguuuuugauuuaaacuacauuugcuguguuaucaagugcuacaugaaaggcugucuagagcuuacuacauagugagccuaguauguacuuauuuaaugguauaguagaggaagguucggaauaggauucauaguuaagaguuuuuuauagaacacaaggaagacuucuuagaaaaaguucagauaucuuagcucccagagagucaagugcucuuauccuaaucacugguuagaaagagaaaaaaauaaacuuuuauuauauaaacccugggugcaaaaguuagucugugcugaaguuucccugguucguucuuuccuuauuuuuuaaagaugaaucucuuuguacaguguaagacuggacauccuguucuacuucauagcugggucucucaccuucaccaugguagacacggggugaauccgggagagguuuuucagcauggacucgaugaggucagccacgcucaggccgauggcccaguugguguagccuuugagcuugaugacuucauaggcacuagaaaccagagcgaggagagagaccacggaaaccugacggcgggugcugccugcucugucugacuauuguccucuuggcccaugucuuaaccuuuuuggcuauaguuccuuuucuuaguaaaggaggaaagugcaucuguuuuguaagcuuuuuaagaauaucaacugaauuaauauacaaacaaaauaaaccuaaggacgggagacaccuagugaugugucuucgaagccaccacgaugguuaagaaugcacauuuaagauuuucuuuuuaaauuauguguaugcauuguguguaugucuguguacacauggugcgugugcacaggacugcuagcaucagaagaccagaggcaccagaugcccauggagcugggguuacagguaucuugggccaccugaugaggguacuagggacguaacuucaguccucuacaaggccaguacacacucuuaacuaauaugggaucucuccaaucccuaaaaaaaacauuuccaacccaaauuaauuuacauaagcauguacuuucaaauauaauaaugaacauuggaaguaaugaaaggcaggagagguuaucacucaaagagcagucaucuaaucacucuaaaauugaagcauuaacuagauugaaaaucuaaggacuuuuucaacuuuuagauccuuuuugcuauaugcaaaucaaauucuccaggaaaagguggucucaguaaaccuugcauaugugaaguagccuccuuccuacagaaccucucuguaaauaguuaacccuuacugagugcuugucagugaucaaugggaggcccaccauguuauacgugaccuuauccugacacgucugugggccuugcacuuuacacagacuaaaagguccacagagaaccaggcuaugggccauuaugaccuagugcaucugggagaagccagaugauagauaacccugaagaugaaaucgccuccaguagcuauagucagcuuugcugguaguaugugagcguaagccugaguuaugggcuguauuucaaaaugauguaugauuugggguagagagaucauaauggagaaugguugauaauaaaagaaagcuuaagaaaaaaaagauuaggaugggagacaucuuaaagagguagggguaggcagauaagaacagagcugauuaaaaucucccagcaggcugcccaaguggguugugugacuauaggggcccaggauccccucugugaggaaccaagccugauuuaacagguggcaagguaaggcccccucacuaggcaauuccaugguugucucuacauuugccggguuuuccccugagaacacacauuugcauucucuagagacuugccuagcacgucugacuggucuacacaaaucuuccccaccucucagacacacucaccaggugaagagucaccagagcagaaguguggauucuaucuaccaggacaggacucaaacucuaaguggagccgcccgcccacucaccuguccaccaccaucuuaugcaccuccuuccaguucucacugucauugucuguccccauuucuggauucaguuccuggagggagacuccugccacauucaccccgcuccacacagccacugagagaaaaagcaagacaaaaccuuuucuuaucucagaucucugaugcaaauuaucccuacuauucuaauggcaauugucccugguagaguucccauccuuuuuggagagauauuuguuccaauuauuugccuucaacuaacaauagauaucagacacaugcacagacacacauguacagacagacacauacacacaaacacacacacacauaauguauauauguuuguggguaugugcuggugcccagaguccagaagggugagccaagacaccugaggcuggagcugcaggccauugugaaccagauguggguucuaggacugaacuuggguccucugccacagcaacaaauguccucaccugcugagccgcuucuccaggcucuacuucugaccuuuucgcuuuaaacaaauguggcucaaaacagucauugccaucauuuacauagaacaugaaauucuuuuccaaaucucuaggcugcuaaaaaccacaaggaauuauaguuugggaucaugcuaaacacucaauuuuagaaauguaaacuucucuccuggggacuguuugguaacaaaagucccucucuucauaauuaaaaaaaaaucuaggauaauuauacccaaauacaguuaucauuauggaaguacacuaauauauaaauuaaggucuucuuaauauuggggagaaugucuacaaacaaacaugggaacuggcuuugaaaucccagucucaugauccguagaaaguuuuggagaacacuggacacucagaugguauggacaauggaccagguacauuccagugcaguuacacagcuauggcagguaaucugugaguggcuaaguaagacccccuuggcccacaguaucugcagugccaagcuuacuagacauccaugcagucuuaaagaaaaccauggauccaucucaucgugcccaagaaugagugacuuuucucaugcuauggaugugacugcuucauacuuaauggggagggccaauacagugagacaggcaagauagcucagcagguagggauaugugcugccaggcgggaugaccagaguuugaucucuguggugaguucaaagccaaccuggucuacauggcaaguuucaagauagccagggcuacacagagagacacugucuuugaaaaaaaccuuaaagauagcuaagugcaucaauggauagaugacagaaagagagcaaacuggaauagaacccaaaauguuaaauauaguacuucugagcccuuucugaaauacagcaauguauaugaaacuaaaaucugaaauagggaaaagagcauuccgggugacccagcagcacaaagggaacucuuucuuaccacuggagucuccaugcucgcccaggauccauccguggcagcugcugggaugaaugccaagcuucucugccaugagguagcggaaucgagcagaauccagauugcauccgcuuccaaucacacggugcuuagguagcccgcucaguuuccaggugacguaagucagaauauccacuaaauggcacagaaaaaauaguaaguaaaugggaacugcucagccaauuagaaggagcuucggcgucugccuccacaugugagauguggccagaaagauucucacaguugggucaggcaggcaggauugaggcauuuguaaagaagcuguaaacguguaaacaugugcaaauguagcauuaucugacauaaggauacucaugaggauuacaagucaaaugaaagaaaaaggcaggugcagcccuuucugugauaguuuggauaaaaauggcccccauagguucauauauuagaauucuuagucaccagggagugacaugauuugaaaggauuagaagguuuggccuuguuggaggaagugugucacagggggugggcuuugagguuucagaagcccguggaaggcccaggcucccucucugccuaaggaucgagcacuagcucucaggucugccugugugaugccauguucucaccaugaccauaauggacuucaucucugaaacucuaggcaauuaaguacuuuuuauaaaaguuguggucgcggugucuucccacagaaauagaacaguggcuagcacacucagucacauugccaccaauauuaacagucugggauugugacagcugucaucacaaacaaugcuaaguuagugaggugcaccuguauacauuuucuugagugugauauuguccaauaaacgaucaugaaaucuaugucacuacuaucuccuagcuggaugacugcuaccuagccuucaucuaugugacacaguggugagauuucuguggggucacagaaguuacaggcuguguuggaaaaagaaggaaauguacacccugggagaaaagaagcugacaauggguuaggcgggccccaccccugcgcuccucuguggagccuggcaaagauaucuuuggcacacucucacugaacaaggccuuucaucugccaacuuuaaugcaccacaaaagcuuucuggagucucauacuuugaagcucuaccuuggaaaugauguaaccaggucgcaccgccagugaagcaggauguggacacgcagaacguggcuaacugcuggccaucucuguucgacacauaccuggcauguuuguuuacauacgugccugaaccauucagaaagccccaaucuaggcucauaaaaaaggagaauacagaaaugaucuccuaucgggucccaggccccaguacuauaggaacugcagugauuccccaccugggcaggcugagccacaauccuccaggugacagaucagacacagcucuaccauuuuauaaauaugcucaccaucaugcagcaacuuugaugguaaaugacagagcaaugaugggugacacggaccugggugacacgccucaauggccuaccccauaguucaguguccaguacaucccaggagaagggagguuagugacagacauuaaacuuuuaaccauuuggucugggcacaugacaaaauauauuuaguuacaaaaccuuaauuauccuuagaaagcuuuuccuaaacagagaaaggcuaacgagagaaaaaucuuccuccacugcccaaaaaaccccaggcuauugcaaaguuacuuucuuugcaagauaauaggaaaaaaaaaaaucaaucaaucaaacaaacaaacaaaaaggaaaaaaauuaauugauugaugccagguuauaagagaugauuccauguuuuaauuuuuuuuuguuuucuuuuguuuugaaucuaccuauaugucuauaagccauauacagaguccaaaagaagauaucggguuccuccagaacuagaggcaccaugugggugcugggaacugaaccuggguccucugcaagaacagccagcgcucuuaacuaccaagucauucuccccacccccugccuugcaagccccguugggaaauguggcuacuguaucucucguccugacuuaucaauucaaaugaauggcucggagggagcuuagugaugugcacuuugcuuugugaguucugauuauuguuauuauuauuauuauuauuauauuauuauuuuauuagauaguuucuuuauauacauuucuccuauucuuauccuggccugcuagggcccagcagaggcugcaugcaaugcccuuauauaauuuuauucacaggcuacaaagguagugucagucacugcaguguguuguauguggcgaacacacauagucauacaugcacaggagaguacacacacgugagugugaaggucaaagguccaugcugagucuuccucaguuguuccccacauuaguuugagaugggguuucuuaaccagccagaguuuaccgauuuggccugacuggcuggccaggagcaccagggcuccucuguucuccaucucccuggcauugaaauggaagacgcacacucucacaccuggcucucuauguggaggcugagcucggguccucaggcuuacacagccugugccuuacagagccacgucccagcuccaccgacccaucauuuacaaacauaaagccuuacaacuccacaacauagacggaugaaaccagaaggcaaaacccaugauacaaggcuucucgcauuuuugaacauguggccugggauggagccaucuguuuugcagacaccauccuucuuugccaguaacagaaggcaaguagacugcggacagccucggucagugagcaaacccaaaacaaugaagucccccaaacguuuggaaccagacaugccaguguuccaguuaaggugccauguugguaccuggguuggaaaccacgaugauggugcagucagggcuguacuugacgaucugaggaaugaugaacuugaacacguugacauuucucugcaccagguugagccgacucucccccuccugcuggcggacuccugccgucaccaccacaaucuuagaguuggcugucacagaguaaucuugaagaaacaagagaguggaccuuaaauucagcuccugggccgaacaugcuaucucugguauguucuagagguuccaccccgcaaaguuuccagaacuuaauuuucuguauuaauagguguguguguguuaugaaccaaaguuagguccucuggaagagcagcacacacucuuacucacugagugauccccagcaacuauuaagagguuuuuuuuuuuuuuuuuuuuaaagauuuauuuauuuaaugugaauacacucuuguccucauacaccagaagagggcaucagaucucaucacagaugguugugagccaccaugugguugcugggacuugaacucaggaccucuggaagagcagucagugcucuuaaccucugagccaucucuccagcccuauuaagagguuuugaacuucaagucucugcagccgcauuuuucuuccuugaguaacaaugaugcaaccugacuucaaaacugacagauaaggagccagggaaauaacaccccaaauccguuuguggcuaagaaguccacugagcuuccagggaaagcugaagcaucucacugagcccgcagcccagcaggcaggcuuuccccgucgccaugaaucuguggcuugcacauuccuacauuacuaacagacaacacagacaaggcucauuuuuaauuccguuuuagccacguacugaugcagacaucuaugaaggaaaagaaaggcaguguuugguuuggauuauaaauugaauuuugguuucuaauacuucauauauuaaagggaugggacacaccuugaaucccauuagucaggaggcugcggcaugaggucaaggucagcauggccuacagaugccuauaguguguauguuuuaagacagucgcacuaugcagcccuguuuggcuuacaacacaccacgaagcccaggcuggccuagaacugccugccucugccuccugagugcugggauuaaaggugugugucaccacgcccggcuguaccauauuucuuaaggaggauuauguucuagcacuguuaauauuuggagaaguuuuucugcuaagguaguaugucaacauuucaguauuucaagaucugacaucuggcuaagauuugacaugaucauuagccugggugacaauguggcuucugacaguuacuaauagucuuucccauaaaaugcagggacuggccguacccuuagcauacaccugugaagaugaaaugacaagcccaaacaccugacgcaguacucugaauguggcuagucaguaaguaauggugauuuaucuaguuuuuucaaggcagccugucccugacacaaagauuaucagcacaggaaaaggaaggggucugggggccuagaagaugccccugggacaaaugcagugcagucuacuagaaaaaucaggaugcuacauaugggcccugcuaggguuguugguauuguuuuaaaagcauauuuuuuaaaaaggauuugauuuaaaaaauaugcagccaaacuuuuacuucagaaauaaaacggucuugccaggcaaagcaccacacacuaacaaucccagccauugggaggggcuagccucaagugcauagugaguucaugguaacauggauuccaugaggucuaucucaagcaaacaaaaugaccacagggcacacacucgggaaaucaagccgaugaagagaacacuuguuaugugguguacagcaccaaaugcuacacggaugcucaugacaaaauguucaugugccgugugcaccuguuagcacaaucuccagaaaaugguuuucuagaaacggaugcagaaaagcaugccugugugagaaagaugcagaaagcaaccaccaccaucauacaucauaauuugugauuuuuuuuccugaugauacagcugcagaccuggagaaggucucauuuuaaaagacuauauagggcugguaagauggcucaguggguaagagcacccgacugcucuuccgaagguccagaguucaaaucccagcaaccacaugguggcucacaaccaucuguaacgagaucuggcgaccucuucuggagugucugaagacagcuaaaguguacuuacauauaauaaauagauaaauaaaaaguuuuuuuuaaaaaaaaagacuguauagucuacaaaaaguagaauugagagcaaauuuuaaauaauaaagggggggggaccauuucuaaguagauggaaauucuguagucuuugaacuuacuaaaauaggucaugaguuuuuuguuguuagagauuacuaaaacugccccauaauucuagcuuucccuaguuaaaaaaaaaaaaaaguuuauauaggcaaugguggcacaugguuuuaaucccagcucuugggaggcaaagauaccccaggucuauagaucaagucccaggauagucauagcuguacagagaaaccccgucucaaaaaaauaaauaaaaaauaaaaaaaauaaaagaaugaacaaacaaauggaggauaacaaaagaaagaacagagagaaguuuaggacagagucuuccaguaauagauagcaacaaaucaacaaaagugagugaucaguuugccguacuggagggugcaucccaaguauccauucauacgaaaaccccuuucauguucgaucccuucgagagugcgaagaagcuacccaccuuuaucggccacaauuuucggagucuggaggaacaagcucccgugcugcagguccaucaucucuccuuugagcuugucuuccaacacauccaccagggcaaguucaucagccagagacuagaaacacaaaaccagccguucgcuccuguuguggucugagugucaaauagcccacaggcucgugaguucugaacacgugguuccuagguagcggugcuaacuggggacacuauacaaccuuuaggacaugaagccucacuagauaaaugagccacugggauggagaccuugagcuuuacagaacagcuggcuuuacuuccuggcucaucugugaagauguuagcaagcagccuuacaguccugcuacugugcugucccugccaugacggucuguacgggaaaauuaagccccuucucauucaaauugcuugccagguguuuuugguugucacuaauccagcacccaaaauccugcaaggauggcuuagccccaaucuaccccacagaagccuucuacaaauggcuaagcacccaauggccaaaauccucaaggacauuggaguaugguauucaaucaucuacaaccuacaauguuuagguuggcucugagcagcucagggucuuggcaggcaaggcacccaagucauaggaugaagaguuaugucaucaggaacccaaucccaggcacagggggggaugacagcucuguaucaaauaugaauacuaauuuuaucuacuuuuuuuuuuuuacuuaaacauguuuaggggaaaaaagauucuucuccuuuuccauggagcaucuuagagcccacagaauucuuauuugcauuuuaaagaccucccacuuaacagccuaacaggcugugcgggugcccaggaucagcgcguccaaucauccuuuaguaacagcacaugugagccacugcaguuagcagggcaacacaauucagagcuuaauguaggaaaccacaucccaggaugucagggucucugugucagagcguguggagaauuagcuuggaagugcaugcguagucgaaggaaagagaugagccaauaccuaaagaaaaauaaccaaagagcugaauccagcuggcuguguaugacagaccuccucgaagagcaguuauacagacagaggcauagcaacuaugcugcugccugucucaagucucucuacccacaccuccauagauuauacauucaccgugaauauaaagauauuauuaaggagcaaggcugguuggaagccaagaguguuaccguagaaaucuuuuaaucuuaagucuccaguggaacagauacaguuguggauuucgccucuuaguuaaugaaugacagccaucaauguguugguauuuaaggcuggugguuuuauauucaagugccuauuaaccaugggauuuuugugggagggaaagguauaacuuuucaaauaauuaacccaaccgguaagcggcauuagcuaguuugcauuuugagcuuuggcuaaccuggggauaugugggaagguauccugggcggcagcagcagugagcugcaagauccagggucacaguucucuccaguguccuaugcugcuguggcacuggguggguuacgcauacuaaauaaacacauuguuuuguggugcugagguauugaauccaaggccuugugcacggcagccauguucucuacuggggcguauuuaucucuauugucaacuuuuggguuauggucagauacguggaggacagccaccugagccauucuucugcugcagcugugugacccugacaggugaccucaguuuaucuuaaaacaaggguaagacaaguuccuaugaggaugaggugauaacaggccaagaaucgcagcaccuggaagguugaacugaugcaagagggaccgccaagauacuaaggccaaccugguuuuuuuagaggagaccccagaacaaaacaguaauacacaccauacacacaaaagaaaaguuuuuaaguuuaccaguuauuuaaaauagagcaccucaaacuuguaaugcccuccccugcuccaccuccuggaugucgggauuacuggcaugugccaucaugcccgacaccacacuuuagauauuuucuuuaauuuuauguguauauaacacauacacacauacacacacacauuuuuaaaagaaauguaagcucaauuguuuuaaccaaaguaagagucaacacuaaauaaagaccauuuaaaaccccuacauuucaggaaacuaucaccuaucauaaguaucuaguuaauuaaaaaguagcuagagaaaggagaaaagaacacacaccgaugaguccuuugauaauuguuucucaguuaaaagauucacaguuugauccuugagaacuuaaaggucacacgguggcuagagggguggcgcaguggcuaagagcccuggcugcuccuguagaggaaucagucuagaucccgagaacccacgugguggcucacaacaucuuaaacucuaauuccagagcaaacaacacgcucuucuaaggcggccauuuugggcaggagugcacaaacaucuauucaggcaaaacaccaaagaaguuaaaguuuagggucaggcacgauagcccacacugguaagguaaccccaacauucaauccccacaagcaggaacagucacaaguuugaggccagcgugagauacauacagacucuuaaaaacaauauaaauaaaaaaggucaagaacagaacucagggguuuaguuguagaaugcuugccuagcauacaaaagagucccugggcucaauccccaacaaaacaacacauuaaacuucacaagcagaaggaauaugcuuggugggaggaauucaagcagcuaccacacaaaagggucagugugcucuacccagggcgggcaggggguggggggaggggcugccagcuugcuucucucucucuuccuacauuuaaggaagcucucagaacaggcaaggccucaagccacuaaaacuaagaggaacauaaagaagccauggugugaacggcaaaggguguguguaagggcagccaggagucuagacaguuagacagcagaaggaaggucaagucuggagacaccaaagcagcuuacaacugaugucgagagcuucgggccacaaugacuguggaaacaagcuggagaacucagaaacuuugaucuugccaagauaugcucagcugguuaaaggaaugcauauauacauauguguguauauacauaugcauguacauauauagagagagggagcaagagagaagaggaaggaaguagagagaguacgagacaaagcaaaaugcagcagguugauaaaucugaaagaugcauauguggaaguguucauuaucaaaauaaucuuuacaaauuucuauuacacuugaaaucacuucaaaauaaagccagagguucaaaguuugaagauaggaagacauucuucaaaguucagcaagcaugucucuacaaaaaacucuacaaacauguccuaagaggacagauuccacugcaucuaaauuuuccagccacagagcucaguuuaccaccacagaaacgaggcaagucacuaugcuaucccucuugguauggggcccacccaacagauacaaugagauaaaucacaaggagacaccagaaaagcaggcacugaagaagaugccaugaaacugaccuuuuuuuuuuuaaaaauaaaaauuaaaaaaagucaaaagcuugcagaacagagaaaaagauauacaguaaggauauaaaaugcaugccuuggauugaggcaaaaccagcuauaaggggugugguuuugacaaccuggagaguuuuaaauaugaauaugaguaugacgggaggacaccacaauacugcagugguguuaagaaacucuggaagcaguuccagaguggucacacaaagagugaccagaaaccucccauaacaaguacugaaaaguacguguaauuuuuccaaguuauuucagaugccugagggggucugacgacaacacagaccuaggcuccucaaacaaacuacaaacuccugcagaaauugugaccuauggugcucuucaagcauaccuuucccagaaugcugauggcacaugccauacccacuuguccaacgcccacuacagugaucuuguuguucgggacggcagccucaucaucugcaacggacgcaaugagcuucuccuuaaggguugccaucuuguccugcaagagaaggggcgaucaaugugauuuacaugcacggaaucugacugagaaguagcccaaaaugucacagcuucaauuuugaaaguauagcucaacagaagcccugaaggaaccacaucucaccgaaugcaggacucagugcaaaguucuccaccaguuuaaaccaaaaugcuuccccagagcagagagcuccaugcaagccauuaaguugccaccaucccuucugugaccuuucugcuguaagugcaaacuacuggcuaaagauacagauaauuauacugaagcaagcucguuucuuucuuuugucccuauaaggaauuuguguuuaaccauguuaaccagcuaacuuauuuuuaagcuuguuuaaagccaauaugaauuguaauuuucauuacaaauaauuguggaagacaaagacugauuuuuguacuuaaaaucucacaaaaguuauggcccugcccuccugacaaagugucuucacagaaaaguuaucaauguuaauaaucuacgcugauugcuuccguuuguuucuuuuuagcgugguucaucacagcugaggcucccuauagguuccacagcccagccaguucguucccuuuaccuucauuuucacuucuaaucuguaaagggcuaaguaacaaaaccuggcuuaguuaaugaacccaguaaggaacccuuaguuguccagagugaaguacuugaagcaaucacaacuacuuugcuccauaacuuauuuuuguuguuuuaaagccucccuccuaauguguacugcuuccagagcuauuuuagagauuuuagaggguuauuuuagccuuagagaauuacacuuguaguuuuuuggugggugggaagaugaacugcugugggaggguuuggacaaagcaccaaccuuaaaaugaauccagucaggcccugugucuuaggcaguuucagcugaguagccucaacaguaagaaaagcagagccuccccaaagccugcccacaccaaguuuauuuuuguuaguuggcuuaaaaucugauaggcuccagagaacauuaggaaggccuggagucccaacguuugggagguggagguaggagagucaggagaggccaaggucacccuccaucauccugggaugcuaucugaaacgcuggaacguugaagcuguccugaaaacauuuuaaaucgcuuuggggaauuucaaaagcggcaguguugaagauccagcaagcacaggcagauaucuagacugaaguucagcguguauucuccucccacccccaccucccacagugauagagaaugagaagaaaauaguuugcguuguagcaagccugugucaaaucagggaguugacuguagagagaaaggaacaggaaaaaacacccucgccucagggugcccccacauucccaucuccuguggauaagaaccaguggucuaggucagaggcuaaggacgacuccgcagagaaucaccuauguuaacucuuaaugcccggguauggccuccaauuucuccauuaaaaccagucauauccuucacccuacccccgaccccaggugcugucggagcuuguucaguuccgugacacccaagccaccuuuccuccugugcaaagcaggucacgagggagacaccagcgcacaccucgauuacggucuccagggggaaagccuaggcuuccacacuuagcacaagaaguaaacaaaauccuagcgcaucuaaagaggcccagcaaguacccggcugcagggcgggcagcgugagaggggacgaagccugguguuccggaccgaacuuuccuuuauccucauugcuaaaauagcugggaccguucuccaucaccaggugcaagaccuuccaaccuucacagggacccaccuagaccuugcucgguuccccggccacugggcgcgcugcccuggcuugcgccccaggcugcaucgcagcugaugggugaugugcuaacugccaaggacuugaagagacuagguuugacuuaccuuacguuacaagucuuucuauugauagcacacaggcccgagaccacccugugcucaggcuguaccaaggugcagaccgagucgggagcucagcugcgcaccucugcucgcucggcuugccacccaaaaccacaaagaagaaauagguaggggcaugaaugcucagggacaaaggccccaaagaguggaugugucguacguagcuccuuccuccuguucugccaaacaauaacaccucugcacucccuacucccacaacacacacccugauguucaguuaagucagguuuugggauccuggauucagaccuaccagaaaagaggaggcucugcggcgcgcugaggcaggggagccacugcaaagucagcaggcugcugcucugcggaucgcagacuccggcucuacaagaaggaggagg

SEQ ID NO: 3473 - RNA, 19266 nt, Mus musculus
ugaggacaguuuuaaaauuacauuuuauuuaccuacuuuguguuucugcuggaggcaauaaggaaggaaaacaacugucccaggauacugauggcagaugagagacagcguguagcucacaggguggguguaucaagaagaauuuuugaaaucaaauucuagccuaucguaauaaucauuucaaugguguguuugccugcgccaagguuacguugcauacuuggaauaaacacauuuuugaacugccagaaacugguuaauuaaagcuggggaagggaggcuaguucccaugucuagaagccagagggggcgauucccuagaggaggggaaauccuccuuugaguaugagcauuugggaagagcuacaaagcugguuguaaaggacaaaggggaggaggguguaguuagggaugcagaagaggcacugaaggacaggcagagaucgcucacacggaugcuacauuguauguaucuuuucucaucgcugugagaaacaccuggcagcuuagggaaggcuuagggaagcauuuguucaucccggagggacaggcauggcggcgggauaggcauggcggcagguggcugauugcaccacgugugcaguuaggaaacagaggugcaugcugggacucagcuggcuuucccuccuuucucuagucauuggacgagugaggcucaccuuuacagcgagucuucccuccuuacaggacccuuucuagaaauaccuucgugggugcacacaggaguguauguuuccauggggaauauaguaaacccauucgaauuggcaacaguaacuaaccauugcaucuucuaagugaguguaucucacagacccagauggauauaaauguccagcaguggacugaccagaauuccaggccgugggguaucaaugaagucuguagguuauucuagacaaagcacaggguaguucaguuagguuguuugucugcugcuucuacauugccuggaaggcauuuuggaaauuaggaaaagcgaaggaugugggugggcaagaguggaaaugauugaguagcugggcagagcccagguccaacuugaguauucaucagagagauguuggcaccagucuagaaaaugguugacuaauguuucugagcuuccuagggcaaugguucucagccuguggucucaaccccuuuuggggguugcauaucagauaucuacauuacaauucauaacaguaauaaaauugcaguuaugaagucccaacaaaauaauuuuauaguuggggucgccaucgugugaggaacuguauuaaaggguggcaucauuaggaaaguugagaaccacugcucuaggugaguaacuucuggagacacagucaucaccuuucccgugguugguguccuggggaaguggcucacguggcuuccgggucaagggcaugcagacagucugggaggccauccuucugggcuugagaggcauccuucuuuacucucaacagaugaagagccaugauugccccagugcuuugaaucuggguagucacagcgacugucacacauuuacaacagaggccugcuuugucucugcagggacauaagucuggcuccauucugcucauggcuguugcugcucucccuguggagaaugugaaccaggacaacugaccucaagaagucuuacuguacuaguucacugccugccucugcccacuucccuccuaccccucucucccucccccuccuccuuccccuuucucucucccuuccccucucuucuucucucucuccuucccccucucuccccucuccuccuucuccuccucucccacucucucccuacccucucucccuuucuuuccuucuucuuccucccuuuccuucccucccuucuuucccuuccccugcuauccaucacucccucccucccccuacucuuuucccuuucaccgauucauuuuuguuuacccugcauccucagccucuuaucugcucucccagcugucagccucuuuacuuccuaaacuuacuuccucaacccucuuucgcagccugacacugauaugcggcaugaagggcucucaccacaggguggcggugagggcagaauguuagagauaagggagauauuuuacagcacgccuuaucuucagccacugucuaaaccaaccuaaccuucccgucccaggacccgcaagucuaccuaguuuucauggcauugaugcacuuacccaugaucuuguagcuuuauguuccucuguuuccccagcaagagcucgugaaguguuuuccaccccacagcuuucucugaccccacucucuuccaaggcuuaaccgauugauugguuuucguuguuguuauuguuugcuugcuuguuugguugguuuuuuccuccugcaugcuaugauacuuugcagaucuaucaaguaugaaauuugagacacguuaugcuguguuuguaacacuucuguuuccuuaacgggacuuggauuucuugaguuaaaacaugaggcauuagccugaggagacggcuuggcaggagaagcagagcaaguaugaggaccagaggucaaauuucuggagcgcacauaaagaugggcacaguagccggcauccgugaccucagcggucccauggugggaugagggacagagacaauagcauccccggaagcuuugggggcagcuagcuuggcuuauacagccacaaacaaaacccagaaaccaacacgggaggucaugacugacaccuaaggcugcccucugaccccuacaaugugcaauauguccaaacucacauaugcaagcaagauuagugaaagauagguaaagucgcaaucaagccguaaugguauuucucuccuggcacuuaggcgguaguccauacauuucaguugcuucuguuugaaucagagauuuuuuuuccacaggcagucauggaugaucagagggaaggagaauucuccagaaaggcauaugggcagcugucuggguagagcuacaacuguaacaaaacuuccuuuuccuauguaguugugguacuguacucugcucucugccugggaugcccaggcgcugccaacacacuggcuagagaagauggggcaaaguccagacgagagucuacagcccguguuucacuuugggacaucagauacuacuacaugcuggaccugaaggggaaauagggucuggggugaauucugugguuccugguuuccucucuggguaccuggguacuguugguguacuacccagaagcaaagacuagaauggggguccaggguccauguucauucuccaggcaucuccacuuggcaggaagaggcaaguggagcccaagaggaacagaaucugguccaacugggaauggguguggaguagcagaagggugagaguugagaaaagccuuuuggggauucuaaggcauggcucucuuaggagaaggccuucccuacagcgaucuuuaaagaagcagcucugagacgauccuugcuuguucauauugcuuucuuggaaggggaugugggcgcauacauuuuauucagggugaaccagggaaggcuauugguuaaaggguaaggcuauuuagaugccucauucgcauggagacaaacuccaggugcuaugcuacaggaccgagugccugugagccucucaguuggugguggaggucaccugucuaaagcaggcaugagaggcuggggaggggcugcuccacuccuacuucagaucccugagauucggggacuuuaaauaugccccaccucaccguucuuaggccugucuagcagcgcaauaacaugccccacauauagucuuaaaguuagaacauuggccaacuaaacauuccuagaacaugaggucuuacaaguaauuccuguuaauguucagaugaagaaaccagucuuauguuucugacacaccacacguguagcuuuuacugacaccgccgccgccaccaccccagccuccaaucuuuaugaauucacaaauguuaaaucauuuuacacucuaagagagaacaaaauaagcaguugacuuuagucuagcagagcuucauugaggaauguugacgaguucaagguaggaguguuugauaaguugggguauuugaugagaaguuccgaguaaaguguuuuucacgcguucuguuugaugaacgacccgagccuucagaggacugggugagcgagcgggcuuugaucugucuccgugucugagguuuaauuggaacuuuuguuucccauagauuugaaaaccugcugugguccagaaagaaguuuguggacaacaugaagaucuauaaccacaguuacaucuacaugccugccuuuucuaugaagacaggcacagagccgucucuccguguguauuacacacugaaagauguuggagccaaucaaacagugcuuuuugcuaaccccaacuuucuucggaacauuggaaaguucuggaagaguagggggauccacgccaagcgcuugucuacaggacucuuuuuggugagugcagccuugggccucugugaggagguguccaucuauggcuucuggcccuucucggugaacaugcaaggggacccuaucagucaccacuacuaugacaacgucuugcccuucucaggcuaccaugccaugccugaggaauuccuucagcuuugguaucuucacaaaaucggcgcgcugaggaugcagcuggacccgugugaggagccgucaccacagcccacuuccuagggacugcagaagaagaaaggacgggaugggggauauuuuugcuagguuuuuuuuuuuuuaaugugacuucuaaaaagaacugccaaagugugucauggauuggcaugauaggaaacaaacaaaaccuaagcaaaacugcuuuugauguuggcuuggagaacaacaagaaauaaagugucccggggaauguuuuuauaguguuguggauuugcaagcgggacaaccccaaggagacgaugauggcagagcacaugucugugauucaaaucaagaagaugugauucgaggaccagaugaacucuuguugcugaggccgaggggcccaucauggcagccugugggagaugcugggauauugcugacugucaauauacacuggcaucauaaucauuuuaaagauccgucuuauugagacuggcauuagaacuauagguuuaaaaaaaauuauuguugauuuuugcccuguucagggcuauggguggguaaugguauagacuuacaaaacccuuccugcugauuauugugauuuguuaaaacaagucuuugaugacuauaguccccuccacuaguacgguuuuaaauaagaaucacuucuuaccuccuuuugguuaagucuacuuagcaugaagcucuguugaguuuagacuguguugaucuauugucuagaucacacgagccauuucuucacaucagaaguugagagggaaacuaaauuuuagguccccauuacaucaacccauuggcucuguuauuuucauagaaucacuagaccugcaaguacacuguuuacuuauaaaguagcagaagcgcccucaucauuuaaugagaggugacguagcucacagagagugagagcuucaucuuuaagauagacaaaggcagggccuuuuccucucuaacaugaauauuuccuuccacgauaacucaugcguguauacgcauauguauacaugcauggauuaucuuguauacauauauauguacauauauauguauacacacaugaauauagacacauacacuuugacacucucuacacuuucuacaaaguaaucaaagauuauucucaugaaaccaucaguacugagugugcauggccuagagucuguaaccaguauuggagagccacauguagugugggcuccauuccauguugacacagucaggcuggcauggcaguugcugucagcuugccugucagcacagggugcaaggcugacccucaaauacauaaaucagaaugugaaccccucucuuacucauagugccucccugcaccccaaaauuucaugaaugggcccuguguugagccuagugacaugugauguggcucuuucaaggaagcagguaggaaccaccagccguuuaaguccuuaaugccgaguggguggggccguuuaagcagcuugguacaucagcuuugacauagcucgggagcuuuccuggcagauucuggcccagugugcuuacuguagguaagggggugagaaggggguucucuuaugaccuuugugcugugagaugugcuaagcucugaggagauguacgaacccauuuuauuuuuucaacugucgucaugauagaggugaaaacgacucacaaguucugccucaucuuggagguagaaacucgguguaucgaccaugucuaugaaaagcagggggcuuuaaaaggaagguuaacuuacaagacaagcaagccccugagauguacccuuggggugggggauuuccaaaagugauccaauauucaggcuacucuauggauagcauuugaacugaggaaacugggcggccugaugguccgcucgcugcugugcagagcuggcuuaguguuuccguuugugugacagcaucaggauaucuagaaggcagcaugagcuguguuauucguaucugcgcaacccugacuacaaucucguuuugagcuacugguauuuaaccauuaucuaaggaagaagacauguucaucaguagacuucaucagaaguguaaaagggcuaagaaaacaucacauacaaagauuucauuaaagauguguucagaugaauacauuaauuggucaaaaucuaagcaagaagcucauaacagaccacugugcacugagagaacugucugggagcuuuagcucuccaucugguuccuagaacagguccguguguuuagucugugcaguuuuaaagccacucucuaugggauuugaaugucagaacagaucuggccaacacugucuguccuuuuuacccgagcagacugcccuucccucaggugccaucaggaccccgaggacacuuucaauuguuaugaccaagagugcucacacuuguaguagggagugaccaugaaugcugguccaguaaccacaggucagccccuugccacagagaaugacucaguaaaguguuaguugugugaaggcugaggaaccccaggcuagaccaaaaggaaagcuugacugcuccugugcucuguccuuuaggccacagguauaacgcugaugucaugaacaggaucucuguggccuuucguuauuuuauagugacaauucacugguaugucguauguaacuuuaugugagucugguuaaaugauguagcuaaacaagugugugugugugugugugugugugugugugugugugugugugugugugucuaugugcauguaugugucuauguguguauagcugugugcaucuguuuagcauuauuuuuaguaaaauauguguuccuaaguagaagccucuccagaaucauccuuuagaacauucuagaguagcaccuuacucuuaagagauuggguauuauucaauccugcuuauugagauuuaggccuucagcuuugggccuaguccacuauuuaauguauuugaccuuuaacuuucagcucagaagggauuuggguuaugauagaaauguuuaauaggaacauuaauuaauuucauugugucuggcaagagaugacaccccacucuaccaccaauuagaucagugcuuuaaguguguguaugugugugugcacaugcauguggaaaauaaaauugcuucauggaggaaggagagagaaugcagagacugcuaaugaauacucaaacaggaauucucuuuuugagucaaccgcgacuuaagaauuuguugauucucaagcucccaagugagggcggcugcugcuugauuuuaaucacacuucaguaaaaauuaagcuaggugaagagcgagucaucccagcagaaggaaagcuuuuacaugagagagcuuuucucagaagaugacucuuagugcuuugccaaaguauauuuuuaaaaaauugugugccuaaaccagauuguucacguuuaugacuuugaaaaaggagggggcacgggagacucucacccuugaggccugaaugcccuugcaggguccugaguucagguucugaugcacacuuacccacacacagcuaacuguuacuccagguccaggacagcugguguccuccucuggucuccauggacacugaaugcaagcaagaacauacacauaauaaauaaaugaaugaauaaauaaauaaaucuuaauaaagguagagaguuaauucucuaaaauggcagauguucagguaguguccuuugugcuucuucgcugggaagccagacaucuauaguuuuauuuuuuucauguuugaaaauaccaaguucauagacucuuccacuggcaaaucauugucaggaaagaucuaaugagaaaaucagucacgaguccacugaaugguuuuuaccuuauaaaauacagugcugugguauagaugcuuccccaaugguuuuuaccuuaugaaauacaguguugugguauagacgcuuccccgccagaaccagguaagauuacuucucaucaaaaagcccagagaucaagggcuguaaagcuuugucugaacucucaagggcaagucugcaguaacaaagacugaggaugcuguuguguguuuuuuccugcccagaguagucagaaaugugagcuccaggcagcccacaucagggguggaagcaaauuaacaauguuugacaccugcagcccagguugauguggcuaaucgggucagcaguaaauccucuuagaaguuuuggaaacuugauucuguuguaugcucaggagaggaagaggcaaggugacaagggaggugaccauaguucccaagcucucagcauccacggggacagaggggucuauaccuuuguucuugaugacccucuuguccaacagaggagcuggcuuccacugagggcugagcuagaagcccccacugccacuuaucucugcccuaucacaguuguugucuuccacugggggcugagcuaguagccuugcaacgacaggagccucagcaugaaaauuugccaauaauuuaaaauuuugaaucaccaaacauauuuugcuuugauuuuuuuuuugccuaggauugcacuugcuaaucuuguggcagagucuggucacuguggcccaggugugacccugcauacgaucauacgcagaguucuuuucucugucuauauggguggacuuccagagucccugaaucuauggagauaacaaauaccucacaguuccugugcugugucuuugaaagucuggaauuccgaaguccagaauaugucuauaaacuccuaaaugugaggccacaagauuuagucucagcccuauacaacuccuguuguguaagugggagagucuuauaucuguacaucacacacacacacacacacacacacacacacacacacacacgaauaguaauagugucuaguaucugccuuauucucagccuuaacauguccucugacauuuucacacacaucccagagauaaaugauugacacauggcacaaaugaaaagguuaucccgacuacugaaccuugcucacuguaauaaggacggcaucccgcgccuccuccuuguugggguucucgcugcugcuagcauuuguaguuucuucugcuguuauggcaaaagaauaaauaacauaaagaagugagcuguaauauugugagcauuugaauagcagcccuugacucucacuugugggagcacaaaagaagaauugcauuuuacgguugcuuguuuaucuagacggucagucucucuguuguguuaaaagccuuccuggauuugcuuuaugguugaagcuguugggacucaaucaaugacucacaguugcuugagaguuuuauggugugauauccugcuucuguguaauuagagcuccucuggauaucucucacuuucaaauguguguuaucuuagcaacuguuucaagauaccaggagauguguugccauggggucuuucggguuaggaugaagagaugaaggauguggcguggacuaggcagcuguauagagaaaacucagaggugguaccugguuucccaugugggucuaagcagucuuggaaccuccagguuccugccuccuccaagcagugcccuccugggugccugagcuuggugaaauaaaccuacacauaucucucugucaccugccuuuugagucauacucucaagaugaguuauaguuuaguuuuccuaucaagauggugggaaaugucaccuugauguugaccacuggaugugguuaccauauacgauguacacagcaagaguuggugucaacuuccuguccccaugauucccaagggaggccauggcagcuuagauucauuauccuucauguuuuaguucaaucucucucucucucucucucucucucucucucucucucucucccucccucccucuagacccccuccccucuucuccucucuccuucccuauguuauuuuuugcccacagaauauagaaaaguauauugacuugguaguggggaguggcagagggugccuuaacuuuuccuggcucggcuccccacuuacauagcucccucauguguuuguuacuuuguagauguuuccaugucugcccaacuuuuaccuuaaucaucagcaaggacccuuuuacauguagcaaaugggacuguuuuauagacauuuacaguagaguauaggccuuggagaagucugaugaugguguguaauacccuuugcugcauuguugaacauuuuucuaaagucuuuuaggugauaacuacagaaguauuccuagaguuaaggauuuccuggaaaauuccaguauucguggaagaaaggaaccaaccuaucgcuguuuucuguucugucuucggcacugauaggcccucucuccacauuuaggaugacuggcggcuaccguaguucacacaaggaucuuacacaugagaaggggaaagaaaggauucacaucacaauauuuuaaagccugcuucaucuuuaacaaauucugaaacaccgcuagacuuaggcuuaucauguggcguaguuugaucugcaaaauauuggggaaauauuuuuaccuuuggccucuuucguuguguauuguagacucuaauuccacacacaugaaagcuguuuuaucaguguaaauuuucagaagcuggauuagaguaaaaauaggaaaauuuaaauauucuuucucauguaauguagucuacugauccauggauauaauaauuccgggagagauuuuuuuuagaucacacuauaaaauugaaccuuugauggauuugcagaguggcuuccucuugcuaaagccaaauuugaugaauagaaaguguaggguaacccaaugcucgcucgccccuccuuccuuccuuccuuccuuccuuccuuccuuccuuccuuccuuccuuccuuccuuccuucauuucucucucucucucuuucuucguucucucucucucuuucuuucuuucucucucucuucuuuccuuccuuccuuccuuccuuccuuccuuccuuccuuccuuccuuccuucuuuccuuccuuccuucccucccucuuucuuucuuucuuucuuucuuucuuucuuucuuucuuucuuucuuucuuucuuucucaaaaaaaaaauucacauaaaaugcagcagguaagaaaaauugauuuaaucgguauucuuuauggugugacuugaaaaaaaaauggugccuaucuguuggcugacacaaacaaugaugugcccaagggaggucacugggaaaaugucuuuucuuucguguguuccugagugguguggcagugaggagauuuaaccaagucucaguuucucuaccucccuuccuuggagaauauuuggaaacguacccugugaauaaaauggcuuuuuuuuuucaacgaagcuucugacguccuuucauuucucugaagcacgucuguucuuuccuucucaaacuccucugagcuuuguuccugccuuggcuucucugucuuacuuuuccuguguggguggaaguucugcugcuuauuaagaguauuguuuuaggagcccugagguauaggacugccgagaucgcuccgcagacaauggagccugcuguucagccagaugaucugaguuggaucauagagguccacauggugagagacggcuccugaaaauuaccucuaacguccacauguaugaaguggcaugugugcugucacacaagcacacgugcacacaaaguuaauuggagcuuuaaaauccaaugcaaaauuuaaaggaaaaaaauaaauauagaauuauagucaccguaucaguaacagcaccacauggggcuggugagauggcucaguggguaaagaggcuugccaccaagucuaaugaccugaauuugauucuugggacucugguuguaaauuaaaugaauaaauguaauuuuaaaaguugccugcaugugggucugagcaccacauagcugcagugccuggcgugggcagaagaggacaccagauuuccuggcacuggaguuguugugagccaccacauggaugcugagaacugaacucugguccuaugcaaguguagccagugugcuuaaccacugagccauuuauccagacuugggaaaaaaauuaaacacuauaugguacauauaagaacuccucgggcagaggaaagauucuaucucuuauauaaagcagacaagaaauuaugcauccuuauagcauaaauaauacacaugagccucuuuuucccaacaauaaaauugucugcguuguaaugagucaguuucaguguguguguccagagaugcucucauuaauugcuaacaugaggcaagacauugcuacuccucuauucaaagugggugacuuugagaggccacacaccuucuggucaaaauuguuuagguaauugcuucauuguccccugggcucugggucccaguucugucagacacuuccucagagggagugacaucaagaaagguacccuauccguccuuuaugguacaguucuuggaaauugauccagacccuugguacagaucuuauuaauuaucugauuuuauuuccaaaguagccuuuuaggcuauggcuauuugaggacagacgauuccgaguggagacaaagcacagcauuuagcugauggcuucgugggguggggcagaccuuucguauaaaugugggugaccguaacugccugaggaaaacagauuuagcuuuggucaccaacuaucacuagcuccuacaagauaaauuuuauaauucagcugcucuacuccauuuugacuuaaacauucagaaacagauagcaagagcccaaaggcauaaguguguucaagaguucccccgauaagccuaaagcaggauaauuaaaaaccacaggcuauuuugaaaauacagcaagaugauaucagaaauuaaaggagggcaaucaaauuccuuucuaauucacaguaggccaccucagggacuugacggcaugcaaagguuugaagguuucuucaugcagagugacuguuauuauugguuguugguuaugccacaggaguuaugguuuccaaucacaaacugagagguugaagguugugguagagcccagccucaauauugggaacauuuuagaauuuuauuuuuguuauuuucuauuuguguguagugugccugccgcaugugagugcucaugggguggggcauagauguugucucuucgggagcuggaguuacaagugguugugagucacccaaugugggugcugggaauugaacucagguccucuggaaaagcagcaaguguuaaucauagagcucucucuccagcccuguauccuggggacauuuuuaucaucaacagggcaacgaaggacuaaaaggcaauugaguguuuauuggcgucaaguuagaugucagucgagacuacucuguuuccaugucugcauguuggagagaagacgguguagccugaugaagguguucauugagguggacugggagacuuuugcuaucagucuccuccugguggcuaagaaaccugagggcugucucuauuucagagguuaacccucaccuuagcuuuugcuggcugagcaaaucauaagaaucauaagaauaauccuaagaagcagguuaucccugcucccuguccgugaguccagccaggcacagccacgguaccugagaucgccacagggcugccuaauguccugucuguuuugucagcagcucucacaaaggagaaggcugggauggugacaucaguuucuaaagcagucuugagauguccccagggcucuucuccauaggcucagauaccugaggcagauguuuauuuugucuuccuuuucuaucaucacuauuuccauuaacaccuacacauaauuucuggcaucaucagcagagacacuguagggccaugaccagauaaggcccccugaugcagcauagcccacgaacaucaacauggcuccuggcuacggcagagaucacagacauccuauggcucucagugguggcacagugucaggacaccaacaaggaccuuugcaguaagagaccuuugugugcagucagagcacagacccaaacauggcccuuaagcaguaguauaagacuggcuuugacgucaccauggacgugagugguaauggaggcuacucacauuggugugggaccugcagcagcauugcucacagacaucaaagcagaccuggcugcaguaaggccacggauccagacauacccgucuguggcagcacagaccuggcccucuccauggccuuaagcgguagcacagccuacaaacaucaucauggcuucaggccgaagcacagacuaucuccauugcucccaacucucugucacccauuuucucuuaugguuuucggugaggccacagccagcaacacaaaucaggcuacuuuaaggcuauggacccaggcauggcccucaacagcagcugagcccuuguccucacuaccgucucauguggcagcacagcccacucacaucaguauggcccccggggucagcauggcccacggacaugaacauggacuuaauaagccaugguacaagucaugaauauccguaugucgcaggcaagagaaaacacgcacaguucacggacaucaaccuggaccucagucaaaucagagccacugaccuacacaugaccuuuagcagaaucucgggacaugguccuuugagaagaucuauccuauuucaggccuccacccugcuaagauuuagggugauccugugugcaggcagcuuguucggagacaaucugcgugugcuuaagcucuuggcugcugccucccauccagccgacuccauugcuacugugcaacaucuccuugacuucauuggccauugacaugauccaccaucaaccuccacccucucaugcuugucaccgcugucacauccccaguuucaccacucuuugucaccacuucugccucccaucaucuccacuuccgccucucuccacaguacgcacacccuuuggcuccuccguucucucuguggugccuaccuguuugggauggagagccgccugugcccgcucuuugcagaugggcaaaaucaguuuggagggaccaaacacuccuguauauuucaaugguuaaggagcacuuugguuucaagacagggucucguguagcccaggcuguccucaaucucacuguguagcuaaggauguccuuaaacuucugaugcuccuguucuccgugucuauuuuaccauccacuggcaaucaaaccuagggccuugugccugcuaggcaagcacucauugaacugaguuacauccccagccgggggugggggugggggugggggugggggcaggguauuaaguuuccuugagagcugggcuggggaauaacaaaaccaaauuguucccgaguacaaagcaggugugaguggacagagaugcacaguaggaagugugugggaacuaacaucuugagaaguugaagcccaucugaccagauguggugaagguuugcggacaugaccaacuuuuccugauuggauguuuggguuacauucaaaauguuuagaaguguggcucucuguacguggugguuuucuguguaauaucuuuuuaauuaagauuuuaagauuuuuuuuuaugauccacuaaucaguugaaggccaucuaggcuggucccaucaucccuguagugugaccauugacgggcuauccguccucugauguaagguguggggucuuuggagugugcguccagaacuaauuauaacauggcaguucuauacugacuuccgccauggcuaugccauuuucuacuccaccuacagugguucagggucuccauuuuccuaacccuuccccgaauuuguaguuguucuucuguccggaguaagaugaacucucaaaggauucuaacuugcuucucuccgcuuacuaagggugcugggugcuuuuuggagucuuuguuagccauuccuguuucuuucuuucguuuugucuucaguccuagaaaccauuuguaacccguucauuugcucucuugauguuuaacauguagcauuuuacaaccagaucgggagccccacugccccuacggugcaccccuauuuuaaagucugaauccagccagguuggguggugcaagcgugugaccccagcacuucagagacauucuucagggccagacagaucuauagcaggccagcaagaccugccuuaggcugaguaaaaauuaaacaaggaccgaguguuaagugacagaugagcuuuuuuguucagguguguuguuuuccuuggcuuagcccuucccgaggaugguagguuucugagaaggcagguuucugagagcuuucaaucugccucuccuuagacaagcuugggaccuggaaagcugcugacugaggcucuugcugcccuugaaggcucaaacccggguucugagccgaaggucaccgcagggcuggccaggguugacaaggugccuuggaugagcauuuccuuguccuuuaacauugaaugcacgugaacgugaaccgcagcauaagucgaacuguguggugcagaaggaaaagcugccccacccguugacauuuauaggcagaggcaguuuugaaaggaguuucauuuuuaaaauaccauguggcuuuagauuaaauggaggaagauaauugcuggucacuggcagucagacauauuuucauagcaauaggcugaguuauagagcuggugcccauaauuguauucuuaaugccuuuacugucaucaaugugacugagaaaucucugucuagauuuuaucaucucuccaaauuaaucaccuaccacuagagagagagagagagagagagagagagagagagagagagagagagagagagcuguauaaacauauuaaaaaggcacuggcaacaugggcuaggggauggugguucagucaguaaagugcuggccucgcaaccacagggacccaaguucgauccccagcacccauauaccaugcagagcacugugcuguguuccugugaucaccaaggagggagagacaagaguaucccuggaggagccuuccagccuagccuaaugugagcuccaagacaaagagagaagaguucuuaaaggagcuggguggugcucucaggaugacccuugaauuguccucugagcucuguacacaucuguaugcccacacacccacauacacauagccacacccacauacacacauuagaacaagaaggcacugacagauggacaucuuggcagucuuccaugacaagugcacaguuacaccaauccccuguuacuagauuuaaaagcguuuauucagugggacugucacaaggcugucauacucuucccucaccuuuaguggcacuucugaguccaugacaaacugcaucugaacgcaucucucuaggaacccggccaccaucagcucuucuucucggguuguacaauuugauuguuuuucacuguagacagugcauucugcaaaauauaacaaauuuauacuaauuuaugcccuuucauaucaucccccugccucuuuguauggauaacggucuauaacuuuauacauggacauauaaaauuauuaauauuuaaagaucgugaaauggcuuaaauguaacaacaaccacaaaacagaacaacagcaacgauaaaaaacaaaacaacaacaacaaaaccaaccaaauaaauguccacaacucaaccgacgugcauccuagaugccucuaaccaaguuuuucugacuguaggaaguggccacuuugcccauagacauaucuaaggaauaagaagugaggcagcaauugcaggcggcaauucgaauucagaaaugucaaaacaugaaaagggucuauuuuagaaucaauaaaaugcuuuuauccuccauuacuggagugaagcaaaagcauuugugaagagaccuugccaaacaagagagcugccaucaaggaaaaugacugugccugcgccugcugccguccuuucuucugccagucaaccuuagcgacaggagggaaaagaucuuaaauaaaagggcccagucagacaagguuuccuugacaauaaguucaaaaucacguuaaccugagcgucuuuagacauaaaccggacacuagggggcgccagcacacaaggugcuagaugagaauaucgacaaaccguuugcuuguuuuuacaaucuguucucuggauaaguacuuacgcgccacgacuucucuggggacuguaaagaugauucgauccugaacucggccuugaagaucucucccuguagugagagccaccaagcaucagugugcaagugagaguaaaggaaaacggcaggagauuaggaaagagguggaaaggauugccgaagcagaacagggcugaaccugauggcguaagcuacucacuucagcaccaagcaugcugagacgggaggacugugagcuugaggcuagccugugcaaauggaaaaaaaaauauauauauauauugucugguucaucaagucaaguuucuuuugcuagcuagggaaaacauuuuaaaaucugcucaguaacggguucugcauuccugaagaaccuucccgauugacuuugugggagggguaagaacagagguacggggcuccuugagggaggauccacaggcaucugugaguccaaagaccaaauagcacugugugacucuguuaaaacaagcccugauggagccgagcccugauccaaua

SEQ ID NO: 3474 - RNA, 738 nt, Mus musculus
cgugaccacagcacaguuaauaauguauuuccaccgcacacgucucaccgaugccaaaaggaggaaggccagcauagaggcacugaagggagcaggugaauucuuuacuacgcagacaucaggcagaugcagauggaggagggaggaccccuuccuggccuggugaaggcucaaggcugugguuuuagagaaagugaaagggguagaugggcuguaacucccauuccgggacugcagcuuuauaaccuuaaccuaggauucaucgucucagcaaaaugugugguagcucguguggugacucuugccuggaaucccgguacucggggaggcuggagcugaaaggauugcugcgaaguucugagccaaccugggcuacauagugagcaguagagcagcuuaggcuuuaaagugagacccuaucucaaaagaaaagauacaaauaacaagacugaaauccucagugugaagacuaaacaccuccuacaaaaaggaagguaccgagcccuggagaaaggccauucacccacaggauaacagcuaaguuccuucauuuucuugggcuucagucucuccacuaacacaccaggaugaugucacccuacagggucaccaggaugaugucauaauacagagccaccaggauguugucagcacucauccagaacuuaucagagggaacaacacugaacauuccuugaaugcuggucacuaccauuaaagauccaucuugggcaaaca

SEQ ID NO: 3475 - RNA, 385 nt, Mus musculus
ugucaguguaaacaauagauguauauuuuuguuuuccaaaaauuacacuauuucagauuuuucuacuuaaaaugcaucucaccaguucccgcaucaugguauuuuaaaucucauucucucucucucuuuaaacacaacugcagcacuguaggaacaacacuugcgcugugaauggggagucucuggagagcaggcucauucaggagugcaguaaucuaguccacacccaacuuccuguucggcugagaucgguacguuggcuucuccuccugguugcgcaaugauucuaagucaucgcagaacacauauugggaugaaucagaucaccugcucaggagaaggguugacuuuucaggagugaagggaccuuuccaggaagccugug

SEQ ID NO: 3476 - RNA, 89692 nt, Mus musculus
ucuuuuuugagccaaacuuuucgucuguugcccaggcuggcuaagaacucgaugcaauccuccugccuccacuuuccaaguucuggguugacaggugugcguccccacaccugacucuaaccagaggauucuuacugaaauucauagaaaaccacuacucgcaucaguaccccuuccugguggccgucucaggaaacacuaaaaguagacuccucuaguaugcuuggcagcagcagucuguccaagggccaacaaaaugaagcgcggcuggguugucaccagcgccgggugcccagagcgcuggagcguguccucagcacggcuccugcaccuaaccgacccgaggcuggguagaugaugcagggcucgaccgguuccccugcucuccagcucagccccgccccucucccauggccccgcgaauucaaaucggccccgccgcagggcagagcaccgagagaucgaucgcucccgccccucgagccgccauuuuuggaaggugggaggagaaaggugggugggcgcggugccugcuuugcgggaugcugacuggacuuggcggcucucugcagcacgucagggguagggcagcacggcuggccggcgcccuuccuccggcugcuucuccggaaugaggccucgguggccgcgcgggacgacucgguuccugcucagagcgugagugcggcgcgcgcgcccuccgcugucaguuggcgcgcgcucccgacgccucuccgcgcgcccccgcgccccccccccccgggcucgcgcucgcucgcucgcucggcgcagacucgcuuguuuguuucugcaggaauccuaggagaggccgaagccgccgugaugccggggaagcugaaggugaaaauuguggccggucgccauuugccggugauggaccgugccagugaccugacggaugccuucguggagguugguuccugguccugccccccagagcacggggcgccgagcccugcccuucccgcgguccccggcuccguggagggaugcccgcccgcccccagcccgugagauguggccaucgguccuggacacgucccgcugccaagcucgcggucagggcgucgguccgaccaccugccgguccgaggcguggcagcggagacgcucgccacgaccucguuugcgguuaggagguuaagggccauugcugcagcaaguccacgcagccagcccucuggggacacccacagccccacggugcgacuacauccaacccguaccccaacaccgucugaaucaucagugcaagucacacacaacagcagcacuaaagcugcccuuguguagacugguagggaggugagcuguuucaggguaauuuauugccucgagguaggaagucaauuaagugccauggguuucaauugcaaaauugcucuuuaagucuaaugauuaguuuaaaagucaugcaaauuagcacaggccuacuguccggaaguuaauaacucacaaccugaaagaagccaaggagaaauuguaauaaaaguugacauaaugaggcagaccauuagagcaauaaucauuugggcuauuaaugcuuaggguucaaagacauaugacaguauacuuauacucaauauauucuuaaacguuccagaaccuaauuaacugcaauucacuguauuuuuuauuuuauuuauuuuuauggcauuuguugaguucaacuucaucuuuuauugaaacaaacaaacacaaaccaaacuaaccccccccccccaaaaaaaaaaacaaaaaacaaaaaacaaaacccaaagcaguuugcuccugggccagaugucaacagagaucuaaugauaacugaaguuguacugccuuucaggcagccuggagaguaauccacacagcugauauuaauaucuaauauguauugagcuucauuauugagauauuuguguuuuguacuuuugaauccuuaguuuuuacagcaaagcuaacuaggagccauauccucaucuuacagguuaggcaguggauuccuaggggcagaaauaaugugcuucgaugaucuaccuuguaaaucuccacagccuagcagcagucucuucuauuauaacuuucccaccucucuagacaaggugcugaauguuauuuuugaaugaugguuguuugcuaggcccugugcuauucugguuuaguugauguauguauaaugaugaacaaggugaauuugguuucugauuuuaaggaacuuuuguuuuggugacuaagacauuuuaaaaguacagaauuuacgaaguagauaaugcaaauuaggaaaaaauuguuaugggugccauaaaaaaaugcacuagaaagugguaaagaucaccauuuuuagguugugaggucagugucaagcaacgccuguuggaugagagacauuagcuccugagagccuguagccugugucuguguaaaagggugaggaggcagaggagaagcuggaggaggcugguguguuacaggaguguaggagcaugcaggugaugucuuuuagugacgggaaggggaguagucagagccacauuuggggaaaugaucaagugagguagauggugagaagauugguguggacuacggaaugggaugucucccguggguaagaauuucccaugggaagacaguuguguaguucugagcuuugucauugcagaucuucagugcuacuggccaucugguuuucuaaaacaagcugcuguagaaacuauuuaaucucaauuggggcuuuuuaucccaccuuugaucguucaguucuaagauaagacauacaaccuuuauauuuauaauaagccuuaaucagcacuuuacaccauaccuacccucuaagcuguuauguuuacuucccugccaguaacuccacaauaugacuugcuaugucccauuugggcuguucuuaauuaaaacuggccagcccucauggccacgauucaagauucuuaccccauggcaugggaauacucucucuccaucuuuuucuuccucacccuguccuuguagucucuccucagacuccaagcccaggagccgaaacccuugccugucuccugcccagcuauaggcugugaacaucuuauuuaauaaauauucuuaaauuaaggagcaaggccacauuguccguggggauuccuucuucccugugggcaucaggcuuggauaccaguauuuagcguuacaguacacagcaaaagaccgacccucagcaucuugcugcucccuggagcaagcaaaggcaguguucaguuaacgugaugguuguaguuuguuguuguuuuugauagucugucacuguguaguccugugccucaaauuugaggcuuuccuguuucugucucugaagggucgggauuauagauaucugccugugugucuaaguuacucuucuguugcugugaagauauaccaugaccaaggccacuuauagcagagacucuuuauugugacuuccauucucagagggugaguccauggucaucacgguggggaagcuggcagcaggcaggaagacaugguaauggaucaguagcugagagcucccaucugaucugcaagcaccaggcagagagagacuaacuacagcggugacacacccagugacauacucuuccaaauucuuccaaaacaguccuaacagcuggggacugagcauucaaauagagaagccuaucauggucauucucuuucaaaccauccaaucaugccgggcaauagcuguggauugugaacauuauaaggauauuaaaaccuaucaaagggcugcacaaguggcucagugauuaagagcagugaauaaucuuccagaggacccugggucaauuccuggcacuaauauguccauucaccauggucuguaaguccaguuccaggaaaucugacaccuuuggucuucacagacacuagacauugcacgagguuugcagauauccaugugcgugugcacgcacaugcaugugcacacgcacacaaacacucauacucacauauacacuuuauuacaaaacuuuuaucuguaaaacuguuuuagagucuagguauauuuccucugagacagagucuugcuauguagcccagacuggcuuugaauucuaaucucuaagugcugggauuuacagacuuguguugccuuaucagucuugucacuaucuauugggcuauucaaaagccaugacaaggugggaaucacuguugggaauuuugcaucgcagggcaccuaguguuucuggaucuucuugugcacugccucaaaacauggcuagcaacuucucaaaccugaggcuggugagaugguucaguagcuaaugaugcuuguugcaggcauggcaaccugaguucagucccuaaacuuguaugguugaaggagaggauuggcuuccaaaaguauccucugaccuucacaggggccaggcacacacagacgcauccauaagaaagaaagaaaccaguuaacuaguguuugaaauagagagagacauuucuaacacucaguucucuaaauuguuagugcagugggauauauccuugaaaaaacuugacauuaagaggacauucgaagaugggguguggcgaugcacaucuuuaauccccagaagcagagccagguggauguagggaauccugugccagcuagaguuucauagucagacucugucucaaaaacguuauuugaguaggaggauaaggggaaggaaacuguuauggguaugugaaaaauaaggaaaagaucaaaugucuuaguagguuggagaggaagcuucuacaaagaggaaacccucaguuuuuaaaaagaauuuaucuuauucgauguguacagugcuuugccugcauguauacaugugcaccacgugcuugacugguguccaaggggccaagaagagaacauggagcccucuggaccuggaauugaggcuaguuguuagcugccauguagguccuagggagcaaacucagguccucugcaagaagugugguuuuuaaccagagccaucucuccagcccagcccucaaguguucacguagcacugagauggaaggaaugaaggcauggaaguggcugcaugggucagcagggaaagugucacugagcucgcuugucaaguugaagucucacuuagggacuuagagaggauugggaugcgugagugagaaaguggccuaagcuaagcggccguggugccgggagagaggagagagucugugguccuugaugugcacauagcuuuuagcaauuaaggaaaugcgauucuaggacauagaauagucuaauaagaauaauccugcaggagggcggaaauuaucaggaaacggaggauaaugaaggauuacauuaacgagauaagcucugugauguggacuguaaguaauagaagcugcugggagaggggccucagggagccuaggccucuaucuagcuccuaaugagacacccaccuccuucccaccacgcccuccagccuugccaguuacagcgacagugugcacucucaugccuggcagguuaugagaacucgugaugcuguggcuggaggauaguuaaguggccacagggacauagaaaaagucuuuuucacaagaguaggaccaccuuggugauggcaaagccagggauagaacauauguaauuggaaggaggguugguguuaaagugauuaggaagggaaucccgcuugguaaaaggguucaggcuguugagcagucuggaacuuggggcaagggucuguuuaguggccuucucagcuuguuccuuugacagccugagcuauaguuuguaguggucugucugcuccuguacuguagacugcuguccagcgugccuggaguuucccaucacuugucuaauuaauaauaauaauaauaauaauaauaauaauaauaaugaugaugaugaugaugaugaugcacucggaggcauuuacaucuauucccagagaggguugccaacugucuuuauuauuuaaaucuuauguacacugauaacaugaguuuuaaaaguuagucaaugcuauauauaaagacuuacagaaguagucacugcccagcauagggggugcuagagcagugguagucacugcccagcauagcgggugcuagagcagugggcgggaguggaugacuggguggaggagcacccucauagaggcaaaagacagagggaaugggauuggggggguugugaaggggguagcauugaaaauguaaaugaauaaagugauuaauaaaauauaucagaacacuaagaaauuuuaaaauaaagauuugauucccacugcucaaaaaaaaaauagucacugauaauugcucuugaauuaggagaaaagauuuaaaaaauagaauaccuuguuuacauuaaaauguaaauuaaaaugaaaaaaauauuacaacuggcuuuaaaucgugcuaccacauaaauauaagccagguuacggaucauaucagcguaguuuauucauaguuauuucauuguaaaaugcauuuaauuuauaauuagaaagauagucugcuugugcagguguaugugugccgugguagacacguggaggucaggaggucuucgucugucacuguggcucugaggagggaucucguguagucagaccugugauucauuuuccacgcugcauguaagucuuuauagugauucugugaucuaaccacauuugcuugaauaacagaucaagguccaaguuguguuggcugaaggaauuucucuucugugaugugaagaccaaguuguaaggaugguuacucuugugaaaugugcaaggcccuuggccaacaccuguacagacaaaaccaaaauguucuuucugcaggaaucucuaggaugaauaagacaaggaguuuggguuuuuuuuguuuuuuuuuuguuuuuuuuuguuuuuuuuuuuuauuuauuuauuuugguuuuucgagacaggguuucucuguauagcccuggcuguccuggaacucacuuuguagaccaggcuggccucgaacucagaaaucugccugccucugccucccaagugcugggauuaaaggcgugcgccaccacgccuggcuaagacaaggaguuuuaauaaauagaucuucauauuaguguucaugcuacaaauuggccaaacugugcuguccuuuucuguguauccaagagucugagggaacaaggagagaaaauaaauauuuaaucaguauuuuuuaucauaccagguauuuucauggauaaugcauaaucaugaaauguccugauaaccucguuuuuuagaggaaaaagcagauuugaacaaguuaaguaacuugaguagaaaauguucuaccccacugugggacuuugaguuaaaauccugcugcucuaaaggaaguuguaagauguucauuuaauggcugaguaauaaaaucuccuuugaaguaaacaagacuuaaggaacugugguuuucacuagagggggucacacauaguggccaugcguggucuaauauuuuuccacuuuggguuguuuauugaaauguggggaugguaaaucuuuaaguuaucuugaguugacaguugacaaagagaaaagauaaguuaucagcacagccacucgucucguccuaagaaaucccuguccccaaguguggcauuagauaaagccagcacccacucagggacuggggaaaucacuccuaccugcucuaaggaagccuucuuaccuguggcaaagggcgcucuggcuugaccaucagccuuugccuuuggugucuagccuaucaagggcuuugcuggcuuguagaucccuucaaggucuauucagcaaguacccagguuacagaguucccuucuuccagguacuugaucccuucacacucugguaauguuuucugcacugccucucucugcuucccuagagacagacaaacagccuugacgguuuggaauaaacuuugcccuuuccgcccggaguuugguuucuuuacugugcccaugucauucacuacuguuguggaaaaaagagggcugugagcauaacuuaaaauuaauacacugugagcucucuuugcccugagucagaacccuuauguauuuggcuuuugagugguuuuguaauucuaacaaacauuuuaccucaaauagauguaaaauuuuagguaaauuaaacaacaauguauguaaaauacuuagaagaacuucuauuccuugauuucuaagguuucuugauuggaccaggccuucguacacuguggugagcagaaaacaaaagcugaaggugcccuugaagcugugaguggcagcugcaccugcacucccagccacaaagaaaagccaugggcuguauuuuuuuucaauauuuaaguuuuaauuuauuaauucuuuuaaaauguaggaguacaccuacauggcagaagagggcaucacauuucuuuauagauggccguagggcugggaauugaacucaggaccucugaagagcagucagugcucuuaccugaugaaccaucucuccacccugacuuuuauacacaugguuuugaaaugcuuccauuaguuagaaaacauuugaaugcucuuaaccaguauuaaagauugucagaugaacuauuuaugcuguuaaaauguauuuuguuacuuaaguuaaauagaagcuguaaauaagaauuaagaagucuuugagcuuggguguguuaaugcucuuuuaagcuuuuccuuagaagugcauugaaaugccaguugugcuuugugagguaguuuuagucaguuauuuuaggaugcuagugguuauagaaaacaccaacuucuaaaauucauguuuguuugcuaggcuuuuucuuucuugaaauaugcuaauuucauuugauagcuuguugcaccaacaccuguaaccaccuugguugaagaaauuucagguuuauauuugguauuauauaagauuguagauucaagauguuucuuuuaacgaaauuuauuaguaauauguuugguuuuguuuagaauuaauuucuuuuuuugguuuuucgagacaggguuucucugcguagcccuggcuguccuggaacucacucuguagacuaggcugaccucaaacucagaaauccgccugccucugccucccaagugcugggauuaaaggcgugcgccaccaccgcccggcuagaauuaauuucuuuucuugaaaguugcugacucuucacuuaaaguagccuugcccuuuuguguaaagcagccuugucuuuguguucuguacuguugguaaugguggcagaccuagaggugaaaaucaugcccgcuguguugauagaauuuuuuauuuuuugggugaaccuggaauuuacucuguagggcaggcuggccucaaacucuuggcaacccuccugccucagccuucuaaguacuggaaucauaggcccgugcuaccucuccguccugacuaguugugacagauugggaaaugaguucuuuauuuggcaaaugccuuuuucaguguccuauuuaucgugauugcuuagaugagcagccuaugucgcccuuaccuucugauuuuguuguagcuguucuccuucaaguggacauaccgacuccucccucagugcugaugcaaugaggcaugcucucuguucccuauggagcugcucagguagaccaguaggccaucccugugccucgcauccuacuugcuuaccugggcagaucaacccuucuuccuucuuuuaggauacuugucuuuuucccuuauuuuauuaacccucacuuugcuuagcugccauuagcauuuauuagcccaguacccauccuuccaccccccuuuuuaagguaaucucuugcuaugcagacccgauuggcuucgaauuuagagaucugacuucucuucugagugcuagaauuaaaggcgugagccaucacucccagccuagcauuuuuaacuauuuuugauguuauacuugaauaguuucuucuauuuuuuuucagguaaaauuugguaauacaaccuuuaagacagauguguaucucaagucacugaauccucaguggaacucggagugguuuaaauuugagguaagcuguugguuugggggugaccccuuuuccugagaaggauaaggagcuaguuuguaugccugggagccauuuccuccucugguggugugggcggauugguuuugaagcauuacaucaucguuaaaaucuaugccgaugcugaugaaaaaugguguccucauagacauuagguucccguuuucuuugggcucuggcauauaccagaccugaagcacaaugcacagacuuggaaacaaacacagucuuuuuuuuuaaacuacuuuguggcuauaguggagcugagguugacccugaacucuugguccuccuguuccugcuuugcaagugcugguuauaggcgucugaccccaggccugcuucccaccacuugugcauuuucaguuccaugcagccuugaguugagacccuucugccucggccucccuugccgcucguucauucuugcaguuucauuuuagguagaccucuguagcauuagguacauuuacaguguuuugcaaacauuacuacuauuuccaaaacuuuauuacccuaaacagaaacuguauucguugagccauaauuuucauccccuucuuuguauugaccaugguagcuuuugauguuuguuucucugaauuuauguaggcuguaacucaccaugcauccaaggauggccucgaacuucuguucggagaugauagacuucuugucuuuaaauuuuacucauccauucauucauucguucacucaucuuuuauguauauggguguuuugccugccuguguguaugagcaccauguaugugcaugguggcuuggagagcuaagucuguguccucuggaagggcagccagugcucuuaaucacugagccucucuccagccccuggacuuuauuuuuaaauuuaaucauuuaucuuuuuguuguugaaauauugaaauuauuuauguguguauauauuuacauauauauucauauauauguauauuuugcuagggauugaguuuaggucuuuauauguauuuuuaauauuuauucuuaucauaugccacuugcagauacuuuaugaucuucaguagguuuuacuuucuuuauuuuauuuuauuuauuuuuucgucaagacaggauuucuuuguauagcccuggcuguccugaaauucacucucuagaccagacugucauugaacucgaagaucugcccuucugaguacugggacuaaagccaugugccaucacugacugguuucuuccuuccuuccuuucuuucuuccuuucuuccuuucuuccuuucuuucucuuuuuuuuuaaagauuuguuuauuuauuuauuuuauaugaguacauugucacugucuucagacacacuggaagagggcauuagauccuauuacagaugguugcgagucaccaugugguugcugggauuugaacuuagaaccucuggaaaagcagucagcagucagggcucuugaccgccgagccaucucuccagccccugacugguuucuugauacuuuuuuguuugguugguuuugguuuuacaagacaggguuucucuguguagcccuggcuguccuggaacucacuccguagaccaggcuggccccaaacucagagauccgccugccucugccaaccaagugcugggauuaaaggcaugcaccaccacgccuggcagauuuuuuuuuuuuaaugaagcuugguaauacagauuuauguuguuguuuaugcuuuugguauuacaaauccccuuccuguguuuucuucugagaauaucaugguuuagcucuuaucuauaggucauugauuaauuuggaaucagauucuuuaaugcuaugauguaagaggcuggcuaauuucuuucuuugcauguaguaauuuagguguuuaauuuucauuuguuaagagacuuauuucucuguuggugagagcuaagacucucuuuuuaguuuacagucauccaggugcuggagagguggcucagugguuaggaugacuggcugauuuuccagagaagcauucggugccuggcuuucaugugggcagcucacaacugcuuagagaacugcugaggguccagugcaguuuucuggccucuauggguacauguauucauauaugcauguguauauaaacacacauacaacacaaacauacacauaccauacaaacacacaucucacacacaagacaucucacauauacacagacacacacacacaugaacacacaugcccaugccuacacccacaugucacacccucacaaaaucuuuuaaaagugaaaagaagaggcuguaugugagauaugcaccagggcuagggauuaguucucauuagcugugguugcuguggguuauugugaguacaugugagucugugguggugucuggcugacagaggguuaagggugagugaagguggggcaggaguugaggcucugguagagaagagccuggcugagugucagguuccgagauggaaggagaaggcagacaggguugagaggagugcucauguccaggagaccuaccccugcccaucuucuccaaggcucagaggaggcgcuucuagucucccauccaugucaugccuucuuucuucaucugcacuuugucuccuguccaguggggaugcuuuugagguaccguggguguugcauggcuguguggaguacucucuaucuuaagccauucgcucuuugcucuuuuaugccuaugaugaguucuucuagcuugcuauaaaaacauuaguuucuucuugugccuagcuaucuccugguagugucugcaguuuuuucuuuguguaccuauuuacuuuuaaauggauugucucaguuuuugacauguccagcucugcuauuguaaguuuuggggacaaguuggugaagcauuaaagaagcucuuacuuagaacacaguuuuguugugguccuuacguagugcagagagugauuccccugucuuccucaucugagccucccuuugcagucauuguguagacuggguaaaggguagcuccuuugucccuuaaggaaagagaacgaagugcagcagacuguuggcugauccgaaagauacugugguuuugcugagagccuucugagcggccacagaaggaaggaaaucacacugcuuugcuccuggucaguggcaggauugugaucucuccuuugcugccugagaauguauuuugcaagagucaggaugcugugaaaugcaaugguaugauuggagaaaauggaaguccuauuccugguacuugcucauuuacccaugucugcacucaugcuacccauuuugagcuucauuuuccucaguguguaucuuuucagaggcacaucgggguagcuguaauucuguuuucacacaggaaagucuuguguggcaguagcaaagcugggcguuacucuuaaaucaguuaggcauuagauugguuugaauauuggcauuuugagacacuuguguucuucagguaauauacaggcaugagugguauaggcaugcugucuuagucacuguguuguugcugugaagagauacccugacuaaggcaacacuuaaagcauuuaauucaggguuagcuuacaguuucagagguuuaguccauuaucaucaugauaggagcagauauggugcugggacuacaucguuuuccacaagcagagagagauggaccacgccugacaugggcuugaaaccuuaaagcccaaccccagugacauacucccuucaacaagcuuauauuucuaaccuuggugaucguuacaaauaguaccacucccuagugauuaaguauucgaauauaugggacacugggggccgaucuuauucaaaauaccaccuucuacuccugagcucccauaggcugguagccauaucaaugcaaaaauguauucaguccagucucaaaaguuacagccuuaacacucuuuaaaugugcagaguucagaguucgaagucucuuuugaaacucaugguagucuauuaacuguuaccugguaaaaucaaaaggcauaucauauacucuaacuuacaaugcacagauuaugcaucaucauuccaagaggguggaaagggcgcacagugagcaaauacuggacuaacgcaguaccaaaaccagcugggcacacuccaaacucuacaucuccaugugauaccaaaacacuucagaucucagcuugcagcuuuguugacugcaccguccuucucuuuguuggacugggucuacaccucaucuauaguuuuccuaggcagguaucccacaauucuuguuguugaauauuuuuaauccuaauccaggguuucuaccccgucuuugaccauuuagcucccagaugaaagauacacacaaccuucauauuuagaauaagcuuuaaucagcacaagagcugggcagauauuuauacucugugcuacugugucuauuucccagccaguaauccuuuuauauaacuugccauguuuuaucugggcugcucuuaacuccaaucagccagcccacauggcuaucacuugaagauucuuaccccauggcagcuucuucuuuuuucaccuucuucccucuucuuguggucuccucagaccccaagucugggaaccuaaggaccuuaacuaccccaccccccagcccccaucucccuucugcccagcuguagacuguaggcgucaucauucaccaaucagaaauagcuugggggacaaguuuauauagcacuacuuguguauguucagacuuucuuguccauggaggcaaccaggccuugggggccaauauuuagcauuacaauaaaaacaaaagaccaaaccuuaacagacuuugacaccucuaacaucuuaggggucuuuaccacaaucuaggcuucaccuaugcaacuucauguuauggccucucuaggccuucaugggaggacaccccauacauaccuggccuuagcaccucuuguuucccugacucuaaaaccuaaaucacauggucaaagcuaccaaguucugcuugcuaggucuggaacacgguucccuccuucaaaugcauccuugucagcuucccuccuucaaaugcauccucgucagcuuaccuucucuccuuaagcuugucugaauuacuuuucacauguuggaagcugaguugaggucaccacucguuacucuauuuagcaucagucuuccuuucacuccucccaaccccuaacagaguuucucuguguagucuugucaguccugaauuuacucuguagacuaggcuggcuuugaacucacagagaucugccugccucugucucccugguguagagauuaaagacaugcaccaccacugucuggcuuuguuuaaacuuuuuauuucucugugcagugaauuuggcuccauuacacuuccuggugcuccuuuucuccucaagccauaccuuuuuccuuguuuagcuugcuccuuuucuuauagauaagaaugaucucuaagagccacaggacagagucagugcuagacugucuugaauacucuucugccaaugcuauugauccucaauuuagcccugacagauuuuuuuccaacaagggcagaaagcagccacauucuuugccaaaauaucgcaagaguggucucuagauuacuuacuaauauuuuucucugaaaccucuugagcuaggccaucauaaucuacauugcucucagaaccucugucuuccuugcucauacuagcauggcccauuccacuuaaaguguucagcugcuuuccuaauccaaagccucaaagucuacauccugccaauaagcagcaugguuaggcccaucacagcagugcccuuccccuggugccaacuucugucuuagucacuguucuauuucugugaagggacacuaugaccaaggcagaacuuauuaaaaagaggcauuuaacugggggcuugcuuacaguuucagagucuuaguccauuauuaucauagcagccaugguucuggaaaaguaguggagagcuacauccagauccacaggcagagaggggggugggggaggggcaggcucagccagacugcaccuggcauggacuuuugaaaucucagaacccaccccgcccuccccaugauacacucccacuuccucuaaaauggcuacaccucuuaauccuuuucaauagugccucccccccccaugacuaagcauucaaauauaugggagccguccuuacucaacacuugaucuuagccaaaaggccaagaagcagugccauccugauucaaacaccacauauacuaaggaaacaaaacugcaaguggaaaagcugcuaagcugggaaguucuagcacaugccuuuaaucccagugcuugggaggcagaggcaagaggaucucugugaguucgaggccagccuggccugcagacaaguuccagcacagccagaacuacaaugaaacccuguuucaaauaauagaauaaaacaagcugcuacuauacuuguggcucagcucacagccagugaaggauccacuugugacauuggcauggcagacaauagcuaccauuccuaaugaucucccugugggaugugcccaugugucuccaaagaaccacuucugaguagcuucucuggucugagcuuucuacaaagggacuccguuguagaagcuguucuuccuucucuccaaagguugccaugggaugggucccuuuaagagguucccacuuuaccaagcucuggguacuaguugcacuuauaacuuacuacuugcaagagaggcugggaaauguaaucuuuuuaauggggcauauuguuaugcaguugauaauaucuaaacauuuaaacuauuuccgagaagcuaaguguguuggcacaugucuuuaauccuaccacuggggaggcugagcuagagcccaucuuggucuaaguaccaggacagccuaggcuucacagaaagacccuauccgccccucccccaguuucuuuuacacaugggcacaggcgugcgugugcgcgcgaacagauacagacacacacacacacacacacucacucucucucucucucucucacagcugcacacacacacacacauuucugaggaaguucuuccuucuugccauucuggaauuguacccaaggccuugugcuugcugugugcuacacgugcucugccacugauuuuugcgcuuggcccuaguuaccacgcuuguguuugcuaaucuccgccucugcccuuaaagaccaucccuagcccuuauggucugguagugcauagcuuguggugcuuagggcuaggugaggguuuaacuugcggugugcuuuuagguggacgaugaagauuuacaggaugagccucugcagaucacaguucuugaccacgauacuuacagugcaaacgaugcuauuggcaagguguacauugacaucgacccuuuacuguacagugaagcugccacagucaucucaggcugguucccaauuuaugacaccauacaugguaaggagcgacgcuggaaggaaaugaagugcagccuggucuucgcuguucaccugaaggacguuuguacuacacugcucuuuuuaacaucauauuucuaaaagacaucuugagaaacagacaaggaaccaaauguugcugagagaaucaccaucucucugagcaguuacacugccugcugacucccauguggcaggcagacaaaggcgaugcguccgucauuuaaaagcugucucucgaggugggguggcucugcuggagcauuuccuagccagcacuauacucugggacggucucuagcacugacgagagaaagaaaagaaaaaguaaaggcagaauaacgauguauugguaggcuauauuuuuaaaauagguuuucuaauuuuguuauuuaaagcuagauccuuauccagagaugaugguacaugcuuuuagucccaauauuugggaggcuaaguagaaagacugugaguuggaggcuagccuguagucuaggaacacgugaaucccugcacugcuguugggggcuuugugaguugagaacuauuuucuuaacaguguucauguuauucaugguucuauucaguuccucacgaguuuuagaggaguuacaacauguagagcagaagugagacagagauuuacaaaaauuguuuuagaagauagcuauuuuuauaaaaaguucaagcucauuuuuuuaugaguaaagaaagcaaugauuaaauuuuuuaaaauuggcaaccuuaauuuuauuaugauacauauugguaaaauuuauaaaaaucuauaaagauuccuugaaaaucucaguaaucuuuugaauguaaagggguucuaugaccaaaaaccucugauacuugcuaaucuaaguggaaaacgugugaauuccaaucccuagcagccgugugugaacauggcauuuucugugauaccagagcuggagagguggacacaggaaaagccuggaauuuauuagccagucagugaugcuaaggagcuagucauggacccagaugaagcagugaacagcuaugugcaugaaauaguuucccaacauuuaacauuaaagguugauuauaauuggcuuaauaugggcucuguguuugaaaucucucuucuucuuuuaguaaaucuagaggcuuuccuuagaaauuguuaagaaagccaggcgugguggagcacgccaggguugggcuguuuguuuuuacugcaguguggucugaaagcccauggauaaaccucucauguuaaaucagaguccacguggcgaggaguguauccuuggugacacugagagcugacuuuuauucuugcccuuccuuuuguuaguuaccagcacuauguaaguucguaaaccuuacuuacauacggauuucuucuuuaaaaugaggacggugcuacuguaggaaugagcucacugggucaugaccuggggcucaccaaguccuuccaccacugcagucccuuaaagugggacuucgugccucagguagucguggcucucaugcaugagccaguagguaauuguggacucagugcuuuucucgggcugccucacccucaaccuuagcuaguguacugagggacgacugggagugagacuacccaggaacacagcuaaccgugcauuuaugaccaggcauuaccugaggagcaguaguuguaucuguuugugucacgauuucauuguacauuuucucaacuuagaaacuugauuuucuuuugaaucugaagguauccgcggagaaaucaauguugugguuaaaguagaccucuucaaugauucaaacagguucagacagucuucauguggaguuaaauucuuuugcaguaaguaaauacauugccauguuuaacagaaaaaaauuagucauuuuuaaauauggaaaacaaauagaaggauuaguugaaaaaguguuagaguuugguuuugacauaagagaaaaaaauguuaaauuucuguagcugugacuguuuauuuuguuuuuuagaguaaaugaugucuaguuuuuccagguucuuagaaauuuuuguuaggaacccccugaggcauuuugcugucguauagaaugcugagugagggacagcgcuguggaccagugcaccuacacccaugagaccccagacaguagcgugugcagcucugcucuguuaguggguggagcuuccccgaguagucaucaucagcaugugaauacauuucccgagagacugguaugaauuucagugauucucaagugcuucuguguacugugcacacuguacugaguaacuacuguacuaguugguugucuggcuauggaugcugcuaggaacagcaggucugagggacucgucagcaaguucacggaggggcugcagugugagauggaaagacacucugccuuuguguuugcauuggcuagcaaauguucauuucguuuucauagacuuaaauuuauuuuuuacuguuauucuguuuuuuacuacgggcauuuuaaaauuaagagccuccaacccaagugaggcacuuccugauauuucuuuucuuuucuuuuucuuuuuccaauuuuuuauuagguauuuucuucauuuacauuucaaaugcuauccugaaaauccccuauacccuccccccccacccccccaccccgcuccucuacccacccacucccacuucuuggcccuggcguuccccuguacuggggcauauaaaguuugcaagaccagggggccucucaucccaaugauggccgacuaggccauuuucugcuacauaugcagcuaaagacacgaguucuggggguuaaauuuauuuuuaacuuguauagauucaugugauacugugauaguuugauuuucuauuuaaugucuagcuauucucugaaucaugaaaguacaguuuacguuuguuauucuuaugugagaaaagugagaggucugaugacaggaaauuauuuuuaggauaaaacagaucuaacagguucucugagaacucaugauugcauugagguuuuguaggagaucuugcauuaaaaaaaucuaaaaaauaaaagcugcauggauacuuuuucaucauuuguuuauauguauauguuuuaaagauuuaaguuuggcuuugugauuuauuaauggauaauaguuaauuuauuuuaacagcaacaucuauuccaaagugcuacagagcugugguaauccacggauuuguagaagaacuuguggucaaugaggaucccgaguaucaguggauugaucggauccgcaccccaagggcaucgaaugaagccaggcagagacucaucuccuugaugucagguaguccaggaaagcuccuuuacuguugauugaucagucuuaagaucuucacuuuccucccucucacauggugcuugacauuuggcagcaaagcuugugacuuuuaaguguugauuccuuaucccaggcacucccccauuaagcuguugaacacuuuuaacaaguagagaucuaaaucagaugugggugucagugugugugagcuggugaacacagagguauguguguuguuguggaggccagaaaacaaccuuaaguauuccucagucacugucgguuaaaaaaacaaaaacaaaaaaagaaaaucccuuuuuuuccccuuuuuuaaaaaacaaaauaaaacaaaacuaaaaaaaaaaaacaacaugguuuugcucuggucuggaacucaccagacuaguuugacuggcuaauugaucuccaggaauccauuccucaguguucugauuacaaauguaagcuacuuuuuaaaaaaaccaaaaccaaaaccaaaaccgugguuucugguaacugagcacugugucaggucuugauuguacuuuagacacuuuucugacugagcuguucgccuggccccuugaaaugucacuuaacuggauagcaaaaggacauuguguuauagguggucuaauguaaggggugcauuguguagauuggaaggagcucagagcaguuagcaguugcaauuuccuccuuugcaucguuuggaaucgcagcuuaggcaagcuguguauuuuugcucacauguucccugugcacagccuuuucuugagaacugacuauguagccuucugaccuucucugccacuugucugacgagcaguagauaugugccagaagauguggaacuugcucuguuugugcgagugugcaugugugguauguguggaccagagguuaacaucuguuccuuuguuuucuugaucaccuuccacuucauguuuuagaggcagagucucucacugaaccuggagcucaucaauuggccagaggacucugcugcugggaguuuguacacacacacacacacacacacacacugaaaucagguccucaugcuugcauagcagaacuugggucauugaauugucucuccauucccugaauguggagcaugucuuccuuguucauccagcugucuaacaccuugacaugaagagugccggcauacagugcagaacucacacuguuucucacugaggcgcauggauggcuggaugagugagcauuuacucaccaugcuucagcuuguagccaguagcaucuuaccuccccagcgaggagccucaucaaauccccagaagccgugauuucuaaacucuugguuuuauauugcuguuauagccuuccuuuucuguaucuaauacagagguaugaaguuacuaaugagucucuuucuuucuguaggugaauuacagagaaagauuggcuugaaaguccucgagaugagagggaaugcaguuguuggguacuugcagugcuuugaucuggagggcgagucuggguuagugguccgagccauaggaacggcgugcacucuggauaaacugagcagcccagcagcguuccuuccugcaugcagcuccccauccagagaacugaaggaguaaguauggcuccgugagcggcagugagcagcuucccaggagcuuucugucuuuuaccucaagcuccguuugcucucaccuucugguagcaguguucaacauacaguuuuacuugugugaucuuucuuaaauauuucagguccuuagacgucaucuaucuaaagcauaaaaaugaauauuuaugucugguguggaacuugccuuccucucuaggagacuccuaacugucacuauauuuacucuuggcgguguguaaagagcacugcaggucgcccuguagacgguucucaggcuccagggucugccccugcaggcaguucauaaaaauaaaaccuugauccagaauucuuggcucuaaacuaucuuuagcuuuacaagagcugggauggaggugcucagcacugugcacauuuaagcaaacuuuucucugaaagacuagguaguaaauuuuagauacugguguuuagucucucugucucucucugucucucucugucucucucugucucugucacacacacacacacacacacacacacacacacacacacacacacacaccaaaccaaacaaaacccagaaagccccuucccaccuaguaccagaccaagaaaaccccaaacaaaccccaaaaccaaaacaacaacaacaacaaguguaagaaauaccuucaaaagaguucccaguccacgaccuaaggacauuagaauuauagauugcgugaaggcugugugcucgguacaacuagucgagguuacucuggcugugaaacaccuugaccagaggaacucggggcagaaagggugauuugacucacacuucugcaucacuguucaucacaucaggacaggaacucuagcagaguaggaaccucagggcaggagcugaugcagaggccauggaggggugcugcccacuggccugcuccucauggccugcugauccggcuuucuuauagaaccuaggucuaucagcccagggauggauggcaccacccaaaauggcuuuuccauccucacuaauuaauaaaaagcccuauaggcuugccuacagccagaucuuauggaggaggcauauuucugaauagcaugugucagguugacauaaaacuagccaauauaccuaguuaggcuuggcucugugauugacuuggccugugguuuuucacuuguuucaaaggaagauucagagugugguugguaggggauagcuuguccaugccuaaucagaaaauacuacaucuggaauacucuaaaacugggaaaacaguaccaguccucaagagccuuggguuucagagcauuuagauuuuggggucuuuagguuagaagugcucagcuagugaagucuacucagauacucugaaaucugagcuggccgaugcucuuguucucaaguguuucagcuaagcgcucuucugaacugucaguggaggguguuggaaugaugaugauuuuucuguuguaauaacuauguggaaagccuugucggggaucagagaugcugccuggucuauguaauugcaacuccgugcaagugagguuccaggccaggcgugguuaguucuuccguaaggaccagcgauggagaaguagucguagguugaggcuugggaguuaugugcucggguaggccagacagaugcaguaagcuuugcugcugcugccauggagcucugccgucauagcaucugcaguacacagacuagggaguccuucguuuauagagcagaugaugggggcucagccucagccucagccugccaucuguuggcuuuuuccuaguuuagauuaucagggggucagaauucuguagauucuaacccauuuccugguucagcaguagucagcguaaaggaaauggaaacaauugcaaaucucaagaaagguuuuuuucuauuaucuuauugcaaaaggaaauuuuccuuaucuugaacauauauuuguuuagccuccuucgguggucuuuaguuauuuagaucaaauucugcucacaaaauuuagcauaguaguagcaaguuuuauagggaaauguacuuacaagugaaauuaauuaaguuguauccucuguuugcuuuauguuccauuaaaaauguguccuaaggcugggauguguaaaauauuugccuaacauacaugagguucuagauguauaucacaguccuacaauaaaauaucauaauacuguaauaaaaugcauaaauauaaaauuuguccuaaaaaacuuuuagcucauacuuguagaauuagguugcauauagauucagauacuacccccuuuuccauagcaaauuuuauuaaaagacuuuuuucuugaagucaacugccaugguacaugccuguagucucaauauuugggaggcugagaggcaggaugcuuucaaguuggaggccagucugggcuacuugguaagauucugccucuaaauacacucacgagcgcauucacacaucuacacacacgcucucucucucucucucucacacacacacacacaggcacacacacacucuuucucucucucucucucucucucucucacacacacacacacacacagaggcacauacacacacacacacaggcacacacacacacacacacucucucuuucucucucacaugcgcacacacacacauacacacacaggcacaggcacacacacaggcacacacacacaggcacagacacacacacacacacacacacucucucucucucucacacacacacacacacacacucuuucucucucucucucacacacacacucauacacacaggcacacauggccugagucuaucgauugccacuaucugguuuuaccuguacaucaggaaccugggcuuuugcaaguucaugucugaaguaaucuguacacugagguuuagagugaaaagaaagggguuuacuucacagaccuuaggaagacaggaacaacaguugucucauguacauucaugaggagccuuuaguaagcccuggugggaguguuucuccuuuuccaucagacauuuacuuuaaauuguaaguuguagagcgaacugucuaccuugcauuauuaggguauugggaagccauuuuacaauauaggccauuguaggaaacccuuuugguuguaggcugcucuguuucaacuggcuguccuguacuuguuacaaaggaaucaguuuaugagacauuuuaacauuaauuaugauuuaucuuauuauaacugaugucaucguugguuauugcauagcauuauuggauuuagguucgaauuuggcaaaaggaaacagcuuggauuuaguagguuaucucaaaugaauauaaaugacuaggauggauuaaacacuggaaauguguuauuuugagacaaacuuucauacaaggagacugguugaacuuaagaauacaucaugguagcgguccaguauauuugaacuuuuauuugauaucauauuuggaaauuuugcaguguuuguaauauuuuaccugcauuagugacauguaugugcucuguaaguuucuucucucucucucuuagcuguuguguagcaaaacaaaucccuuugauuuuccucaugagcucucaauggaaacuugcauuucaugugauuucucacugcucuggacacaaggugcuuucuaaaggacgaaagugugagcucuuaugugcacagaacaacuaaguugaggaauuugaagccccuuccucacuuuagcagagagaagaacgccauucacucagcugucuguauaaaagcagacuccccuaagagauuuaaugugucagcucauccuaagcacguuuuagauuuauguuacccacagcagcagagcaucuguccugccugaguuugaagcuguguucucuuguagucuggugcuacauuagccugcauugaugcagucucugccgucuguuagagguugagccauaccugguccuacacacucacaucccucauuuucucuuccugcuucaaguucucauguuucuaaucaccuaaguaauuacuaaacuuucuucuuagaaagauguaagacaugguauaaacagcuuguaucuugguuucaaagaacaugacaauucuguauuugagcuuucacucuuaugggagaucccucccauuaaaaauaagaggaaguccuguuuuggugaaaaugaaagcaaguauguuaaaaaaaaaaaacaaccauaaaaaucaagucuuaguagucuuucuuaguuccauugacaauuacgcuugcuguuuuucuuauugacaguuguugauuuacuaauuuaauucuuuaaaauuguauaucuuaacacauuaauuauuagcuguucucuuuuaauuucaacuuuuugcaugcuagggauuaaaaaauaaauuuucuuccuuaacaaaaaaagcuccuuugaaauaauuuuaacauagcuuuuugcaaucuguuguauguauuguuuucuuuucuuccacuuugaccacaaauuccuucaggucuccgcugguucauccuccaagccauggaugccgcucgacucacaacagcccaauucacacugcuacuggcucacgacucacucagaacuucucugugucuguucccacucucaucuauacugguacgagacugcucagacgccagagcuggggagaggcaggccacaggcucaguggcugcagaggcaggcaggcagguaguguaggcagguaccauagucuuugcuucuucccuuucuuacuucuaauccagcuucaaugaagaacuucuguuaggcugacacaaaggcucugacuguggaagugaagguguguuuucagcuucuagagucucucuacagauccugucagagccccaugauuguguauugcauucagagagcucuccaaauguauucuuaugaacaguucuguguuguuuagaauagaaauuaauacacuucaaagugaaguagacaccaccacuuugguuuguuuauuuucuuuuaugaaccaagucugcaggguuuugagaugauagggucuguuugauucuguggaagagggcuaugggaaaaacagguaagcaacuguuugcaucaaaugcaguguuucaaaaguucuacuuauuguucucuucgcuguguuuuuagcuguagcacgcugaugcuauaggauaaggaaacaguuuuucuuucagagauacuuauguguguguaaauauggagauaguuacagauauuuccacacaccauuuguggccaucauuuucguuuguaacuuacaaaaacauuuauuugaaauauuuugucauuauuuauuuguuuuguuucucuuuuuaauauauauauuuuuaauccccauuagucuaccauuucaugcuucuuugcuuucccacuuuggcuuauuaacuguuucaacgcagauaacauuuaucuggagaaugaugaaugguuagacagcauucuuugucguuggccugguucccagcuccacacuuaagaaaugacugccggccccaccccaguucuuccugauguuucgucaugcugccaacugucaagcccuuuggcacaugauugcuuaauaugucuccaccuucuucuggcaggauucccuucaaugaggaucccaaccccaauacucacucaucaggacccucaaccccucugaaaaaccaaacuuauuccuuuucaccuuccaaguccuacagucggcaguccucuucuucugacacagauuugaguuugacacccaagacugguaaggcgcucccacccaccuuuuguguuuccucguaagaacuuguuucuguuccuugugagccgcacaccaaaccuuuccuccuguugcugcauuuaaguuaaugugaccacugauaaucucaguuauuaaagcuaauugguuuuuuuguuuggagagugacauuuuaauugauuuaauuauugucaauauuaaguugagaguuuuguuuggguauugacauucuucauuucauguugaaguaaagaggaaugccacuuuaaaauaaaacauuugcauaguaacucuagaggucugcaaccaaauugcaguuuugaaccauaauuccucuuaagcauaugacuaauuuauuucuuauucauuuccauuucagcauuuaguucuuuauuuuuauuauggggcuaguucagaacuggaguggcuguauagcaguguaggcuucgcucaucugcuuuuuggcugaaggcugaagguucaguguagaguauuaccuugaguuuaacuagaaaacagaaaaaaaaucaaagaggaagugauauuggucauaucuauuuuuuacauuuguuuacaugcuaacuuaaaagguaauauaaauacugaucacuucaguucuuagaugauuuuuauagaagaauuauuuugcuuggagagcgacguuuuagcuguuuuagucaugcuugauaugaaguuugugcgauuaggcugcuuggcuuugcuccuuacucuugcucuccagguugaaacugcaguuuaaauuuucucacccuuggauauuuuucaauuuauuaaauuuauaguuaucccuuucuuuuugcauugugagugguuucuggguuuuuguuaguguuuuuugauaagaaguugauaaaauauuaaauuggcuucaugagagaauucaauuuauuuaaacaaaaaaaauuuuuuaaagauuuauuuauuuauuauauguaaguacacuguagcugucuucagacaccccagaaaagggcaucagaucucauuauguauguaugguugugagucaccaugugguugcugggauuugaacucaggaccuucagaagagcagucaguguucuuaaccgcugagccaucucuccagcccuuaaauaaaauuuuaaagaacgauugaaaauguaaagauuuacuauuuuuaguacuuuaaguacuagaaauaguuuuccuaucagauugacuaaacuguuuuuauuuguauuauuuugaauuugucaucuuuaauaaccuuuaauguuuuaguguuagaagaauuuauaaaauggauccagauuuuuugaaaacaaucaaaacaaaaucuuauuauaaacuuaauuuuuuccuuuuuuaaaaauaaaauugaucacagaauaaacacuauaaacacccauuccuguguuuuuauuaccaucccugucaucccucucuaacaucauugauuuugacagcuacuuuauuuuuuuaaguaugcucagccuuaaccuaagaagccaagugcagaucaggaacccuugggaaagcacuguaucuguccccgugcaggcagaguuuccugcuuccgucuggccuagaugacgacgcaugagagccgcuuugggguuagcaugugcauuguguuagguauuauaagcaguacaaagacgauuuaaaauaggaggaggcuaugcgaaggcuauuugcagagcgcacugcauucuguauuugugaauuuuguuccugcggugcuggucaugguggccucagcagcauucccuacagaugcugaagcuguacuguauauaauuaugaguaacaauuaaaaaguacugcuaaagccucuuuacucuuguucuucacgcucagccagguguggcagcgcacgccuuuaaucccagcacucaggaggcagaggcaggcggcggaucucugaguucgaggccagccuggucuacaaaguguguuccaggacaaccagagaaacccugucucgaaaaaacaaaaacaaaacaaaacaaaaaaaaaagauagcauuuuauaguaauggaugcuuuggaaugugguauuuuaacuucuuugugccauaaaaauugagccauugaaauugcgaugaaauuuaaaaaaaaaaaaaaaaaaggaguaagcgacuagccguaauguucaugccacugagaacaagguaggcuugggaugggaccuucuccucugcaccuuuucuguaggcuggagaugaaacccagcucauggugcaugcuggacaagcacuccaccucagccagccuccuccucagcuccuggguacuuagagaccagaucuuauuaaguugcggaggcuggucucugccuugugagcaggagucggcccaggcccaguauagcugggacucugggugugcucuuauaaacaaggagaugugacuggagcugugaggcuuuggucugcucacuggcuucuaagcugcuuuucaauaaugcucacugauuauguucuugucguaccacagauaacguuuagaaagcgggguuuuuuuuuuuuuuuuuggcuuuuuuguuucuuaauucuuacaaaaggacaaaccuaaagauuguacaggcaucagcaauggaagcuuucugacuggcaucagaugugcuagcaaggacuucuguaguacugguucuuaaaaccucauuuauauaccuguaagcugacucugauuguuuuguuuuguuuucccaccuuaguagcuuguugagacccucgccaccuuugcgcggucuggaggggcuugccaccucucaguuuuguuaccucguaagcugagacucagugagcauccuuuccugucucuguccggcuucugagaagcaguacaagucgauuaugauugacuuacuauuuauaaaccgagacgucagaaauagagcagaauaaaggguggucugagaaaguuauuuuucuguuuauaaugcauuuuuuggguuaguuuucuuaauuuuuuuuuacuuuauuagaaucuaauuuauaacauuuuaaaaaaugagauuuuaaaaauguuuuccccaauuucucaacuaauaggaguggaauuuuugaaugcuguaauagguauauagcagagauuuacacacuugauuuggguagauuuuacuuucuuaggcaggguggcuguauauauuucuuacaauacacaggguauuugaccuuuaugugcaaauaucuguaaauagugauaugaucacauuaaaguaugagacauuuuagagguaagaugaaaggauuaauguauacaucaaaacuggagaguaaaaaccuagcuuggaauucauaauacauuacucuaugauuauuuuuuaaaugaguaucccauuagcacaaauauaugcaguaucauagcuaguaacauuuuaagguaccaaaauuuacuacuuuaaaucaguguuuuggauugaagccacaaguuucuuaccauacggagaguggugguuuucagccauacaaguucuuaaauacagucagccagccaaccaaccaaaaucaauuggugggcaauuuaaguauuugaagaagucagucaaaagugauggaaugcauaaagucuugcuaaugauuuaaaguuuuucagugcuugcagaguuugaagggcuuuguucauuuugaagguguccuugguuugcauguuggcuagggcucuggcggguggguggguaccugagcucuggcucacucaguguggguuugucugcauuugaauccauuugauuguuauguuugcucucacugcguuccuucuccugcauuucugaucaucuucugaaccuacaucuuugcuacuuuccuccacagcaccuuacccacaggggccggggaucuaccugugucccagcuccaccccccucucuugugguuccuuucaccuuaagucccgccuccucucggaaucuagccuuaccccucaucacucuagccuugucagccccguucugaggaaaaguguuucuuucagugaagagcuguuccuggcugcuucugguaggaucacauuaugucagcuuuuuuuuaaauaaucccuuuguuuuaaaucaucucugaaaacauguuauuuuaugccauagagaaugacugugugcuuuaugugugugagugauuucacugacaguuaaucagaaccacacauaugucacugacgcuuacuugauggcuauuaucaguagucacugaguuuucuguuuaacaaagauuaugugucaggauguggcuguggauguuugcugucacucucaggaccgaggucucacucaguguccuuguagaugcucuguuccccucucuccauaccugcuccauccacauccgaccugugccauccuguugcuaaaccagaaggcuacaugagaaaauuauucuguuugaaccaguuuaagucucauuuuggugcuauucuuuuauuauacacuuguuuucuuuccauuccauuaaucaaguuauucugcuauguuuucugguacuuuauuuaucacugcaaacuuaccuuuuauuuugugauuuuaaauaugcuucauauaaagaucuuaguuuuguuuccaguuagcauuguguagucucuaaaaaccuuaagauuacuguaagaaaaacuuuuguuuucagagaucagaaugggacuacacacaugcuaacccuuguuuccuuauccaagaacagcuaaaaauguaaacauggauuaacuccucccuaaggcacugcagugaacuugaccggaugcaucuuuagcuuugagagccagugugagccaucccaucuccauagaucgugggccauacuuguccuuguguuacuaucaaaacaaugacgacaacaaaugcuagggaaaauguaauauuagccuuaaaauacaucuaagggugaggaaauagaauucuuucauccaugacuauguacauuugugaugugcuuacacauguguguugauuuuuguuaaugagcacaucccauguucagaggagagcaugagcagagaauaagcuucauucugaaggcugauuggcccguuagcuuccuguaguuuugaccugagcaguuaguguguuucuucccauauuuuaccagauauuuugauguguuuaaguuguuagcauagucaguuauucuuuugguuauuuuauuaaaauuaucaacuuauaaauauugaauauuaucaaagaauuguugccuuauuuuaauauuuuuauuagaauaaauugauuguaaaacuagcugugaccauaacuuugauaucuuacuuuaaagaaaguuuuaauauaguagaguaaaaugcaugugcuacuuaccauagcaaaauagguuaaacauguggcugaguuucuguauuugacacugucugugaagaugagugcacuugagcuugccggugucuacuuaugugcuuguuccuuacgugcugcuguccuguaggaaugggcagugggagugcuggaaaagaaggggggcccuuuaaagcccuuuuacggcaacagacgcagucggcguuggaacagcggguaagagaacacuuucuauuccuucucugucucugugguuuuguacgccugcgcuccuuccuggcugcuuaaaagguucugaaaaggguuuuugaucauuaucuauaauguuguacuuuuaaaguucaaauguauuuaagauaucagaguaauuuuuucaccaauauuuacuuuuuuacuuaggaaaauuucuuaacuuuucuguuuuguggagcuuuuuaauuuaaaauacuuaaauugaauuuuaauuuuuccagucuuugauuuaaaauauuucuucugaaaauauccauugaauacugaaaucauuucuaguucucauuaaagguacaauauagagaagaaaaugauuagucuuuuugcagaaaaccaucucaguaaugcucucuuaaaucggcgcuauaauaugcugacacuuaccucuugacguuacuuuuugucacuggccuguuuauuagauaccagacacagauucuguucuuaguagauuaaaguuaagcgugacugucuagcauaauauggguuuggguuuugguuuugugggguuuuuuuuuuuuguuuuuuguuuuuuguuuuuuuuuuuuuuuuugaggcaggguuucucuguauagcccuggcuguccugaaacucacucuguagaccaggcuggccucaaacucagaaauccgccugccucugccucccgaguacugggauaaaaggcgugggccaccacugcccugcuaugauauguuuauuuaaugaucauguauaauguuuauuuaauuuguuggugggaaacugcgucugguuuuuggaugauuucucucucucucuuuauaaccauccuugcaaagggaggaucgccucauagguucuguagaaggcggguauguuucuaaacgugcgagagccuggucugugcuagaagcuuuucuaucuuguucucuugaguuuuauuugagcuuuuaacaauuguugcuggcauuuucugaccuuguacugugagacucaugcucuuuccugcugacgcggugcaugguuccauguguccuguccugggcuucggacagagcuccaagcuuuuuuaugucugcuuuggaagcuugaagcacuuagagaauuuuauuuuguguguucauuuugcaccagcacuugggagagaacaaaggugagacacagugaaccccaucaaaggugugccuccuucugcagcuuguuugauucugugacugcagacaggaagguucuuuucuuaugcugcaaguagauauguauacacacacacacacuuaugcugcaaguagauauguauacacacacacacacacacacacacacacacacacacucacacacacacauacacacacacacacacucacacacacacacacgccccuuugggacaaggguagagcaagcagagcugaagcagaggaauaaguugagcucuacccaggccuuguuuuccccaagugugugggauugauccaaaagucuucuuaggucuuguugcuaggaaaccaucuucccacugagcugggccccagccccaugcucugccccauucuuuauuuuauaccuggguuucagcuacacuuaccuuucugacagcaccagucuucauggaugaaaagcagacagagccaaagguuagagccauggagaagagggucggaguagggugcaggugucuauuuaccauguuuugggccagaauaguuuucucuuugucuuuucccacuuugaaucugauugauugaugaauugaguguacuggaaauguggcuguguucagugcugggacuuuucugugugcugcagaccuuuucagccauuucauagagaaaauaguaaacugauuuuggauuggguuugauaaaauuuguggauuuuauuuuguuuuguuuguuuuuguuuuuuugagaugguaucuaauuugaaaccagacuaccauagaucacuaaguaguucaggcuagcccugaucucaugaucauauugccucagccuuacacaugcugggauuacaaugcccaugucaaagguguguguguuaaauguuuuaaauugaaauagagugucaucacuuuuacucccuuccuuccuucucccagcucuuaccaugucuacccacacucaaggugauagccucuuuuuaaguuauuaguccauauacauauauggaauacuguguaaguacaaccugcuaaguuuguuuuuguuauuuguaugcauaugguuucaggguugacuacucuggguuggacaaccaauaaguuggcuuauuccugagagaagcuaagucuuuguaguugcuuguaauucuuugucuaggaguaggaccccauaaaaucuuaccccuucuguguuggcuugugcacugauguugcuauuguucuggcuuguuuauguugccauuucuaggagagaauguuucagcagacuuguugggcucuuacagguuuuccgucuccuuuccuuagagguucucugugucacagacgcaggagcugugauguaguuguuucuuuugggguuggguuccccauggucccuccaugcccaguugugguucucugugaugggcuccauuugcuguaaagagaggcuuuauugccgaggagugguagcugcacuuaccaaaugaauguauauggauucauuuguaauugaggaacugugcuggcuaauaauguggccucacugggugggaaguguugauucagauaggauuuccuccugugagugggcuuuaagcccauuuagacagcuguugguuaccacagccaugugagugucacauggagggccuuuaggauaucuugcgugcuguucauuguuauaggucauaggugucacagcuagauaagacuguuuaauuucaucccucuuugcagcuugcauaauguuuucuggcacuguggagauuagauugcaggaaaaaaagaggcuuucagauugcagcucaaaucauccaaguguggggcuguaagugcgugggguccucaguaauagaggccuucauugagagacaaccaaggucuacaucaauaguuuacauugcuuuuguagucacuuggccugcccugaccaaccaugcagagguuuuucaugucugguacuggggguuuuguuagucuaugcuucucguaggggagcacugugaggccaaaugcuuuaacaucuuuaaacuguguguguguguacauauauacacuuaucuguauuacuuuuaacuuuagguauagacuaugacuccguguaggucugucagccagcccugguagccuuggugugauuuuccucuuuccuucuccauguguucugaucuucguucuucuacaguuggagucaguucgcugguuuuuccauuucucacuuccuauuaucuccaccccuccgcucacaccuauggucuuuauucuuucuuuguuuuugagguuacucuuuguuguauauucacauaauauuaucugaggcuuugaggcuagggaugucagauagaugagaacacguagggauuuuuaggugugcguauggagaccagaggaugacucaaaggaguggcucuucuuccacugugcaggugaguggaauucagguugucaggcuuggcagcaggcaccuucaccugcaaggcccucuugcuggucucuaacgugcuuuuaaacaguuuaaaucuuggacauguucaugcauuggacauauguuacuagaagaucuucauaggaucagcagcaaagguguugagaacuacagguuuuguguauacuuauguaagaccuacuguguggcugucaugguuuuacgugugugccacucuuccgugcaguuucccuguguucagaagcagcagcacaguagugcuguaggucgccucuggcugccgugcugcuguugauuuccauccguguuucagucucggucacguagaaacaguuucugcggacaggcuuuugacucuuguuaaacaguuuaccuguucuugccuucauuaagguaaaggucacuucugaguucugcccggguuuaauguauacacgcauaugcacacgccaugugaacuuuaacuucaugcuuccugaggaugcagggcucuccucugugcuggugacugcaaauugaucugccuuacaacugugcuucagcuguguuuguaucccugcuuuaagcagccagccaguggucuugcugcuuuuuuaugugccugcuuuuagcaauagcucuuucccuuuauuuguuucaucuaaucugcuguagccuagaaaaugcaauaaugacaaauucuuaaaaugacaagcauuuuaguauguguaacuaccuuacccccgugugagcauccccuguggagacgccuuggguugcaguacaugagccauagcacuugccguccucggagagcucuccuuauggugaaaguagcuggggcuguuggugagugacuuccgguuaggagaguuacauuuauaucucacagccaggcaggucagcuagcagucacuccuucuauagacacccccccacccccguguuuccggugaguuccuaucuuaaguuuucuuuuggguucuucgugucauuccauggcagaaggggccacagcuuggaagaaccugcagguucacgcugcgucccucacucugaccacgcacgucucucuucugcuucacgcacagauaugcugccucucuccacacagucauuggcucacacuucaccuagauguuucccuuucucguucuuaccccgacacacugccuaucuuuucacuccauggccugugcuccauuucuuuaggucucuuguuacaugcuggccuugggaauauuuaccaauaaccuguauugccuguaugugugagaggcaacuauacugagaaaugcaaauggguugcuagguuguccaauuguguaccuuacugggaaaugguguugaauaggaauucgagaagagaggaguguguucuaaauaucucagcugggaacucuucaauaugucccucagucagaacggauaaggcagcuggauuuugaauuccacugagcauguacggaaacagauucggaucugugaaugucugagaaauuugaaugaaacugcaggucuagcguguguauuccaggccaugcauuuccuaugcugggaucugcaugugcagagccuucuacugugcaccuggccaucucugugcuguccuugucuucaccaggaguucccguuccucacccugacggccuuccccccuggacuucuugugcacgucgguggcguugucagugcacgcucugugaagcuuuuagaucggauccacaacccugguauguucuuuaaaaaguuuuauuuuacugccuuuauuuaaggugugauuguaaaaguugauuuauuuuauugauauugaaagcaaauuuaacuggaaaagagagauaaaaauagauuauaaacugagauaaguuacucugagauauuuucaguaaucacaauuaaagguaaacuaacguacacuuuaguuaauuuuuaauguacaacaaaugagcgcauuuugauuuauuuugacugagcuguucuuuugaggggaucauuaauuaauguuugaguuagcuguuauauuuguuuagggagaugagggauuuugcuguguauaaaaucauggacauugcauuaggccauuaauguuuuuugcuugcucauaugaccaaaagagggagagcuagcgugugucuuuaaagcacagagugacauagaagguaggcagcugaguccuggcaguuuuuggggcuuggauuacaaauacuuagaugcaggggcugaagagauggcuuagugauuaagagcacugacugcucuuccagagggccuggguucagaucccagcaaccacauggcagcucaccacugucuguaucuccaauaucuccaauaucuccaaaaaauacaugcaggcuaacaccaguacauaaaaugcaugcaagcaaauacauuugaagacaaaugaaagaaauucuugggugaguuuuucagucuauagcaagcaugcucaauagugguagcucccuuuggagucaucucucgugaugcuugcugaaacaccaugaaccugaagcgauauugacauuuauacuucugcauauuuuggaagacuuuauuuaauucaucacuuccaacagcuucuuugugacauguaggaaaagaggaaaagguugcucuggaauauugcauggaaaacguugccggcagugcuuuuaaguauaacaggauuacucauuuucacauuuaaguuuaaucggugcucugugacucgauuugacuugagaaucagaauggaguucuucugacugcuaaugagacuugagaaaguccaugcuagucauguuuguuuagcucuagagugagcaaauauauaacuucagcuccaguauuuuguuuugauuugguuuauuuuccccauuccuuuauuuuuaugguuaguuuaagcucucauuuuccucaucguauuuguacacuguagcacuuacagggcaguuugacugcugcuggguagcucauucaguucauguaggaggugggugaggagagacugaucagcgaagccugagcccugugccuucuauggaugagugacucagguucugagggcgccugcugauaggacacuguacaaaguaguucuagaaauguauuuaagggauguccucuuuccuuuugguacuuccaaacagauaaacuuuagagccugggcagacaaauaaacauuguuuaaauuagcuuuaaauggggauaaauaucuaaaaagguucuuaauuuuuacaaacucuucuccuugagaguuucuucuacuuaccaguucauuccagccauacaacaaccuaagagcccagagagagggugcucagagaaugaguugugugcuguaaccagcagcacacagagcccagagagagggugcucacagaguggguugugugcuguaaccagcagcacacagagcccagagagaggguguuccagaauggguugugugcuguaaccagcagcucacccuuucagaggagcugucuguccugcauagcaaggacaguuacuuuucaguuacuguuacuguaucauccccagggcgaguguacaguaguuuauauguaaauacuuugaaaugcuguggaguugcauuuuuaguuugcuuuauuuucagucaaauacuuaccaaguguauauucuguggcucuaaugucuuauuuugauuuaaauaagugcuuuuuggauucuuuuguguauaaauuaggcacuaaaaugcuuaacagcuucuccaagucccuugaguaauuuuccuggugaacaaagcuggauauuaucccuaggagcaccuggacaaccucugagcacugggagucagcacugcuacugugcugagagagacuugaugauggucagaauacauaggcuguguuucccagcagcuaucuuuugacuagugaauaugaaacauuuuaauuuuguuuucagcagaaaaaggagacauucuuauuuucaaaccauugccacuaguucuaacuacuggugauuauuucagaguucuuagcacuucuuucuuugcuaaaucccaggacaacagaagcaugaacagggagagacaggaguggguucaagcguacgaugaccaaguagccagaggaguuaaugcgaggacuguagcugcucguccugccugucucuauuccuuauuaacucugcugucucugucuuccaguuccugucaagugcuggugucaauuguguucuugucuguaguuuucuuuuguuuguuuguuugauuccuacuauucugcaccuaaaacugaucaacuaauuugcuguuuugaacucagccuuugucggaauuauggguaacacaagaucuuacaaacugcuagacuggaauaguuucaauucagguauuuuaauggucauucaguauuacauaugcugacagaaauuauggcagcucagugagguuuuagagacauuauagauuaacuagaucauucugugauaguuaugucacagcuuguaauuugcauggaaaugcaugugcuaaaugaaucaaaaccauaccauaaauuaugaaugacuuugcuuaugugacuaacuuucagaauauaauuaaauucuauuuaugcauuuggccaguguuuucauaucugguaagugauacaggcauuagcuuuaucauuaagcagcauuuguuaaauacauuaaacaaccagccugauaaaccuuaaagcacgcuuaaacugcucgguaagccuuaauaguauuuauugucuuuuaaaugaccaggaaaugagacuccuagcauucucauauauaaugcuagaaauguuccaaaauuucauagcaggacaguuuucuucaggacaauuaacuaucuauaagcuuuccucuuuccacaugagauuuccaguuuuucuuuauaaguaauuugaauauagucuguauccauuaacaugaaacaaaccaaaacuuuacagcugaugauguguuuuaguaaggccaguuagcuucuuuugaaaagcauauuucuacuaauauacauaucuaaaauuauuuuuggaauuaaaacuucuauuuuaauuaaacacuaaaguggauauuuaaaggauuuuuuuuagucccuugucucagcauaucuuauagccaaacaaaagcaccaaagggcucagcauuuucaggaaucuuacaguguguguaagcaucggucagaguugugagcucugguggcccuugaccgacucugaagggagucguguuccugauguggcuuugucaguacaaaugcaaaguggucucaguuccagacucuuuaggggaauugccuuuguauucaagacagggucuuaccacugugcugacauuuguuaaagugaaaagggcuguguucgagguacugccuuuuuucuuuuuggugaaaaaugaaacguacccuauuagauuuguuuuauaaagugagacuguauuccaauacaugguuagcuuggugcaauuagaaaaauagguugugcauaaaaaugauuggucacuaacaacuuaaggaaguaaaaucuuguagaucagccacuuguagagugugguaguuggccaggugacagaaauguuuuauaaaaggaaagugcagaaguuaaauucccagacacaagaacacugucccaggcaagcagggcagcaguuuggccaggagagacaugguugaggaagcaguauaucuugccaucacugaaaguaauaucagaugggaagugugcagaagagacguggguagggagccaugugcugaggaggagugagacucugauggcagacggcugggugagcagugagccagauacgguacaggauggcuagacauacacaggacagccagacauacaggacggcuagacauacacagggcagccagacauacaggacggcuagacauacacagggcagccagacauacaggacggcuagacauacacagggcagccagacauacaggacggcuagacauacacagggcagccagacauacaggacggcuagacauacacagggcagccagacauacaggacggcuagacauacacagggcagccagacauacaggacggcuagacauacacagggcagccagacauacaggacggcuagacauacacagggcagccagacauacaggacggcuagacauacacagggcagccagacauacaggacggcuagacauacacagggcagccagacauacaggacggcuagacauacacagggcagccagacauacaggacggcuagacauacacagggcagccagacauacaggacggcuagacauacacagggcagccagacauacaggaugguuacaggaugaggauggcgaguacucauagugucauccugcgacugaaauaagguugagugcaauccgagguuagaaaaaggacucgaaaauucugaagaaaaugugauauguuuggugaauauauucaaauaauuuuuacauauccucugaauuuggagguauccugccauugcugucccauaauaucaaaaugucaagaauugaccaugcuucgagcuggagaaugggucagugguuaugagcacugacugcucuuucacaggccccaggcucaauucccgcaaccgcauggcagcucauagcugucgcuaauuccaacuccaggggauccagugcugccuucuagccuucacagguacugcaugcacaugguagccagaaauacaggcaaacaccuaaacacaaacguuaaaaaaaaaaaaaaaaaagaaccuaggcaaacaaagauuugacccuuauuaguaagaaaaauagugauuaauauuauguuuagcacauacuucauuucuugaguucugugacacugugaguaauuguggccuuaguuugauaauaguuauccaggaacacacacacacacacacacacacacacacacacacacacacacagaauucagaaugagaaacacuuguuaggugcuagacuuccguaaaaaaguauuaaauguuuuacuguguuguauacaguguggaagcaggcaugauuaaccaaccauguuggugucuguucugauucuuaagcuaauuuuugaaggcugugcauaucagauuuucauagguuucuaaucuuucaguaagauacuuaaugcuguaugaaugcauauucuauugugucccaaaccucuagcauuugugagucagucugaggcagugcuucucuguuaguuggauagcuacuuuauagaccacaaaguguuccgugacugaguccuccugcccauugcuuuuguucuagccaucuggucccauguugaccacagugaugggacguuuuaugcacuaggaaggagcgaauccgucccaggaaucugagaauugauugugaugugacuuucuguuuucucauuuuucuguucugagaacaaaauuugagaaaaucaggaggacauaagcaucuguaaaggagccugaaguguuacuguucuuugugugacacccagggcugugaugagaucgugacaacaugccuugggucuuccuggcagacacugccucucugcagagcuggagaugagcugaagaggcuugaacguaucuggaugcuuuccaguagcgggucauucgagucucagaucuuagagggagacuccaauccuauugugugggugaacaaaacaaaacagugguuuccuuaaggugucaggaaaacauaaccaaaccacaaucaaagccuacaugaccuggcuuugggacuuacacuuaaccguggaugauggacauggguuugcuggugaauguggcaggccugucagcugccugucaacuuucaagcaagggggcaggugauuuuugauuuaaugucauguccagaauaaggaaaaccaaauuaguuagauuguugguuuuugguuuugagaauuuuugaaguguuaagaauauuuuagaugaaucuugaauuuuauggcauauacuuuuucuucuuaaaucauaauaaauagacuugaguuauaaggcaaccuuuagugguuugaaguuagaaaauguuggguuuuguuaaucacuauuaugcuuuuuagaaagcucauuuugggagcaaaaacucaguuaaaaccuugacaaauaaaauuauuacuuuacaaaauauuuaauuguaagaaaaugugaagaacugggcaguggucacaugccuuuaauuccagcacuggggaggcagaggcaggccuggucuacagaguaaggucaggacagccaggguuauguagagagacccaguguaaaaucaaaaccaagaaaagaaaaugugagcuagcugaugugucaggagauaacaucugacuuuauucauucucuuuuguuuauuuuguuguaacaacccuaaaacacucuuaucugucagugacggcuuuggcacacucaugugaguugagcacugucccggcaccaggagcacugugaagccgggugggcauccuguucacacucugucagucagucacagaaggcaggcucccgggaaugugacuucugccaagggucucagcgguucuuuucugggggauacugaugcucaggugagaauuaacguggauguagacagcuuuggauucuuuucagaaaguuuucaggaagugaugaggcuaguccuagcagcagcauguguggcgucuggauaaggaaaguggaguuacagaguggauuauaugucuggaagaagagcaacauuccguuagaugcagaauaacuuguaagccagcugccauccugucauccaggcuuugauguccuccacgugaggacuuuuucucagucugcucucaucccugcucaguggaggcuguggacucuggaaccugaacucuucaauuucuguuacuccaggggagucgcucuccagaguugcggaaugcaacuucuguguccuccgcagguagauuagcagauccaaaagguuagcgugacccagcccaauaucuuucucuccuccuguccauuucuaaguuagcuugagcuggauuugauggcucguacucauaaucaugacucauucgaagcugaggcaggaggauugugaguuuggggugaguuugaguugcaugcugaaccccauucaagcaaaaaacagaauaauuauguuggguaaacaaaaacagaacugauucugaacacuuuggguaggcgggugugucuuaguuacaaauaugcaauugucucaaaucaccgaaggguagagucuaauaaaggcauuuuguguugcgaugaucgugucuuacuuccugagauauacguuggcauuuaaaaaucuguaguaguuucacccacacuucugaagcaaaaagauggcaagauaucaagcugugaccaugcucuaaaccagcagccgcaauagaaaaguggagucucgugacagccacaguggggacauugcuaagcaccagcgcugugcugaaugcagagcccagcguguuaacuacggaaaggagaaagaaguucagagaucuguaaccuauaaaaaguuugacccauagggaaaaaaagcuuuaaaauagcgugaaauauaauuuguagaauaauuaaaauucaauuuuuucuaaaauuuuuuuuuaauuagaaauaauuguauagaugaucagaacacaguacuuaauguggaaaucauuuucuuaccaccuuuggagugcuuguuaaaugagcacacaucucagcuguauuuuccaaaaaugauuaauaguacccauguauuacauggguaauucuauacauuuuucagcuaaccucuguuuuacuuuuuguaaauguaugauagaccuucaaauuuaugcuuugguaccuuaaauaaacuaaauagguucaguaauguguuuccuuuuaaaauguaguuagcaauuuuuaaacuuuaaaagguucuauccuagagauuaaauagugugauauugcuguuuuuuauugauaauaagaucaugcuaauuauaaguacucuuugagccuguggcccaucuuuggcauguuguaguggagcuuugaaaagaaauagaaucuuucuuaauacuaaauaaacugauuagucugaauuuuucuguaguuaaauaacuuugaucccuugcuccugcuuacagucuaguggccaugguugccggagugacuagugauggaguguuccuccuguacgcuugccuugcucucaccuagacucuagggccauuccuuuucugugaccauuucagugagcugccauaguuuucagucugugcugucaccugauccgagcaugcgccaaaacaucacuguuccuaguuccugucugccaaaucugcuuugcaaaccuuuuguuccuuagcuuuugcuuuagccaaaaccaaauuuaacauuuccagaguguggacaugugucaucugcuuccucggugcccaugucauguaacuagcuucuuacacucgucaguaccuugcuaaguauuacuggcaucucaugcacuuguguggcugugucagaaugaaggcugcuugugagcuugccugagggguaugaaugcugcucucagucagcucgcucucgcucucgcuaagguuuaaucagccacauauucuuucauggcuuugguuuaacucucuguuguuuuauguuauaucaagguaagucugauguggaguaacuguauucuaugugguuacacauaccucaagggaaugacauuucuccauuugaguaugcucggcauuucuaaaucaauacauuucaagcuuaaaauaaguagcucccuccauuucuucauuauuuuuuaaaaugguguuguggauugcugccgauaaaacccauuguuaaaaacagggaaucuaccacaugcuacuugugguacagguaaggugagccuacugugagaaaacuuucaacauggcacacaaugauugcuuuaggaaauaguucaaaaaguaaauagcaaagucauuaaugacuuuaagaaaaguuagacuuauuugaaacaguguccaguacaacaguuucugucuagacugaaaguuauuucuguuugugauacuuaguuuuguagaacuguaauuuaauagaccagguuacuacauaagcaauaguauuuaccuggauguuuaaacuggcauauaagcaugcacguccagccaggcaugguggcucacacuuguaauguuagcacuggggaggcugcaaguuccagcagccugaucuacacagugagcuugaggccaguugggcaaaacccucucucaaacaaagaaaauaacaaaaaaggcacaucugucuuauuagcaaaagugacuaugggcucugaaguaugucugugcucuuaauuaggaauuucagccaggaauauacgaacaagcuuggggcgcgcuguaggugcaaauggccacucgcaugcucauaguaugggauguagccuucucuguucuuucuucuuuacuuuauccugugcuuucaccuuuccucgguuccuaucagucugugggucuuucuuuuccuuggcaggaagcuguucuaggguagcucuuucuccgacuccaggcuggcuggcauuuacccugcuccuuuccccuuggcgucuccuccucgcugaggagacgcccaucacagcagugugagcucuagcaggcuuccuaaccuuucuuuacugucucuccucacugcuucccuagugaguauacuucuacuucauuuguuuugaaaaacgaugcugagagucggauauaacugcuguguaacaauagaaagugauaauugcuuugcuuugugugcuaguaccuuuuguguggaaaauaugcagcauucagaguccucccaaacccacacugagcacaaaagaagcaaguaacagaccagucuugcuucuaacaccuuugcccaugaagaguuagucucccuuggagugcuguucacucgcucagugcaggugauugagagguguguggccacuccuucauucaugcugcccccuuacaaggaugcucaugaccccaacaggucugcaguccugagcacuguuauugccaaacacugggaugaacccagugccucuacguguggccgugccauuuagcucagcucuagccccuaaacagucuuuguuacagugagacaggaacccaaguuccaaguuccaaguugaugaccaggcucugauuaaaaacucaugggccaguuuuucacauacccaggacuucaggcauggguaccaugcccauaagccacccuuugaaguuauaggccauguauagaguuuauaauuuuguguuugaaauuugcccuucuauauuaaccaaauuauuuguguuaacccuuuaaauguauuuuuucuuuuucugccucucccauuuuuccuucuuuuuagauuggcuaguccuuuuauacccuguuacuguggcuaguucuuuuauacccuguuacuauggcuaguccuuuuauacccuguuacuauggcuaguccuuuuauacccuguuacuauggcuaguccuuuuauacccuguuacuauggcuaguccuuuuauacccuguuacuguggcuaguccuuuuauacccuguuacuguggcuaguccuuuuauacccuguuacuauggcuaguccuuuuauacccuguuacuauggcuaguccuuuuauacccuguuacuaugcccuggaacuuauauauuuauuaaaguaugacaaagguucuaaugucauaauaaauauugauggauccuuaccuugggaagaacucagaauguaguaauuauaaagauaggugacagaauacaaaaucaguauuuaaauucaauuuauggaucggauacauaauguauucagucuuugagaugaaacauaguuuguccucucuguuucgaaucugagcacggugcgacgacaucucacuucaguaaacuagcauucagaacugaaggcagaaggaucaggucacagucauccuuagccacauagacucagcucgaggaaauccuguccccaagauuagucaaacaaauaaacaagguaggaaucugggaaguugagguuuccguuuuagguuauagcgacuaaaacauaagccauuaugcuaaaugugugcacuucccuugacaugguagcgcuaguauagcagaguggucuguccuagcaauacaguuucaguacugaacccugauucuuguaugaagucagcauucuaauaaagcaggaaguguacaguguggggcagcacuucagcucccagaggcaagcuuccugcagauauuuccugcuaauguguaacaugcugucaaguagucaacugacuuaaacuuuauuuuucagaugaaccagaaacucgagaugcauggugggcagaaaucagacaagagauaaagucacaugcuaaagccuuaggcugccaugcuguagugggcuacagcgagucaaccagcaucugguaaaugaccacuuggauuucuugacuugacacugguuuggcugauugugugagcuggagcaauacgauacagauccaaggagagaggcacagagggaagccaagacggggguugggcaaaucagaccaaguucaggauaccuccgcccccuugagagccgcaggcuagcugugaacuggaugauuuguacaggcugugcuacgggauagucagcaugcccacuuacuaguccuugcuuguagcacuucagucguugagucuggggacucauuccagugggacauucagauggagugcuugguguucuauaaaugaauugccaaauaucuggaauguuugucuucagccauccuuaaucccagcacuuggugggcagagcuuucucugaguucaggccagccuagcaacauagugaauuccuggccagccaagagcuacauagacccuguauuaaaaagaaaaggagaagaagaagggagggagggagggagggagggaagaagggaggaagaaagcaagcaggcccagccacaaagucacuauacuuacuacauuuauaagucgggauggaacuacuucuuuugcuaacaauauuccuccuaauagcuaaguuagggagagccuucaaaaggguucauuccuucuaccuuucaccugaaccaucucuccugugugcccagagcugugcucuuugcaaggguuucccacccccagucauccuucugccacggccccuugucuguugucuuccuuguagccucugggauaaggccuucuuguuacuaagcccucuauugccacacacaacuuuugaguacaguuuauauuuguagauccauugaacucacuuaaagaaugugacacuaugaaauuuuacuuuuagauuacauaugacguaauguuuuccuaccaacauaguuugcuccuuuuauaucaguuuugacccuguuauuuuaggcagauauauuuuucucuuuuuuaaaauuaagauugauuuauuuuaugugcauuggugauuugcauccuucuauggcugugaggcuggauccccaggagcuggaguuauaaacaguugugagcugccaugugggagcugggaacugaacucaggucuuuuggaagagcagucagcgcucuuaaccgcugagccaucucuccagcuccauauguuuuucuuuuuuuuuguuauuuuaucuuccuggaacccuaucucuauucccuucuagaaaggugguauuuguuauaaugcagaggccauuagacccugugcugucuaccguugcacaguauaaugcaugcuacccgauucucugcucauucugucagagagaggucauuaacuauaguaaauaugaguaucacugagcuguguucuuuaucauuuugugcuuuuuauuguuccagaccauguguuacacauuugaaccauucuaaugccguagaauaaauagacuuuuuguuuugcuuagguuacuuuuuuauaauuuauguauaggcauguuuuagcugcaugaaugcacauauaacacaugugugccuguuggguggccuggagcugggauuauagaugcuugugagccaccaugaggguccugggaaucgaagcuggguccucugcaagagcaaaaagugcucuuagcaacugaaccaucucuccagcccccauaguaaccuuuccccuuuuauuaaacaccaucuuacuaacaacugcucuaccuuauucucugguagguaguccugccuugugaguggguuuacugccauaugcuuuuaugucugaaggcuuugauguuuaagacaugauucuugcuaagaaauuuauauuguguuggaaaacugugacaucuauaguaaguuuuauuguugagauauucuaggaugcuucaggaucccagaggaccagaagucugaaguaggaugggaauguuaguggaaauggagugcgagugaacugucauucagaagugcagugauggacugacugaugcuugcuugcaucacggagacuagacgagaaugacagcagugcagagaagaggcauguguggaggccggagagcgcgugcacguguggagagugcgugcacguguggagagugcuggaaggacagagccuggagaacuuaaagcugaaucacgggcacaaggccucuaaguccauugaauuuacuguagucccgauucaugugccagaagcuacugcucucaaaacauguuugcguuuaagucuucacuaauguuuuccuguuccagccuguccuuccuaguguuacugacagagguuucugaagcacaugcugcccugaacucugccuguuccucaggcacccacagcccaucugcccugaaccugacgccugugcucagaugucacauggcugaucuugucuugcucucuggcuucuguccacuuacuccuuuguucucccuucucuccucugcugcacuugucucaguugcuaugggugaggcccagcagcuguaucgauugccuaauuacuguugcuuucaagacaggcaaucugacaugaaaaauuuuaaagaauucuuuuuaaaauaagauucauacacacacaugcgagugauccauuucaaguuuuguugaguauauuuuggguacuaucuuggguguguuuguaauucuaaugcagauuaugcuguagcaccauagauuacuuauauaggugugcuuuuaggaucauuuuaauaacacuuuauacauaguuagaguaauaguuugguagcuuguuacuagauuuauaguuggaacucuaacauuuccggaagcucucgccuccacguuugaugcucacauagcuuguguuuccugccuaggcuuggggguaguguuugcauacuaacgaacauguaggauagucugacuuggacucaguuuaucacucuugauauuuaguguuuucugaagguuuauugaugggaaugcuaaccuguuuguuuuguuguuguugcuauuuuguuuucuagugaagaagucuguauuuuaucagcgucuggcacggcagcugugcugaacccucgguuucugcaggaaggcacuguggagggcuguuuggaacaaagguugucauaacuugcuauucuaaacugaggagggagagucuggcuuuguaaaucucagagccagguaguuuucuguacaguuggugcgagugccagguuacaugccugcuuccuguuagcuggccugcgcugacugcugugcgggauccuguccuacacagcaucaagucccaugcaugacuaacagcaggagaauuucagguauaccuuucccuuuuguaaaugucauaaauugccauaaaauggaccuaauuucuuuuacucucaguuauaaccucacgucucuaacgaauacaguuugcucauuuguaucaacuuggacccuuuaucuuaggcacacguauuuuucuuuucuuuuuuuaaaacuaugauuuguuuuuauuuaagauacauuggugggguauuuuuuguuguuguuaauuuaucuuuuuucuuuucucucucucucucucuuuuuuguuuuuguuuuuguuuguuuuucgagacaggauuucucuguguagcccuggcuguccuggaacucacuuuguagaccaggcuggccucgaacucagaaauacaccugcuucugccucccaagugcugggauuaaaggcgugcgccaccaccgcucagccuuuuucucucucuuaaguugaccacaaaucucccccuuuuuuuuugaggaauuuuuauuuuauuuauuuuuauuuuuuaaauauuuuuuauuauuauguauuuuccucaauuacauuuuuguuuuuaauuaauuuuuaaacacuccauguuuuagucccgcccccauccccacccuggucccuccaacuguuccacaucccauaccuccuccccacccccaccucaccugaccucuaaauucccuggggccuccagucucuugaggguuaggugcaucaucucugaaugaacacagaccuggaaguccucuacucuguguguguugggggccucauaucaacugguauaugcugccuguuagaugguccaguguuugagagaucuugggaguccaaauuaagugagacugaugguccuacaggaucgccauucuccucagcuucuuucagccuucccuaauucaacaacaggggucagcugcuucuguccauugguuggguacaaauaucuacaucugacuuuuucagcugcuuguuggcucuuuuggagggcagucaugaucccuuuuugugagugcuccauagccucaguaauagugucaggccuugggaccuccccuugagcuggaccuucuuuuccucaggcucuucuccauuucuaucccuguaauucuuucagacaggaacaauuaugagucagaguugugacugugggauggcaaccccaccccucacugauguccugucuuccugcuggaggugggcucuauaaauucucucuccuuacuguccagcauuucaucuaagguccuuaccuuugcauccugagagucaccucccaggucccugguacauucuagagggucccccucaaccuccugucucccaagguugccugcuuccauucuuucugcuggcccucaggacuucaacucuuuucccucacccaauucccccaccccauucccuuuccuucucagaucccucccucccucccucccucccucccucccucccucccucccucccuccccaccugugauuguuuucuuuucucucccaagugggacugaggcguccucacuugggcacuucaacuuguugaccuuuuugaguucuguggacuguaucuuggguauucuguacuuuuggggggcuaauauccacuuauuagugaguacauacaaaaagagaucaagggggauacagauugguaaagaaaaaaauaaagguaucacuauuugcagaugauaugauaguauacauaauugaccccaaaaauucuaccacagaacuucuccagcugauaaacaacuucagcaaaguggcuggauauaaaauuaacucaaauaaaucaguagccuuccuuaauuuauacaaaggauaaacaggcugagagagaaauuagggaaacaacucccuucauaauagccacaaauaauauaaaaugucuugggguaacucuaacuaaacaagugaaagaucuguaugauaauaacuucaagucuuucaagaaagaaauagaagaagaucuuaaaauggagagaucucccaugcucauggauuggcagaaguaacauaguaaaaauggcuguccugccaaaggcaaacuauagauucaaugcaauccccaucaaaauccugacacaauucuucaaagacacagaaagagcaauucucaaauucaucuggaaaggcaaaaaacgcagaauugcgaaaacaauuauaacaauaaaagaauagcugggggaaccaccaucccuaaccucaagcuacacuacagagcaauagugauaaaacugcaugguauugguacagagauagacacugugaucaauggaauagaauugaaaacccagaaauaaaaccacacacuuacagucaguugauuuuugacaaagacgccaaaaauauacaauggaaaaaagaaagcaucuucaauaaaugguguuggucuaauuaucuguuuguauauaaaagaaugaaaauagauccauauuugucaccucguacaaagcucaaguccaaguggaucaaggaccucaacauaaaaccagauacacugaaucuaauagaagagaaaguggggaagauccuucaacucauugacacagggagaaauuuccuaaacagaacuucaauggcucaugcucuaagauaacaauugauaaauggaaccucaugaaacuggaaagcuucuguaaggcaaaggacauagucaauaagacaaaucagcaaucuacauauuggggaaaaaaaucuuuacuaaccccacauccgauagagggcuaauauccagauuauauaaagaaguuaaucaccaggcuggugagauggcucaguggguaagagcacccgacugcucuuccagacugcucuucugaagguccggaguucaaaucccagcaaccacaugguggcucacaaccauccauaacgagaacugacucccucuucuggagugucugaagacagcuacaguguacuuacauacaaauaaauaaaucuuuuaaaaaaauaauaagugccuacuaucacauauacaaacuuacagcuauagaaaauuauuuaaaaaaaaguguuaaucaccaaaaagccaaacaacccaaucaaaaaaugggguguagaacuaaucuaaaaauucacaacugaggaaucucgaauggcugagaagcaccaaaagaaauguucaaaguccuuagugaucggagaaaugcaaaucaaaaugacccugagauaccaccuuacacgagucagaauggcuaagaucaaaaccucaggugacaacacauguuggagaggauguggagaaagaggaacacuccuccauugcuggugggauuacaaacugguacaaccacucuggaaaucaaccuagaguuuccucagaaaguuggaaauagaucugccugaagacccagcuauaccacucuugggaauauacccaaaagaugccccacaugccccagggacaucuguuccacuauguucauaguggucuuauuugugauagccagaagcuggaaacaaccuagauguucccugauagaagaauggauacaaaaaaugagguucauuuacacaguggcuacugugguccuccaggcuggcgcaggcugagugggacugcauuugcaucugucagguagauaguacauuugcaagguggcuagauuuacuuguaguuaguuuuucuuaaucuucaaaaacaaaagacaacaaaaacacucauaagacagacguuucuaaauagucacugcaguuuuauagaagaggcugugauagguuagguaccuaguguggguucacauuguugaacaagucuagcacuuugcagugaacgggugguuguuggugcucacuguugguuuauuuguaauacgcaugucauacgaagaaguucuuuuggcucugcaggaauauuguuacuagaaauaaggaauuucaauguauaacuucuucuaacuuacuauuuuuucucuuuaaucuuuuguuacaacuuucuuccaauuccugauuuuugauucuuuggugaucccacacauguguuuaauguauguuggucacuuugcccgucacuacugucuuuucacccucucgcucccacugaaacucuucucucuaacagcucuuccuucugcuuuauggcuuuuugggaaacaaaauccugaauuuaauugggguugcaucugugaacauggaguggaaguuaccugcuggggcacagacgacauaucaguggcuaggauuauucucccucccucaggagccauuagcugucagugugucaguagccucuggaggacuggguccugagcucuucccuugggcacaguggcauaucagugguccuuacucugugugucauucacagaagacaaggcucccagcaccagcacuucucccauccuccugugcucucagcauucuuaacaacccuuacugugcagugucccuugaugagaggagggguggucuggauauucuuuuagggcucacacucaguguccagcuacuuauucuucgcacugugaccacacgagacuguguauuaaccauccccacugcagggaggaacuucucugaccaaaggcuaagagcagcauuaguccauggguaacuauaaaugugaucguuuagaagccaacuugacacuauuuagcaagcaacaguggaaguuuccuaauagggcccaugaucaccgcaggcaaagaccaaguuuacagcacuagguaugaggucucugcuguggagugggccugcaauccagccagaaaacagguggugacugacaguccacuauuuuaccagugcgcauguuuugccuggcaguuugcuauugcagcucaccugggcuauuacugggaaacacuuuuuccuccagaagccuguaugucacuuagcacuguguaagcugguugggaguggggagguuugcagccaaagcauuuccugucuuaccguuugguuccuauggacaaccaagaguugauuuguuucuuuguuucuguguguauguguuuguauucauuaaccguuaggaaaugcuaccuuugcugucucuccaucgguuucuaugacuaccccucccaaccccaucuuugucucagaagucagcucugucagugugacgcagcugcuccuuggaggaggacuggcacugauuucauggucgcuaguaauuuaucagucagugcacacugcucugguguaaggugcauugucuaugacagauacacuguauggaauagaugguguuuaaaugacuuaaggauuuuagaaaugcccuaugacuuuguuugcuauuuaucuuuuauugagccugacuagguaucggacccugaucagagugccuucuuacuuuuaaaauauauuuauauaggauugaagagaauuuaccggugggcugcggauucugccauauaccauaugaugaacugaacaugccguuucccgcucaucucacauauugcuauaacugcaggaagcaaaaagucccugauguucucuucacaacuaucgaucugcccacagacgcagugguuguugguaaagguugucuuauucaggcaagguauguuugugacagcugaauugguauccuugagaaaccaugagguauagagacauagacuugaacgauauacacuguuucuuauuuguuugauccugaaccaacuuggcaacucuaucuuguauuuaucucaucuacagcugucaguaaaaacacacucuauaacacucaaguuuguacgcacagaaucgguuuaacauuucaagucuguuguauauguguuuauuauauuuaugacuuaguuugucuucuaguuuggaguauggcuaaauaucugcuuuagagaccucuaaaauauucuggaacaggguggguuuuuuguuuucuuuuaaagaacagugcuuccuccaugcaaaauucagcuguuuaucauuggauaggacauccuggacugugacacauacagcagauagcuuuaagugucuaguucaccaacaacggccagguuuccuggucccuuggauguuucuuuuuuuuuuuuaauuuauuuauuuauuauauguaaguacacuguagcugucuucagacacuacuaucugaagagggugucagaucucauuacaggugguugugagccaccaugugguugcugggauuugaacucaggaccuuuggaagagcagucagugcucuuacucgcugaaccaucucaucagccccaccuuggauguuucugucuucaccuugaaacuucagcaguagugacacgcuugguccauuucuccugagacuauuuggauuuuagugucacacagucuguuuuuguuuuuguuguuuuuucaagacaaaguuucucuguguagucuuggcuguccugaaucuuguucuauagaccagacuggccuugaacucacagagacauucuugccucugccuccggaguccugggauuaaaggcagcugccuccaccuuccagcucucuuuuuuuguuuucaccugcauuugguauuuugccugaauguauguuugaaagagagaggcagcuucuggaauugaaauuacagacagcgugccauguagggaauugaacuuggguccucuggaagagcaacuagugcucuuaacggaugagccgucucuccagcacccugagucuuuauguuaacauaguuaaugcccuugaguuuguugaguuaucuuaaugggagccauggguuuggacccucugucaacccaugguguaugugcugugcuuaugccugugggucucuuguuucuaaaucuaguguaacaaccuguuccugagcuucaggguuguagaccucugcuucacacccuaauaugaugagcaauaggucucacguuguuccaguuguaccaacagccccccacuuccugaucaugucuuuguaugucaauagcaccccucaccuguucauguccuguuugggaauuguugauacuauccucuuuuacacaucagauuaagaccaaaguuauuacauugagcuuuguucugaaauauacuuuauucuauuuaguguuuuucuucugucuucugcuuccauuuggggucuccucccccucuccugaaguauauauccuugaguauuuuuugaugaucuguuggugaugaguauuuguuuuuguuugucugaaaauguauuuauuuuuauguuggaaacauuuuaucugcagguauuuuuugugugcacaguaacgacagccuuuagcacugccuuucuggcuguuguaugugugcugugcugaucugugcucucuuugaaagcuuucacuugcauaacagugcucauauaauuugugugcuuaagcuaacauuucucucugcuguucauccauccuauaguuaugugugugguguuuugccuacauguauguauguaugcauguagguauaccauguucauacugaugccugcagagaccaaaagagggcaucagaucccuuagaacuggcguuagagaugauuguaagcugccgugugggugcucugacuugaacucugguuucuggaaaaacaaccagugcucuuaacugcugagccaucuccagcccuggagccaaagauuuuuaguuguguagugauucugaccauugaugcauuucuagagauccugagguuuuugguuucugcuuauuugaacuuccaguaaagauacacugagggacagaaauggcagagcaacagguuauagucuaacaaaucugagacuuguguguuucuaagcaugcuuugacgcagucuuuucuuaauggugcuggagaucagaccucaaacauccuaaugagggcccucccaguaaaccagauccaaaucuggacauuucucaggacaguaccaagaaugcagugcacuuacggaauuauucuccuuuauagguuaugucgauuaaaaaagaaagcacaggcagaagccaaugccacagcuaucaguaaucucuugccguuuauggaauaugaaguacacacucaacugaugaacaagcucaaacucaaaggaaugaaugcuuuguuuggacugagaauucagaucacagugggcgagaccaugcugaugggcuuagcggugaguggggaggcuuuugucaacuccgaggcaggaaguguugugugggacucagaggguuaguuaagagaggauaaacagaugugguagugcauccucagcguccugcaccaggcucugaagcagugaucggagaucaaggccugccugggcuauacagcaagacccugucucaagagaguaaguuaacaaaaguagacgacuaagcuaaagaaacagacaucaagacuuuaacaguuggagaaguuuuaggaaauaaguccagugguuugcuuuuauauaguuuuaacgaaucaguccaucauuccuagaguugaaaccacugaucuggacucuauuauuauauauugggcuguugacaguuacaggauuuucauuuguguguugacagauuucaaauuguauuucuuaugucaucuuuucaucaccuaaggagauauuuaauuuauaaaaucuauggacauuguagucuuuuuuucucuauaaauuuauaguuaaaaugcaaaauuguuuucuguuucaucucuuuuuuuuuuaauuaggcuaaguauguaaauuuuauuuaguuuuuuagguuuugaggcaaggcuguuccuaaugagugcaugccuugaagucaugauccuucugccuccgccugcugcggacuggauuugcaggcugcaccccuaugcucagcuguaugguuuuguauguaggaggugacaguggugagcugcuuaguucauggcauugauguaaccucaggccugcuccauguuucaugcucccguaggaugccauuaucugggccacugcucugugaacaccagaauuucaggaucggaaggcuagcuucugugauagcugacaggacagucccuugcuagaugucacuuaagaggagaagacagugcugccaugggguaauuccagagagacgggcugauaaaugcugagagugguuucaaauccagguccaucugguucugcgguucaaggcuggugugucaucagccaguguguuagcaaaguguuagcugaugcuaaggcuugucagggcuucucaguaguugacaugaggagcuacauuguggcucugcuaaugaaguucugggagagugcugccaagagccaguuuuagccauugugcagaugucauuuuugaaugucaaaaacuugacaguugauggguuucacauaaauauacaagcauccaagauggaaagcgcuacugccccuggauucccauagcuccacuugaauucugcuucuuuuuuucuuuauuauuguuucacauuuacuuguagacaugcacaaaccauggugcacauacuguggugcacauguugggaccaaagacuagcugugggagucacuucuccccuuucaccauguaggucucauggauggaacccaggucaccaagcuuugcagaggggccuuuacuugccauuuugccagcccuguuuuugcucuuuuugagauagaguuuuguguagcccaggcuagucuugagcuuguuauguaaccgaggcuggucuugcauuucugacccuccugguucuagcucugggagagcuggauuacagguaugugcugccaccccaccuuuaugcuuagguuucuuacaguuuguucugcuugugguagcuuacacacacacacacacacacacacacacacacacacacacacacacacacacauuuugucuuguuuuaucuuucccauaauuuuccaauacugauaguguauacugacugauuuagaaugagagauuguuacuggguuaaacgguaaaauaagugugucaaguaaauuguuugugugaguggccauggagugaggugggugaauuagauguacagagcagacugccucaugguuccucaccacgcccuuuccauacuugaucgcagcuguucuccgcgguagcccuucuauaggcagacugccugcucauugggggcaaagcugcuguaguaacuuuuccuguugcuaagggaguccugauuccaaguugguuuauauauggauucuaggcauucugaaacacggucucauacagugacccagacaggccuggcgcucacgcugaggcuuagccugccuggaaggucacagucuccugggcaagucgcucagaauucaaccuuuaucuuucuucuuuuauuucuuggauaaguaugagguaaagauuuaaaaggcauagcugguuaugcaguuauguaauuagagagcccccuucagagcugucaccaucuacucaggagucucccugaguacaucaacccuguuagcagagugguuuuguauguuuuugcagacauggccuagccaugugucucuuguacaaagcaaagugcacauuccuagacauagaccuuaaagccauuguuguuugguguuuugucugaugauaucccuguucuuuuuacaagucggccacaggagucuacuuagcagccuuacccacacccgguggaauccagaucgcugggaagaccccuaaugauggcuccuaugaacagcacaucucccacaugcagaagagaauaaacgacaccauugcaaaaaacaaagagcuguaugagaucacccccccggugagugacucgggccugcccagugaaggcaccggccgcuggcugcagggagggacuuggagggugucuuccucaggacaugggcauucuucaccucuuuacugucauugcuuaaaugucuccuuuuugaugaggccuccucucuuccaguauacacagggcaggucuccuuucaggucuuauuuucucacaugugcaugugucuguaucugugugugugugugugugugugugugugugugcaugugcgcauguguucacauguuugacuugugggauauuacacacccagaaauuuuuuucucuugcucauugcaaccuguagagaaaagcucuauuacagccauguuucuuguucuagaaagaacucuauaggugucuuuuuuucuuaggcacaugcuagcagugagcauuuaacaccauuuuggaaaaccucuguuagaaccuugugaaggagguuucuggaagagcagcaggcucugccuguugagcucccaucauggcccagguuaacuguuuaaaacacacacaucuggugcacgguuuguagaagaugaguuuuguugcuguuggagauuacuuagcaagugaauugugcagccugugcaugcauuuguaaauguaugcauuaucuugacauaugcacacacauuucuuacucuucacauuaacuaucauagagcuccuggaaaagccaggaucugaaagacuagugcccucuucuggagacucuuuccaucuuuguagccaaucguacuuuaaagugcuuuagaggcgcacaucuagauaguguguaggcguccaugugccuggguggggagguucccaccucauuguagcucccugucugugcacuacaugucaccuugaccuuguuacacacagccugggcuguuagccugcuuuuguagauaaaagagaacaucugcaucgucugugaccuggaaaggaagcuuuagaguucagugaguguaucuuguggauuuuuuuuucucaucaggaagcugcauguuaauauaaaaccuuaaaagcaaacugaagaauucagugucuguaauuacauuucuuucaggaggugucugaggagaugauaggaucccccaucccagaacccagacagcgcuccagacuucuaagaucacagucggaaaguucugaugaaguuacagaguuagaucuuucacacgggaaaaaggaugcuuuuguuuuagagguaauacugcauugaaauaauguuguaaaugucugagaagguaaauauuuuauaauuggguucugaacugauugacaacuuguacuauguuacagcuaccagggaaauuguagacauuucauguauuugaccuuagcagcacuugguaacuguugcuguaauauaaacagcccugaagccacuuggauaaaauaauaguuaaaaugcaagcugagcaaccuucauagugaugguuugaauaggcuuggcuucuguagacucucguguuugaaugcuuagccuguagggaguggcacuaauaggaagauagccuuguuggaggaaguguugccacuguggacuuugaagucucuauacucaagcuccacccagugaggaagagagucuccgcauggcugccuuuggaucaaaauguagaacucuuggcucuuccagcacuaugacugccaugcuucccaccaugaugauaauggacuaaaccucugaaacuauaagccaccccaauuaaauguuugccuuuauaagaguugccuuggccauagugucucauaauagcaaugaagcccugacacucaucaaaaguguaaaaucugaauugcccagcaauuacaaauuugggggcugagacuguagcucauuugguaaagugcuuaccuaauguucaugaagccuuguacaggaucccagcaccguguaaacuggacaagguguuuaagccuuugaucuuggugcuccagaggaaguauuccucacuguauggugaguucaaggccagcuuggacuauaggagacccccuaaagaacauuagaaagcucacuuuuaaaguugugguuuuggagcauuuuaggaguaggagugcucagcuucuaacaacuuuguagacaucagagucugaagcacuccaggacaagacacucagccugcaguaguuuaccauuuggaguuauuuuuguaagccugggugacuuuaaauauaaaauguacugguuuuauucuaucuaucuaucuaucuaucuaucuaucuaucuaucuaucuaucuaucuaucuaucuaucuaucuaucuaucuaucuauccauccauccauccauccauccauccauccauccauccauccauccacccacccacccacccacccacccauccacccacccaccuaccuacccaucuaccuacauaccuaucaauuugguuuuucaagaaaauuucucuauggaacuugcuuuguagaccagcaggcuggccucgaacccacugagaucuugaacagugugguucaagcagggauuauagcuaugugacacaaugcccagacuaauguacuguuuuuaacacaguauaauugucuuuacuuuguuaugacugcauuugauagauauugcuguaugcacuuuguaauaaucccacugagugcugaguacaguguguccuugcugcaugcaugagaugguguugacagucuugaacaguuaaacuccuuuccugaggagucucuguggcauggugcucagcagcucacuguucucagagcaaugucccccaccgaccccugagaguagcuuaggagaggaacaguguccuccgcccaccccugagagacaagggaaugauacaggcaccuugugagaagaacguuguugaggucugcugcuuugaacccagcggcucuggaagcugguaguggaauuguguugggaugggauucuagaggagagucugaagcacggguaacugcuaagggaaucgcccaucagacaugcaguugggugggaagagagggauuuuuaguuuuaugugguuuuuuuauuuaaagauuuauucauauguuuguauacaugugugaguuuaugcagguugucccuguggccacagagauccagauccccacugcugggguuacaggcauuuguagagucaccgcguguggcacugggggcucucagcuggguccucugccagagcagugugugcucuucacugcugagcucccucugccuccugacgagggucugcuuuccauugcuuuacaguguaggaugggagagaagggaggucaguggggaagcagugugcuucaggcaggcagcuggcucugggcuggguggcuagcacagcuaacaguaacaccagugcuuccuggagccuguaagaaaagggcuugucaggacuccacuucccaucuagggaaggcaaggucaagcugggcccuaaaagugucuuaacaagcucuccagguggcugaugaucccugaaguuugauccagagcauaacugauaaauuaggugaugggauccugacuggguagagacacaaaagaaaaguacguccauugagggcacaagaugggggcaggggacagauucagugagagaggagacaaauggggaacaccggugacucugcuugugucguguuuggggagucguggcuugagguguggccaugacugggcagcgaagcugaaaugcagguaagcauggcuguaggacgcuguauguacaaacccuggcuuuguuuaggcuuguuuauauuauauguagaguauuuuuauaaacauuuuugaaaagucugcauaauuaugucaguauacuuuaauguauaaaagguuuuaccuagcaguauuugaaguuguuacuauggugaaauuugcugaugcuagaauuuuuguuuuauauuuuuauuuguuuauauguguguguuucuguguauguaugaacauauaugugcgggugucugcagaaucaagaagaggguaucucagcuacuuuuguauuguuaugaagagguaucaugaccaaggcaacuucuagaagaaaagaguuuauugaugcuuacaauuccagagggguggaguccaugaccauccugacagggaaugugacagcaggcagguagacguggugaugggguaguaguugagagcuuucauacucaucuguagguaggaggcagagagaaagagcuagcuucugaaaccucuaagccuacgccaaaugacacagcuccucagacaaggcagugccuccagauccuuugcaaacaguucuuccaccuggagauuggguguaggauccaugauccuauggggcugaucuuacuccagcugccacccagggcacuggauccauucaggcugcaguuucagagcauugugagucucaguuugggggcugcgaaccaaacucugguccucagaagagcagcagagcacucuuagcccugagacaccacuccagcccccauguuaaaugcauuagcaggggaaauggcucugcauuuucguaguucuuaaaccuugagcuuuucagagaaugaaaauaauuuuuaggucucaggacagcuuccguauuuggaucgaugguuacacaguagccuuaucuuucugucucuagaucgaugacaccgaugccauggaagaugugcacucccuccuuacugacgccccgcccccuucagguacgcagcaagcugacuuugagaucgugugcguccgguguucugguuccuauugucaggggacuagcuuucucguuaguuaguuauuucauuuauguuuuggaaauggggucucauguaucucagcugcguugaacucaguauguagucaaaaguaaugaaaauuuuauauuuaaacuuuauaguugagaaauauuauuucuaaaauucaaaaucaguaaauuaucuuaucuuaauuauaauuuguuuuggcagguuuuuauaguuguaauacagaaauuaugccuggcauaaauaacuggacaucagaaauacagguaaacuuuuaucagauugaagcaaaugcauauacauuacuuaaauaccaauucuuuuugacccccaauagcaauuacaaacacuguucuuuuuuaauuuucguaguuauucauuauuugggguggugguggcggcggcugacaccuuuaaucucagcacuugggaagcugaggcagguggauuucugaguucaaggccagccuggucuacaagaguuaauuccaggacagccagggcaacacagagaaacccugccuugaagaaaaaaagaaaaaagaaaaguuauucauuauuugccaguucuaucaauuauuagacuuugggaaaaaaaaauaagaugucguguuguucuuucuccugcacuuagauguucacgucaguaagaguggucagacuaaguagccucaacuugacuaaccaagcucucaauaagaacuucaacggccuaugugagaacuugcucaagguaggagccugccacucagaacuugaguugacuggaccagucuuccuugucccugugccucauguggcugcuucugugagccugucagccucaccugggccacacugggccacucgcuuauucuugcucuucuaagacagcauuaggaaagaaguguuuaacucaguagcuuaacuuucauaaaaaucucguacaucuguagaauguuuuuaagagccugaguaaacuuuuauugguguguguguguuuugcucagagugguggguuguauaaaguuguauuggcuaauugcggugguaugcagugacuggaaucccucggucacuugucuuccaagauagucccaccucuuacuucauguccucuguguuuacgugaucauauucuauaaacaccuaaaccuugcugucacccaguugcugacacugcacucucaaggggcggggcaguuuagcucuccauucuuggguuuuaccuuuuuuugguauacugucucuggacagcuaacgccacgaauucauuagugugcgugaagagggaagucaccaguccucuccuuucugcagagccuguauuucaaacuucgguccaugacccccugcugccucugccaugugaacuuuacagugucucugccugaagaugaguuaauccagguaaugaaggugcauuugauuguagaagaggggucuagcccuuugggaucuguuuuagcuuaauguuaccauagucaguaacuucacacaguguuuuaacucagacuaucugaagguaugucuuagcuugcaucaggcuguguauuucauuugucuugcugcugguaaucugcaggggugcuccaagugagcacauuguacacagaauggggcccagugugcaugacuuuaccagucccuuuuacagaccuggucuuuuagaaaggcacauucagaaaagucuacauuugauguacauguuguaugucugaauuuacauagaauucugguugagaaucuuaaucaggaagggagagccagucaguugauauaggucgucccuuggugcuaaacgaagauuguaagaaauuggauuuuaucacugguuauuuugcuaaucauaauuguuucccuaauuguaggucacagucacagcaguugcaauaacuuuugauaaaaaccaggccuuacagaccacaaaaccccacguugaaaagucacuacaaagagguaaacuuugaagucuagcaaguaaaguucucauuugccuguuacagcuucaccuaugguaggcuaggguaugguuguuuguuuguuuguuuguuuguuuguuuguuugguuuguuuguuuguuugagauaaggcuucuuuguguagcccugaguguccuggaacucacucuauagaccaggcuggccucgaacucaaaaauuugccugccucagccucccaagugcugggauuaaaggcaugcgccaccacugcccagcaauaggcuaggguuaaagcuggaccagagaugguugcuagguaacugcugugcaucugccucuuagccuccacagauaacgaagaacugcugcaguucccacuggagcucugcucagacucacugccuccucauccuuucccagcagcuaaagguugguccccugggagccuggguggcacgguggucucuccccucuguuuccucagucagucugagaagucugcccuucaucccaucauuguguguuguucuuacuuuacuuugcaaacagugaagguucauuuuucuuauguuccauucuuauguuucaguuuuaacaaaaguuuuaccuuuaauuucccaguguauauauuuauguauauuuguguauuugguguuuuaucugguaaauguucuucuaguagagguuuuuauuuggauuuucauagagucuccaggggaaugcacagauuagacaggaaugugcuuccguccuuucuaaccccugagacagaguuucucuguguagcccugggguuccuagagcucccucugaagaccagguuggcuuugaacucccucugccuccugagugcugggauuaaaggcgugugacgccacuggccacuggugcuuccauccuguacacaguggcuggagugaaggacagugcuuuuauaagaaacagauagcuuuuaaaauacaaaauaaucucccccuaaugaaaaaacucuuaaguucuacagaaaagaaugggaggacugcuuuucgcuguuucuuuuuguuuuaguauaaauuuuauuuugauuucuuaaaacuauucugucuaaucuuacauuaccuauucaguaaauguaguuuguauuuuuucuaaaguuuuuaauugagaaaugauucauuuguuauuuaauaucaaauuaguuacuauaaucauuauauuucauaacaauugaaauuguucuauaaguauuuuuauuugguaacaaauuauauguaaaacagaauguauguguguguucacuaaauaagccaucgcacggucuaucuguccauguagggauguauguuaaucucagagucuauagauuugaagagauaagccauguuggaauucugaacugguaacugcacgucuuucugugucaccaacuucaauccaauuuagagugguacagaaaaccuuagcuucccugacgcuggcucagaggcuaacacuugccaguuggaucgccuuuaguucccagcauccacauggcagcucacaacugucuguagucagucucaggggaccugaugcccucuucuggccucuuuagcugucaggcacacauacucuggacagaaauacaugcaugcagaacacuuguacacacaaaaucaaaauaagucuuuaaaaaaaaacuugguugaguuccuuagauacccccagauuuucagggaucauuuguccuuccucugcgugaggaaccaccugugaaaccuggucagcacagggcuaagucugcugcuggcuuacaagaauauguuuggaaucgggguguauuuuagcuggauuuuaaccacauagucucuacuaauuggacuugcagaagauuagcaugacauuuguaaguuuguuuauccauagugacacuuccaaaauguugaagccacuuacagcgacugcuuguguggucggccccugugugaaacaaagggugcugugcguuuggugaacugaagaacgagaggggagcaucuggcugggagccuuacaugugugcugcuucaagugcuuccugcggaugucaggccgcagcagaggccugagguggacgaaagccugcuggcugacgaaagaccucugucagcccuggcuucacaggucuacaaucucaaguuuuacacuuccucuuagucuuuaaauuaaguuuuaaaaauuugcguguuucuauguuuugugauugugagcauguuuguaguaguuaaaauguaagugaaagguugaacucacguccaguucagagagcugccauaauuaccagguuuuccaggaagcuccagugagguaaagcagccagucagauuccucucuaaguuaugaguccuuucgagcaaccccagcgugggagcggcugacagagggugcggagugagggguucgcucuguagguuaaagccucggcucuaggccuuacuuaagaaaggguuuccagaguuagagaaacauuaagugacaccauaccaccuucacugcuguccuaaaaucagaaccaucaugucuacuaauauauaaaacauacuaaaaugugugccacccagugauccaugcaaaaacugugcuugccugguacgugaaaaccagcagugcacacuguaccugugccucucgccuguaguuguccaaguucuggcuuguguugcgugcgugcguaaguugucuucucucguccuuucaggaggacgcgggcuuuaaaguuauuugaagguaauuugcaaggguugaggguaagguggguugugaaagguuugaagaguagagcagugcucuuagagcgugccuggaguguuuaugugccgggacugacaguguugaauagacuagaaaggcugugaaagucuaaggguggcagugaagaagauucgggagaggaagccaggaggguuguguggcuuugcugaggugaccagcugagcaggcagaauuucuuuucaaaaauguuguaaacauugacuucuaaucaacagucagggucucaaaaaaaaacaaaaaaacaaaaggaaugauauuuguuucccuucgugucaacaaggagaagaggcugaagagccaggcaugacguguuuauaaacagcugcacuuugcuuuuaggugaaccuucuguuguuauuuacuuauugacugacugacugguuauugucaacaagggucagugucacauacugcuuucauggcaugcgucuauccuagguccccguagaguagaucaggcccugcguugucccuccauguccagcuucccuugcggugguguuugcguuuguuuuucaagggaacauguuuauugguuugucuuagaucucugauucacucagugucaccuagauaguuaccacgauuugcuugcuuugaaauauuaauauguguugauuuaaguuauuucuuaaagguugucaggauuugcagacaggccuuagaaggaacauacaugauguggaaucaccaugacguguuuccuaggcugugcuguaagaggacauggguagcacagguuuuacacuacuuccauaauggucuagccucauguuuauggcuaguucuauauuuguuguuguuguuuuuaauacacuuuuuaaaaugaugcauauaaaaaagggagagauuaaauauaguaaaaauauacagucuaagugaagauauuugggguaaaaaauuuuacaugaaaaauuucucauagaauguagaugaaaucaauaauuuucugcuuuaauguuuguaaaagguuaauaccgcuuuagaaaucugaagauauauaucuggaauauuaguuauggugaggugauggacuuuaacaauuaugacccacaugcuacuuuaauuauaucucaaauaugguaaagucuaaucuauuauagaaugguaguuuuauucugaucuugacuguuuaauacugucaguaaguuaauaggacgacauagucuuauugguuguaggauggaccagggccuuuccauucccuccugcucccgucuucaugcugcuugcuucucccucagucaccugcucagugcagaugcuguacccuggcaggggcacucgauuuaaccagccacugacuacgggaggcagcauaaaaaucuguaagcauuagcuuuuauuuuuccaacaaaugaggaauguuucugaauucuuaacuguauguaguagcucuguauaugcuauagauacuuuuauauaguaacagucucuuagaugucugcuguguuugcucuuuacaaauuguauguguucauucacauugugaccacaguggugacagccauacaguaggcuugugaguaggcuucauguagucuggauggucagagugcuggcaggggagggaaugagaaugagaggcuagagagagguggccgagguguaaucccagaauuuauuagugugagacccucucuccaaaacaaacaaacgaaugaaggaaugaaacaaauguaaagagaggucccagugucuguagcucauccaagagaugggcuggaagggagggcuggagucagcggagaagcagaauccucagggcagcuugagguccgugagcugcugaaaaggcagagugcaaagcaaggacaaagaccuaggcuguaacaggcucugggaggaagcgcaucgcgcucuacagugccgaugcgaugccuuacuucugauuucccaugaugaaagcucuucacguggaagcuucuccuuccgucuuuaccuucauaauuuacagcuccauggugauuucuucaucagcucauccacaucugaggaggcuucuaucaucuuuagacucgucauuaacuucgucauuaagccacuuuuuauagauacaagguauauucaaucauuuauuauguugauaaaaaugccugaaagacagugaaacucaguugugauaauaguaacuuaaaacgaguauuuaaauaggaaaauaauaaaaauuaaagacacuggauuuuuuuguuuuguuuuguuuuuuguuuuuguuuuuuguuuuuuuuuuuugguuuuucgagacaggguuucucuguguagcccugccuguccuggaacucacucuguggaccaggcuggccucgaacucagaaauccgccugccucugccucccaagugcugggauuaaaggcuugcucuaaauuucuuaaagugaauguauuuuuuaaguuauugucuuaaaaauuccuacaaauaauauucuuuuguagaauaaaaagaauggccgggcgugguggcgcacgccuuuaaucccagcaccugggaggcagaggcagaggcagaggcaggcagauuucugaguucgaggccagccugguccacagagugaguuccaggacagccagggcuacacagagaaacccugucucgaaaaaguaaaaaaaaaaaaauuagagcaaagaugauugauaaauucuaaugguagaaguaaaaagucacaggaguuagugauuuguguuacagcagccuuugucuagugugugauacucaccagaaaauggugauuuagaaagaauagaaacuuaaugccucagaguucuggaggcugggaagguaggccuacacugaaguucuaucaacuuggaagggccuuacuggguuguaaugugugggagaccaaacugacccuuuacagugguaccaguuucacuggaguauguuaguauguaccucggaggagcugagcauccaggcuauagcuacagcugacagguguaucucguuggcuaucauagccgccugagcagaaccggagaagcacaugaaaggagggggagacuuguugccacugugcugcugcuguguuggucacuaacaaucucaugucugcuagcccguuccuaaccugcaguuguuuuauucuccacacuuggggaugugcggcuuguuugcuaaguguugcuagagcaagcuaagagaguaaucugaaaccuuacuggcuuugccuaguuagauuccuagucucguuggauggaagaaggaagcuugcucugugcaggcugaccuuuaacugcucacgugggcacaugcacacaucacacacacaaguacacacacauacacagaaacuguaaaagcgugggcugcugugugucuugauaacagcccuuugcggauggaguggggcucucaucugcuugggcaguguuugucucacuccuccacauggacggcgcaugacguagaauucagcacuagcuccccagcagaccuugaauggugcuuauaagaaguaaugaaagcuguugugggggcuggcgagauggcucaguggguaagaacacccgacugcucuuccaaagguccgaaguucaaaucccagcaaccacaugguggcucacaaccacccguaaugagaucugaugcccucuucuggagugucugaagacagcuacaguguacuuacauauaauaaauaaauaaaucuuuaaaaaaaaaaaaaaaaagaaaucuguuguguuugauuacugcugaccuggaauugcuuauugcuuuauuguuagaguuaccaguaugucaacaagccagacugcauacaguuguagugccuucuuguuugagagucuguuaccugggaagccaggaagucugaggacuucugugucuaagguguacaaacuggacugaaguggcagaguucacuuguuccaccagcugaccuugagcaucucugcaagagaagaguuaagaucagagcaagugugagugauaacagugcauucaagaggcucugugaacgcugaagaauggcugugauccaaagcuauugaagucagggaacaaagaacuccucccccuuuauaaaaaaauaggggaaaagagagagauucacacaguauaaagaucauguagucuaaaauagagucuccuucuuccuucaucucccuucucaagagcacacacucuuacuagcuacguagaaaaaaauggaauauuuauuaauuuuuuuauuuguuuguuuaugguuuuuuugagacaggauuuuuuuuaaugguuagaaacauuuucuuaaaauuaacucauuuuguacauucauagcaucauuggcugaacgacuguuuaauucucuaacguucuaaugccuuaacaccuugcaaauuuaagcucagauguccauuacagcuucaucuccugccaguuccaucccaccaugggcucucagcacugcuguaacucuucccgcugccuuuguugagacagggucuuauguagcccagacugaacaggcucacugcauagcugaggaugacuuuacauuccugacccuccuucuaccuucuuccaaaggcuggguuuacaagugugaaccucagugcuaggcuccuaauugucuucuuuaugaacacaaacauuuguauauugcuuugugccauguauuuuccauuuggcacaguuuaggguauaauggcacaguugccauuaaaucagauacaacauuacagaguuacagaagagaauuucuuuuuagugguuuuuaaaauuauuugagucauuccuucuugauccuugggggacgggagucguucacaagaggccuaaucugaauucuacauucucucuuuuuuuuuuccugugaguggagcucaagucuuagagccugugcacacuaggcaggcagccuaccacgaagcuaucguucccugccucuugguucuuuaagucagccuugaaccgucuguacauuccgaguuacagguguuugucaugacaccuagcucaaguagacccucuguaaugaauacucauggagucugcccuccucagcagggacuccagagaaacaugggaaccucuaagucucgaguaggcugguuguucauguaugugucgagccacuuccuguccugugcagucucuagagacuuuuaagcugcugaauauaugucaggaccggucuggcuucuuccuguauucccaucucuuucuagacuugcuacaucccucagucugcugaaucaggaagaccguacccuguuagauaugccguccguggacauuaugaucaauguuuacacguuugugaccgucccagucauccuguggccugcaguccuuaagcaacuccacauucggaggacugcaacugcugcacgcucuccauguuagcugccacaugcaaggcugccccacugaggagaaugcucuguacaagucauauuuugaguaauuaaauuuuacaaaucugaaaauauuaccaaacgaccaauacauuagagauagacaauguauuugcuuaauugauacuuuaaaaaaaaauuggaugccccaaauauuuucaguguuucuaaugagcuauucuuuuucuuucaguuuuauaauuccuugagacaaaaauacaaauaugcuaguacagagagagcgugaagaccacugcaguauuuuuugucuguuuguuuguuugguugguuuuucgagacagaguuucucuguguagcccuggcuguccuggaacucacucuguaaaccaggcuggccucgaacucagaaauccgccugccucugccucccgagugcugggacuaaaggcgugcgccaccacgcccggcugagcgugaagaacaagaguagagaggcuuuagcaguccuuucaccuuuucacaauaucuuacauauacacaacaaauaccuaagaccccaggacaaccucugucugagugcuacccaaggcugcuaggaagggugugauucugggcgugauuccuagcaaucucuggaggugucaaucacuuagcuucacaaagguuugcuaccacuagagggaguuguugauaaagucagagggugaccuuaaguuggaggggagggagggacgcagcuaggcaguggugcugauguguguggcugguuuucugcugugugauguucccagguacuagcucucauuccucccuuaaaacauugcccuccccagcacacggacccugucuucuuaucucgucccagggcccuauuagcaugcuacuguuuguaauuucucuagaaacucacuuuguguuguaauaagcaaucaucuuggcauaauauuuauuaauggggcuguuuucauauaaaggaacugccaguuuauauccuaauacuugugcuugguuugcuuuuauaaugaagccauaaagacuuacuuguucuauucuucugguuuacggaagauauuaacaagcagcagagaagaggugcuggcuuguccucgcauccgagcuaauguugucuguauugucuuauuagaacaccuggagagugcgaacucuaacucagguauaccagcugcacagagaggugaguuugucugccuaagcacacagucacuguaaggugugagguuauagaugaggagacaugcaguuagagccuaggaaugcacuggacaguggaguagagcccaggacaggcuguguuguauuuagaauguuuacaaauucaaaaguauuuacuuuguuauugcuacuuuuuacuauguaaacguuuuugaguuucuaaagguuuuguucuuuagccuuuuaccaucagcagcaauguaaauauuacuguugccagaaggggugcuagcugcuccccuccuucuugucagaggccuuggggccaggagucagaccuggaagcggaacguagccagcagugccccucugguuucuugcuguuuccagaguuggguuauugaugacccuuuaguaagagacaggucaguggugggguggguuucuuuuucuuuuuuuuuuuucuucuguuuuuuguuuuugguuuuuccccuucaaacacuuucaguacuuuauuauuuuucaguuuugaauuucagcuaaaaguagggaaugggguugcucauaauggguugauuaugaauugaaaauuaauuaaauaaauuaauauaaauuaaguaaauuaaaaucaaauagaaguaacuaaauucucauagugaggagagugggaacaaccgagcaggcugaguccucugcucugcaucagccgggcuguacuugucccagacuccgugcccagcgcucugccaacccuuacuggguuuggacacuuggcugucuaaagcuugacugugcaccaccuccugucugugagcuacagugaaguuaaguuacgucaucagagcagcauuguggcgaguacggcacaucauccauauuuuucuuuguuuucuuuguuuccugucuguguuuccagcaacgucaguugauuacaguuccuuugcagacagaugcagcagcuggauagagcucauuagacugaaagcucagaccauaaggcgcggaucaauuaagacaaguaggcggauguuucuaccacguucugaugaccugagaagcauaccccugacuucgcaguggugaaggcuagaccuuacugccuaguaacgacacugcugaucaguccuguguuugaauguggaagcugcaggugcuuggucaugugugaggagcugucacagagccuuucgguggcuacuuuuagcuguagaauggucuuuuaaauuuuauuuuuuaugaaaguacacagaugcauauuacaucccugucuaggaggacucggccagcuuucuuguugaagagacacucuucaggacccagugaacugcugacagcaaggcugucagcuuccgcauucugagggacagggaccaaguauguacagagaaaaaguagacaguguaucuaucuuacugcuaagccagagagagaugcuuuauaaccuguguuacggcagauuuugaggaaaccauauuugagugaguucauauuaaaaaggaaaaaacuacauuuuaaaggaaagaaugcaggaacuacaucagaaucauuuuuuguaguccucgaggugcuaaauuaauaaguaggcgaccuugguguccuccugagguggcagggauggugugaccauguggcugguugugagguuagaaacacagguuuguguuucuggcugauugcaguuacuuaauagcuggugggaacuauuuuacuguuagcuucccaaagcaucuuuuagacagccacgaucgacuguuaagguuuaaguuacauggcuguuuaagcaaaaaagucugggaaagacaaacaggaccguauuacaccugauguuaccuaggcugccugcagggcuccagugcuggaguguuccgacaaagguggaacuuacuggaaugucacaacuuugacacucuccuggauaacuuguuccuacagcagcucccccugcucuggcgcucuccugucucacucugugccaucauugugugucucgcugcaccgcaucgacaucuuccuuugcaggaaugccauuuuccuucccagacuccauuccagcaccuccucaugucucuuucucucucucucucucucucucucucucccucucucucucucucucucucgauugcaugcgaugcaugauaacuucuuuucucucaugacauggcuuagccucacagacagcugaauguuaucaccucuguuuggaagccuuaggggauuaucaguuugcagggucuguucuuaauguguccuucucuuucucuaauuuuagcugugacuguugaaaaagcaagugccaugggugauggaaauuuccggaaucgcucugcuccaccuugugcaagucccacaguugggguuguuaagaugacgccgcuuucuuucaucccuggagcaaagauaaccaaguaccucggcaucauuaacauguuuuucauucgggaaaccacuucucuccgcgagguaacuuacaaaacggaagguuguuuaagcccauuuguuuguagaaguuguagauccuuguuguaaaacacauaauuuucuccuguauuugaaacugcacugccgggacacgugcagguuucuaaugaggugguuuggguucuuuuuuuuuuuuuuucuuuuugguuuuugagacaggcuuucucuguguagcccuggcuguccuggaacucacuguagaccaggcuggccucgaacucagaaauccgccugccucugccucccgagugcugggacuaaaggcgugcgccaccacgcccggcauuuauggguguaaaguuuauaggauugugauuacauuucaaaaucagggccacucucuugugccauuuguaacaugggaauuuaaccuaaguagaaagggaaugguguuguaccucaugagucagggcuacugaacacauuaguguuguggacagggaaacugacagagaugggaggcccuguccucuaagggugcagugucucagggccuuacgcuguggaaagugcgcguuuccugagaugacucagcucugccuugcuuugugucagggaagcccugugcuccugcuucuccacaccacacuucugucuccagcauggagccugccuggcacagugcaagccccgcugucuuugugcaaaugcaugauggggucugacaggacaguuacuuagguagauucuuccuccuaagccaaccuauuuuauuugugcucuguguuuauguggaggaugaaccaugucgucucagaacuucuaaguggagaaucagaguccacuucaguuugauagaauggguuuguuucaaaguugcaucguuuuucuguuguuguucucuaguugcuccuaguaguacuccuuuaaguuccugcugugggaugguggugcuguguugcucaggccggucucauacacaggauccugucuucucagcuuccuugacaguggggucugugcacaagcugcgggccacacugcguccgccauuucuuuccuuacucuucgcugcuguugcauuauucacugcuggugcguugcuccgugguugaucucaccgcaacagaggccugcgcuguuaacuuaaggcggaguguccaugugugccauuggcugggagauccuucuuacagucagugaugccuccuaggacccacccccugcauauaccauacuccagucucugacuucaucagcagagggugacuguggugcguacagagccgcacugugccguggagcugagauggcugaucucauucccgaguuucaacagagauaguucacaagaucacuaucugggaguucugcuuagauuuauagaaagauguccuggagguggaaagguagcucaguaguuagagcacuggcugcucuucaggggaccagggcucaguuucuagcaccuacaugguggcucacuaccauccauaacuccauuuccaggggauccagugccgccuucucuccucucugggcaccaggcauggaugugguacacagacagaaauacagacagaacaccuaugcacauaaacuuguuuuuuuuuuaauuagguauuuuccucguuuacauuuccaaugcuaucccaaaagucccccauacccacccacccccaauccccuacccacccuguacuggcuaguuuugugucaacuugacacagcugggguuaucacagagaaaggagcuucaguugaggaaaugccuccaugagauccaacuguaaggcauuuucucaauuagugaucaagggggaaaggccccuugugggugggaccaucucugggcugguagucuuggguucuauaagagagcaggcugaucaagccaggggaggcaagccaguaaagaacaucccuccauggccucugcaucagcuccugcuuucugaccugcuugaguuccaguccugacuuccuuggugaugaacagcaguauggaaguguaagccgaauaaacccuuuccuccccaacuugcuucuuggucaugauguuugugcaggaauagaaacccugacuaagacacauugguaccagcagagugggguauuccugugacaaccugaccauguuuuggggaggucuguggaaggacuuuggaacuuugggcuugaagauccauccguuguuaagagcucugucggauguuuuguaggagcuuggaagauaauguugagaacagugcagaagauggaggccuggcuugugaaauuucagagggaaaauuaaagacucuuuucagggccauugcuguuuugauugugaaguuucuguaguucugguuagcuggggcugaagaaucagcugugauuaacaagauaccagaacuacuaaagcaaaaacuuugcauuacugggacuauugaugcugguuagcuggagcuaagaaauuaguggugauuaagaagagaccagcaucauugaggugacaucuucugggaaguguuuucugaaagcacaaagaggcuguguuccagagauagucaagguuguacuccugcugcagcgggacuugguaauguguaagguucacccaggagguacugguuuugaaggcaugaaggggucacgcagagcagcugaggcuuagcacugugagaggccauggaaggccauuggugaaggugcagccucaguugcaauugacgacccaggacugaaggggucaugccguguuuuggagaugccaguaccaugagaugaccaccaagagcagcagcagcaguggaguacaggcaucuggagccuagaggaugaugcaugugcuacaaagggcauggcuggagaagugacccaagcccuuggaggagcccagaagaucgugaguuggaucccagacauuggacgguuggagauugauuuuugcuuuugauugugacugugcccugauauuuucccucuugaaggaagaaacuguuuuaguggagcccacaguuaagagacuuuuaauuguaaaaagacuggauuuuaaaagagauggauauuuuaaagagauugaaaauuuaagaauauguaaagacugugggacuuuuaaaguuauauagaucuuggggaugaauaagaauguaaggguugaggcuugcuagugauguguuugugugucaaguugacaaggggucaauuguacuggcuaguuuugugucaacuugacacagcugggguuaucacagagaaaggagcuucaguugaggaaaugccuccaugagauccaacuguaaggcauuuucucaauuagugaucaagggggaaaggccccuugugggugggaccaucucugggcugguagucuuggguucuauaagagagcaggcugagcaagccaggggaggcaagccaguaaagaacaucccuccauggccucugcaucagcuccugcuuucugaccugcuuaaguuccaguccugacuuccuuggugaugaacagcaguguggaaguguaagccgaauaaacccuuuccuccccaacuugcuucuuggucaugauguuugugcaggaauagaaacccugacuaagacacacccacucccccuuuuuggcccuggcguuucccuguacuggggcauauaaagucugcaaguccaaugggccucucuuuucagugauggcugacaaggccaucuuuugauacauaugcagcuagagucaagagcuccgggguacugguuaguucauaauguuguuccacauauaggguugcagaucccuuuagauccuuggguacuuucucuaacuuguuuuuuuaaagauguacuuaagaaaauaacuuugcuucuaacaguaggcuucaaguucucuuacuucaauuuaauucagaaguuccuauuuugaucauccugaaccucuaguagaguugauaggaaaguuaaacugaaaagccuuuacacuauugacuggcuugucauuucuguuuuguucguuugugaauacaaguccuuaccccacaguagccucugcuucuuagcaauguaugcgcugcuucucucugcaaugcugaauucuuauuagcacagaauguggaagacggugcagcaaguaccaccagugagacgugugcaugggagcacacacgugugcaugggagcacacaugugugcaugggagcacacacgugugcaugggagcacacacguguaggcccagcucagcugaguccugagguucacauuuggcccugagcaaaaucaggaugauggugacggugcugaagcaguagcagugugcagauucguacagugcacuugccagcagcaugaggucuguguucauaaaacgcacaguugugugauaagggauagucacaggcaaaucacaaugcccugagcucuaaggaaaguccuucaaaguccuuacucagauguguuuaguaaaagugugcuuguuaaugaaaaagacaaaccuucacucugaagacaauguaaaugguugucuuuacauuaagguaaccuggaaugugcacuguguccucugacauuucuguguguccugcccugugugugacguugucugcaggaaggcggagucagugguuuucuccacgcuuucauugcugaaguguuugccaugguccgagcucacguggcagcgcugggcgggaaugcuguuguguccuacaucaugaagcagugugucuucauggagaaccccaguaagaaccaggugagucaacagcccgccaccgugaggaccugagggugccucuggccacccagcuccguuccuuuccacagaagcggcuuguuagggcuuugagugaggaugcuuccagcaugcuuacugacugcuucaauaaccacgcgguugucaccacucaggugcuguuacaccucacaugacccguugucaccccuaguuaagcauuucuggacuuucugcucugagcuauugaucugccaguucuuggugaacuuuugaaauauggauacaacugugucuccucucugaggagaacugagggugagaugucuaguuugaccugccccgaugguggagaacauaccacaggacagaccacuuauuuaauucuaccaaaauauuacggggaaacugacagaguuacggagaugggaggcccuguccucuaagggugcagugucucagggccuuacgcuguggaaagugcgcguuuccugagaugacucagcucugccuugcuuugugucagggaagcccugugcuccugcuucuccacaccacacuucugucuccagcauggagccugccuggcacagccauacugccaggauuuuauauaauguucacuucuguuuaguauuucgagcauagcuaaucuauauuuucccuuucuucuagaacguauuucuauuguuuuggguauuuuccuuuuauaaagaugaugcaguaaaaaguccuguccacuauucucuaggggaagggcagacucugcucugaaagacacugacagaucacccuucuccagaacaugggauuuguugcuuuagcaacauccagcuuucaccaccuuccaaucauaaggcauggccucuuauugucaccuuauaggucucugauuaagagcaggcuuaacuaucuugucauggaucacugggcuuucuggauuucuuuucuccacucuugcuagaucguuuuuaauccugugccugacuggcucugccggauucgcuuuucucccagagccguguacagcaggcaugugguccccucgccugcaugcgucugagcuucugucugcuguuuccacaggcacagugucucauaaaugucaguggggacgcggugguguuuguucgugacuccgacuuagaggucaugucaucucagcagccugcugccaacugccagcccucauguaccggagaaguuacaacuugaagacagcggcucaacuggcucaaccgagugaaauucaugugucuccauugugugucacccucuucucagcccagaggcccggcguggggugggguacugaggagcagggaugcggcuggauagcuugugugcacaucugggagaguugagaauuucugaucuugacauuuuguuuguccagucuacacagacaggccccauggauucugguaccuucaguuaugggaguuauuuguaauuuguguugauuuuuaauaaaaguauaauuaaaaaugaaauggaaagcuuaucaagagucuaggguaggaagcuccuguggcuuugaaaaccaagcaggaauccaauugcuaaugaguccauagcugauuuguaaauggaggaaacuuguguguauuuucagagaaugacugcagcuuucucagugucuucugcuugaagugaggacuuuguuagcuggaugggugauguguuuguuagcuggauggguaguguguuagaccaucuuuuaaaggaagguuuacggugugggucuguagaauugccugagugcucucaggaacuucucagagguguccgcacccaggagcggaggaugccucaggacuggcuguccucauggaggagggagggggcaccucacgacuggccguugcuucauauuuaauugucuagaagaggcuuggcuccaacaggggagagacugcuguggaauguauuuaaguagugaaaauacaguugaccuaggaagaacaggauuguuuucuaaugauauauugcacucaauaaucuuagggauuggugagguacacuguugguauagaagguggaaaggagacuugaauaugcugugaaguguugaauguauguauuaagucuuaccuaugccaaguacccacuacuaaugagauagcaaauuccuccuuugcccaauaaaauguccuuauaaaacauaggauuuuauucucucaaaacagcaaauuacccuaaagaugaaaagucauuuuaaugcuacacaggugucaauauuuuucuguauuuuguuuauaauuuuauuuuuuaaauaaaaaguuuauaaacaacacauuccua

SEQ ID NO: 3477 - RNA, 77398 nt, Mus musculus
uaagauucaaauccagaguuuaucucccaaccugacccuuuauuuggcauuuaacacauaauguauaguaucugucacuuccaugugguuaguauuucaucuuuccagggcaaucgcuucaauuccaagauaaucuuaaaacauaagacaauucuuccaacugacugugcugucuggaggaguccauggacaggaaagacagccugagguaaauacugcuacaugcugcccaaaucaggccuggcuuccgaaaggguuucagcauggagagacagaaaguacacuucuauguucauucuuagaguaaacauguacugaaaauaccuacuaugugcugggcuuugaggaugcaaagaucuagaaggcacaggaccccuagucucauagcagcgcagugagcagccaguuauaguuacguaaaaagggcagugcggacaaccagccucagacaccuugggugagauuagugcagaccgugauacgaagaagggacagucaccuuagcguggacccagggaccaacggagaaaagaaauccaggugaccgaacuuuugauuaaaaaacaaaaacaaaucaugguaggacgccugucaaucaccccagcauccagaaggcugagggagacgggaaggcugcucugagucugagaccagccggggugaacauuagggaacaccaggccagcagggcugcauggggagcccaaaucugccccaauuagaaacaaacaaacaaaaaaaaaacaaccaaaacaaaaaacaaaagaaccucaccagcaaaagaaacaaaguguccugcucugagagugcccaugagucacagggaggccgccugugacauuuccucaguagcccuuccagcacauagacaucuuauugguuugggaacccauucuccuacuaaggaucugguacagggugagggagacuacaguaagcaauugcuaccauguauauagguggcauugaacacuggcaacuuucuguggcucaaggaaaaaaaccucauuugguaacacaugaggaacgcgacuacaaugugcaagacuagauggucacagguggucccagcucgagggcaggagucgcucuucuguggcaccgucaccgauacccugagcuuugccgucaggguagcucgauuguccagucacucuccacccuuccauacugaaacaaaagcaaaaacacgugcuucagucuaaaagcgagcagcucaacaaaaccccacaggcuccaucagcugcagcaggggcucugcagcuaagagcucggacugaucuuccagaggaccuggcuucuaucagcaccuggguucaaaagucuuuaauucccgcuccagcggauucaacacccucucuguuucaugugcacauaccacccccucuauucccauagacacauaauuaaaaauaaaagcgaaucuucuaaaaaaagaaaaugaguguguuggcaccuacccguagucccagcacuugggaggugaaggcaguaaggaucgacaggcauuuaaggcuagccuggacuguaaaagacuaucucaaucaaucaauaaaaugauaauggccucaggaugaaccugcagcuuccuuuuccuacuccaugaaacaagagcccauuccucacaccccuuucccugaugccugaagcccaggcuccugcugccccgaggcaggcauggugguauuaauaauauucaucuuguuaggauaccauggaagaauuugaugcuugcugugaugugaugucugccgugucucuucaauagcucugguuugaaggcucuguccccaggguggagcuaccaaaugauagcagaacugaagcuguggccuuggcccuuagcucacuagagccauugccuuucacugcauagaaaccugccaccuaccugccagucucagagaccagaccaaugucuaaucucuaaaacugugagcuagacaaaccuuuucucguuauaaaaugacuaccucaaguauguuguuuaauaauaugaaaccuaucaaugccauauuguuuaagacauuucccgucucuuccuauauguaaauacacaaaaguaacacaugagcuguauuuaaaaaaaauuaucuuggcaucucauuccuucuuucaaugaagaaauauuacugucuguauacucuacccaagacuugugcuaaucccaagggacauaaagagaaguuuaaaacaaagcaaaacaaacaaacaaacaaacaaacaaacccaaaacccaagcauucaagcagcucuaggagggacgggugugacugaacuuuggagucuagguagcucaggagguauuuaaaagcuuuccacaggaggugugccgcacaugcucugggggaacucuggaagguucagggccagccuggucuacacagugggacccugucuuaaaaacaaauccaaugaaaagguuccuacagggauugaacacugaaggacagacagccaugaccuuauaaugcaaccacguuguaggaggcucagcagagacguggccucaugaaacaaaggugcuuuugccccgccccccacccccagagugggagcugggaguguaggguggguggaaacaggagagcaggcgacauggagagcuagugccucucccuccucauuauaaaaagaagggguggggcacaaaacaaucuuguguugggacugugcccuuugcaggagguaaagugaaggucccguaagcuagcacccagggaccaauguggauaauuagcuacaccggacaaguacuuauccuaauauucaaaaguuuauacaucugagguuucaaaaauucccccugggucauacuggcaagaacuuggguuuuaauuuuucuuuuguggguuuuuuuuuaacucuugucuuuaauuuuguggaacacuuuguagggaaacaucauguuucuguguaacacccaaagagaucaaaugucaaacaugauguaacaucagacuucuuuuuucccccucaguaauuacuaaaauuauuuuucuuggaaacaggcgagcuagucacuuggcuaacagcaccaauuugccaucuugucagaggauaauuuggagacuugaggacacaagcauaaaauaauugagggaagaagaugugguuuugauuauggacggaaggcccuguugcuuaacgcacugggggacacgggggugugugcuugugacugacuccgagucaucucugaucuccugugccugugguuacgaccuuugucuuuguucaguauggauucugaguggacggggggggggggggggggggggcucagacuugcaaaaugugugaugacugugaacuucugauccccauguccacccaccaagugcuggauuaccagcaugugccugcaaccggaaauacucuacuuccccaggccugacguuggauuuaaugucaccgucccugaagcacauaaaucaagaggggaaaguuuggguuuucucaaccgcucuaccacaugugucuguuauuuauuuuuuuccuuuuuccagugugugugugugugugugugugugugugugugugugguguuguaggcgugucuauaugugucuggacauguggacauguagauacauauauauauaugugcacgugcaugcaaaguccuaagguugacacucuucuuccuuauucacagagauagggucacucaaucaagcccagagcgcauggauaaggcugguugaacugggcagauugcuuuggggaucuccuggcuuucuuucagaaucaccagguggguugucaugucaugcagcaaucuacauaggauucuggguaccugaauucugugggugacaagcauuuaagcacucauccccuaugugcgucuuuucaauuuuaaccuuuaaaaaaaaaaaucaggucucacuauauagcccuguugaacgccaacucccgauguagaccaggcuggcuuugaacucagagaucccuugcccaucccuccaaagugcugggauuaaagguguucuccucaccaacuuucuuauaaaagaucucuauggaaagcaccucacugguguaaaacaauaaguaacuauucucuuuccuucuuuauuaguuauuaguuuuggcuuuuuaagacaggguuucauauagcccaggcuagcuuggaaguucauuugguggaggauggccucuggucuccugaacuccagauguagugagauuacaaaugugaccagcugucuggugugagaggcuggggccugaccccaaggcuuugugcccaguaagcaaggacuccaccaaaugagcucuguccccagccugagaaacucgggagagaaaagcagguggcuuauuauauagaaaaagcagguaacaaaauuguguuuaauuacaacuaucuuguuggaaaauauaaguaaacagguaaaugcuuauauaauauuggaguuauaaacauucaaaacuuagaauuaacaguaauuguaucuaagugcuagauccauggguaaguuuaauuccucuuucuuucuuccccccucccccagcucugguuauugagacaugaccugacauuaccacaugguagguuaagacagcaccacuauauuccaacccugucuccuauuuuuaauauauuuuccauuuuuacaauaacauguuauacucuuaaaucagaauuuuaaaguauugaaacacauuuauucuggaaugcuagcugacaccacaucccucaugaguacuccacuuccacaccccccaccccccaccccaccccccacccccuccccgccuucucucuuucaucuccggucuuacucaacucugcuuauucugucaggaauaucuuccuuaaguuuaaauuacucgcccugaaucacaccacuucaucucuuuccuuugugguucuacuauguggaggacauaaugcuuuagcacuaaacuugggcuaucucacugaccacagccugagcccuagagggauuuuuuuuuuaauauuuuuuucuuuuacguaucugaguauuuugccugcauguaugaaugugcaccauccauguggaaugccagaggcacacaaaagaguguaccagaacuccuggagccagagcugugaacugauugauaugggugugcugagacaugaaaugaacacagguccgcuacaagagcagcaaacgcucuuauccccugagccaucucaucuccccagcuggcccccaaccccagguggugaagauggcuaccuggauaucagucagcuuucccaggauucgacuugcaagcuuggggccauucuccaucguuggaauaugcagcaucugaggaaggaaggagaaaggagucugagggggagaggcgcgcauggugggaccaggaagaccggagucugagggggagaggcgcgcauggugggaacaggaagaccggagucugagggggagaggcgcgcauggugagaacaggaacacuggagucugagggggagaggcgcgcauggugggaacaggaagaccggagucugagggggagaggcaugcauggugggaacaggaagaccauuccuacaacaggaaggcaaucccaccagaccaagggaggcaccugacauacugccaacacaugcuaccucccuaaccugagcuuuuucuuuuuccauuuuuuuauuagauauuuucuucauuuauauuucaaaugcuaucccaaaaguccccuauaccccccccccgcucugcuccccuacccacccacucccgcuuccuggcccuggcauuccccuguacuggggcauaugaucuucccaagaccaagggccucuccucccauugauggcaaacuaggccauccucugcuacauaugcaacuagagacacaguucugcgggguacugguuaguucauauuguugauucuccuacuugaauaaaaaagucaauuaaugacaacauauucauuuccuaccaacucaacugaaagcacaaaagguuuggaaaucauucuucagggugguuuaaggaauucagaauagggcuggugagauggcucaguggguaagagcacugacugcucuuccgaaggucuuugaguucaaaucccagcaaccacaugguggcucacaaccaucuguaaugagaucugacccaccucuucuggugcugucugaagacagcuacaguguacuuaucuauaacaaaaaauaaaucuuugggacagggugagcgggguugacuagagcaagcagaggcccuaaaagucaauucccaacagccagaugaaggcucacaaucuguacagugugugcacauagacauaaaguaaauaaauaaaucuuuaaaaaaaaaaaaaaggaauucagacuagaaggggucccugaaacaguagacuaacucaacccaggagucuaagaauccacaggauggauaauugcccccuacugaacacgcuggcaaggaaccagaccucaaagauauuucucaacaaacaaaagcaagacauuucaaagagaugaauuaaagcaaggcucuucuuuuacauaaggaguuucugaaccuacaucuggggcagggcgcaccuccaugggccacaacucccaugggaaggcaggguuaaauuccuagcugaaagagaucucaugcccuuggcuuauaucugagccaugcccguucaugccuugcuggcgggcuggcuuuugaugcuuugauaguuaguagauagcucauauucucaaacacucuucuuauuaugccuuuuaguauaauacgauaauuaggaacccuuugggcucugaaugccucccuggagcauuuaggagaagcauuaaagauaaguuaaccuuuguaaacuuuuuauuucuagaguggaggaacaauuggauuuuaguuacuaaaauggacaaauaacauaccuagacauuaucguaaaauacucagacugggcccuuacaauccuuucuuccucucuuugcuucucucugucccucccugguaugcaugccuccuccuccuccuccuccucccucauccccaucucucugccauaucaacauaaaaccagguaguuuccccacugagaaauaucugcaugucaaacuacaucaccaaccagcccugaaaagcaaauucuaaaguguuaagcaaaacauaauaacaaauaauaauaauaauaauuaauagcaaugauaaugaauaguaauaaugaucagacuagucagcugagauuauaagguucgauucaggaaucaggggacuuuguaucuaacaagccaucagaaguaguuagucuuguaggaacaacaccuacgcaguuacaggcugccugcauggccacagcauagcagcuacacacuuauggaaacccuggaaagcaauuccuauauauauauauauauauauccuuacacuauaaagacagaggcugacagaugugcacgaggaaaagcccucgaacugucaaaauaauacacacacgacacaagcaaaagugaauuaauggggcuggagagacggcucggugguuaagggcacuggcugcuccuccagggacccagguuugauucccagcacccacaugguugucuguaacugcaguguuagggccuccacagacacugcacacacacggugcacagacagacgugcagacaaaauacccauacacaugaaauaaaagcaaauaaaucuguucuuuaaaaaaaucagacaaauguagcaagaagauaauaggacaucagagggcaucauuugaaaugucugugcaggggcuggagagauggcucagugguuaagagcaccgacuaaucuuccagagguccugaguucaaaucccagcaaccacaugguggcucacaaccaucuguaaugagaucugaugcccucuucuggugugucugaagacagcuacaguguacucacauacauaaaauaaauuauuaaauauuaaaaaagggaaaguguugaaaugucugugcaguguucuacugaacccugacaacagcaauggcaucugaugaaauuucaccucgcaugcauucaguggccgcuccacuccuaauuccuacugcagcgggcuggcagaaccaggggacagucugaccaaguuaggcucacacauuuuccaaggucagggcugacuugaucucaugguugaguucucaugaaaccaccaggaaggugaaauguuugagccaacccaggaccaugcucuccaauuucccucacguuaugacuucauucaauuacagguaaauguuuauaucuuuaaaauuccauucacucauuuacucgcuuauuguguguguguguguguguguguguguaggaggagggugcagacaagugcaggagaggaggucagagguaagcuuugcaagucacuuucuuuccuuccacuaagugggucccagggaccaaaucuuaaguucucagccuggaugauaaacgucuccaucacugcgccaucaccagcccugggcaaagggcuaggaaugaugagcacauaaaacuacuucucuuaccuggcccuuguacagaauaucagagacugggcagacaacgcaggcugucccugagccgaacaucuccuucacucuguuccccucaagggcgguggccaggucauccauggugaggugucucucacauaccuuaaacucacccuguuuggaauguuagaaagaggaggaggaggaggagaaggaagaggcgaaggaggagggggaagaggagggagaagaggacggggaggaggaaggggaggagguagugguggaagaaaaaagagaaaaagaaaaaaaaagucacugugugucuuuggaucuggcugaacuuggauggugucauaaugguccccugcagggagcaggaaagggcccacugugcgauuaccuuaacaaguugagugggaaagggcacacuguguguuugcccaacacucugagcaacccacuuccaaaucacagcuuucaaaggaacuugucuagauauucaucauggagucaugacgcacagucaugacuuuagggcgugcacauugucauggauuucacaagcagcugacucuaagaaccacuucacgcacuuaacacauuuucugugucuuccaugauagaggagaacaagcgacugcaucagacguugguaugagaauggccguugacuuuguacccaccaugggccgaggucucuaaugcugaagacguccucuuuacauuacaggugaggaugcuugggcuccagauggggaggggcuuucccagggccaaacaauccucaccugauugccuucaaaauuaguaaaaaaucauaaccugagcucugagagcugaagucaucgcucuuuguuaggagccaauguuuugaauuuguaugagcaacuacagugagagcuguugugauuuuguuuaaaguuaaauaaauuauuaaacaagcauguuucagaaaaucaucaaaccuuacugagaacuguugaggucugcguucuggagagaagcaacagaaaaauaacccucuugcacaucaacagagcagggcucgucuguggauuagcucccugugcggcaagcugugaccccggugccucuuggcauuuucaacaaagcuuuaaaguaagcugcagauaaggagacaaggaaagccagaauauccuccagaauaaccuaucuuccaggcucaagagccagaggugugaaacuggcucuuacuggccugguccggcaaccuucugugcucgguugauuuacucucuuaauaaaacagaaauuacugaacgucaggaagcuaucuuuccaacugcaaacauauuugggacagggcaagcuguugaaauuaaaccagcagcuugcaaaggccgugcccacugugugccagccaacaggcagcacugggguuuuguccacucuggacuuaguaggauuauuuagcuuacagccucuguuugcagucuuuuccagagaaacugugguccacuccaaaauuauguguguguccaaacauuuguguaugaggacugucugaccacaguguccugaaaaccuuuucauggucuauggggacuuuuggaacacaugaaucauuagugccagccaagaaccccugccagccagccaaucuacuccacauccgccuuacaaacgcuaugucacuucaaauaacaaacuccaaccuugguuccauggaugugaacauccacagaaaacaacuuuauauuuucuuugaguguuuuugauuuuaaaauaaacauguguggaaaucugagacaaugggaaugggguagugggggaagaaaaaaaaucaggaccaaauuaauauuacguugauauuaauauaucaauaaaaaucuguagcuccuauaauacuggaauacauuacaggauaggauaugucaucaacacaacauggaauagcuugcaguuaagacgggguggaaacauccagucugaccaagcuggcuuagaaggcacccugcacacggacuggggcuaguauugaagcccuccucaguaagacaccuucuccagcugguucccugcuuaaaaaggucugccaacacagaccuucucaggagaucuucgcucgaggugagauuuaaagauuagauaacacaggugggaacuaugggguaugcuaucauugcaaagcaaagcucauuuggauugugugugaaugugugugugugugugugugucuguaugagugugcaugugugaguaugucuguguaugucugugugugugucuguguauguguguaugucuguguguguguaugugugugcacgucuguguauguguauguguguguaugacuguaugucuguguauguuuguguguguauauauauacgucugugugucuguauguacaucuguguguguguaugucuguguacaucuguguguacaucugugugugugugucuguugggcucauggauguuguucaggcacucacccacuguugugccagcuccaggaugcucugccuggucacuccugggagaaugaugccaucuagugggggcguugccagcuccucuucugucaauuagaaacagggaugcuugcaagauuuccaucauuaacaacauaccgcagcagugacaauucuuaaagccacuuucauaugagaacagaagagacagcucagaggaugccaacagcugcugcuacucagaccagagcucuguucucauacccacauaaggaggcucacaaccaccugacucugccccgaggcauuuccacguccucccuucuggacuccauggucccugcauucgugugcacauuccuacacacacacacacacacacacacacagagagagagagagagagagagagagaaagagagagagagaauacaacaaauuuucuuagauaagcagaaacagaugacaguggguaagggcacuggcuccugagucugaccaccugaauucaauccucugggaucccacagcaggagaaaacaccaaccaggcccucacaacuguguauaacucuaauuccaagcauucuagcgcccucuacuggcugccaaggguaucuauauagagagcauuaacacaugcuaaagacaacacacacacacacacacacaaauaaaacauuauaaauaaauaaauaaauaaguuaaaagugaacucuauucucaguacugagaauuaagaaauacucuucaagaugagcagucaugucaaaauuauucccaaaguagauaaaaauuaauugguaccuauaacaacacgcauaaaaucuugcucaggacccaagggaguaccaagcguuuguuucugcgagaagcccauuaccucagaguuggguagccugagccagagagaugacuggaggcaagcaagagcuugucagggaccugaguucagaucccagcacccacauaagagcuggaugggggggcucacacuggugcuacagaaacaaggagacacugccuggccaacuaguuuagccaaaccaguagcccugggcucagugaaagaaaggccuugugucucagcacauaagguggaaagaagcaagagaagacccuaccucaguccucugggcucuacagcaguacacccccacaggagcacacacaagagcagacacccucccuuucucauuccucugagcuccacagcaguacaacacacacacacacacacacacacacacacacacacacgaguucuugcuccuggugcugccugcacacugccuucagaagcccacaucaucugugggucgagcuacacuggugcugcaugaaugggggcgauccggaguuucccacagagaucugaaggcagugggcucaggggaagcuucgugucuucaaaagaagaaaagagaaaaaaugcaaacaccgucucaagagaugaacugccacucugacuacacgggagacccccaagugaacgcuccaccaugaaagccaggcgcagcgcuccagcuguaagcucuggguaacccucccccuuucaagucacucugguggacucagggaauacaucaguagguagacugcuuucagaguaugugugaagcccuggguuugauccccucaucacaugaauuggaugugggugacuuacagaugcaaucccagcacuagggaauugaaggcagaauugggaauucaaggucguccuuagaucagauuugagacuagucugggcuguucuaucuuuaaaaagucauccuugguagucaacuccccccuuccuucucacuacuggcaucuagcaauguggaccaacaagccuuaaauaucaccuuacaaagaugcugaaccuuauagcagacaaccuguccaugaccuacucccugagugcagaggaugucacaaauaugcuuagagaagcaccagcuagaagcacuagaggaauugcccugcuauugcagggcucacgcugcccuguugcuuuggggcucccccagggccuugaauauagauaggaacuuuagaacuaacccagaccaauccuuaucuuaccagagaaacaaauguauguuugcccagaccugugagagaacgcucggaucccacagcaguguuccagcccugggacuacagcucucugucucaggaugcaagcgcaucuauuccccuagugcuucucucugucucaggacgggguggagcuagaaucucuccugcucucugaugguuuccaucuuuguaugccccaguuucugcacgaugucuggccuagggagguauaugggaaugugugguacaugcagguagugcccuugaacagaaaagggucagaucuguaagugcugggaacugaaccuggauccuuuggaagagcagcuacugcuccuaaucacggauuguggagccauuuccccagccuccauaauaaguauuuuuuaauuuuaaaauaugaaugaaugaauucucuuugcugggcugcagcagggaccauuuauuuucugaaaaucacuuuuuagaaagaagagauugguacuggcgauguucccaaggguacuugucauuuguuaaguguuuauggucuuaaaauaaauguguuugggauaacucguuagcuagacagagaaaugcaugggugugugugugugugugugugugugugugcaguuuucacacagagagagaccuuucuuacaguuagcguagcucuccgacaacaccgaguuaaacccaaacagcaguguucacacacgcaaaggcuguucuauggaaugaauuuagccuccugcuguaaccgccagccugaggucaagaaauagaacaucuguccccugguccccagacagagcagaugacaugggacaucuguccccugguucccagacagagccggcuacaugauagcauuugggugagaaguauucguuuuccucugcaaccacaacacacucccaggagccagagcgaguuccagaacacccaggaggaaacagagccccacagacauggcuugugacucugcaaauguugcaguugguugcuguccugcauucugugggauccaucuucauccuccaaggaggagaaucgaaggagguuucucuguuacaugguguuagauuaucaaugagacagagaagauggguaaagagacaggaaccguuuguuuauuaauugugugugugugugugugugugugugugugugugugugugugugugugugugugugugagagagagagagagagagagagagacuuuaugcccaaguacgcaagugccuguggaucucccggagcugcaguuacaggcagcugugagccaugagcugccagguauaggugcuaggaacugaaguuuucauccugacccauccucuccaaccccccuucgccugcuaaacaccccaacugaagaaacacauugaaacuaaaacuggcuugggcaaaaguuauaaaaucuaacucuuaguaaggccucauauauuuugcaagaggcagaaaacaaacccacuuauccccacugcgaccugccauguaagcgugucccgugacuugugucuggauaagggacaauuauuugagcaggacagugucugguuaacuuguauggcuaugacguagauaguggcuaaguccuugacaccucccauaaauaaugacuuugccuuuucugaaugaugucccuauuuguaucuguggugcugguagguggggaccaggacaggagugacuagagaggaagaugucuccugaacacagaagucagcacuggccaucuucucucuaccaucacuuccaauguauguuuaugugaaguucuaguuugaaaucccccaaauuccagcauaaauuugguucucuuacauuuccaaguacagcagacuuugaagaaggugccuggugcaucucccagaaucgcaugcccagggccagaggaacacaagcagaagugcucagaucaaguucagggcaggcuguucacucucccucagauggaauauaaggcaggccuguacucagaucagcacgcagggcugcaugcaaccuuggcugaaucacuucuucccaccucgacagcaaaaugaagcugguguggagggggcuaccgcaaagcaaugaguucuuuaauggucaccgaaggcaagacugggaacuuguacauggaaguauuaucuuaccgugugcgugcgugugugugugugugugugugugugugugugugugagagagagagagagagagagagagagagagagagagagagagcauauguacauguguaugagcauuuguucauucaagcaugugugcacauguacaagggagugugugcacacacgugugugugcauacaugcagaaccagaggacaacauugagugccuuccucuagcucucuccauguuauuuuugaguuagccucgcucacugaaccugcagcucacccugucugggaggccgaugggucagugagcucccagggucugccugucuccacuuccuaaugcugguguuagaaauguaaacagccagccacaccccugaagucguugcacauucucggugucuauaauuaccaugaaauaaauaaucuacaaucauaagcaggucuaaaacuguguuccuaaguucugcacaccuauugaaaugcuaacagucgacacaggucugcucuguucccugcuuuauggcauuucacucgaugcuacauaaacugucaacacuuccccugaacucuuaucaaagcaggcacugagcauccaggaugcuaaagauagccacauauaguggcacauguuuauaauuauagcaucccacaaccucauuccaaaggaggauuucuguaagcuaccaagugguacccugucuuaaaaaacaaaaaaacaaaaaaaaaaaaaaacaaaaacaaaaaacaaaaacaaaaaaacccaaaaaacaaaacacucaagccagguaugauacaaucccauauauucuugccauacagaauggaggaucuaacauuucaaagccagcccuugugguauaaugacuucaagguuauccugggcuauacacugugugugcgugcaugggugcaguaccccuggaguccagaagagggcuggauccccugaaauuagagucacagacaguugugagccacagugugguugcucagaacagaacucagguccucugcaagagcagccagggcuuuuacaugcugagccauauguacagcagcucaguuugaaaucagucucaagcuuuucaagccaaacagcagaaacaagaauaaaaaccaacccugaugcggucuccacagcagccacuauaguccccagccccgcacugcccucgauguccccgcccccugcgcucuugacagcaucagcugucaagacaccagaagagcaauuaccuccgucuucguuuauccaguagaggaaaagauucauugugccuacuucaguuaucugguuguccuugccguacagccacaggaccugcugacagccauucuccacggccucgcacugugccagaagggaggcuccauaauugcuagggggagagagagagagacagagagagagagagagaggaagagagaggaagagagaggaagagagagacagagagagagacagagagagagagagagagagagagagagagagagagagagaguuagcguuuaagacuugaagguggccaagauggcucacuuccuucgaaggccuacugaccuuacaucuucagaucccacaggguggcaagaguuaacccacuuccacgauuuauccucugaucuccauacaugcacuguggacacaccaacggggggaagggaggaccaauuguuccagacacugggacaggaggcgcaugucuaccugagucuuucucuuucucugccaacccccaagauuacuauaauccacuuauaaauuuggaaaauuaguggucuuauaauuuggcuaaggaauacuugacauugucuugccugggaaaaccauaggcuauacccuggguugaggcuccaacaaacugacugaucuccuccaaaacacuucccuuuaaaaaaaaaacuucuucccugggccggaaaagagcucagucagugaaggagccuacugccaagacuagugaccugggcuugaucccagggcccacgcagugggaggagagaacugagucccaugaggugucuucugacccaccaugcaugcccuggcacauacauuaacacgcgacacacaaaugacuuaaguaccuguaggacagacaaacauggauguuaaaagacaaaugcugcccuggcagagggaggaggggaaacaggauuugagaacuaaccugaaacucaggccagguaugagccaaguggucaacuacucaggcuaacacaucuccacucacucucagaaugcuacaaggaaugagccuagugaucaacuaacuacucaggcuaauacaucucuacccacucucagcaugcuuggccucuaaucguugggaaaggcaaagccucacugagaagucugccaaccucgggcuuauuuaguuaaauacucuacauuuuguuuucuuuguucucucucguucucucucucucucucucucucucucucucucucucucucucucgcucacucgcucgcucgcucgcucgcucgcucgcucgcuguuuaguggcuucaaaugcgaguccaaagugaccugguuuucuauuucccaugacuggagaccaugcccacacaugacuggagaccacgcccacacaugacuggagaccacgcccacacaugacgucagcgcaggaaauggucaggcgaugcagucacacuuuuagcuuccaagcaccuuuugggaaccuuaaagccauugcagaauauucucucccucagugauguccacacccuuaggcucagaaccugugacugugucaagucacuuaugucaagacacccugcagguggcauuaaugucuucauguaacugcgaugucaccaugauagcccagggacagccuuggacugagggagaccacauuuccccacaggaagguuugggagcaacuugcaaugggaaagagugaccaacuuugaaacugauacaggugccaugaaaccugguuguuggcaugggcagagaaggggacaagacgugaaggacuauacaaauaauggaggggcuggaggacugaagaggggcacuucaauauucucucccaugaggagacauuuauacuccacauuaggaguccaagcauacauauuaacagcuucacgcaugcacacugcucagaguuuguucuggguuaaccucccugccaucucccuggucuacaccauucacacuucacaggguuuaauuccaaauauuagagaaugcagucagagauggcaagaaacaauaacaagagaggugcagaagcuggagagacaucuccgugcuuaagagcacuugauucucuugcaaaggaccccaguucaguuccuagcacucacauggcaaccccugacuaccuaaaaguacucgucuggccuccaaggguaccaggaaagagcaugguucgcagacuugcaugcaagcagagcacuugcuuugaaggcuggcuuguguuaacuccaccccucccugugaagcuugcuggaugcagacaaggugugaggugagauaauauuaaguuguuauucuacuaucuucuuagaucacgggcucugugaauaaggcaggccuaaagcucacucagucccugccuugcucacucagucccugccuugcucacuggcaacaugaacaguaacacaaauaugcacucuccgugugugugugugugugugugugugugugugugugugugugugugucaugugcaugugccuauaaaggccaugagagagccucagaucccagggagcaggaguuacagguuguugccagccugcugacacgggggcagagagcuuaacuuaggaucucuagaagagcagcaagugcuggugacugcuaagcugggaggcuagaauuaauucuguagcaaauaccgcucaggugagacgcaacaguguugcauacacaaagacagaggaagcugaccugaggcgcccaagcuacaguuuucuagagaagcuggucaucuauaaaugcucuguaggggguggggagcacauggggcuugugggauaccuuucgcaucuugcugccaucagcccucauaucagaggccuaucccugggcaaugacuuuccuaaaccucucagaacaucacugaaagucacuuuccaggagcaucucuguaugucaccaguugauucagaccagggacgaguccgugauacuugcuccuucuguuguauccaccgagggacauucugaauucagagccaagucaacgcugaaacuggccagcacaucucaaacccucuuuuguuuccugccagcuacagauggccggugaggcuggccaggcagagccaaagcagggcuuuccucugccccuucacagcaggugagccugccaucuguggcuaagcagacagugaaauagucaccuuuccagacaggguucccuggagccaagugaaagcaucauccccagggccagucucuagcuggaaaggacccugguucaagucacugcuccaugcccauguguggagagccgugccgcgagcaaucgccauuauaagauggcgcuggccuccgcugugccuaacuaguaaacaagccuuguacgcaggugcaagagugaacucacgccuagucacucccauucucggaguguaauaguggggugaugggcgagcaacgaaucaggagccgucacgccauaucggggugcugaaacgucacacugcggguuauaaaggcggcgccauuuucccgguucaaggucuuccugaagaaguaagcaauaaagcuuuugccacggaagauuccaguuuguugcgucuuucuugccggucgagugggacacaauacccaugccacacugcugccuuagaggggccacaagcaacaccuccaacaacuaacacguuuacaaagcuaaaucuuaaaccacagacagcuacucgcuugugaacucuaccaagcacaccgccauugaaagcgcacaacugucacuauacaggaaggacacagggaccgacuuacccgcccaucuugcagucuccagucccaccuuuccaggcucugauguacuuuggauuggcccacagggacaccggaguaaaagauccacuagaaaaauaaggucccacggggcucaggaucacaaagaguagggcuuuggaaggcuucuugacgccaagagauggcuguaauaaagagagaaaccaugccucuguaaccaacagugagacauccuucuuaagagucuaaaauagaccuguguccacaucccagaaggucacccaaacaaagcuuagugacacaaagcuuuuuaaagaauauacugagaaugcguauuuaaauuugggugugggggauaaaaggaugggacacagaugccucaguggauaaaugcuuguuugcugccacaccugaaaagcugacuaccugagucuggucccugagccucgcgugguggaaagaagagagccaaccacuacaagcugaccugagaccuccacagacaugcuacggcaugcacggucaacacaacauaaacaaaucauuguaauuuaaaagaacuuuaaguuccguuuugguuugcuuucugaguuaugauuucagagggagaaacacagcugucaguugcaguugcugaaacugcucacaggaagagugaagagccugccuccuagaacauaacccacccccuucaagucuuugugaagccugcugggcacuccagaaaaggugaggcccaugagcagaggugggcauggggaagccagcugugauggugccugccucugcagcacauaauagacaacagaaggcaggcagagacagcagaagucccaucaaaaggagaugagagaacuuagacuucacaucauggacaacagggaacuggaaaggugguucaguuacuagcacuggcugcucuuguaggggacccggguucaguucacagcaccuacauggaggcucacagcuguucauaaauccacuuccaggggauccagugcccucuccuggccucuaugcugugcgugcgugugugcacacauacaagcaggcaaaacggccaugugcauaaaauaaagauaaaucuuuggcaaauggauacaagacagaagacagccuuuuccacaaauacaggaagacuauaaauuucucuagcacaaggaaaagucgugaagugagggcaguggauuaucagaaacuccaagucccagaggccgugugucaugaagacauacaggucaguuccauucagcuauacuauguaagacggcaagaacaaaccaacaagccaggaucccccaggauggaugcugaccacugcaguguucuguaccugugacacagaggcuggcagccgcucagugacaaugaagagggcccugacucuagcuggcugcacacuuuaugcucucugccuaacaagcugaugcugacagacucugcagcugccuuuugcuugagucuccaccacaccugccucuagcacgcacugccugcccucaggcccucuccauuagacccaggugguaaauagcugaagcccaggaagcaguugugggccagugaaccggcuuguuugccacauaugcuugacugccugaguugaauccccagaacaugggaaggagccagauguggcaggauguggcacgugugagcccagcacuccuauagagaggccggaagaagacagagcagccagcagcuggugggcaagcuagccuggagcucaugacauggcagauagauacugccucauagaggugagaugagaaaacaacuucugaaagcugcccuccgacaugcacacuguacuacugugccaugacacaugugcgugaggcacacacacauacacacaccaacacacauguucacacacauacaugcacacacucacacacauagacacacaagcacacaugcucacaaacacacacacacucacacacauauaacacauucacacucacacauacacauacucacaaauacacauauaugcacauauacacacacauucaugcucacauauacacacucacucagauacauacacacaccacauacacccacacacacacauacauugacacucacacacaugcacaaacauacacauacagcacauacacacacacacugucuguggguaaggacaucaccugaaagccccccaccucccucuaucaggaggaccaagcaggacucugagccccuagaauaaacugaugguaaacuacaugacugagucagagagaccggucugagagcaguggggcuaguuugaauaugguugguugguugguuuuuguuuugagacagucucucuacauaauccuggcugucauggaacucacucuauagcccaggcuggccuccaacacagagaucccccugccucugccucccagaugcugagauuaaagguguuuguucuucaauaggaacuuaucuucucccccugcaggaugaagagcuugggaacucuaugucuucucaucugggagggagacugugcacagauccacaccuguuucgucccagcucugggggaaccaucuugucucugagaguuucuucaauggugagacugugugggcaaggugucagacaggagauaacugaggaagucgcuguugcagcgucuucugugucucuggugcucugagcaccucucugaggccuugaagcugcaguuaggauauuucugcugugucagaagcaaaggcagccagagaaagggggcacacuuuccuaguugccacacacaaacaccagugagggugugagggcgcaaagacccccggcuccccgucaaacacucccauuguagcugucagucucucuucccuuuugggcuuuucuagaagcugggaggaagacaaacccuaaaaagggaaaccugauccacaauaacccagggggaaaggagucacuuuauccaauaaauaugccaccugccuuauaaauaaccauaaagacaacuuuuaaaaauagcacaacuugucaggaaaaggaaagggguuaaugggaggagagugguccaaauauguuauaaacguguaugaaaugucaggagaccccuuagguauaauuagcauagacuacugcaauguaaaguuucaaaauccacaacccagaacucagugggccgcuccucauuaugggccauacugcuccaggcucucuuugaaaugcacauucugcuuugcuagauaaacugccucugaagucuuucuuuugagaagaacccggaggacuuucacugguagcagcaccucacaucuagagggucucacccggcugccguuugcucgagguuaaggaugugauuugccggcuuccugccugccaucugucauuccuccccugccauugugagcuaacccucuguaaucaccaacccaaguaaaccccucccucugcaagcugccuuguucacaguaggaucacaacaggagacuaaccaacucaaaugauaaggaauccagagaggccacucagauaugauaugcuagcuguuaucugaaggccacaucuagcuucuaaauuucugaaugaauugucugucuuauguacaaccuaauaguacuuuguccccuaccucaugaaugcuggugcacacacaccaaguauuuuauacaauugcauuauacaaaaaaaaaaaaaaaaagaaagaaagaaagaaagaaagaaaagaagagaagagaagagaagagaagagaagagaagagaagagaagagaaaagaaaagaaaagaaaagaaaagaaaagaaaagaaaagaaaagaaaagaaaagaaaguaacaguagcuacagaguaauaauuuuuuuucucuguacuaaauuucaccucguucgggcugggacguuaggaucugugagggcacacaguauagaagcaaaggggaauuccucugugugcgugugcuuuccugaccuugguaaguuaguuugcauuuaguccacuagggggcagcagcgagcacagauggaaagacgcagaauuagacacagccaccaaaucucccgcugacaaagcaucuugaugagucgcuucauucauauccauauccuuagcaacagcuaaguuauacaauaaauagcauuuguuaaugcuggccaaagcugugcguaggaauguauuuucuaaaauuuaauccagguccacucaugauugcaagcccgaaguuccucuguggaccauagauggcuuaggaaccuuccauagcuuacauccauugucucuccaugaaaagaauucauugagggcuggagcaccggcucagcucuucuugcagaggacccagguucaguuuccagcaaccacguggaaucucaguaacuucaauuccagggaucugaugcccucuucuggccucaaaugggcacugcacccaugugcacagauaggacacucauagauguaaaauaaaaaucaaaucuucaaagaacucacugccguuccuuggagagcaaguggggagaaagucuccaugccacuucaauacugagugagucaaaauucagucuaggcgucaagaaagauuuagugacaagcauugucccucuaccacaaacaaacacacacacacacacacacacacacacacauacacucaggaucccugacuuagccccuugcuccaaucuccucuucuacccugaaaagcaauuuacauauccugugcuccuauuaagugaauuuuauuauguaaugccaaccgaaugacagacaagguuaugggaugauaaaguugugcuucuuauuaacuaaaagaaaagccacauaacuaaauagggaauaaggaugucagcggccgguggacacugcaaauggccugugccaagucuguuugucucaggaacauuucagcguggugguuuuguuuuagcuuugggagacggggcuaagcuucacaauaaccagacccauuaguccucugcacagacaaauggcgcuuggguguggugagaaacaaaggcuacuucuuucugggucacccagaaaucccuucacagaaggggggaugucacgaguuauuugaaggguggcagaaaggagucagugaacugagaaauuccauuagucuacaguguggccucagaggcagggagcagggcagccugcaagugggaggacaguucugaccgaagccaacaaagcaaauaauaagguggcuggauccagaggaagacaaccagcucgcuugcuuucagagacuucuguuuuaaaagcuuucagaguuaaaugagaaaauggaaccaugucucuugccuaucaucucagcacuugggaggcugaggcaggaggauugggggucaaggccaauuuagcugccuaagauuugggggcugaauaagucuagaagaggaggaggaggagaagaaggaagaagaagaggaggaggaggaggaacagcagcaacaacuuagagcuggagagaugcuuaggugggcuaugggugccugcugguucuaaaggacccaauaucaguuccagcacccaagugagauaugccuuacagaagcuguaauuccaguucccagggauucaaaacccucuccugacauccucagccauaaggcagacaaagcacucacauacauguaauaauaauagaaauaaucaauacaguaaguacccaagaccuucccugaaggcacuugcugcugccugagcuccauccccgaucagcacagcaugacuugucauucaauucuccucccucuccaccuuccagguccucuccugcccuccccaccucuauuaccuccucugaaguccccguugaagcccugacucccugcauuaaugacuuuucucacugcuauaaggaaggaaucgcauaggaaaugugggugucuggucucuguguccacggucagagagcagggagagggauguuugcugaugcucaacaccguuucccuuuuguucagucagggacccaagcccgugagucaguaccacaacauucaggacaggucuucucuacucaguuaaaccucucugcuaacacccucauagacucacucagaggaauggcugcuaggggaucgcaaauccagucaggcagagaguaagaucacagcucugguaugacuguccaaagccauaggggcuuuuagguuggugcaucaugggaggucacaaggguaaagccauccugccagacuuggguccuuauauagagaaaaauuuacagaaacucucccuucugggcagacaagggccagggaggaccaccuggaaggaagguaccaccugaagccagccacaaucaggcauggaugcccaggcuccaaaacacugcaaaaauaacugcaguuugagcugcucagucuguaagagaaggacaugacaacucuuggucuccagaugguagagaugucuggaaaggagauggaaccuuuagaagaugcaacccgugcuagaggaggcaagucagacuaggcagcagggcugugggcuuugaggguuuauaaucugaccccaguucucucucucccuugugccaauggaaaugugaucuaccaacuuucugcccaaugccacacccucccuaggugaugagccccauccuccaggaccucacauaagcuaaaguaaacucuuucuuccccaagcugcuuuugcucacgguauuuaaucauagcaacugaaaaauaauuaacucacuguggcacuguaacaaagcagccagucacacuaagacucaucccgguagcauccaacauugaagcccaucuuacacauccuuuagaugucacuucaggagcaagugcccccaaccugagugaggugcugugguaugugguucucgagcauccagcuugucaaaggcggacuaauagacaucuuaaaucuacucauuucuuucuguuuugauaaccagugugucuccauaaagcagaaccauuuuuaucaugcguguuuugucuacauguauguaaguguauugugugugugugccuggucccugcagaggccagaagaagacuuuagauccccuguaacuagagugaaggauaguugugagccaccgugugagugcuagaaacugaacucaggucucugcaagagcagccaguauucuuagccacuagccaucucuccagcaccauuauuccugauuuuuaucaaauauuuguagaaaaacaaccaaaccuuaguaagacauuccuuguagaaaauggguauagugcuccaauccaaucucgcaggaccugagacugcauuaauuagggaagcagaaaaccuggccugaucagggucacaagucccuucuggucugcaccagcuccggggcaccuugggcucggagucugcagacacccccaagguccccacaggacucuucacgggaucuuaggaccucuggugaguggaucacaaccucugccaggagucagguuugaacaccagauaucugggcaccuucccugcaagaggagagcuugccugcagagaauacucuaaacacugaaacucaggagagagcuagucucccaggucugcugauagaggcuaacauaaucaccugaggaacaagcucuaaccagaggcaacuaaaacaacuaacuccagagauuaccagauggcgaaaggcaucuuacuaacagaaaccaagaccacucacuaucaucagaacgcagcacucccaccccacccaguccuaggcaccccaacacaccugaaaagauagucccggauuuaaaagcauaucucaugaugaugguagaggacaucaagaaggacuuuaauaacucacuuaaagaaauacaggagaacacugcuaaacagguagaagaccuuaaagaggaagcacaaaaauccuuuaaagaauugcaagaaaacacaaccaaacagaugauggaauugaauaaaaucauccaagaccuaaaaagggaaguagacacaauaaagaaaacccaaagugaggcaacgcuggagauagaaacccuaggaaagaaaucuggaaucauagaugcgagcaucagcaacagaauacaagagauggaagaaagaaucucagaugcagaauauuccauagagaacaucggcacaacaaucaaagaaaaugcaaaaugcaaaaagauccuaauucaaaacauccaggaaauccaggacucaaugagaagaccaaaccuacggauaauaggaguagaugagaaugaagauuuuucaacuuaaagggccagcaaauaucuucaacaaaacuauagaagaaaacuucccaaaccuaaagaaaggcaugcccaugagcauacaaggcuacagaauuccaaauagacugaaccagaaaagacauuccucccgacaaauaauaaucagaacaacaaaugcacuaaauaaagagagaauauuaaaagcaguaagggaaaaaggucaaguaacauauaaaggcaggccuaucagaauuacaucagacuuuucaacagagacuaugaaagccaaaagacccuggacagguguuauacagaagaugucccaacaguuaagaaggacacaugcuccacuauguucauagcagccuuauuuauaauagccagaagcuggaaagaacccagaugccccucaacagaggaauggauacagaaaaugugguacauuuacacaauggaguacuacucagcuauuaaaaagaaugaauuugugaaauuccuaggcaaaugguuggaccuggagggcaucauccugagugaggcaacccaaucacaaaagaacucaaaugauauguacucacugguauguggauauuagcccagaaacuuagaauacccaagauauaagauacaauuugcaaaacacaugaaacucaagaagaaugaagaccaaaguguggacacuuugccccuucuuugaauugggaacaaaacacccauggaaggaguuacagagacaaaguuuggagcugagacaaaaggauggaccauguagagacugccauauccagggauccaucccauagucagccuccaaacgcugacaccauugcauacacuagcaagauagcgcucucucuugugagacuaugccggggccuagcaaacacauaaguguaugcucacagucaacuauuggauggaucacagggcccccaauggaggagcuagagaaaguacccauagagcuaaagggaacugcaacccuauagguggaacaacauuaugaacuaaccaguaccccggagaucuugacucuagcugcauauguaucaaaagguggccuaguuggccaucaguggaaagagaggcccauuggacaugcaaacuauauaugccccagugcaggggaacuugccagggccaaaaagugggagugguagguagugggggggugguaugggggaauuuugggauagcauuggaaauguaaaugaggaaaauaccuaauaaaaaauauuaaaagaaaaaaaaaagaaaagggguauagagacgggcacagaagcaagcaccuguaaucucaaacacuugagagucugaggcagaagaauugccguuuggucaaguucagccugggcuacaaagugaguucaggcccaucugggauacaggagaccuuguuccacacaaauaacaucaaagccacuauaucugaaggucagccagcccaggguuacauugcugaccucccacaggcuuugcuauuaaagaauagcucuguccccgugggcucaggugaggagucccuggcuacuuuucggggauucugaagagcacuucugggaacagugacuucacaccuagacucacaaaugucccgcagggugagcagaaaaggacaaagaaggcuggcaacuuuucuccacugaggcuucaccucgaggcuaaugacaccucagagaagccaggcccaguacgguagguguguacuggcuggcuuugugugucaacuugauauaagcuggaguuaucacagagaaagaaaggacacucaauugaggaaaugccuccaugagauccagcuguaaggcauuucucaauuagugaucaagggugggagggcccauuguggguggugccaucccuggacugguaguccuggguucuauaggaaagaaagcugaggaagccaggagaagcaaggcaguaaguaacaucccuccauggccucugcaucagcuccugcuuccugcccugugugaguuacaguccugacguccuuuagugaugaacagcaauguagaaagugcaagcugaauaaacccuuaccuccccaacuugauucuuggucaugacguuuugugcaagaauagaaacccugacuagggcaguaggaugugcaaggugcagcaguggaaacaggaggaucccagccuccuccuccuccuccuccuccuccuccuccuccuccuccuccuccuccuccuccuccacugccugcuccccuccucuuccucccuccuccaagucaccaugcuaagcuccugcaguugggaaacaggucugugagcaaagcugccuccugcauuacugacacuaaaaagaggccccacccuccaccgcucaagucacuaccacagaaaugaagcugucagugacacaaaugacagguauuacagccuuuuccacugaggcuucaccucgaggcuaaugacaccucagagaggccaggcccagcaccguagggugugugagguuauagcauacugacaggagaugugguccgagagcuuaacacucagugugaaaacucaaaacgaaugccaaggaaaagucagaucgugagguuaggaccugagaaacaaggcucgguaaaucuaaaaucaguccuaagcagaaauguccacauggucaagugcacaagaacacugggaaagggucaagaggaagaguacacaacacaggucacucucagacaaugucauucgcucccugucacagucgcuggccugcuccuucccuuccggugugaugggacaggcuuggggcaggcugaguggcuauguggcuuguaaaacccaagguguguggggccugcucugagcugcagggcugcacaguaagagauggcucauaagacuaggaaucuccucacugcucugaccuuaccauuccaacugcuagcucaagcuggguagaggagaaagcaaacacaaagccagaugugggggugugggggugugcuggcaaucccacucgggaagcagaggcaggagauuaccuguaaauuugaagucgacaaucagggagagaggcugagacccugauccaccaaaaaaaaaaaaaaaaaaaaaaaagauucuguuucaagcugccaaucccagaaguggggaagcugccccaauagcacugguauaaaaaugaggccagccugggcuacugcacgguaaauucuagacuaguguggcuaggcuaaugagaacuugucuccucaggauaaauaauaauaaguaagcuguuguguuuucauuccaauacauuccauccagcccagaagcuccucaagcaguaagcuaaacaacucaaaacgguucuagggugucccugagucacgaccgccaccccaacacucuggcuagaacaggcaauaaaagcugagaaucugucucagaaaagcaaagcugcaaagaagacuuggaggccacaccagcugcaguggaagcggaaaccagccgagccgccugggagagauuuagaucaacugugaggcacauggaaaggacuggccaagcugcugcgcugccugcaggcuguggcugcuccagguccccagcuuugggagcugucacccgugcugggguggacuugugacgcagcugucuuugagucauuucuucuccagcaagugaccccucacccauauuccuguaaggaacaaugaugagacucucaggcucaccacgcuggauuuugguggcaugugcuucaaaucuguuaugggcucccuaucugcgauguguuguggcuccccaggaagagguuugucagccaaaugacaagucccuuacuaacuucuauaguuaagacaucuccaaagaggccagcuaaccaaggcugggugugagggagccagaagacaccaggucaggugaccaagggcacaacacugagagcaaagaccauggcaaggcacgggggcaacaaacuacauaaagagaagacauggguaggaagccccaagacagacauuaccaaucaaagccugaugugcugugacagacauuaccaaucaaagccugaugugcugugaacaggcacugcaaucgauacggaauugauucauccaauguggaccuguguaaucgauaccuggggauacaacuuggugucuccguggagaaagugagcucuuuaacauucacaugggugagguuuaaaggaaauaaagaaaacuuuaaaacagaggaaugaccaagugaagaagccuuuaaaacacauuuuuuaaaaaaucaaaaaacaaaagaugcaaacagugacuuuaaacuacaguuaaauacuugagucagacagguuacccacaccuguagccaccaacgcuugcaagcugagcaagaaucaagccacaggagccacgugugguuacacacuuuuaaucuuaguacuaggaggcagaggcagaaggacuuggcauucaaggccagccuggucuaaagagcaaguaccaggacagccagggcuacacagagaaauccuguguugaaaggaccuggguuucauuacagcucccauagagugacucacaaccauccauuacuacaguuccauaggguccaauacccuccucugacauccuagggcaccaagcacauguuuagaauguguagcauucuacauguagguguaacgcccauaaaauaaaugaaugugaaagcaauucaauacuuguuucucaacagaugccaauuacagacagagaagccuucugcaauggauuuaucuuauaaagagugggucuugugugauagcucaguggguaaagacacuugccaacaaguauggccuaucuaguagcccuagguuuuauuauccaacccuucccuaccagcuccugaugaaguauauuuucagcaauuuuucuucgaaugggggccuucucuuccuauuuuuuuuuuuagcagaauugcuaaggauucaggauaauaaaaauaaaaccaagcguucucucugacaaacuuucuacagcaugaccgcaucgaucuccaagggucugucaugagggagccacaccccagaacuagccaucaagggaggucaaaaaauuacugggacagguguguacagggagggguauguggaaguguaguguguguuuguguguguguguguguuguguguguuugugugcucacguggugguaguggggugagugauuaaaaaaaaaaugaaaauuaccuuuggggcauacaagaugacucugaggaugaagguacuuucugccaauccaaacuacccaagcuccauccccacagcacacauaguagaagaaucaauacccaagaugcaauucugacauccacacacgugguggcucacacaagcccacuuauguacacauaaaaauaaauuuuuuuaaagacuuuaaauuauauauauauauauauauauauauauauauauauauauauauauauauccccuaaauagagccaggccguaccucaguuccgauaaauguggggcggauguagaggcuggcagagguggaguagggaacccauucuuggucgaucuguagaagcugaagaauacacuuuaggagcuccuccuugucaaacaucugaaaggacagaaucccuauugaguuccagcaaaggacagacagucagacucccagaucagagagcagacagaagcucaauuuucaaaacuguccccauguugcagugccgauuggcuccuucaacagcuuuuauucacucuuuccuaacaugaaacaucgugagagguacccggaauaaaugcuuuaaaaaaaaaaaaaucugugaaucccucuggaaaacuaugaauuauucauaaggaaaagauaagacguuagauucucugaggcuucaagauggcucagcucagcagguaaggggucaugccgccaagccugauaaccacaugauagcgagaaagccaaguugcuucugaacucuacacucaccucccugcccccaaauaaauaaaugagauuuuugaaaaagauguuagaucccuauugagcauacucccauaucaguuauacuuuuacacucaaauguaacaaguuaugaucuuuauuuuaaaguggacaucuguggucucuuaucaauuauaguuggauuuuaugcucaaaaucaacaaaauauuauuacuucuauuuaaaaauugguaucugugagcucuucuguucucaauuauaacuggauauuaugauugaguauaacaaagcaucauggcuucuaauuuuaaaaaauagauaucuacaacuuuaagguuuaaaacaaccucuuacccagaaaacauaaaacauaaacaaaccacaagggaaaauaaagauaaaauuugccuauuugaaacugaaacucuggcuuuucagaucaggaagcugauggugagauaccaaugaggaauugcagcaggccauguucugaacugaacgcuggucacaaagacaaggggacaucagcuuaucccaaaggugacaagugugcuuuguaaacugaucaagcaguuuccacucauccacaggccagagggacacuuucagagacgugauguguuaugcaagguuaugcagcaccacacacuagcaugaucacagugcacuagcaugaucacagugcacuagcaugaucacacugcacuaacaugaucacacugcacuagcaugaucacacugcauuagcaugaucacacugcauuauuagcaugaucacacugcacuaacaugaucacagugcacuagcgugaucauggaacaggagcaugaucuuauugcagaggugucagaugugaggauggcuggcuauccaaguaaccugugccaacaacaagucaggucuugggggugcugagcagagaugaaguuuaaucaauuccaugacugcauggaccaggaaaccgcagaucacuuugcuguccuccuucugagugaccuuggacaagugguuuaaccucccugggcuggguuuuaauuuucuucuucguacagccguacuaaaauguacaauuuaagaugcucagcacauuaaggggcuugccaucaucccguguaguacagagaacugauucucaaggugcccucugaccucuaauugaaggcaucacauacauaagucagcauucacucucauauggucugaugcaauuauucagcaaagauuuuuuuugggggggggggggugugagagcagaauaaccaugaaauagaagggaaugcaaauguucauaccggcagcgugguccucacagcagaucggcacauucuauccauguugagguccggccggaacaaucggaucuuguuaucaacuccccgaaaggcuuucaagccuucaaacagcugaggagaagagaaaagucucagaaggugacuaagacaaucucagugguuacguugcuauccuuggccuuaacuggaauggagaggggaggggggggagcaaugugggaacagaaagggaauagaaagguccuuucaguacucaaccugaucagccagcagaacagggcaaucuaagcauucuagcaccacuccaccacuccuggucagaaguuaaguaugaaucuuggaaggccaaggaagaggaagggaagaggggagagggaaggggagggggagggggagagaguccacuccuguggguuguccucugaccuccacaggcacaccauggugaucucaugccagccacauacacacacacacacacacacacacacacacacacacacacacacacacacaaaugaucacauagaugcaugcaaacaugggaccugaguucaauccuagaaucgacauaaaugaaagccaggcaugguaguacauacuuguaaucccaacugccaagacagacagauccccagagcuugcuggauggccugccuacucgaucccaaaccaaugagaacaagguggaugguccuuaaacggcaagcuugcucucucucucucucucucucuguguguguguguguguguguguugggggggaggaguugagaaggacagauuucugagcuaaaguucucugaugaaggaacaacuaggcuagagauaccagagcucuccguaacgguggagaacaggaauguugcggauccagaacccugaauuaucuuuaaucuccaucgccauuaauuacccaccugugcuccuaaccucacauuguucugagccagaagcugaaaggacgucaucagacagcaggacuuucuacuuggcuacccuguuacccaaugucccagcacauuccauaaaugcguugacuaguaaccacuuccacaguaggcugugucauucggggccacgugaucccacgugcccacaccaaggccauucucuggcucaguaucacacgcuucuuacucccucuggacaagagcuauguuucuuuuacaccacaccccugccucuaugagcaagaaaguacccaggagaaaaaggcucacaaaacagccuggacaaggacacacaauggaaaacuaccgccuccgagacucacagaggaacacucgcuccccuuagaccccaguaaccacacuccacagcuaggaucuucucccugggcaagcaggcaaagagacaagggacauacaccuucuuuucuggauuaaauucccaauauguacuuucccaacaugccccgcccaagcagcgcugugccacucugccucgguagccccuucacccucuuuccaaccaagcgcuggucagggcccaccucacgcaggaaguguggcuauugauggacaagagcgcagagcuggaccccacagcucagugugugauggaggcgcaugcuacgaacugagcuguuuccucguccccaauccaguucucuuuuccccucuaauugaaaauagauucuuucuucucacaugacauaugcugauuacaguuucucucuuguacuccucccaguucccucugaccucaccucccuuuccgucucucauuagaaaauaaacaggugucuaaacaauaacauaagaaaucacaagauaaaacaaaagcuaacacgugggacuugggcaaaauaaauaugaaagagcccgagagaaggcaagagaaucagacccacugguuugcacacucaagaaucccauacaaacgcuaaaccggaagcuagacgauagaugcaggggaccuggggcagacccgugcgggcccugugcaaguccuggggcagacccgugcaggcucugugaaugcuaccucgggcucugggguucguaggagcuugcucgauugauauagagggucuuguucuucagguguccuccgucuccucuggcucucacacuuucuggggggggggggggggggaggggggggaugguucccugagcccuuggaggaauuagauggagacauucuauuuaaggcagaguguucuuaguucucugaauuucuacccugugucuggcuguaggucucugcauguguucccaucugcuucaggaggaagcugcaggaggaagcuucugacgauggcuggcucugaucuaugaguacagcauuuuauugcugcauuuaaaaacaaacaaacaaacaaacaguaguauuugacuuuaccuuaggucccuagacugucggucucagguucuuggucacccaagcagcccaaccugauucuuacugaagauauuucugguaacucggucuagcuaaucaaaccuuaugaagaagcacuguauuuuauuagaucacuaauaauauggagaagguuguggcuuuacggcagaaugacuguaauuugagggcuauuuuugguuuugcguguggaacacagaguauuacucacacaaggcaaguguucagcacuaagcuacauccccguuuaauuucuuuaaaacugugauuauggcauuugaaaggcugagccaggaggacugcuaugauuuugaagccagccugccaccaauaacaauaauaauaauaauaauaauauaugaaaaagucaaacugaaauuucaguugauauacuccaaaacccaacauuuuuuaauucuuccuagcucaccuccuauagaggccagcaggucucacacuguggcaccugugcaguugggugacauagcuucaaaagugaaccccaugguaauucugaguccuaagucugagaaucaagggaccuagaggcgcugagguuaccacagccuucucugaaggggaaugguccguucaccugucauuugaugcaaagagcuugccauaaauauaaugcagcaggccgugugacuagcagugaucugggaaugaagcuaagaaucuuuaaguucagacugguguggcaauguguaccugugaccccaguaucuagaguucaaggccagcuucagcuauaccacggacuggaagccagccuaucuuuaaaaaacaaaaccaagguacuaagaaguuauuugaucaucuucuagaauaggggccaccacugggucuggggucauacaaugcacacuguguugguaaagagagacuccagaggcagggcuggccccucccacaucagacccaaauguuuaccccaaguguccuccaaaccuagagcaggcuggcacucccacucugucacagagaggggaaaaaaaaaaacaaaaaaacaaaaaaaaacagcaaaaacacuguguccuugaaucuccacugggaggcaaaacauuucugcagacauuaccacuguuuaucccauguuuaaaaugccugugguggaagucugaagccaggaacugguucaagggcagaucagucugcuuccaacaggucuguuugcuccccaagaccgugucucccaugcaaguacuauccgggcccuguccugcugaucuccccagaucagauucgaucuggagcaaucaggguggucuaaccacagacaccccaagucccuuccuacuggguguugugagcaccccuuuaaugaugugacuucaucuuccucucucaguggggcugccuggguugucucucccugugaaccugaggacauuuugcuauuccuuugcuuugugcuuucagaauaccugucacccauccaagagagcacacagccuggucuauggacugugcagcauagcucaccgcagccguugucugcucucucccuccguaccaggcauggcucuacagcgguggcucucacaaccuuugggucucagccaccauguggguacugagaacuuugcuacaguucucugccagaucagcaggugcucuuaauccccgagccaaugcuccggcccugaaugugaauuugaaugcuucucacuucagaucauuaaauggguggauuccgggguguucuggugggaaauuugaacuguaaacacaaguagugaaaugaaaaugaucucuauaaaguauaagaucucucgaaggcacaaucuugggaaccaauauucagaaaugaauauuugauccuguuuccuauggccauuuucagucucuugguaggucagaauuuaucucugugccuucaguguucuggggaaagucauuacccgugaagaaaccagaauaaacugaaauauagggccaaggggaugggacaauauucugcauaucuguuucaguguguaucaacagaggaccaagauguggagucuccaaacacuccacggugaaggagcgugcucaaugccaucccacaggcugguuauaagaaagcaguuagcacagcgccccauccugugaccgacccuucacaaucacucaaagaucugagaaguagagagcaccuaauaaauuaguaauacucauugcuuuaggguucuuugggauucuguggccuaggcuguccagaaagaaaggcauagucucgguuagccuugaacuuucggcccauccagucuuagguuaccaagugcugagauuuucacacacacacacacacacacacacacacacacacacacacacacauaucacauuuuacuaauaucacagauaagccaagccaaccugcaaaacuagcucugagacuuaucggcaauccacuuggcugcaggagaaguuugaagauguuuaugacaaccuccaguuaagacagcagggccuguccccgacccuaaagaagcuugcaaggccagagaaucacggcccacgggugcucccaagcacuuacuuccacagcguagugcaaaacagaggcagcgggauguaugggcaaguuuccaaaaggcuuaaugugagguuucucccauccagacgcagaggaccacuccaccgucagcauguggucaguaaacguagcuccaaagaccagcgaauccggguccggcuucucuuuuaagacaguggcuggugugaugaugagaucuuuggccuguagaggagaaagggaaagugccuggagcccacacugcaugggcuagaugguccaaagguccaaugugaacaccauuccuuggugaugacacgaccacacccagcacagaauuuaacacugggggugucugaggacucgcugcaguugguggggugcuugcagaagccccggguuugaccacugaaagacuguggaggcaggagauucagaaguuccaaccuugucuaaaaaaacugacccaaucaagucucaaauaacaaccccaauaucauaccguuaacacugagaaccaaauagaccaaaccugugcucagaguucagucaauuguucaaaaucucugcaacagggccugacaaggugacaaagcaaguaaagacacuugccaccaaaccagcaaaccugagcuugauccuaggaccuacauggugaaaggggaaaaccaagacuccacaaguuguccucugagcuacacccaagcacuguacaugcaccucccuccccagcaccccacaagcaauaaauaacugccauuaacaaugcaaaauaauaauaauaaccuuagagccggagagacagcucaguggaaaagagcauuuguugcucucacggaggacccaaguucaauucccagcuuccccauggugguucauaaccauucuuaaauacaaaguucguggggaucggaugcugucuuucugaccuucacaugcaccaagcacgcacaugauguaugcacacacauacguaaagacaaaaacacacuuuuauuucagaaaaaucaaacgaauuuagaaauacauuuuuuuuuuauaaaacucaauaauuccugcaauaauacggugguauacgcccgucauccuggcacucaggaggcugaaguagaagaagagacacaaaugugaggccagccuaggcaacaaagugagugccaggccagccaaggcuacacagcaaggcuaagucacaaacaaaucccugcaauggcuucgguuguagugccaugagaagcaaacuuuaggggugugggagauguggugaaaugauucccgauucucaccagaccccagagaagcacucccagaagacacacagcauugcucacaguagcagggagcauccuucagggcacacagcagugcucacagaagcagggaggaucuuuaaggacccagccacugcccgcuauggcugccuccaccuccccagagcauuccaaucacauguccccagcuccuccagauacggaggcucacagaugggcacagacagcaaagaagugcucuccucuuugaagacagacaggcagagagagaauagagccgcagaugcaaacccuguccuaggaggagacagacaguaaacaaaagcccuccuauucagccgcacaaaaacaggaagauaggaaacaacugcacucagcuguucuccacaaagccagcucggccguugucacaaacccaagucaccucgguucugauccuuaacuugggaacagcuagagaacaacaacaacaauaaguaaaguacaauauuaaaaagaaacugugaagaagaaagcuuuuggugguauuggggacagggggaguccggcagagucucuugucacucaggcuggcuuaaaacucuccaauacuaagucucugaguggcgcacacuagccaagcacucugucagcugugcuacauccccagcccccacccacaguucccgacaauaagauaauuagcaacguuuaggaagacgcagaacaggugugucuguuagauggucagugugagcugaacggugagacugaauucuagacauaucuuaaacacggagaagccagcagacaucggcuuucuagacuuucauuuauuguuguauguacauacacaugguacgcaugaaugcgggcauaguccgcagcccuggggagcucagaggacaacuucugggauuugguucuuuccuuccaccacaggcaccagggaucaaagaugcgcgugucaucagguuuacacggcaaucacuuuuacccauuaggucauccauggcccugauuuucuuucuaaacaacaucaucaauaaugugcauggcucuucaaaagaucuggcgaaauuucucauccagccccagcuucacucacucuggcugacugcacaccacccucacuucacugcauucccaggcucugcacuacuacuuccugacauggaauggacagacagacaguaaacagcagggcuuucuucucuccucuccuuaccccucucucuccuccaggcagcugccaaaauuuacagcuugcccacccuacuacuucucucuugaacuuuaauauaacugucuucaagcuuaaaaacaaaaacaaacaccugagccuuguuguuacucuucacucgccaucugaauuaggauaauuugaaagugaacucgggcucugucucaucaauauugagggugcccgcuuuuccucguuacucaauaucagcauucuuuuguaauuauucuuagcauuuuuaauuuuauuuaagcuuuaaucacagaggcacugaggcucagagaguguacagaauauacagagacugccuugcuuccuggacugugacugccagccaaggacaguuacccaaguuggcauggguuauccacaauggauuauccaaaccucccaccuaguauuuuugagcuacucuguaucuuuaaugccauggaucauuagaaacacccauccuugcucugcaagcaaaggggagauaaagaaauaacgaggaaacuagaucaaggugauuaaugcucugaagaauuaaaggaacucggaagaagaggcagggaaggggacuuuggucuuggcuuugcagaggccugccucgugugucugagcacaccugaacgcagggagcaagcaggaugucuacagaccuaggaguaauguauuucaggcagauggacaaaguaggacauagcaaagaccccugcugcaggaagaagaggaaggagagagcaggggugaaaggucagaggucuacagcuauugcaguugggaaagcuaggcaaguuauggaccaggauagccggcuaugccccuauauacuaacucucuaaggccucuggcuauuuugcugagaccacagccuuugccaucuccuucccaggaaguaguaggccauaaacucaggaagccucuuuauugcucuuugcaggcaccugccugcggggagggagcagggaugccuggccugcagaggugagacuguccuggauuuccuggcaguuuaguaguugaacaagcaagccagcuguggugagaagauauaauuaagagaaucugagcaaugcugagcuuuauccagcuucaccaggcuuccccaccuccauaccagugauuuuccaggcccaggccccaagccucugagaucaacugcaagacaguucuccguucgaacucugucugccaagguaaaaaucacuuucaaaacuuugagcaaaaugucucagccucuggccccuuggagguccugggcccauugacaugugaucuagcuuauagauuuuaaaucuucccacaguagggagagagcucagugagaaagaguacuugccgugaaagcaaggggccccgaguucaaauccacggguuaagauaaucaaggugucacuaauaugauuguauacucugaacaguucaccuaaaaugcuuccagagcugaagcugcaggggcagggccuacaguguguaagucccgggcacaacacccagcagugcaacaagcagaaaaacgaaaguggggcccacccacaguuacccaaggcuagaccaaaacucugaacccuuugccuaaaaugcuucucagagccuaagcugcaggggcaggaccuacaguguguaaguccugggcacaaugcccagcagugcaagaagcagaaaaacggggcccacccacaguuaccccaggcuagaccgaagcaccagagcugcuuaagggccaagcugagacacagagcacauuuauauucaacuuagugcuuuucuucuagagccaaagagacagcucagaggcuguuucacaggcaagcuggguucacucccagcaccaucaagcagcucagagacaagcauaacuucagcuccagggccuuccagcaccucuucuggccucugaagccacugcacucacggcaacaucuauacaaacucauaaguaggucaaaaaacaagugaaaucggcgcucuaauucuaaccuuugaauacuagucgaaacucuaaaugauaaaauuuccaggcauucccucuguuugugggaaucacgguuaucuccccugaccauuucccucuaauccagauuugaacauaaagauuucccuccuauauccaguuuuuucaaaguaacacaagaucuuguggccuuuauaauuucaccaagaaacucuaaauuccuuuauuugagacaauuuccauaauucuagagauuaaaaguuaggguuuuguuuuuuguuuguuuguuuguuuuuguuuuuguuuuuuugagacagggucuuacuauauagccccagauagccuugagcucagagauccagcaaccucugucuacugagugcugggauuaaaggcaaggccugaagucaaaggaagguggaugugaggccugaagacauagcucagaagcuaagagcaccagcugcucuuucagaagaccuugguucaauuccagcacccauggcagcucacagugaucuguaacucugguccgagggcaucgauacccugucaggcccauguggacaccaaauaugcauaguccauguggagggaagcacccauaaaguaaaauaaaucuuuaaaaagucagauggcaugguacacaucucuaaucccagcauuuaaaaggcuaaggcagguagauuccugaguucaagacuagccggccagccuugucuaccuggugaguucuaggucagccagggcuacacaaugagaccccugucagaaacaaaguggggaaggggaaaucuaacuaaccagccuuuguacagcgaugcuuucuaucaugaucauuggaagaaaacagggcagccuaguaacugagaaaugacacagggcauauuaagaacaaguuccugggccagcuauacggcucagugaugcuugccuccaagccugacgaccuaagaucacuacguggaucccacacaguagaagggcagaacuaaccccuaaaagcuguucugacuugcacaugcagguaccuacacacauacacaaaggaaguaagccagcacgugcaaacauauuuuaauuuaaaaggggggaacaguuuucugcuuugacaccaugaugaggaagcaccugagcacuucgguucuucucugcacuggaaacgaaaggaaacucacuaaacucgcuuagucuaagcccgcggugcggugcaucagcacuggaagcacggggcuucccagggagcuccugcacgcuucugcuccacugagagagacugcucucaucgaguccgugcuuucucugagaaccuaaugaggucugaagaagaaaauucuacagcuuugaggccaaucagaggaaacuagaaugaagagagcucgucucugagguccauaggaaaagucuaaaguaguaaauacagcuucuuaaacaaaggcggugaaaggaucaggagagccggcucgccggaagagugcaggcagcucuuccagaggaccagguucaauucccugaacagugagugucaaguggcucaccgccaucuguaacuacagugccagaggacccagggcaucuggucuccaagggaacucauucaugugcacgcacgcaugcacgcacgcacaaacagagagagagaggggacagagaggacagagaggcacacuuaaaaacaaauuguugagagaaaaaaagagagagagagaaaauuggcccacaaagagaguaaagcacgcuguacaagccugacugacagccugacaguucuccuuccagaacgcucaagucuuggugggaaaggagagagacaaccccuccaacuuaccccugauaccacacaugcaccagugguaucaauaacaaauauacaaaaauuuuaaaaugacaauagauuuuuuuuauuuugaagaauuagauuuaaaaggagagagagagagagagagagagagacagagagagagagagagagagagagagagagagagagaacugcuuucuuggcccagcuagcacccucacuuuuuuaauaugugaggauugagaacagaauaauaagaagaggauggaggagagaccaggaaagcagcaguuccuuagcagauagaaaacuguaagaagcagggaucacggcuaagugugugacucaguaauagaggcucuuagugugugcaaaggccuggguucaacaaucagcaccaugcaaagccaagcaauaaaaccugucauuucuaguccccagauuaucgauacucucaguccacaccuaaaacgcaaggagaguaggucacgcuuuacuauugcuacgcagaggacguguacaaauuucaauuaacagauacacuauuuuucacuaugagcucuaucuugcacugaaugcuuugcauaaaaccauaaagucauuucaguugaaaugcauacaauaauuuuuugagauauugauuuauugaauuauugucuuuaaaagguagcaagaguucaaggccagccuguauaguucuaggucagccaaugugacccgaaauguuucguuuauuagagcugaguccuggaggugcuuaaagaacugagcccccgcuccacugacuggucacgugacucacacgugaccaaugugggccucucggaagugcuacaggaaaauugcguuaacacaccagaaaucacacagacagaauccacagcaccucacuguaguauaucuuacuauauuuugguuuaaaacaaaucgcuuugugagcagagggcuuauccugaauucaccauuccgcuucgugcuccuagcacugucccugaacacugaguguccccugugguucaaaacagacgacucaaguuccagucccucucugaacccugccaggaugugaggucacagggacauucuguacuaugggugacaauugacagugaguaucagagccaggaaaguggcagagccaagcacccacgaagaucugcaaaacccuucaggcugggggcugguggagaaggauggagggcugucaagugcuuuaauaagaucucugucccuccaauaacuccgcugggaagcagagaccgugcccauacauaaaccaaacaaugcaagggaaagaaaucgcagucugggacuguaaacgugcuccgugguuuuuaaggagaaaaaguacagagcccuuuucuugggcaagcagagcgaaggguuaagcugaugcaauuuaaaaagcaaccuccaguuccuauucauuaauucgcucuuuuccgauaaaaugucuaauucauaagacaaaacaagcagcuugcuguuaggcaaauuuugcuuugcugacugguauuaaucucaaauggcuuuuccccuggcuguaauuuaaaauucaagaacucacucacuuuaaauuccccaaacccuaaucucaaccugaaaugcauuaacuaacucagucacuuaaccaccccagcaaaugccuuacccuaaaagucuccgccacuucuucugauccucuuucuccagcaaacggcgcggagcauccauuacugcaguccuuaaaaauaaaaauaauuaaaccuccauuaaguaaagccaggugagucagugcgggaccuggucaagggacuuaccaucacagaagacagaaaagccaagucuguacuguccaacaggcaaggccagcuccagccagagccuguccuaggcuucccacccggucccaagucugccuuguaucuucccgcagcuuagggaggagcuccuuaaauuccgggucagcccaggagccgggguucuccagcaaagaacaagaaggcaauugucucccaaauguccaguaagucgucuagaacgaggguuuaagccauuuauaaagggguggggaaaaaaaaaaucucccgagcgcgcucagccucguggucuugucaaucaagggcgcacaauaggcaggcugcuuuaagcgugaggggaugcggacuggcuggaaccauuuucuccacccacagggucccccaugcuuuggcggcggccaaaacauugcacuugaaaaacaagaucucuugauacugccagcaauuaaauaaauaaaugauaccgugguuccgaauuaacuagggaaaggggcaggcauucaaaagcuggaagccaguuugcuaaauaacugggaaagagggaacgaagggauccaagacugcaaaggcagcggucuggauguuuugguggcaaaaucuucccuuuaauccuccaguuuuccuagccuagacuccagcaucccuggugauccccagccaucacaucaucccuaacgugcccaagauccuguggcgacccucgucuagcacguuuucucuccgugcuagucugugaccccagcaacucuugcgacgaccccuaaauccccacagugaucccugaguccccaguaguguccuccgugaaaauccccaggaugaccccagaauuccccaguggagacacucuuagcuccggaguccccaguggcgaccacgagcacccaugaauuaucuccauccuugaguccccuaguggcgaccuccgaguucccccgcaccuccaagucccucgccguaaccccccagccccgccccccuccccgcauccccucgcgaccaguguugccuugcgguaauacccaagagccuaguggcgcccuaccgcaguaacccccgccccccgagugaguccccgcgggaugcugguccuggcgccccucgccuuucgccacgcagguaccuggcgggccaggguugcaguugcucugggcaagcaggccaugacgaagcugcgggagcgugggaauacguggcacagcggcgacucguggcgcaccgcggaucccgacagcccgggacugcaguuuggcguggcgggugaaagagguacgaugggagagccaccagcaagcacccggcgcaggggcgagcgcagccgaugcagcaucuccgcguugcgggugcgugcagucacgcauggcugggcacgcgcauagagggcucaggagcacccgcacuuuacuaaggaacucugaagggcagggcucuggacaucucagagacacauuagcaucacaagggcccucucuccgaucuggauuugcagcagggaccugcauuugugcuucggcucucgccugcaacaguccuacaguugcugaccucgaaacguggacucugccucgcuguucccugccaguagccuccgaugcaaccaccauacggccuaugguucaggcaaaacagccguccuguuagugcgggguggugucugucgcuuuuaacccccgcccuugaagggcugaugaaagaugauugcuaagaguuuccgacgaccugugcuacaaacagugagacccagccucccaagcaagcaagcaaacaaaccaaccuagggguuagaauccacaaucacuaccagcuccaaggaccaccagcugaccuugaguccucgcacucagguggcagaagcuaacuccuucauuucugccuucacuacugauuuuaaugagcuaaauaauaacagggccuccauucucccuauuguucaccucugagacuuguuuccaaaggggucccauggacucucccaaacaucacagucuauagccaaggcuauuguuuacucuccauaagcuaaugguaaagcccuguuugcugaagacauaauuugcauaugucaucaaacauggagaauaucagccuaacugaagcucuaccccuccagaccagcacacauggcacugggagguacuucaucacauaccaccagaggagaaaaguaaucaccaauauuacccaucuaugaaccaugagauccacaacggagaccugacugcaagaugucauggggagauagugguacaaauguuacuguuggauacaaaguuacauaaauguuauuguuggauacaaaauggcccucaaauggcaaugcagguaauuguguccuaaacagaaggacucugacuugaucagguaaacagaaggauuguuacaaaaggaaagggaaaaaaggggggggggaauuaucagcaucugauagcaaucuccuauugcaggauuguguuaccaaggaagccacuguaccccuugcggaccugaccucuggcaagggcaucuaguuccuaacuaacccugcacuaacaccuacacuuuucuggccuugaccucuccuuuccugacgccuaaaggcuuccugcucuguccacacacacacuccccugccaagacagcacagcauuuugacuccucaaauaagcuuuccuuucugcccucacuuauaguuaugggaguaacuggcuacuuuucuauuagauuuaaggcccacucugugagauggaacccauacauugcacugcugaaguggccaaacugagacuggauaagucaugggacuaaaggaaaaccuacuauuauucugcuaaagaaacauagcaaugaaugacuccuaaugacauauugccaugccuauugggcagaguaucacucggcugcaucaaaagagccaggcaguagaugggauugaugcagauccacaacuggacuuggcuauagauggugacugaaacaacaguaauaaagagaaaaaucugugcugugguucacuaccugccacugugaccaagucuguucauuuuugagacaaugucucacuuaaccaaugcuggcuucaaagucacuaaguaucccacagcaugaacuuugacuccucccucaaucaccucccaagugcuggaauugcuagaguauuacuccacgaccagguuauacugugugcuaagcucaaaccaggcgaccuccccagugccugaaucuuuguuaucucacaacguggacagggagcacuugagauggaacugcaaaucaauuugcugcucugccuaaaaaggcguaacuugcuuuuacagugcugguauuuucuuuuuucugaauguauucuuucaccgugugugugugugugugugugugugugugugugugugugugugugugugugugaguguguguguguguugugucugucugucugccugccuuguguguguuugcauuuucuucacaaaucuuaaauccaauugucccuuuugcaagaacaaucaauuaacacuccaugaccuaaucuuuaaaucuccuuaccccugcuucuauaaucugcacagggcaagccugcugagagacaguccacagaugaccugguaaugggagucuccucuucccucacacugccguacaaaaugugucacaggguggccauauacggacagauuacaaggcaguccagugucacacggaaaaugaaugugcuaaaugcuucugacaccccaggcuccucucaggccagaaagccaagccuaccccuuacucccccacucuccuaugggcugcucauuaucucugccuuagccugaaagccuccagccaucuugaagcucugucacaggagugacagauggaccaagaugcagagucuaaguagagauuagagauuucaguguuuguuuggaaacacuuaggcucgaaguuuuguauuuuacaaaaauagauucaaguucugagugggagacauuaaaccuaauuaaaugaggcuaaaacaaaacagguauuuccuucaagacuuuagaggacauuuuauuuuacacuuuugucucacuccguaguccugguuggcuucaaacucacagcgaucugccugcuucugccuccugaguacacgcaccccggcacuagaugguacuuugcucuuaaaauucaaguuauagagcuggaggggcagcuagcccaaugguuagagcacucgcugcucaugcagaggacuggaaucugguuccugccacucacacaggagacuuucuuuacaaccacuuguaacuccaguccuccgggaguuccaacuccuccuucccaucuccacaggcacugcacucacgugcauaacgccguccgcagacagaaggggagcaucccguaagcccgucaugaugaccacauaaagauaaaggugcugcucaaaucugguccugauuuaacuggaggaacugccccugccagcaagcccugauugcccagcccagcaaccucugccugucuccagccucaagccccuuuagugaucuucaguaucuccagcuuugcagucauccuguguccaugggaaaaguguaucuuugugcuuucuguugcuguaaaaacaccaugagcaaaggcagcuccggaguuaggguuuauuuggcucacauauugggaucagaauccaucauugaggggauucagggcaggaccaccuucccagggguggcaaugcccaagguauaccgggcccacccacagcaaucaacaaccaagaccacaccuacaggacagucugcacggaggcauuuucucaccugagcguccuuccuccagaugacucuagucugugucaaauugacaaaaaucuaaccaggacagugaguguaagauuuccugcugcugggguugcagaucccugccugacauguguggauguauucacagccuaagccacgcauacuaauccuauucuuucuccucucauaauuuacauuauucccaggagaccugugauauuggauacaaaguuaauucuggacauauuaguuacuuccugguuagugugaggaaauaccuaacagaaaguaauguaagagaggaagggcauggcagaagggggaagcauaaagcaaaaguauuaugaaaaugccacaaagaagccuuuuacucucuaaguaauuuuguaggagggagggagggagggagggagaagcaaggaaagaaggaaggaaggaaggaaggaaggaaggaaggaaggaaggaaggaaggaagggagggagggagggagggagggaggaagggagggagggaggaagggagggagggagaaaggaaaggaaauggggacagaggaggauacacaugugaccacagcaagccugcuaugcucccuggugugcccugguuaacaagcacagagcccacagacacggcagaacacagcacauauguaguccacaccugucugcccaguucuaggaagcaggugcagugcauauuugcaggaagugaucagcacaggcaaagguggagggcgugucugguggggggugcagcugauggccagcaaagauccaagagucccagcaaauagagaaaugggaauuuuugaaucaccagucugcagggaacugcuaaccaaagguuuuuuuuuuuuuuuuuuuuuuuugguuuuuuuuuuguuuguuuguuuguuuuuucucucauaagagugcuacacauucaacaaaacauggaaaugcagggaaucacacuuggaaugcacgggaacccacaccugucaucacagcaccugggacacacgggcaguaaguagaauggaguucaaggucagcugggugugaugacacaagucuuuuuaucccagcacuugggaggcagaggcagggugaucucugugagucagaaagucuccauggguccaggacagucagggcuacuuagugagacccugccucaaacaagagaaucauuuggacucagucuggacuauaugagacugucuccauuuuuuacuuaaauuaauauuuguaugcaguaaguuaugugugaggugucacugguuguggaacucuguccuuggagcaugacgacacagacacaucugagaguccagcacccauucccucccgccccauaugcacauggucaagagaggcacuggagucuauuggaggagguagcucacugagggaugaagaauugucacccaggcaggguucagacaguaguugccugacucacccguguuccugaaagucaucccaugcuguaucaacuuuuucugggaagcugugagcaagcucuucacccccuacagcguaccaagcaaugacagaccaagguucagagcccagaaaagucaauucggugacaauggauacaggagcaugaaugaccccaaacagcugcaucacacaccaagucccacccaucacagauggcugauucacagcggcugcaucccagaggccugccucucuguugccuuccugcuccagcagggaggaaguaauagcuagacucccaaggaaggguccugugaccaaacuggaagugucaauguaccauuaccacuacacacagaccuagcugccacuguguuguucccugccugagcaagguagucucuacuccaaacugugcgugguucugaggagaaagccacaaggacaccccucacccauguucucauaacgccacauagacucccuccaauaaccucacugguucacaagauugggggcauucgacagacugcuguguccaucaaaaaaugacguagucaggcacccaccacuccuugggaagucauuaagcccacagcaaacaccagcaggcugagcaugcccaucaaguugacagugccaagggugugccugguccuggugagcucuuuauaaccuuaagugccauugucaguuugggcagggaacugucaaucacagcauccagaggaacucuguuugcccuguagagaccuugaaucucagguaaaacuggaucccugguuuuugagggagagagagcagaacuggaguucaggcaaagacauuuuuuaagaguuaagaggaagaaagaaagcuaggaagauaacaugcuugccuggcaugcgcaaggcccuggguucaaacuccagcacuaacaaucuuaaaugguaauaauaauaaaauuaagaggcuggaaagguggcucagcacuggcugcucuugcugaggcacaguuucaguuccuaguagccaugagacagcucacaaucauggguaguucuagggaauccaacacccuucucugacccccacagcaucagacaugcacaugguacacaugcaaacaugcaaacaaaauacuauacacauuuagagacagacagacagacagacagacagaaacugagacuaagacucgccaagaagauccacccaagagcaugcuguaggcuucucagaaccacaguugagucgccaugguagacauguuuaucaucuuaauggcucaaguuaccccucaaagauuugcuagggggcugcuuuucccuuuuccucuuuuucuucuaaaauaacuuugcaauuaaaaauuuuuaagauuuauuuuuaaaauagggucucauuauguagcccagcugauguggaacucaauacaauaaacaaggcugccucgaagcucacagauacaaucuugcuccuggcuucugaggacugaugcuuaagggcaugcaguaucaugccucgccaaauaauuguaugugaagugugugccucuguguauggcccugugggugccuucagacuccagaagagguugcuggauaccauuguaguuacaggcuguugugagcaaccaaacaaggguucugggaaaugaacgcaggucuccuguaacaacaguacauguuacaaacagcugagacccuuuucuucuuauuugauaaguggaggggcaugguaguuacacuuguugugacccgguuccacccugacuaggaguggcuucuuguugaggcaaagcugggaggauagacaggggauuuacggugccuugauuacaggagggcuugggacacaauaaccuaaguuauucauuucuccacgcccuagcaacuuuuguggcuuaucccuuggagugagggaaagaacuuugauuuuuuuuuuaaagagaggaaaugcggguaugaaaaaagaaacgggaaccaugcugccaagauguucccuccugcagaugcuuucugacaggcagaccuugggagagauuuaaauaaaggcuuacccaggacaacaccacaggcuggagacauggcucagugagaaagggcaccccaccaagccugacaaccugaguugaaucccccaaacccacaugguucccccacgagucagacuacaaguguaccauagccacacccacacauacaauaaacaaaugaucucucuugaaaaucacauuuuuaaagaccuuaccugccucuguuuucacuuugcucuaaaacaaggugucaaugucacuaugcagcccugacugguugggagcucaguguagacccugaucgugagcugcggacaggaaaugaagccugugaacgcauuggaguucucaaccaacacauuaauuggaaagaaaccaaagacagauuccagacacuggugaccagcucugacaccacagggcaaaccgaggcagguagccagugggguggggggggggggucagugcugggagcagcugaccaugucgauccagacacugaugggggcugcugccuaugacaucgagggaugauugauuacaggagggcuugggacacaauaaccuaaguuauucauuucuccacgcccuagcaacuuuuguggcuuaucccaggucuccucagcugcacucaguggaccucagggcugcauccuguuuuaaccucccuugcuacauccacccagcccagcugcugagucaccuuccuagacuuuuguccuaaucagacuuuucuccuguacugcagggcugggaucccaggaaaggggcagcagagaccagagagguacgucucuucuucuuggugacucuggagugugucaaguggacauuaaaaacccacccaggacaucuuccuucuugaauguacauccuucgugaccacagaaagcugcuguuugugugguccccaguggagucauguuauaguguugucuaauugucuuuuuccuuucaaucccuccuucccucccucgagaccccguugacugacugagcuggcuuggucagaugguaucucaacauggagggcucaagcacacgggguacagugaaggacacauugggaaaaggaagcgugcgcaaaggaaaauaagaaaauuggggcuagcagugaguaaacccuguaagaauggggcaagguaauggcagaaugcuuuuuauacaucugcuuaaagauaugcuaaaaucuagaggagccaagauaagucaaaaacagcuuacccaguuucugacuuuuaauagaagaaauuuguccuugguucucugaggaagguaugguaaguuuacagacaugggagaaagaacacauggcccugaaaaaaaauccccauagaugauuuuagucuuuggauuucaguuagagauacuuuagauccuagacaugaaaguauggaauuaggaaggauauuagaagaugcaggggcuggagagauggcucagcaguuaagagcacugacugcuguucugaagguccugaguucaaauuccagcaaccacaugauggcucccaaccauccguaaugagaucugaugcgcccucuucuggugugucugaagauagcuacaguguacuuaccuauaacaauaaauaaaucuuugggccagagggaacgggacuggagcaagcagagguccugaguucaauucccagaaaccacaugauggcucauaaccagcuacaauguacucauauacauuaaauaaauaaaucuuaaaaaaaaaaaaagaagaugcagauagugaaagcaagaggagaaacaaagcuuucccauccauaccuauuucugaggcguuggacaaggcaggaaagagugacgcgccucuugauccuagagauaagauugaacuagaggaaaaggcugccaaguaucauaaugaggccuccuuuucgggauucucuuaagguauuuuuugcaaaggaauaggcaaggauaucccagagacagaagaagaugaaacaacaagaauuaguucgacuuguugaaagacuugagcaaguucucagagaacaaaagagcaucgaaaguucagauuccaaggaggucgcaucaauaguagagccaaaaaaugaagguuuugccuccuccagugucuuuaaagagcaacagaaaugaggggaaaccuuacuuuaaauccuagaguuacucuguuauccccucuucaggcaggacugaaacagcuguagaacgaggggaagacauacaaggacaugcucugcaaugcccuguguccuugaagcacaggaucaagaagggaaccuguuagauaccacacucccauuccuuuuaaguagcuaaaggaauugaaaacugccugugcucaguauggaccuacugcuccauucaccauggccaugauagauggccucuccacuguggagaauugcaggccggucuaaaguugagcugaggucugaaccccgaagggugauaauucaccuauaugacacgguagguguucccucaugcuccuggaacucugguuccuaccuaaguuaccgcaccccacagcccccacaagagaagcauggcuagaagucacauggcaauggcccaagcuucugaccuucaggcuaaacuccuccccaguuaccuagcaacaguaaagaccauaaaaagggcuguucagucccugcuugcucucuuacuucucacucucuuacuucuuaccccucucucucaccccuuucuccucucuucucuccuucuuuauaguuacucaacaaauauuugauugugguuauuugccuaaccaaagguuaggaaagcaaaaucagagagaauuagcacccauuauagcuauccccagcaaagguaaacagguuuuggguauuuuuaauggagaccauuggcacuccaugcagauaaaauuacuuggaaaagugauguuccuguauggguagaucuguggucucuuacuuuagaaaaaaacucugggcaugguggcacacaccuuuaauuccagcacuuaggaggcagaggcagguggauuucugaguucgagaccagccuggucgacagagugaguuccaggacagccaggacuacacagggaaacccugucuugaaaaaccaaaaaaaaaaaaaaaaaaaaauuaaugaaaccauggaacuuauacuauuuuauacuguucuuucacauccugaugguugcacaggcacacagguuugcauuuagugugccugcuuguaauuuaaagaccuaugggagcuggagagauggcucagcaguuaagagcacugacugcucuuucagagguccugaguucaaaucccagcaaccacaugguggcucauagccaucuguaaucugaucuaaugcccucuucuggugugucugaagacagcuacaguauacucauaugcaugaaagaaagagagaaaggaagaaagagagagagagagagagagagagagccuaugaaaguuuugccucaaggaauggccaauagcccuacauuaugucauguuuguugcugcuucaauauaagagauuaggacauugaauuuuucuguguauauuguucacuaaaugguagauauuuuauuagcugaucccucugaaggagcucuacuacaaccuuuaaaaucuugggaauuaguuguugcuucagaaaagauucaaauacaauauguccuuuucaauauuugggacaucaguuauauccuaaacaaauuguggcacagaaaauucaaauaagauaacacuuacuuugaaugauuuuuaagaagcuguuaggagauguuaauuggcuaagaccucaucuuaagcuuaccacaggagagauauucucaagggugauguauauccuaauuccccugggcaauuaacugaugagagaugaauaucucuggagaaaguaggaagccaucagccaacaacagauacauuauacagacuaugaccaaguguuggcuguuugcguucuugcugccgcucauguacccacagcaguucuucagcauggaccugacccuguacucauaugggaaagaggccacauuuauguuuuuucacaggaagguaaauggagcaugauggcugcccgaagagcuggugcaacacauggaacaaucucaccuuccugcugauucccccccccccaccuuccugcugauucccuuacugaugaugacgauuccugcacacagugaaguccacugggccuauguuccugacccaccacugauacacuucuuggaucucccugggcaagggagucaacuuauaauaaaaccaugacuuucaaugcauuuggugaugggauuccuguuugcuuugugaagaacaguacaaaugauggguguauuucuguguucauucagauguggaagaaaaacauuucacaaaccguaacucaaagcauagagauggacacaguuaaauauuaugagggaccugccccugauccucuugagauauggccuugugggucugaacccacaaagaagguggaacgggcauuucacacaacuguuaaauggagaaaauguuauaaucaacccccaaugugguuuaauguuuccaauaauaugugaauuauugauugggcagggaaucaaucaaacacugggcaaaggagauguccauaggccuuuggcaaucagaugccauuucuaacaucauauuuggaaguuagcuaccgcucucuaugaaguuacauugacaauagacaaaauugggacagggucuggauuucaaacaaguguuagugcauguguuaaagcuccuaaucuuuuauuaauuggucauguuaagauuacuuuuguuucuucuacaguauuuaauauaaguugaguugauuguauacuuucuaauuguguuaguguguucaaaucuggcauuucugucaugguagucuaucaaccaacuuuuguuuuacugucugugaguauaacaggaccuuggcauucugaaaaaagccuacaaauccuggaagaagugaguggaguuuuaaucagaagcaagaggguagugggcuuuaucauugcugguauagaggcuuugauuacauuaacagccaauaccacggcuucugcaauugcuuugacacaagaaguuaagacaaccacuuuuguuaaucauuuagcaaaaaaaaaaaaaaaguuucuaaugcucugaguauucaagaagacuuagauaagcguuuggaacaauggauugaugcccuuuaugauacuauucaaauuauuggagaggagguucagagucuaagaguaggaagacaucucaagugucaugcuaaauaccaauggauuuguguuacaacuaaaauuuacaaagauagucacuauaauugggagaaaauucaaagacauuugcaggguauuuggcguaauucuaacaccucucuggauaucuuaacuuugugcaacaagauuaugaauuuaaagaauacugcagauacugcugauaaaauaauuuguggcuuaagguuaguauuuccaucuuaagucaagcuucuucaagaguggcuuauauagcuugaucauguuggcccuucuuauccugggaauacuuuuauuccuguccauuucaauaaaacuugccuuuaacaacaucagcauguugguggccaaaauacauggcuugaaacuaaaaaugaauccccagacagagccauuaauuuaacaaccuagcagucaacugauggaugagauuccacacagagucuuaacuaagacagaaacucauugcuuuugagaauacauauuccgugauggguaaggaagguguucuugucucaacaaccuaagacagaggaacucuuguuuaugaaauaaaacaggggagguguggagagcucuuuggguugauuuaggaauuuggcaggaauuuggcauugggcuaggacaaggaaguagacuccaggugaauacagcugagguuuguguacuuuguaucuugaugggucuuguuggacccugaauacaguaaucaugggacauuucucuaugcuuuguuguucaacuacucugcauaugccucaggacugaccgcauucucagcaugugccuagagcuauagaaaaacagacuggaaaaaaauuaaacccaguucagcuucagaacugguuggaaucauguuacuguauugucuaauugucuuuuucuuuucaauucucacucccucccucaagaccucuuugacugacugagcuggcuugcucauauacauauacacacaguuacaguuagcagguggaaggaaugaugcugcaacaacgcuauuuuuucucccauaguuuauaucccagcaaaaucuuucaagcaguauaaaauuaugauggugauuggguuuuaguucuagugaaugguuaugaaaaaagcaguauguuucccaauaccuuugcaagaaacaacauuuuguagcacagguaaagaaaacaaauuauucccaagaaccuacguacauuuguaacuaagcaacuuguuauaguuuaacaaaguguaagcaagcagugugguuuacucagccaguuucucuuacugggaggcaguaauuuucgguuaccaagaaaggauuuuuuuauuauuuauccuuuuaaaaaucagucauagaaccgggcagugguggcacacaccuuuaaucccagcacuuggaaggcagaagcaggcggauuucugaguucaaggccagccuggucuacagagugaguuccaggacagccagggcuacacagagaaacccugucucagaaaaccaaacgaacaaacaaacaaaaaacaaaaaaaaaccaaccuucagucauaucuaccuuauauccccagagucaaucaucacuagucagccucagugagagucacgucaaucagugcugccuuuguucuuguucccugaccauaaaaagucccuagcuuaacuaauaagaugugccuuuuugaacuucagauuguucccuaagauuuuucuacaucagagccaauuacaaaaacaucuuaacuucgcuucacuaacaauuuuauuuuucaaaaaaauuuuuuuucuaaaggucauggucauugcuggcaaucuacauccuaaauucucuccucggguggcgauugaaucauuaaucugcuccagcagcaaugccugaaagacaucaagcauuaguacugugagugccagagacacagcccagugagggacugggagcuccuuggaguuuucacacaauucuuagauuaggagggaugugagggcagcaagcagagcagaacuccacgacagcaugauguccucaggacacaugguccucugggcccucaggguuguuccucuccaaggagcacccaccaaggcugugcuaacuggcuggguugcauuccauaaagccaucuguugccucucccucaaggcccucagcaggagguuucaggaaagagcagucaaggcggcauggggcuguguguuugagaagacugcaugacaaggagauggaguguggagaagggcacuugucuucuaguauacaagauaacggauuucuuccuggcaccggagcuccacccuaaaccagcaaggucaccaaaacaacaaggucaccaaaaaaaggacauuuuucuuucccacuuuccuuuuuuuuuuuuuuuuuuuggauuauaauccaucauaacccugucucauuccucccuccaaguccucccaguugcugucugucagcagaggaucucugauccgugaagcaagcagauggaugucugcagcaguguuuguccacaugguaggugucucucgauggauggucagcacugguuuuuaacugcccaaacucuuucuggcccugucucaagugugaugucccaggaggugccucggguggguaagauaaagccaggugccacugggguuacagaagaggugucugguaagaggccuaaaccacccagauuagccucugggaaauuucagagaaaugcaugcggcaaacuguccugaaagcuuugauccucaggcacugagagacucaccagacuucagagaauggggcaaugaaggucuuuaaacaaagggucucggcccugcucugucuggcagucaggagccccacuaguggggcacacaaauucuuggcugugauugggagugacuuguugagacaaagcugggaggacagacaggggauuuaccaugcccugauuccaggagagcuugggacacaauaaccuaaguuauucauuucuccaugcccuagcaacuuuuguggcuuaucccuuggagugagggaaagagaacuuugguuuuuuguuuuuuuuuuuuuuuaagagaggaaaugcggguaugaaaaaagaaacggggggcuggugagauggcucaguggguaagagcacccgacugcucuuccagacugcucuuccaaaggucuggaguucaaaucccagcaaccacaugguggcucacaaccauccuaacgagaucugauucccucuucuggagugucugaagacagcuacaguguacuuacauauaaguaaauaaaucuuagaaaaaaaaaaaaaagaaaaagaaaaaagaaacgggaaccaugcugccaagaugcucccuccugcagaugcuuucugacaggcagaccuugggagagauuuaaauaaaggcuuaccagggacaacaccacaggcuggagacaugacucagugagaaagggcaucccaccaagccugacaaccugaguuugacccccaaacccacaugguuugugggaacugauuccccacaagucagacuacaaguguaccauagagcugcccccaacacacacacacauacacacacaccaaauauucuuucuuuaaaaaagaaagaaugcaccaucaugccuggcuugguugauauuguucuauuuccaaaauuacaagacacuuuauuccacaaacuagaaugcuuaucagauguaccaaaagaucgguuaacauacuuaucagacauacaaacugauugguuaccaccagcaaauagcugauaagggcuuggcagagggaaugauuugugucuguugaaucuagaauugugggugacuuggaacuuaggcaugacugacuccauucugauuuuagcuugaucgguaucaauuuggaguugacaacagucauuucugcugacuuuacccaaaagguuggagacugaaaaacccaagcuucucuguggggugguccucuuggcaaaguggugcaaguugaagaaaccgguucaaucccacauuuuguagggugaguacaauacugaauggcugccaugucuugcucugcuccaaaacagcggcugcauucuuaaaugucuagugugugcuaugcuguuugacaaauguaugaaaauugguaaauuaugcaaaccuuucgaggcuaguggagcccugucgccagacaaaagcuaggaagguugggaggauucagaaacucugguaauucucauuaucugagaacaguaggcgguucaucaacucuugacccaguuccuguccuggagcacaugaccacaugaggauccugacaacuagucauguagcacgaaguaucuagauggcccguugaaagcguuuagccaauaagcuucccuucccagauauucccuccugcaaaagguauuuaaucucugguccacccugaguaaguugugugcacccauuuuuaccaugaauaaacaguuuggacaaacacggacuaucucucucaucaagaaccuguaggggcugggggaggagccugcaucauacaaagagcuucacugacugaaucucccaaagaaggacacuccacacuccagacacucaucccugagcuaagcuccucccucccccaggccagggcuccucacuggccuauggguccccuccauucccgacuccuugaaguuccuagaggcaccuggguguccagaaaccccagcuuuggccccagccugugucgguucucacccugggguuggagucccccaucuuagacugcaucccaccaccccugagcaugugucuucagagagccuaaccacccgcuggcugugaagaaggaauguagccuagcacacaccuccuuucacauuaaagguaugcaucuuuuaucccagcaguugagagagaguggaggagcacaagggaccugcauuugaugugcaccuuuaaccccggcacucaagaggcugaggcagauguguuagagccuggacuacacagugaauuccaggccagccagcucaacuaguugagacucuguuucaagugaucaaaugaaacaaaaguagguuuuaaaugugguuguuuccgugucagcuuuagaucagcugaggcgguucaguacacugccucuaccucuucacggauaauucgccuuagcccaacuuccacagauaggccacugggacuuuugcguauuuucuuguuuuggcuugugggagugacgagccugcucuucgugagcugugccuauaagcacucugaggucccagguggcagccauuagacaacucaccugaaugaguuugucuuuuccucagucccuugcccuguuaaucaggguucuaggaaacaggccugcaaggccaugcaaguacgcacuuuuaacuaauaagccaccucuccagagccucccucacauuuguuguggugaagaugcguacugggucugaagugcuuccauuuuuauuuuuuggguuguuuuguuguuuagcuuuguuuuugagagauggucuuggguagcuuagacuggccuggaacucacuguguggcuccggcuggcuuaggccaccugaucagacagucuucuucugcaguaaugguugcaaugcacucauggggugugcuccaccacgccccagaugcaagcgcuccuuugaccucgugugucauuugugaauccugagcuguguauaacuuggggagcagaaaagacccacagaaccugagcuccacagagcacaguugcugccuggcaucaugagagcccugggcagcaaugagcaagacaccugagcuuacaggauccacuggggcuuuuggcaaacccauucugcuauggcacaaggcugucccauuuccugaggaagcuggcugguuagccuuuccuggagggcgggagucaaacacagaaaagccaguuuaccacuggggucagcuguagccggaccuccaaagaguugaaacuuacugaaguuaguuuccuucuaaaguuacuuuccucuaaagcccgugcaggcuauuuuucuuuugcuaauuacaggacauaguuugaccucuguaaggaaaccugauauaugacagucccacuuuaggaagcagguaaaucaggggucuuuaauauuuuuuaguguuauaaucuuuuuuuuaauuauuuuuggauuuuguuucuuuuuuaagguggggucuuaaggagccuagacuggucuuaaacaaucuguguagaauuuuugaauuguaagaaaauaaucaaacuaucacuaugguccccagacugaagagaauggcuacauaguuuaaaguacuuguuguuccuccagaacacacaguucucagcacacguaugagguugcucacaaccaccuguaacucaagcuccaagagauccacugcccucuucuagcuucuguggguaaguacacucacaugugcauacucacacacacacuuaugcacacacacuugcacgcacaguuuuuaaaaauacaauaaauauuuuuaagguuuaagaaaaaucagacuggcagaucccauagagugcagcugaguucucucucucucucucucucucucucucucucucucucucucacacacacacacacacacacacacacacacacacacacacacccuggcugcacaggaguucagagccucagugucacugucuucucccucagggccccaagaccuucaguagggucagaggcuuacacagugucacauaagucccaugugcuucaugugcacauuacaguaaccugaggucaugauucugagucaaaagcaagccaggaacagaaauccuccucugcuguuagccguacugucugcaucuguuugccaaugcucaagaggcaagcaauggaaucuguggguagaagccaagaacccaggauguuaguuaugaaugggagaaggagauagcacaggcuaugaacagcacagagggguagcuacacaaaacagcacuggcugggauggcugugaccuccucuccugagugagggaagggacuagcuaauucucggccuugaaggcagccauagagauaaccucuguuugccgccccgcccccucaacacagcuguuucucaagacuuagaaugaugugagccaaggagagacucagcggcuaucaucucugcagccaucucgggcuauuuacuuacagguugguacuuuuccacccugacgagagacucguuuuccuagcaugauguuuuugcaagaagcccaccacggcugaacacacucugauaacaucuuguuuuucuccuacacagccuggacuugugguuaagugucuccagcugcacucuccagugugugcauauauacccauaguugccuuucaauaaacaauacuugagacuugaucagauagccuguuuugucuucauucuuugagucucuugguccucagucccacucucucucuugcagacuccauugacugaccugcgcacugggucagugggaaaaggugcuugcugccaaaccugcugaccugaaccugaggaaccccguggugaggagagaacugacuucucaaaguugugcccucaccuccgugcacucugguuugcacacgaacacacaaugcucuuuuaauaaaauacuaagguaacacuuuagcuacacaguguaaagccugccuaguagccuuagaaagagcaagcuaugauaaggcucaaguauaugagacuuaaaccagcuauuguuugcaagucauuauugcauuauauaacuaguacauuaaagacacauuuauauccucuuuuguuggggaggcucuuuguuuguuuguuuuugagaugggagcgcauguuguccugacugcccucaaacuugugguacucguuugcccaaacacacaugcacacauucaggugugcacaaaauuaaaugaguaaauguaaaaauaaauaaaaauaugcaugaaaacccuucguaaagcugucaggaaaagcaagcauagaacaaacauuagggguaauuaauucuuauuaauuuaauacuagcuaguaggaauauuaauauugaaaaggaacacuuaauaggaaugugguaguuagaguaggaaugguccccauagacucuuguuugauuucuugguccuaaggaguggcacuauuagauguggucuuauugggguagguguggccuugcuguggagguaggcuucaagaccucaugugcucaagauacacccaguauggaagacacucucccucuguugacuaugggccagauauagaacucucagcuccuucuccagcaccaugucugccugcacacugccaugcuuccugccaugaugauaaugggcuaaaugucugaacuguaagccagccccaauuaaauguuuccuguauaagaauugcuguggucauggugccucuucacaauaagagaaacccuaaccaagacauugccucccugccuacuuuauggcuguaguuaucuuaaguuccacacaucccaggcuggccucagacuuucuagcgauuuaagagugaccuugaaugauccucgggccuccaccuccacaguaaaugccuagauugcaggcauccacgacugugcuccacccucuauucuaacuuuuaucuuuuaucuucagaguucaaagaaguacuuauuaugauuucacaauuugaugcacaaauauucagaacaaagaacaccgcagccagcugaggaggaaugaauagacuuggcagaacuccccuucugugugguggugagaugcucaaggacuguccggugcaaaccugccauuuccucauuugggacggaugcaaaccgcaucucagcugaguuccuuugccaaaccaccacggcuucucugggugagcaucccaacaguucacuuacgguuaugcucauaaggaaucgguaguugaccucaaacucugugccagaaguucccuaugcauauaugcagcccucauagagggcuacaugaggcuaucucaaagaaccaaaaccaaacaagacuuccacagguagacaucggguaagaccaaaacaccagaggcacacacuaagguccagacuauaaacagcaccaacugaucaaauauucggguacauacaucaaaacaaagaguaaacgcacugccuuuuauaguagauaaccacuuuaugcuuaucccugacuagcuuaagaguaaaugagacucagacuaugguuauuucauuuggcuuugacaauuacugggggggucaccccuaaucuacuuuucuaacugccagccugacugccucuccagggauguaccccagauacaguccuggccacaugcucaugggccuucuucccccacuguggcuuccuccuccccucccguucuucuuccuccuucuccaguuccuuccccauuccucagccaaguaacucgaagcacaccuaccucuaaucccuccugaaauuggcuuuagccaauuuuauuuaaccaauaguuauaaaucaaggaacaagguuugcacaacaaaagcuugcaaaccugagagugagaauucacucauacauucauagcuuccgguacagaauuuagcauuacaauaccuagcaauggcccaaacuucaacagcuuuuggguuuuaaucuaagacugcuuuuuuuuuuuuuuuaagauuuauuuuauuuaugugagugcacugucuuugccuucagacaccccagaagagggcaucagaucccauuacagaugguuucgagccaccaugugguugcugggaauugaacucaggaccucuggaagagcagugcucuuaaccucugagcuuccuuauauagcuuccugggguuuuuuuuuuuuuuuuuuuuuuuuuuuccucucaguucuuguugaauucugacauagcuaagccuucgccaguguuccaaaguccuagaaaguccuugagcugaccaugggcuuggaauucauuaagaauguugcccauucagugacauucagaauugccucugguauuacacuaucacuuugaauaaaagcuaacucacugcccuacacaggaauuuacugucaucuaggaagaaggaaguuugagacuaaggagaaaccagaguagauacuuagaacuauagauagcugaguuacacccauacacacguauuuacaauggccuagggggaagguggacuauacauacaauagacuaaaauaggaacuauggcaagggcaugaagcccuugacccuggcuucuaagauuaaguggauuuauuuauuuauuauauaugaguacaccuuagcugucuuuagacacaccagaagagggcaucagaucucauuacagaugguugugagccaccaugugguugcugggauuugaacucaggaccucuggaaaagcagucagugcucuuaaccacugagccauuucuccagcccgguggagcucuuuuuaacaauggauucuaucccaggugguuccugucagaccuucuguguuuguauuccucuguuuuguguaagaauccaguaaccucuuuguaccuugcuggugugucccuauuuucuucuguauaaaaaguuugaugcucgauuugacaaauuacauucagauucuacacaaccucuccuguaugcaucuaucauuccauccaacgcuuugcccaccugccccagagacccguuccacacagacaaaggggccccgagggucugcagcagcucuuuucuuccauuauuuucuuauguuugucuuuucuauuuacuuugauucuuuuucuguauuuccagaauauuauuauuuaacauuuucucuuuccugaaguaugguagugcauggugguagauaucccacacucuguguuaaccccccccccagucagugguaaccccacucaacaauaaccccacacuccaugauaaccgcacacaaucauacaaaaguggggccuggagagauggcucagugguaaagagugcuuccugcucuuccagaggaucugaacucaguacccagcacaccaucaggcugcucacaagcaucugcaauucccaaucuagggguuacaaggccaucuucugcccuuugacggcgcccacagacaugugguacacacacucacagggcacacacaaguggaaaaaugaaauaaaucuuuaaaaauaaauaagaguuaagaucuuuuaauuaucuuucccguuaaccaguaaacacaagacagauguuuugggaaaaccauuuuccaccaaaaagucuuagccuauaugauagaaaagugucugugagacauaccaugcugguacagguaagaugucuaauuucuacacuauuuuaagagcauacacauucauuucuaaaagugaugucauucagugagugauuccaaagaacuauucugagcaguggugaacugcuaguuccccuagaauuauuacauaaagaaaucauaugggcuggguggcucaguggguaaagcagaaccauaaggcuaugaccucacguccccagagcucaguaaugccaagugaggugaugcuaugucuuggauuccugagaacucacaggccggcuucccugacauaacucaguagcuaacaacagagaccccauuucaaacaaggaaggcaaagagugugagaaguugcucucugaccucagcacauaaguguuggcaugugugugcaugcacuuacacacauaaacaugcagacacaagcacauaucuuauacauacacacaaaagacaaugucuccgugaaauggcuccacgggcaaaggugauugguagcaagccucgucucuucaguucuauccuggugacucccauaguggacagagaauaaacucucaaaagcuccccucuagggccuggagagauggcucagagaguaagaaccacuggccgcucuugcugaaaacccggguucgauuccuagcaucuauauggugacucaaaaucuguaccuccaguucuuucuucuggugugcaugugguacacagaucuacaugcaacuaaaguauacaugaaaauaaauauuuuaaauuaauuaaagaaaugugacuagcaggcuuugaaggaauagagaugucuuagucagggucacuauuccugcacaaacaucaugaccaagaagcaauuuggggaggaaaggguuuauucggcuuacacuuccacauugcaguucaucaccaaggaagucugggcuggaacucaagcagagcaagaagcaggagcugaugcagaggccauggagggauguucuuuacuggcuugccuccccuggcuugcucagccugcucucuuauaaacccaagacuaccagcccagagauggucccacccacaaggggaccuccccccuugaucacuaauugagaaaaugccuuagagcuggacuuguggaggcauuuccccaacugaagcuccuuucucugugauaacuccagccugugucaaguugacacaaaaccagccaguacaagagagaacucuugccagucaucucacagcaacaccacagaaagcuuucuaugaagcaugcauccugaaaccccaaaaggcguaaccaacccagauacccaggcagagucuuuauuucugcacuuaaguaaggucuucagaguagcccuaaccucucaguuggugacagcuuccaagcaguucccucauggacacaaaugagaugggaauaagacccacaaucacaaaaacaaccagggagucacuguaaaauagcguuucuccuccugaaguaacugucgucugcuggcuuaccaccuccaucugcuaaccuaagccuagaccuggaagcuucuagccucuguacaaucuuaucuuggccuagaaugcuuucagccucugagacuuacugcucaauaaacucaucccuuccuagcucuuucugagcucuggcuggcuggugcaacucagcugcucuggcucaagcuccucuccaagcugaccgaagcaaacuugcuucagucagcuccugacugaauugcucugcuuggccucaaacuaacguuggcaacgucuggcuccuucucauucgcuggcucguucugucuucaccugugucuagcucguucucucucugcauccugucucucuauaacuguccugguaaaacugccuucuuccucucuacuggucucucuuaaguggcaccccauucuucucuguucuugugagacuuggauguacccuagccugucacaucuuucucugguuggucgcuuugucugccacucuauuagacagcacuuucaaacauggguguuucuuuuuuaccaggcuagucucgaacccagaaauccgccugccccugccucccgagugcugggauuaaaggcgugagccaccacgcccggcggguguuucuuucuacaaacuaacuucaccuucauuguucaggagagauuaaaggugugugcuaagggcagagccuaagggcagagccacacuguaacacagacucaggguucacagugugaucaaauauccugcaacaucacagguacaccagaaagcuuuaucaaguuuuuaacuuccuuccaaaaaguuccaacccauuucaaauauaaaacaucaggauccaaugagcugaaaauaauucuuacagacuuucccccgcaacucccccacccccaccccaggguccccugcagccuaagguggcuaggggcugcugccaaggauagcccugaacucuugauucuucucucucuaccccacaagcacugggacuacagguauguguuaagccuggcccucagagacauuuaagaaaaaaaagaaaaagacaaagaaaaaaacuuuccaucauuugucucugacucagaaagcaaauuaagaugaaacacaccacucaccccugcaccacucucucccaacaaggcaguaaguagccaucuuggcuuagcccccuucauuaguuauacagauuugagccuugccaaggggaccacagcuggggaauuuaaaccccuugcucagcuggcuuguggcuuccagcuuuucccuauacacagacugcccaucuauggagucuaggaacuuauauuuuaagguagauauauacagaaugaacaaaugauuaagagagauagugaauacauuaaaugcauguggauaaaauuauaaaggcauaugauuuagugagauaagguaaagaauguaaagaaaaggagagaagagaggggaggcaaggagaggagagagagaugagaagagaaaacgagaaaauuagaaaacgagaaaaugagaaaacgagaaaaaggaaaagagaaaaagagagagaaaaagagaaaggguaucuaucuaucuaucuaucugucagggcuaggagcgagggcggcacaguggggauggagacgugacguguggauucccuccagcuaggcuugagcagucugagugucuaacuuccuccgccuccucagaaacugaaacguggcuccgcucuguagcuccccgaaacccacguuuuauuacucgaauauuccuugcgggagacuaggugacugcacagccgacagagcaucauuucccuucggaaaggaaacuuuucagaucuggcaguuuuucagacagccagagcucuggcucuggaaaauaucuuaaaacgccucaggcuggccucugggcuagcuaucucagaugauaauuagaguucaccgccugcacucucugguccugaagcucgagugguccguaacucggaagcuuccacuuggaaccuggaccuuaaaagacaagcgaucugcuuucggcagauaagaggguccuccucccccuucuauuacaacuacccagaagagcguccgagcauccucgccaaacccuaucucugggcagcucaaacgcaacgauacgguccuucuucccgccuagggagcauguaggagaggcgcuguggcauccucuaaaucuggguaccgcauuuacagaaccaggacaagaaccggagcgggagcaucugcggguggauacgaggccagauccccacgcuuaguagcccaggacgggggacaaagcaaguugguccuuccauccuccucucuccacccaguguccgagauauuccgggugggugaguagcugcauuccagcaugaacuucagcaauacgcuuaccuucauuucucguggcuugggucguggcuccggcuccugggugcaaaugugagucuccucuggaggaggcggcugugcagugacacguggcgcucagggucggucggcaagcgcggaagauggagagcugggcgcgcuccgcugcggauugcaucagcagcgacuggcucagccgcgagcuacaguccgaccucuggcucacuccaggguggagacacugauccccuccagugauuuguaucgcaggaggggagguagcagaggaggacaaaucugaaagcgucuuugauucauuugcuaccuccccagucccucccccaaucauacgcuguacuaggaucuagucucagaacugggaaguuuuaagguauauuuuggauaauaaagaagaguuuggguuuuuccgucucgcucucacgcuccacaccccacagacaacucucaaauacaaccacucuuaccaacuccuuuucucucuaauuuuuauaacauuuaaauaaauauaauagauuuugaauaggagcggguggcuagauggacagggacagugguggauaagggccaacuggcaggagccgguucucuccuuccaccaucugagcccuggauggaacucucacucucagucuguggucuacgcucug

SEQ ID NO: 3478 - RNA, 77398 nt, Mus musculus
cagagcguagaccacagacugagagugagaguuccauccagggcucagaugguggaaggagagaaccggcuccugccaguuggcccuuauccaccacugucccuguccaucuagccacccgcuccuauucaaaaucuauuauauuuauuuaaauguuauaaaaauuagagagaaaaggaguugguaagagugguuguauuugagaguugucugugggguguggagcgugagagcgagacggaaaaacccaaacucuucuuuauuauccaaaauauaccuuaaaacuucccaguucugagacuagauccuaguacagcguaugauugggggagggacuggggagguagcaaaugaaucaaagacgcuuucagauuuguccuccucugcuaccuccccuccugcgauacaaaucacuggaggggaucagugucuccacccuggagugagccagaggucggacuguagcucgcggcugagccagucgcugcugaugcaauccgcagcggagcgcgcccagcucuccaucuuccgcgcuugccgaccgacccugagcgccacgugucacugcacagccgccuccuccagaggagacucacauuugcacccaggagccggagccacgacccaagccacgagaaaugaagguaagcguauugcugaaguucaugcuggaaugcagcuacucacccacccggaauaucucggacacuggguggagagaggaggauggaaggaccaacuugcuuugucccccguccugggcuacuaagcguggggaucuggccucguauccacccgcagaugcucccgcuccgguucuuguccugguucuguaaaugcgguacccagauuuagaggaugccacagcgccucuccuacaugcucccuaggcgggaagaaggaccguaucguugcguuugagcugcccagagauaggguuuggcgaggaugcucggacgcucuucuggguaguuguaauagaagggggaggaggacccucuuaucugccgaaagcagaucgcuugucuuuuaagguccagguuccaaguggaagcuuccgaguuacggaccacucgagcuucaggaccagagagugcaggcggugaacucuaauuaucaucugagauagcuagcccagaggccagccugaggcguuuuaagauauuuuccagagccagagcucuggcugucugaaaaacugccagaucugaaaaguuuccuuuccgaagggaaaugaugcucugucggcugugcagucaccuagucucccgcaaggaauauucgaguaauaaaacguggguuucggggagcuacagagcggagccacguuucaguuucugaggaggcggaggaaguuagacacucagacugcucaagccuagcuggagggaauccacacgucacgucuccauccccacugugccgcccucgcuccuagcccugacagauagauagauagauagauacccuuucucuuuuucucucucuuuuucucuuuuccuuuuucucguuuucucauuuucucguuuucuaauuuucucguuuucucuucucaucucucucuccucuccuugccuccccucucuucucuccuuuucuuuacauucuuuaccuuaucucacuaaaucauaugccuuuauaauuuuauccacaugcauuuaauguauucacuaucucucuuaaucauuuguucauucuguauauaucuaccuuaaaauauaaguuccuagacuccauagaugggcagucuguguauagggaaaagcuggaagccacaagccagcugagcaagggguuuaaauuccccagcugugguccccuuggcaaggcucaaaucuguauaacuaaugaagggggcuaagccaagauggcuacuuacugccuuguugggagagaguggugcaggggugagugguguguuucaucuuaauuugcuuucugagucagagacaaaugauggaaaguuuuuuucuuugucuuuuucuuuuuuuucuuaaaugucucugagggccaggcuuaacacauaccuguagucccagugcuugugggguagagagagaagaaucaagaguucagggcuauccuuggcagcagccccuagccaccuuaggcugcaggggacccuggggugggggugggggaguugcgggggaaagucuguaagaauuauuuucagcucauuggauccugauguuuuauauuugaaauggguuggaacuuuuuggaaggaaguuaaaaacuugauaaagcuuucugguguaccugugauguugcaggauauuugaucacacugugaacccugagucuguguuacaguguggcucugcccuuaggcucugcccuuagcacacaccuuuaaucucuccugaacaaugaaggugaaguuaguuuguagaaagaaacacccgccgggcgugguggcucacgccuuuaaucccagcacucgggaggcaggggcaggcggauuucuggguucgagacuagccugguaaaaaagaaacacccauguuugaaagugcugucuaauagaguggcagacaaagcgaccaaccagagaaagaugugacaggcuaggguacauccaagucucacaagaacagagaagaauggggugccacuuaagagagaccaguagagaggaagaaggcaguuuuaccaggacaguuauagagagacaggaugcagagagagaacgagcuagacacaggugaagacagaacgagccagcgaaugagaaggagccagacguugccaacguuaguuugaggccaagcagagcaauucagucaggagcugacugaagcaaguuugcuucggucagcuuggagaggagcuugagccagagcagcugaguugcaccagccagccagagcucagaaagagcuaggaagggaugaguuuauugagcaguaagucucagaggcugaaagcauucuaggccaagauaagauuguacagaggcuagaagcuuccaggucuaggcuuagguuagcagauggaggugguaagccagcagacgacaguuacuucaggaggagaaacgcuauuuuacagugacucccugguuguuuuugugauugugggucuuauucccaucucauuuguguccaugagggaacugcuuggaagcugucaccaacugagagguuagggcuacucugaagaccuuacuuaagugcagaaauaaagacucugccuggguaucuggguugguuacgccuuuugggguuucaggaugcaugcuucauagaaagcuuucugugguguugcugugagaugacuggcaagaguucucucuuguacuggcugguuuugugucaacuugacacaggcuggaguuaucacagagaaaggagcuucaguuggggaaaugccuccacaaguccagcucuaaggcauuuucucaauuagugaucaaggggggagguccccuugugggugggaccaucucugggcugguagucuuggguuuauaagagagcaggcugagcaagccaggggaggcaagccaguaaagaacaucccuccauggccucugcaucagcuccugcuucuugcucugcuugaguuccagcccagacuuccuuggugaugaacugcaauguggaaguguaagccgaauaaacccuuuccuccccaaauugcuucuuggucaugauguuugugcaggaauagugacccugacuaagacaucucuauuccuucaaagccugcuagucacauuucuuuaauuaauuuaaaauauuuauuuucauguauacuuuaguugcauguagaucuguguaccacaugcacaccagaagaaagaacuggagguacagauuuugagucaccauauagaugcuaggaaucgaacccggguuuucagcaagagcggccagugguucuuacucucugagccaucucuccaggcccuagaggggagcuuuugagaguuuauucucuguccacuaugggagucaccaggauagaacugaagagacgaggcuugcuaccaaucaccuuugcccguggagccauuucacggagacauugucuuuuguguguauguauaagauaugugcuugugucugcauguuuauguguguaagugcaugcacacacaugccaacacuuaugugcugaggucagagagcaacuucucacacucuuugccuuccuuguuugaaauggggucucuguuguuagcuacugaguuaugucagggaagccggccugugaguucucaggaauccaagacauagcaucaccucacuuggcauuacugagcucuggggacgugaggucauagccuuaugguucugcuuuacccacugagccacccagcccauaugauuucuuuauguaauaauucuaggggaacuagcaguucaccacugcucagaauaguucuuuggaaucacucacugaaugacaucacuuuuagaaaugaauguguaugcucuuaaaauaguguagaaauuagacaucuuaccuguaccagcaugguaugucucacagacacuuuucuaucauauaggcuaagacuuuuugguggaaaaugguuuucccaaaacaucugucuuguguuuacugguuaacgggaaagauaauuaaaagaucuuaacucuuauuuauuuuuaaagauuuauuucauuuuuccacuugugugugcccugugaguguguguaccacaugucugugggcgccgucaaagggcagaagauggccuuguaaccccuagauugggaauugcagaugcuugugagcagccugauggugugcuggguacugaguucagauccucuggaagagcaggaagcacucuuuaccacugagccaucucuccaggccccacuuuuguaugauugugugcgguuaucauggagugugggguuauuguugagugggguuaccacugacugggggggggguuaacacagagugugggauaucuaccaccaugcacuaccauacuucaggaaagagaaaauguuaaauaauaauauucuggaaauacagaaaaagaaucaaaguaaauagaaaagacaaacauaagaaaauaauggaagaaaagagcugcugcagacccucggggccccuuugucuguguggaacgggucucuggggcaggugggcaaagcguuggauggaaugauagaugcauacaggagagguuguguagaaucugaauguaauuugucaaaucgagcaucaaacuuuuuauacagaagaaaauagggacacaccagcaagguacaaagagguuacuggauucuuacacaaaacagaggaauacaaacacagaaggucugacaggaaccaccugggauagaauccauuguuaaaaagagcuccaccgggcuggagaaauggcucagugguuaagagcacugacugcuuuuccagagguccugaguucaaaucccagcaaccacaugguggcucacaaccaucuguaaugagaucugaugcccucuucuggugugucuaaagacagcuaagguguacucauauauaauaaauaaauaaauccacuuaaucuuagaagccagggucaagggcuucaugcccuugccauaguuccuauuuuagucuauuguauguauaguccaccuucccccuaggccauuguaaauacguguguauggguguaacucagcuaucuauaguucuaaguaucuacucugguuucuccuuagucucaaacuuccuucuuccuagaugacaguaaauuccuguguagggcagugaguuagcuuuuauucaaagugauaguguaauaccagaggcaauucugaaugucacugaaugggcaacauucuuaaugaauuccaagcccauggucagcucaaggacuuucuaggacuuuggaacacuggcgaaggcuuagcuaugucagaauucaacaagaacugagaggaaaaaaaaaaaaaaaaaaaaaaaaaaaccccaggaagcuauauaaggaagcucagagguuaagagcacugcucuuccagagguccugaguucaauucccagcaaccacaugguggcucgaaaccaucuguaaugggaucugaugcccucuucuggggugucugaaggcaaagacagugcacucacauaaauaaaauaaaucuuaaaaaaaaaaaaaaagcagucuuagauuaaaacccaaaagcuguugaaguuugggccauugcuagguauuguaaugcuaaauucuguaccggaagcuaugaauguaugagugaauucucacucucagguuugcaagcuuuuguugugcaaaccuuguuccuugauuuauaacuauugguuaaauaaaauuggcuaaagccaauuucaggagggauuagagguaggugugcuucgaguuacuuggcugaggaauggggaaggaacuggagaaggaggaagaagaacgggaggggaggaggaagccacagugggggaagaaggcccaugagcauguggccaggacuguaucugggguacaucccuggagaggcagucaggcuggcaguuagaaaaguagauuaggggugacccccccaguaauugucaaagccaaaugaaauaaccauagucugagucucauuuacucuuaagcuagucagggauaagcauaaagugguuaucuacuauaaaaggcagugcguuuacucuuuguuuugauguauguacccgaauauuugaucaguuggugcuguuuauagucuggaccuuagugugugccucugguguuuuggucuuacccgaugucuaccuguggaagucuuguuugguuuugguucuuugagauagccucauguagcccucuaugagggcugcauauaugcauagggaacuucuggcacagaguuugaggucaacuaccgauuccuuaugagcauaaccguaagugaacuguugggaugcucacccagagaagccguggugguuuggcaaaggaacucagcugagaugcgguuugcauccgucccaaaugaggaaauggcagguuugcaccggacaguccuugagcaucucaccaccacacagaaggggaguucugccaagucuauucauuccuccucagcuggcugcgguguucuuuguucugaauauuugugcaucaaauugugaaaucauaauaaguacuucuuugaacucugaagauaaaagauaaaaguuagaauagaggguggagcacagucguggaugccugcaaucuaggcauuuacuguggagguggaggcccgaggaucauucaaggucacucuuaaaucgcuagaaagucugaggccagccugggauguguggaacuuaagauaacuacagccauaaaguaggcagggaggcaaugucuugguuaggguuucucuuauugugaagaggcaccaugaccacagcaauucuuauacaggaaacauuuaauuggggcuggcuuacaguucagacauuuagcccauuaucaucauggcaggaagcauggcagugugcaggcagacauggugcuggagaaggagcugagaguucuauaucuggcccauagucaacagagggagagugucuuccauacuggguguaucuugagcacaugaggucuugaagccuaccuccacagcaaggccacaccuaccccaauaagaccacaucuaauagugccacuccuuaggaccaagaaaucaaacaagagucuauggggaccauuccuacucuaacuaccacauuccuauuaaguguuccuuuucaauauuaauauuccuacuagcuaguauuaaauuaauaagaauuaauuaccccuaauguuuguucuaugcuugcuuuuccugacagcuuuacgaaggguuuucaugcauauuuuuauuuauuuuuacauuuacucauuuaauuuugugcacaccugaaugugugcauguguguuugggcaaacgaguaccacaaguuugagggcagucaggacaacaugcgcucccaucucaaaaacaaacaaacaaagagccuccccaacaaaagaggauauaaaugugucuuuaauguacuaguuauauaaugcaauaaugacuugcaaacaauagcugguuuaagucucauauacuugagccuuaucauagcuugcucuuucuaaggcuacuaggcaggcuuuacacuguguagcuaaaguguuaccuuaguauuuuauuaaaagagcauuguguguucgugugcaaaccagagugcacggaggugagggcacaacuuugagaagucaguucucuccucaccacgggguuccucagguucaggucagcagguuuggcagcaagcaccuuuucccacugacccagugcgcaggucagucaauggagucugcaagagagagagugggacugaggaccaagagacucaaagaaugaagacaaaacaggcuaucugaucaagucucaaguauuguuuauugaaaggcaacuauggguauauaugcacacacuggagagugcagcuggagacacuuaaccacaaguccaggcuguguaggagaaaaacaagauguuaucagaguguguucagccguggugggcuucuugcaaaaacaucaugcuaggaaaacgagucucucgucaggguggaaaaguaccaaccuguaaguaaauagcccgagauggcugcagagaugauagccgcugagucucuccuuggcucacaucauucuaagucuugagaaacagcuguguugagggggcggggcggcaaacagagguuaucucuauggcugccuucaaggccgagaauuagcuagucccuucccucacucaggagaggaggucacagccaucccagccagugcuguuuuguguagcuaccccucugugcuguucauagccugugcuaucuccuucucccauucauaacuaacauccuggguucuuggcuucuacccacagauuccauugcuugccucuugagcauuggcaaacagaugcagacaguacggcuaacagcagaggaggauuucuguuccuggcuugcuuuugacucagaaucaugaccucagguuacuguaaugugcacaugaagcacaugggacuuaugugacacuguguaagccucugacccuacugaaggucuuggggcccugagggagaagacagugacacugaggcucugaacuccugugcagccagggugugugugugugugugugugugugugugugugugugugugugagagagagagagagagagagagagagagagagagagagagaacucagcugcacucuaugggaucugccagucugauuuuucuuaaaccuuaaaaauauuuauuguauuuuuaaaaacugugcgugcaagugugugugcauaagugugugugugaguaugcacaugugaguguacuuacccacagaagcuagaagagggcaguggaucucuuggagcuugaguuacaggugguugugagcaaccucauacgugugcugagaacuguguguucuggaggaacaacaaguacuuuaaacuauguagccauucucuucagucuggggaccauagugauaguuugauuauuuucuuacaauucaaaaauucuacacagauuguuuaagaccagucuaggcuccuuaagaccccaccuuaaaaaagaaacaaaauccaaaaauaauuaaaaaaaagauuauaacacuaaaaaauauuaaagaccccugauuuaccugcuuccuaaagugggacugucauauaucagguuuccuuacagaggucaaacuauguccuguaauuagcaaaagaaaaauagccugcacgggcuuuagaggaaaguaacuuuagaaggaaacuaacuucaguaaguuucaacucuuuggagguccggcuacagcugaccccagugguaaacuggcuuuucuguguuugacucccgcccuccaggaaaggcuaaccagccagcuuccucaggaaaugggacagccuugugccauagcagaauggguuugccaaaagccccaguggauccuguaagcucaggugucuugcucauugcugcccagggcucucaugaugccaggcagcaacugugcucuguggagcucagguucugugggucuuuucugcuccccaaguuauacacagcucaggauucacaaaugacacacgaggucaaaggagcgcuugcaucuggggcgugguggagcacaccccaugagugcauugcaaccauuacugcagaagaagacugucugaucagguggccuaagccagccggagccacacagugaguuccaggccagucuaagcuacccaagaccaucucucaaaaacaaagcuaaacaacaaaacaacccaaaaaauaaaaauggaagcacuucagacccaguacgcaucuucaccacaacaaaugugagggaggcucuggagagguggcuuauuaguuaaaagugcguacuugcauggccuugcaggccuguuuccuagaacccugauuaacagggcaagggacugaggaaaagacaaacucauucaggugaguugucuaauggcugccaccugggaccucagagugcuuauaggcacagcucacgaagagcaggcucgucacucccacaagccaaaacaagaaaauacgcaaaagucccaguggccuaucuguggaaguugggcuaaggcgaauuauccgugaagagguagaggcaguguacugaaccgccucagcugaucuaaagcugacacggaaacaaccacauuuaaaaccuacuuuuguuucauuugaucacuugaaacagagucucaacuaguugagcuggcuggccuggaauucacuguguaguccaggcucuaacacaucugccucagccucuugagugccgggguuaaaggugcacaucaaaugcaggucccuugugcuccuccacucucucucaacugcugggauaaaagaugcauaccuuuaaugugaaaggaggugugugcuaggcuacauuccuucuucacagccagcgggugguuaggcucucugaagacacaugcucagggguggugggaugcagucuaagaugggggacuccaaccccagggugagaaccgacacaggcuggggccaaagcugggguuucuggacacccaggugccucuaggaacuucaaggagucgggaauggaggggacccauaggccagugaggagcccuggccugggggagggaggagcuuagcucagggaugagugucuggaguguggaguguccuucuuugggagauucagucagugaagcucuuuguaugaugcaggcuccucccccagccccuacagguucuugaugagagagauaguccguguuuguccaaacuguuuauucaugguaaaaaugggugcacacaacuuacucaggguggaccagagauuaaauaccuuuugcaggagggaauaucugggaagggaagcuuauuggcuaaacgcuuucaacgggccaucuagauacuucgugcuacaugacuaguugucaggauccucauguggucaugugcuccaggacaggaacugggucaagaguugaugaaccgccuacuguucucagauaaugagaauuaccagaguuucugaauccucccaaccuuccuagcuuuugucuggcgacagggcuccacuagccucgaaagguuugcauaauuuaccaauuuucauacauuugucaaacagcauagcacacacuagacauuuaagaaugcagccgcuguuuuggagcagagcaagacauggcagccauucaguauuguacucacccuacaaaaugugggauugaaccgguuucuucaacuugcaccacuuugccaagaggaccaccccacagagaagcuuggguuuuucagucuccaaccuuuuggguaaagucagcagaaaugacuguugucaacuccaaauugauaccgaucaagcuaaaaucagaauggagucagucaugccuaaguuccaagucacccacaauucuagauucaacagacacaaaucauucccucugccaagcccuuaucagcuauuugcuggugguaaccaaucaguuuguaugucugauaaguauguuaaccgaucuuuugguacaucugauaagcauucuaguuuguggaauaaagugucuuguaauuuuggaaauagaacaauaucaaccaagccaggcaugauggugcauucuuucuuuuuuaaagaaagaauauuugguguguguguauguguguguguguugggggcagcucuaugguacacuuguagucugacuuguggggaaucaguucccacaaaccauguggguuugggggucaaacucagguugucaggcuuggugggaugcccuuucucacugagucaugucuccagccugugguguugucccugguaagccuuuauuuaaaucucucccaaggucugccugucagaaagcaucugcaggagggagcaucuuggcagcaugguucccguuucuuuuuucuuuuucuuuuuuuuuuuuuucuaagauuuauuuacuuauauguaaguacacuguagcugucuucagacacuccagaagagggaaucagaucucguuaggaugguugugagccaccaugugguugcugggauuugaacuccagaccuuuggaagagcagucuggaagagcagucgggugcucuuacccacugagccaucucaccagccccccguuucuuuuuucauacccgcauuuccucucuuaaaaaaaaaaaaaaacaaaaaaccaaaguucucuuucccucacuccaagggauaagccacaaaaguugcuagggcauggagaaaugaauaacuuagguuauugugucccaagcucuccuggaaucagggcaugguaaauccccugucuguccucccagcuuugucucaacaagucacucccaaucacagccaagaauuugugugccccacuaguggggcuccugacugccagacagagcagggccgagacccuuuguuuaaagaccuucauugccccauucucugaagucuggugagucucucagugccugaggaucaaagcuuucaggacaguuugccgcaugcauuucucugaaauuucccagaggcuaaucugggugguuuaggccucuuaccagacaccucuucuguaaccccaguggcaccuggcuuuaucuuacccacccgaggcaccuccugggacaucacacuugagacagggccagaaagaguuugggcaguuaaaaaccagugcugaccauccaucgagagacaccuaccauguggacaaacacugcugcagacauccaucugcuugcuucacggaucagagauccucugcugacagacagcaacugggaggacuuggagggaggaaugagacaggguuaugauggauuauaauccaaaaaaaaaaaaaaaaaaaggaaagugggaaagaaaaauguccuuuuuuuggugaccuuguuguuuuggugaccuugcugguuuaggguggagcuccggugccaggaagaaauccguuaucuuguauacuagaagacaagugcccuucuccacacuccaucuccuugucaugcagucuucucaaacacacagccccaugccgccuugacugcucuuuccugaaaccuccugcugagggccuugagggagaggcaacagauggcuuuauggaaugcaacccagccaguuagcacagccuuggugggugcuccuuggagaggaacaacccugagggcccagaggaccauguguccugaggacaucaugcugucguggaguucugcucugcuugcugcccucacaucccuccuaaucuaagaauugugugaaaacuccaaggagcucccagucccucacugggcugugucucuggcacucacaguacuaaugcuugaugucuuucaggcauugcugcuggagcagauuaaugauucaaucgccacccgaggagagaauuuaggauguagauugccagcaaugaccaugaccuuuagaaaaaaaauuuuuuugaaaaauaaaauuguuagugaagcgaaguuaagauguuuuuguaauuggcucugauguagaaaaaucuuagggaacaaucugaaguucaaaaaggcacaucuuauuaguuaagcuagggacuuuuuauggucagggaacaagaacaaaggcagcacugauugacgugacucucacugaggcugacuagugaugauugacucuggggauauaagguagauaugacugaagguugguuuuuuuuuguuuuuuguuuguuuguucguuugguuuucugagacaggguuucucuguguagcccuggcuguccuggaacucacucuguagaccaggcuggccuugaacucagaaauccgccugcuucugccuuccaagugcugggauuaaaggugugugccaccacugcccgguucuaugacugauuuuuaaaaggauaaauaauaaaaaaauccuuucuugguaaccgaaaauuacugccucccaguaagagaaacuggcugaguaaaccacacugcuugcuuacacuuuguuaaacuauaacaaguugcuuaguuacaaauguacguagguucuugggaauaauuuguuuucuuuaccugugcuacaaaauguuguuucuugcaaagguauugggaaacauacugcuuuuuucauaaccauucacuagaacuaaaacccaaucaccaucauaauuuuauacugcuugaaagauuuugcugggauauaaacuaugggagaaaaaauagcguuguugcagcaucauuccuuccaccugcuaacuguaacuguguguauauguauaugagcaagccagcucagucagucaaagaggucuugagggagggagugagaauugaaaagaaaaagacaauuagacaauacaguaacaugauuccaaccaguucugaagcugaacuggguuuaauuuuuuuccagucuguuuuucuauagcucuaggcacaugcugagaaugcggucaguccugaggcauaugcagaguaguugaacaacaaagcauagagaaaugucccaugauuacuguauucaggguccaacaagacccaucaagauacaaaguacacaaaccucagcuguauucaccuggagucuacuuccuuguccuagcccaaugccaaauuccugccaaauuccuaaaucaacccaaagagcucuccacaccuccccuguuuuauuucauaaacaagaguuccucugucuuagguuguugagacaagaacaccuuccuuacccaucacggaauauguauucucaaaagcaaugaguuucugucuuaguuaagacucuguguggaaucucauccaucaguugacugcuagguuguuaaauuaauggcucugucuggggauucauuuuuaguuucaagccauguauuuuggccaccaacaugcugauguuguuaaaggcaaguuuuauugaaauggacaggaauaaaaguauucccaggauaagaagggccaacaugaucaagcuauauaagccacucuugaagaagcuugacuuaagauggaaauacuaaccuuaagccacaaauuauuuuaucagcaguaucugcaguauucuuuaaauucauaaucuuguugcacaaaguuaagauauccagagagguguuagaauuacgccaaauacccugcaaaugucuuugaauuuucucccaauuauagugacuaucuuuguaaauuuuaguuguaacacaaauccauugguauuuagcaugacacuugagaugucuuccuacucuuagacucugaaccuccucuccaauaauuugaauaguaucauaaagggcaucaauccauuguuccaaacgcuuaucuaagucuucuugaauacucagagcauuagaaacuuuuuuuuuuuuuuugcuaaaugauuaacaaaagugguugucuuaacuucuugugucaaagcaauugcagaagccgugguauuggcuguuaauguaaucaaagccucuauaccagcaaugauaaagcccacuacccucuugcuucugauuaaaacuccacucacuucuuccaggauuuguaggcuuuuuucagaaugccaagguccuguuauacucacagacaguaaaacaaaaguugguugauagacuaccaugacagaaaugccagauuugaacacacuaacacaauuagaaaguauacaaucaacucaacuuauauuaaauacuguagaagaaacaaaaguaaucuuaacaugaccaauuaauaaaagauuaggagcuuuaacacaugcacuaacacuuguuugaaauccagacccugucccaauuuugucuauugucaauguaacuucauagagagcgguagcuaacuuccaaauaugauguuagaaauggcaucugauugccaaaggccuauggacaucuccuuugcccaguguuugauugauucccugcccaaucaauaauucacauauuauuggaaacauuaaaccacauuggggguugauuauaacauuuucuccauuuaacaguugugugaaaugcccguuccaccuucuuuguggguucagacccacaaggccauaucucaagaggaucaggggcaggucccucauaauauuuaacuguguccaucucuaugcuuugaguuacgguuugugaaauguuuuucuuccacaucugaaugaacacagaaauacacccaucauuuguacuguucuucacaaagcaaacaggaaucccaucaccaaaugcauugaaagucaugguuuuauuauaaguugacucccuugcccagggagauccaagaaguguaucaguggugggucaggaacauaggcccaguggacuucacugugugcaggaaucgucaucaucaguaagggaaucagcaggaaggugggggggggggaaucagcaggaaggugagauuguuccauguguugcaccagcucuucgggcagccaucaugcuccauuuaccuuccugugaaaaaacauaaauguggccucuuucccauaugaguacagggucagguccaugcugaagaacugcuguggguacaugagcggcagcaagaacgcaaacagccaacacuuggucauagucuguauaauguaucuguuguuggcugauggcuuccuacuuucuccagagauauucaucucucaucaguuaauugcccaggggaauuaggauauacaucacccuugagaauaucucuccugugguaagcuuaagaugaggucuuagccaauuaacaucuccuaacagcuucuuaaaaaucauucaaaguaaguguuaucuuauuugaauuuucugugccacaauuuguuuaggauauaacugaugucccaaauauugaaaaggacauauuguauuugaaucuuuucugaagcaacaacuaauucccaagauuuuaaagguuguaguagagcuccuucagagggaucagcuaauaaaauaucuaccauuuagugaacaauauacacagaaaaauucaauguccuaaucucuuauauugaagcagcaacaaacaugacauaauguagggcuauuggccauuccuugaggcaaaacuuucauaggcucucucucucucucucucucucucuuucuuccuuucucucuuucuuucaugcauaugaguauacuguagcugucuucagacacaccagaagagggcauuagaucagauuacagauggcuaugagccaccaugugguugcugggauuugaacucaggaccucugaaagagcagucagugcucuuaacugcugagccaucucuccagcucccauaggucuuuaaauuacaagcaggcacacuaaaugcaaaccugugugccugugcaaccaucaggaugugaaagaacaguauaaaauaguauaaguuccaugguuucauuaauuuuuuuuuuuuuuuuuuuuugguuuuucaagacaggguuucccuguguaguccuggcuguccuggaacucacucugucgaccaggcuggucucgaacucagaaauccaccugccucugccuccuaagugcuggaauuaaaggugugugccaccaugcccagaguuuuuuucuaaaguaagagaccacagaucuacccauacaggaacaucacuuuuccaaguaauuuuaucugcauggagugccaauggucuccauuaaaaauacccaaaaccuguuuaccuuugcuggggauagcuauaaugggugcuaauucucucugauuuugcuuuccuaaccuuugguuaggcaaauaaccacaaucaaauauuuguugaguaacuauaaagaaggagagaagagaggagaaaggggugagagagagggguaagaaguaagagagugagaaguaagagagcaagcagggacugaacagcccuuuuuauggucuuuacuguugcuagguaacuggggaggaguuuagccugaaggucagaagcuugggccauugccaugugacuucuagccaugcuucucuugugggggcuguggggugcgguaacuuagguaggaaccagaguuccaggagcaugagggaacaccuaccgugucauauaggugaauuaucacccuucgggguucagaccucagcucaacuuuagaccggccugcaauucuccacaguggagaggccaucuaucauggccauggugaauggagcaguagguccauacugagcacaggcaguuuucaauuccuuuagcuacuuaaaaggaaugggagugugguaucuaacagguucccuucuugauccugugcuucaaggacacagggcauugcagagcauguccuuguaugucuuccccucguucuacagcuguuucaguccugccugaagaggggauaacagaguaacucuaggauuuaaaguaagguuuccccucauuucuguugcucuuuaaagacacuggaggaggcaaaaccuucauuuuuuggcucuacuauugaugcgaccuccuuggaaucugaacuuucgaugcucuuuuguucucugagaacuugcucaagucuuucaacaagucgaacuaauucuuguuguuucaucuucuucugucucugggauauccuugccuauuccuuugcaaaaaauaccuuaagagaaucccgaaaaggaggccucauuaugauacuuggcagccuuuuccucuaguucaaucuuaucucuaggaucaagaggcgcgucacucuuuccugccuuguccaacgccucagaaauagguauggaugggaaagcuuuguuucuccucuugcuuucacuaucugcaucuucuuuuuuuuuuuuuaagauuuauuuauuuaauguauaugaguacauuguagcugguuaugagccaucaugugguuucugggaauugaacucaggaccucugcuugcuccagucccguucccucuggcccaaagauuuauuuauuguuauagguaaguacacuguagcuaucuucagacacaccagaagagggcgcaucagaucucauuacggaugguugggagccaucaugugguugcuggaauuugaacucaggaccuucagaacagcagucagugcucuuaacugcugagccaucucuccagccccugcaucuucuaauauccuuccuaauuccauacuuucaugucuaggaucuaaaguaucucuaacugaaauccaaagacuaaaaucaucuauggggauuuuuuuucagggccauguguucuuucucccaugucuguaaacuuaccauaccuuccucagagaaccaaggacaaauuucuucuauuaaaagucagaaacuggguaagcuguuuuugacuuaucuuggcuccucuagauuuuagcauaucuuuaagcagauguauaaaaagcauucugccauuaccuugccccauucuuacaggguuuacucacugcuagccccaauuuucuuauuuuccuuugcgcacgcuuccuuuucccaauguguccuucacuguaccccgugugcuugagcccuccauguugagauaccaucugaccaagccagcucagucagucaacggggucucgagggagggaaggagggauugaaaggaaaaagacaauuagacaacacuauaacaugacuccacuggggaccacacaaacagcagcuuucuguggucacgaaggauguacauucaagaaggaagauguccuggguggguuuuuaauguccacuugacacacuccagagucaccaagaagaagagacguaccucucuggucucugcugccccuuuccugggaucccagcccugcaguacaggagaaaagucugauuaggacaaaagucuaggaaggugacucagcagcugggcuggguggauguagcaagggagguuaaaacaggaugcagcccugagguccacugagugcagcugaggagaccugggauaagccacaaaaguugcuagggcguggagaaaugaauaacuuagguuauugugucccaagcccuccuguaaucaaucaucccucgaugucauaggcagcagcccccaucagugucuggaucgacauggucagcugcucccagcacugaccccccccccccaccccacuggcuaccugccucgguuugcccuguggugucagagcuggucaccagugucuggaaucugucuuugguuucuuuccaauuaauguguugguugagaacuccaaugcguucacaggcuucauuuccuguccgcagcucacgaucagggucuacacugagcucccaaccagucagggcugcauagugacauugacaccuuguuuuagagcaaagugaaaacagaggcagguaaggucuuuaaaaaugugauuuucaagagagaucauuuguuuauuguauguguggguguggcuaugguacacuuguagucugacucgugggggaaccauguggguuugggggauucaacucagguugucaggcuugguggggugcccuuucucacugagccaugucuccagccugugguguuguccuggguaagccuuuauuuaaaucucucccaaggucugccugucagaaagcaucugcaggagggaacaucuuggcagcaugguucccguuucuuuuuucauacccgcauuuccucucuuuaaaaaaaaaaucaaaguucuuucccucacuccaagggauaagccacaaaaguugcuagggcguggagaaaugaauaacuuagguuauugugucccaagcccuccuguaaucaaggcaccguaaauccccugucuauccucccagcuuugccucaacaagaagccacuccuagucaggguggaaccgggucacaacaaguguaacuaccaugccccuccacuuaucaaauaagaagaaaagggucucagcuguuuguaacauguacuguuguuacaggagaccugcguucauuucccagaacccuuguuugguugcucacaacagccuguaacuacaaugguauccagcaaccucuucuggagucugaaggcacccacagggccauacacagaggcacacacuucacauacaauuauuuggcgaggcaugauacugcaugcccuuaagcaucaguccucagaagccaggagcaagauuguaucugugagcuucgaggcagccuuguuuauuguauugaguuccacaucagcugggcuacauaaugagacccuauuuuaaaaauaaaucuuaaaaauuuuuaauugcaaaguuauuuuagaagaaaaagaggaaaagggaaaagcagcccccuagcaaaucuuugagggguaacuugagccauuaagaugauaaacaugucuaccauggcgacucaacugugguucugagaagccuacagcaugcucuuggguggaucuucuuggcgagucuuagucucaguuucugucugucugucugucugucugucucuaaauguguauaguauuuuguuugcauguuugcauguguaccaugugcaugucugaugcugugggggucagagaaggguguuggauucccuagaacuacccaugauugugagcugucucauggcuacuaggaacugaaacugugccucagcaagagcagccagugcugagccaccuuuccagccucuuaauuuuauuauuauuaccauuuaagauuguuagugcuggaguuugaacccagggccuugcgcaugccaggcaagcauguuaucuuccuagcuuucuuucuuccucuuaacucuuaaaaaaugucuuugccugaacuccaguucugcucucucucccucaaaaaccagggauccaguuuuaccugagauucaaggucucuacagggcaaacagaguuccucuggaugcugugauugacaguucccugcccaaacugacaauggcacuuaagguuauaaagagcucaccaggaccaggcacacccuuggcacugucaacuugaugggcaugcucagccugcugguguuugcugugggcuuaaugacuucccaaggaguggugggugccugacuacgucauuuuuugauggacacagcagucugucgaaugcccccaaucuugugaaccagugagguuauuggagggagucuauguggcguuaugagaacaugggugagggguguccuuguggcuuucuccucagaaccacgcacaguuuggaguagagacuaccuugcucaggcagggaacaacacaguggcagcuaggucuguguguagugguaaugguacauugacacuuccaguuuggucacaggacccuuccuugggagucuagcuauuacuuccucccugcuggagcaggaaggcaacagagaggcaggccucugggaugcagccgcugugaaucagccaucugugaugggugggacuuggugugugaugcagcuguuuggggucauucaugcuccuguauccauugucaccgaauugacuuuucugggcucugaaccuuggucugucauugcuugguacgcuguagggggugaagagcuugcucacagcuucccagaaaaaguugauacagcaugggaugacuuucaggaacacgggugagucaggcaacuacugucugaacccugccugggugacaauucuucaucccucagugagcuaccuccuccaauagacuccagugccucucuugaccaugugcauauggggcgggagggaaugggugcuggacucucagaugugucugugucgucaugcuccaaggacagaguuccacaaccagugacaccucacacauaacuuacugcauacaaauauuaauuuaaguaaaaaauggagacagucucauauaguccagacugaguccaaaugauucucuuguuugaggcagggucucacuaaguagcccugacuguccuggacccauggagacuuucugacucacagagaucacccugccucugccucccaagugcugggauaaaaagacuugugucaucacacccagcugaccuugaacuccauucuacuuacugcccgugugucccaggugcugugaugacagguguggguucccgugcauuccaagugugauucccugcauuuccauguuuuguugaauguguagcacucuuaugagagaaaaaacaaacaaacaaacaaaaaaaaaaccaaaaaaaaaaaaaaaaaaaaaaaaccuuugguuagcaguucccugcagacuggugauucaaaaauucccauuucucuauuugcugggacucuuggaucuuugcuggccaucagcugcaccccccaccagacacgcccuccaccuuugccugugcugaucacuuccugcaaauaugcacugcaccugcuuccuagaacugggcagacagguguggacuacauaugugcuguguucugccgugucugugggcucugugcuuguuaaccagggcacaccagggagcauagcaggcuugcuguggucacauguguauccuccucuguccccauuuccuuuccuuucucccucccucccuuccucccucccucccuuccucccucccucccucccucccucccuuccuuccuuccuuccuuccuuccuuccuuccuuccuuccuuccuuccuucuuuccuugcuucucccucccucccucccucccuccuacaaaauuacuuagagaguaaaaggcuucuuuguggcauuuucauaauacuuuugcuuuaugcuucccccuucugccaugcccuuccucucuuacauuacuuucuguuagguauuuccucacacuaaccaggaaguaacuaauauguccagaauuaacuuuguauccaauaucacaggucuccugggaauaauguaaauuaugagaggagaaagaauaggauuaguaugcguggcuuaggcugugaauacauccacacaugucaggcagggaucugcaaccccagcagcaggaaaucuuacacucacuguccugguuagauuuuugucaauuugacacagacuagagucaucuggaggaaggacgcucaggugagaaaaugccuccgugcagacuguccuguagguguggucuugguuguugauugcugugggugggcccgguauaccuugggcauugccaccccugggaaggugguccugcccugaauccccucaaugauggauucugaucccaauaugugagccaaauaaacccuaacuccggagcugccuuugcucaugguguuuuuacagcaacagaaagcacaaagauacacuuuucccauggacacaggaugacugcaaagcuggagauacugaagaucacuaaaggggcuugaggcuggagacaggcagagguugcugggcugggcaaucagggcuugcuggcaggggcaguuccuccaguuaaaucaggaccagauuugagcagcaccuuuaucuuuauguggucaucaugacgggcuuacgggaugcuccccuucugucugcggacggcguuaugcacgugagugcagugccuguggagaugggaaggaggaguuggaacucccggaggacuggaguuacaagugguuguaaagaaagucuccugugugaguggcaggaaccagauuccaguccucugcaugagcagcgagugcucuaaccauugggcuagcugccccuccagcucuauaacuugaauuuuaagagcaaaguaccaucuagugccggggugcguguacucaggaggcagaagcaggcagaucgcugugaguuugaagccaaccaggacuacggagugagacaaaaguguaaaauaaaauguccucuaaagucuugaaggaaauaccuguuuuguuuuagccucauuuaauuagguuuaaugucucccacucagaacuugaaucuauuuuuguaaaauacaaaacuucgagccuaaguguuuccaaacaaacacugaaaucucuaaucucuacuuagacucugcaucuugguccaucugucacuccugugacagagcuucaagauggcuggaggcuuucaggcuaaggcagagauaaugagcagcccauaggagagugggggaguaagggguaggcuuggcuuucuggccugagaggagccuggggugucagaagcauuuagcacauucauuuuccgugugacacuggacugccuuguaaucuguccguauauggccacccugugacacauuuuguacggcagugugagggaagaggagacucccauuaccaggucaucuguggacugucucucagcaggcuugcccugugcagauuauagaagcagggguaaggagauuuaaagauuaggucauggaguguuaauugauuguucuugcaaaagggacaauuggauuuaagauuugugaagaaaaugcaaacacacacaaggcaggcagacagacagacacaacacacacacacacucacacacacacacacacacacacacacacacacacacacacacacacacacacggugaaagaauacauucagaaaaaagaaaauaccagcacuguaaaagcaaguuacgccuuuuuaggcagagcagcaaauugauuugcaguuccaucucaagugcucccuguccacguugugagauaacaaagauucaggcacuggggaggucgccugguuugagcuuagcacacaguauaaccuggucguggaguaauacucuagcaauuccagcacuugggaggugauugagggaggagucaaaguucaugcugugggauacuuagugacuuugaagccagcauugguuaagugagacauugucucaaaaaugaacagacuuggucacaguggcagguagugaaccacagcacagauuuuucucuuuauuacuguuguuucagucaccaucuauagccaaguccaguuguggaucugcaucaaucccaucuacugccuggcucuuuugaugcagccgagugauacucugcccaauaggcauggcaauaugucauuaggagucauucauugcuauguuucuuuagcagaauaauaguagguuuuccuuuagucccaugacuuauccagucucaguuuggccacuucagcagugcaauguauggguuccaucucacagagugggccuuaaaucuaauagaaaaguagccaguuacucccauaacuauaagugagggcagaaaggaaagcuuauuugaggagucaaaaugcugugcugucuuggcaggggaguguguguguggacagagcaggaagccuuuaggcgucaggaaaggagaggucaaggccagaaaaguguagguguuagugcaggguuaguuaggaacuagaugcccuugccagaggucagguccgcaagggguacaguggcuuccuugguaacacaauccugcaauaggagauugcuaucagaugcugauaauuccccccccccuuuuuucccuuuccuuuuguaacaauccuucuguuuaccugaucaagucagaguccuucuguuuaggacacaauuaccugcauugccauuugagggccauuuuguauccaacaauaacauuuauguaacuuuguauccaacaguaacauuuguaccacuaucuccccaugacaucuugcagucaggucuccguuguggaucucaugguucauagauggguaauauuggugauuacuuuucuccucuggugguaugugaugaaguaccucccagugccaugugugcuggucuggagggguagagcuucaguuaggcugauauucuccauguuugaugacauaugcaaauuaugucuucagcaaacagggcuuuaccauuagcuuauggagaguaaacaauagccuuggcuauagacugugauguuugggagaguccaugggaccccuuuggaaacaagucucagaggugaacaauagggagaauggaggcccuguuauuauuuagcucauuaaaaucaguagugaaggcagaaaugaaggaguuagcuucugccaccugagugcgaggacucaaggucagcuggugguccuuggagcugguagugauuguggauucuaaccccuagguugguuuguuugcuugcuugcuugggaggcugggucucacuguuuguagcacaggucgucggaaacucuuagcaaucaucuuucaucagcccuucaagggcggggguuaaaagcgacagacaccaccccgcacuaacaggacggcuguuuugccugaaccauaggccguauggugguugcaucggaggcuacuggcagggaacagcgaggcagaguccacguuucgaggucagcaacuguaggacuguugcaggcgagagccgaagcacaaaugcaggucccugcugcaaauccagaucggagagagggcccuugugaugcuaaugugucucugagauguccagagcccugcccuucagaguuccuuaguaaagugcgggugcuccugagcccucuaugcgcgugcccagccaugcgugacugcacgcacccgcaacgcggagaugcugcaucggcugcgcucgccccugcgccgggugcuugcugguggcucucccaucguaccucuuucacccgccacgccaaacugcagucccgggcugucgggauccgcggugcgccacgagucgccgcugugccacguauucccacgcucccgcagcuucgucauggccugcuugcccagagcaacugcaacccuggcccgccagguaccugcguggcgaaaggcgaggggcgccaggaccagcaucccgcggggacucacucggggggcggggguuacugcgguagggcgccacuaggcucuuggguauuaccgcaaggcaacacuggucgcgaggggaugcggggaggggggcggggcugggggguuacggcgagggacuuggaggugcgggggaacucggaggucgccacuaggggacucaaggauggagauaauucaugggugcucguggucgccacuggggacuccggagcuaagagugucuccacuggggaauucuggggucauccuggggauuuucacggaggacacuacuggggacucagggaucacuguggggauuuaggggucgucgcaagaguugcuggggucacagacuagcacggagagaaaacgugcuagacgagggucgccacaggaucuugggcacguuagggaugaugugauggcuggggaucaccagggaugcuggagucuaggcuaggaaaacuggaggauuaaagggaagauuuugccaccaaaacauccagaccgcugccuuugcagucuuggaucccuucguucccucuuucccaguuauuuagcaaacuggcuuccagcuuuugaaugccugccccuuucccuaguuaauucggaaccacgguaucauuuauuuauuuaauugcuggcaguaucaagagaucuuguuuuucaagugcaauguuuuggccgccgccaaagcaugggggacccuguggguggagaaaaugguuccagccaguccgcauccccucacgcuuaaagcagccugccuauugugcgcccuugauugacaagaccacgaggcugagcgcgcucgggagauuuuuuuuuuccccaccccuuuauaaauggcuuaaacccucguucuagacgacuuacuggacauuugggagacaauugccuucuuguucuuugcuggagaaccccggcuccugggcugacccggaauuuaaggagcuccucccuaagcugcgggaagauacaaggcagacuugggaccgggugggaagccuaggacaggcucuggcuggagcuggccuugccuguuggacaguacagacuuggcuuuucugucuucugugaugguaagucccuugaccaggucccgcacugacucaccuggcuuuacuuaauggagguuuaauuauuuuuauuuuuaaggacugcaguaauggaugcuccgcgccguuugcuggagaaagaggaucagaagaaguggcggagacuuuuaggguaaggcauuugcuggggugguuaagugacugaguuaguuaaugcauuucagguugagauuaggguuuggggaauuuaaagugagugaguucuugaauuuuaaauuacagccaggggaaaagccauuugagauuaauaccagucagcaaagcaaaauuugccuaacagcaagcugcuuguuuugucuuaugaauuagacauuuuaucggaaaagagcgaauuaaugaauaggaacuggagguugcuuuuuaaauugcaucagcuuaacccuucgcucugcuugcccaagaaaagggcucuguacuuuuucuccuuaaaaaccacggagcacguuuacagucccagacugcgauuucuuucccuugcauuguuugguuuauguaugggcacggucucugcuucccagcggaguuauuggagggacagagaucuuauuaaagcacuugacagcccuccauccuucuccaccagcccccagccugaaggguuuugcagaucuucgugggugcuuggcucugccacuuuccuggcucugauacucacugucaauugucacccauaguacagaaugucccugugaccucacauccuggcaggguucagagagggacuggaacuugagucgucuguuuugaaccacaggggacacucaguguucagggacagugcuaggagcacgaagcggaauggugaauucaggauaagcccucugcucacaaagcgauuuguuuuaaaccaaaauauaguaagauauacuacagugaggugcuguggauucugucugugugauuucugguguguuaacgcaauuuuccuguagcacuuccgagaggcccacauuggucacgugugagucacgugaccagucaguggagcgggggcucaguucuuuaagcaccuccaggacucagcucuaauaaacgaaacauuucgggucacauuggcugaccuagaacuauacaggcuggccuugaacucuugcuaccuuuuaaagacaauaauucaauaaaucaauaucucaaaaaauuauuguaugcauuucaacugaaaugacuuuaugguuuuaugcaaagcauucagugcaagauagagcucauagugaaaaauaguguaucuguuaauugaaauuuguacacguccucugcguagcaauaguaaagcgugaccuacucuccuugcguuuuagguguggacugagaguaucgauaaucuggggacuagaaaugacagguuuuauugcuuggcuuugcauggugcugauuguugaacccaggccuuugcacacacuaagagccucuauuacugagucacacacuuagccgugaucccugcuucuuacaguuuucuaucugcuaaggaacugcugcuuuccuggucucuccuccauccucuucuuauuauucuguucucaauccucacauauuaaaaaagugagggugcuagcugggccaagaaagcaguucucucucucucucucucucucucucucucucucucugucucucucucucucucucucucucuccuuuuaaaucuaauucuucaaaauaaaaaaaaucuauugucauuuuaaaauuuuuguauauuuguuauugauaccacuggugcaugugugguaucagggguaaguuggagggguugucucucuccuuucccaccaagacuugagcguucuggaaggagaacugucaggcugucagucaggcuuguacagcgugcuuuacucucuuugugggccaauuuucucucucucucuuuuuuucucucaacaauuuguuuuuaagugugccucucuguccucucuguccccucucucucucuguuugugcgugcgugcaugcgugcgugcacaugaaugaguucccuuggagaccagaugcccuggguccucuggcacuguaguuacagauggcggugagccacuugacacucacuguucagggaauugaaccugguccucuggaagagcugccugcacucuuccggcgagccggcucuccugauccuuucaccgccuuuguuuaagaagcuguauuuacuacuuuagacuuuuccuauggaccucagagacgagcucucuucauucuaguuuccucugauuggccucaaagcuguagaauuuucuucuucagaccucauuagguucucagagaaagcacggacucgaugagagcagucucucucaguggagcagaagcgugcaggagcucccugggaagccccgugcuuccagugcugaugcaccgcaccgcgggcuuagacuaagcgaguuuagugaguuuccuuucguuuccagugcagagaagaaccgaagugcucaggugcuuccucaucauggugucaaagcagaaaacuguuccccccuuuuaaauuaaaauauguuugcacgugcuggcuuacuuccuuuguguauguguguagguaccugcaugugcaagucagaacagcuuuuagggguuaguucugcccuucuacugugugggauccacguagugaucuuaggucgucaggcuuggaggcaagcaucacugagccguauagcuggcccaggaacuuguucuuaauaugcccugugucauuucucaguuacuaggcugcccuguuuucuuccaaugaucaugauagaaagcaucgcuguacaaaggcugguuaguuagauuuccccuuccccacuuuguuucugacaggggucucauuguguagcccuggcugaccuagaacucaccagguagacaaggcuggccggcuagucuugaacucaggaaucuaccugccuuagccuuuuaaaugcugggauuagagauguguaccaugccaucugacuuuuuaaagauuuauuuuacuuuaugggugcuucccuccacauggacuaugcauauuugguguccacaugggccugacaggguaucgaugcccucggaccagaguuacagaucacugugagcugccaugggugcuggaauugaaccaaggucuucugaaagagcagcuggugcucuuagcuucugagcuaugucuucaggccucacauccaccuuccuuugacuucaggccuugccuuuaaucccagcacucaguagacagagguugcuggaucucugagcucaaggcuaucuggggcuauauaguaagacccugucucaaaaaaacaaaaacaaaaacaaacaaacaaacaaaaaacaaaacccuaacuuuuaaucucuagaauuauggaaauugucucaaauaaaggaauuuagaguuucuuggugaaauuauaaaggccacaagaucuuguguuacuuugaaaaaacuggauauaggagggaaaucuuuauguucaaaucuggauuagagggaaauggucaggggagauaaccgugauucccacaaacagagggaaugccuggaaauuuuaucauuuagaguuucgacuaguauucaaagguuagaauuagagcgccgauuucacuuguuuuuugaccuacuuaugaguuuguauagauguugccgugagugcaguggcuucagaggccagaagaggugcuggaaggcccuggagcugaaguuaugcuugucucugagcugcuugauggugcugggagugaacccagcuugccugugaaacagccucugagcugucucuuuggcucuagaagaaaagcacuaaguugaauauaaaugugcucugugucucagcuuggcccuuaagcagcucuggugcuucggucuagccugggguaacugugggugggccccguuuuucugcuucuugcacugcugggcauugugcccaggacuuacacacuguagguccugccccugcagcuuaggcucugagaagcauuuuaggcaaaggguucagaguuuuggucuagccuuggguaacugugggugggccccacuuucguuuuucugcuuguugcacugcuggguguugugcccgggacuuacacacuguaggcccugccccugcagcuucagcucuggaagcauuuuaggugaacuguucagaguauacaaucauauuagugacaccuugauuaucuuaacccguggauuugaacucggggccccuugcuuucacggcaaguacucuuucucacugagcucucucccuacugugggaagauuuaaaaucuauaagcuagaucacaugucaaugggcccaggaccuccaaggggccagaggcugagacauuuugcucaaaguuuugaaagugauuuuuaccuuggcagacagaguucgaacggagaacugucuugcaguugaucucagaggcuuggggccugggccuggaaaaucacugguauggagguggggaagccuggugaagcuggauaaagcucagcauugcucagauucucuuaauuauaucuucucaccacagcuggcuugcuuguucaacuacuaaacugccaggaaauccaggacagucucaccucugcaggccaggcaucccugcucccuccccgcaggcaggugccugcaaagagcaauaaagaggcuuccugaguuuauggccuacuacuuccugggaaggagauggcaaaggcuguggucucagcaaaauagccagaggccuuagagaguuaguauauaggggcauagccggcuauccugguccauaacuugccuagcuuucccaacugcaauagcuguagaccucugaccuuucaccccugcucucuccuuccucuucuuccugcagcaggggucuuugcuauguccuacuuuguccaucugccugaaauacauuacuccuaggucuguagacauccugcuugcucccugcguucaggugugcucagacacacgaggcaggccucugcaaagccaagaccaaaguccccuucccugccucuucuuccgaguuccuuuaauucuucagagcauuaaucaccuugaucuaguuuccucguuauuucuuuaucuccccuuugcuugcagagcaaggauggguguuucuaaugauccauggcauuaaagauacagaguagcucaaaaauacuaggugggagguuuggauaauccauuguggauaacccaugccaacuuggguaacuguccuuggcuggcagucacaguccaggaagcaaggcagucucuguauauucuguacacucucugagccucagugccucugugauuaaagcuuaaauaaaauuaaaaaugcuaagaauaauuacaaaagaaugcugauauugaguaacgaggaaaagcgggcacccucaauauugaugagacagagcccgaguucacuuucaaauuauccuaauucagauggcgagugaagaguaacaacaaggcucagguguuuguuuuuguuuuuaagcuugaagacaguuauauuaaaguucaagagagaaguaguagggugggcaagcuguaaauuuuggcagcugccuggaggagagagagggguaaggagaggagagaagaaagcccugcuguuuacugucugucuguccauuccaugucaggaaguaguagugcagagccugggaaugcagugaagugaggguggugugcagucagccagagugagugaagcuggggcuggaugagaaauuucgccagaucuuuugaagagccaugcacauuauugaugauguuguuuagaaagaaaaucagggccauggaugaccuaauggguaaaagugauugccguguaaaccugaugacacgcgcaucuuugaucccuggugccugugguggaaggaaagaaccaaaucccagaaguuguccucugagcuccccagggcugcggacuaugcccgcauucaugcguaccauguguauguacauacaacaauaaaugaaagucuagaaagccgaugucugcuggcuucuccguguuuaagauaugucuagaauucagucucaccguucagcucacacugaccaucuaacagacacaccuguucugcgucuuccuaaacguugcuaauuaucuuauugucgggaacugugggugggggcuggggauguagcacagcugacagagugcuuggcuagugugcgccacucagagacuuaguauuggagaguuuuaagccagccugagugacaagagacucugccggacucccccuguccccaauaccaccaaaagcuuucuucuucacaguuucuuuuuaauauuguacuuuacuuauuguuguuguuguucucuagcuguucccaaguuaaggaucagaaccgaggugacuuggguuugugacaacggccgagcuggcuuuguggagaacagcugagugcaguuguuuccuaucuuccuguuuuugugcggcugaauaggagggcuuuuguuuacugucugucuccuccuaggacaggguuugcaucugcggcucuauucucucucugccugucugucuucaaagaggagagcacuucuuugcugucugugcccaucugugagccuccguaucuggaggagcuggggacaugugauuggaaugcucuggggagguggaggcagccauagcgggcaguggcuggguccuuaaagauccucccugcuucugugagcacugcugugugcccugaaggaugcucccugcuacugugagcaaugcugugugucuucugggagugcuucucuggggucuggugagaaucgggaaucauuucaccacaucucccacaccccuaaaguuugcuucucauggcacuacaaccgaagccauugcagggauuuguuugugacuuagccuugcuguguagccuuggcuggccuggcacucacuuuguugccuaggcuggccucacauuugugucucuucuucuacuucagccuccugagugccaggaugacgggcguauaccaccguauuauugcaggaauuauugaguuuuauaaaaaaaaaauguauuucuaaauucguuugauuuuucugaaauaaaaguguguuuuugucuuuacguaugugugugcauacaucaugugcgugcuuggugcaugugaaggucagaaagacagcauccgauccccacgaacuuuguauuuaagaaugguuaugaaccaccauggggaagcugggaauugaacuuggguccuccgugagagcaacaaaugcucuuuuccacugagcugucucuccggcucuaagguuauuauuauuauuuugcauuguuaauggcaguuauuuauugcuuguggggugcuggggagggaggugcauguacagugcuuggguguagcucagaggacaacuuguggagucuugguuuuccccuuucaccauguagguccuaggaucaagcucagguuugcugguuugguggcaagugucuuuacuugcuuugucaccuugucaggcccuguugcagagauuuugaacaauugacugaacucugagcacagguuuggucuauuugguucucaguguuaacgguaugauauugggguuguuauuugagacuugauugggucaguuuuuuuagacaagguuggaacuucugaaucuccugccuccacagucuuucaguggucaaacccggggcuucugcaagcaccccaccaacugcagcgaguccucagacacccccaguguuaaauucugugcuggguguggucgugucaucaccaaggaaugguguucacauuggaccuuuggaccaucuagcccaugcagugugggcuccaggcacuuucccuuucuccucuacaggccaaagaucucaucaucacaccagccacugucuuaaaagagaagccggacccggauucgcuggucuuuggagcuacguuuacugaccacaugcugacgguggagugguccucugcgucuggaugggagaaaccucacauuaagccuuuuggaaacuugcccauacaucccgcugccucuguuuugcacuacgcuguggaaguaagugcuugggagcacccgugggccgugauucucuggccuugcaagcuucuuuagggucggggacaggcccugcugucuuaacuggagguugucauaaacaucuucaaacuucuccugcagccaaguggauugccgauaagucucagagcuaguuuugcagguuggcuuggcuuaucugugauauuaguaaaaugugauaugugugugugugugugugugugugugugugugugugugugugugugaaaaucucagcacuugguaaccuaagacuggaugggccgaaaguucaaggcuaaccgagacuaugccuuucuuucuggacagccuaggccacagaaucccaaagaacccuaaagcaaugaguauuacuaauuuauuaggugcucucuacuucucagaucuuugagugauugugaagggucggucacaggauggggcgcugugcuaacugcuuucuuauaaccagccugugggauggcauugagcacgcuccuucaccguggaguguuuggagacuccacaucuugguccucuguugauacacacugaaacagauaugcagaauauugucccauccccuuggcccuauauuucaguuuauucugguuucuucacggguaaugacuuuccccagaacacugaaggcacagagauaaauucugaccuaccaagagacugaaaauggccauaggaaacaggaucaaauauucauuucugaauauugguucccaagauugugccuucgagagaucuuauacuuuauagagaucauuuucauuucacuacuuguguuuacaguucaaauuucccaccagaacaccccggaauccacccauuuaaugaucugaagugagaagcauucaaauucacauucagggccggagcauuggcucggggauuaagagcaccugcugaucuggcagagaacuguagcaaaguucucaguacccacaugguggcugagacccaaagguugugagagccaccgcuguagagccaugccugguacggagggagagagcagacaacggcugcggugagcuaugcugcacaguccauagaccaggcugugugcucucuuggaugggugacagguauucugaaagcacaaagcaaaggaauagcaaaauguccucagguucacagggagagacaacccaggcagccccacugagagaggaagaugaagucacaucauuaaaggggugcucacaacacccaguaggaagggacuuggggugucugugguuagaccacccugauugcuccagaucgaaucugaucuggggagaucagcaggacagggcccggauaguacuugcaugggagacacggucuuggggagcaaacagaccuguuggaagcagacugaucugcccuugaaccaguuccuggcuucagacuuccaccacaggcauuuuaaacaugggauaaacagugguaaugucugcagaaauguuuugccucccaguggagauucaaggacacaguguuuuugcuguuuuuuuuuguuuuuuuguuuuuuuuuuuccccucucugugacagagugggagugccagccugcucuagguuuggaggacacuugggguaaacauuugggucugaugugggaggggccagcccugccucuggagucucucuuuaccaacacagugugcauuguaugaccccagacccagugguggccccuauucuagaagaugaucaaauaacuucuuaguaccuugguuuuguuuuuuaaagauaggcuggcuuccaguccgugguauagcugaagcuggccuugaacucuagauacuggggucacagguacacauugccacaccagucugaacuuaaagauucuuagcuucauucccagaucacugcuagucacacggccugcugcauuauauuuauggcaagcucuuugcaucaaaugacaggugaacggaccauuccccuucagagaaggcugugguaaccucagcgccucuaggucccuugauucucagacuuaggacucagaauuaccaugggguucacuuuugaagcuaugucacccaacugcacaggugccacagugugagaccugcuggccucuauaggaggugagcuaggaagaauuaaaaaauguuggguuuuggaguauaucaacugaaauuucaguuugacuuuuucauauauuauuauuauuauuauuauuguuauugguggcaggcuggcuucaaaaucauagcaguccuccuggcucagccuuucaaaugccauaaucacaguuuuaaagaaauuaaacggggauguagcuuagugcugaacacuugccuugugugaguaauacucuguguuccacacgcaaaaccaaaaauagcccucaaauuacagucauucugccguaaagccacaaccuucuccauauuauuagugaucuaauaaaauacagugcuucuucauaagguuugauuagcuagaccgaguuaccagaaauaucuucaguaagaaucagguugggcugcuugggugaccaagaaccugagaccgacagucuagggaccuaagguaaagucaaauacuacuguuuguuuguuuguuuguuuuuaaaugcagcaauaaaaugcuguacucauagaucagagccagccaucgucagaagcuuccuccugcagcuuccuccugaagcagaugggaacacaugcagagaccuacagccagacacaggguagaaauucagagaacuaagaacacucugccuuaaauagaaugucuccaucuaauuccuccaagggcucagggaaccauccccccccuccccccccccccccccccagaaagugugagagccagaggagacggaggacaccugaagaacaagacccucuauaucaaucgagcaagcuccuacgaaccccagagcccgagguagcauucacagagccugcacgggucugccccaggacuugcacagggcccgcacgggucugccccagguccccugcaucuaucgucuagcuuccgguuuagcguuuguaugggauucuugagugugcaaaccagugggucugauucucuugccuucucucgggcucuuucauauuuauuuugcccaagucccacguguuagcuuuuguuuuaucuugugauuucuuauguuauuguuuagacaccuguuuauuuucuaaugagagacggaaagggaggugaggucagagggaacugggaggaguacaagagagaaacuguaaucagcauaugucaugugagaagaaagaaucuauuuucaauuagaggggaaaagagaacuggauuggggacgaggaaacagcucaguucguagcaugcgccuccaucacacacugagcugugggguccagcucugcgcucuuguccaucaauagccacacuuccugcgugaggugggcccugaccagcgcuugguuggaaagagggugaaggggcuaccgaggcagaguggcacagcgcugcuugggcggggcauguugggaaaguacauauugggaauuuaauccagaaaagaagguguaugucccuugucucuuugccugcuugcccagggagaagauccuagcuguggagugugguuacuggggucuaaggggagcgaguguuccucugugagucucggaggcgguaguuuuccauuguguguccuuguccaggcuguuuugugagccuuuuucuccuggguacuuucuugcucauagaggcaggggugugguguaaaagaaacauagcucuuguccagagggaguaagaagcgugugauacugagccagagaauggccuuggugugggcacgugggaucacguggccccgaaugacacagccuacuguggaagugguuacuagucaacgcauuuauggaaugugcugggacauuggguaacaggguagccaaguagaaaguccugcugucugaugacguccuuucagcuucuggcucagaacaaugugagguuaggagcacagguggguaauuaauggcgauggagauuaaagauaauucaggguucuggauccgcaacauuccuguucuccaccguuacggagagcucugguaucucuagccuaguuguuccuucaucagagaacuuuagcucagaaaucuguccuucucaacuccucccccccaacacacacacacacacacacacagagagagagagagagagagagcaagcuugccguuuaaggaccauccaccuuguucucauugguuugggaucgaguaggcaggccauccagcaagcucuggggaucugucugucuuggcaguugggauuacaaguauguacuaccaugccuggcuuucauuuaugucgauucuaggauugaacucaggucccauguuugcaugcaucuaugugaucauuuguguguguguguguguguguguguguguguguguguguguguguguguguauguggcuggcaugagaucaccauggugugccuguggaggucagaggacaacccacaggaguggacucucucccccucccccuccccuucccucuccccucuucccuuccucuuccuuggccuuccaagauucauacuuaacuucugaccaggagugguggaguggugcuagaaugcuuagauugcccuguucugcuggcugaucagguugaguacugaaaggaccuuucuauucccuuucuguucccacauugcuccccccccuccccucuccauuccaguuaaggccaaggauagcaacguaaccacugagauugucuuagucaccuucugagacuuuucucuucuccucagcuguuugaaggcuugaaagccuuucggggaguugauaacaagauccgauuguuccggccggaccucaacauggauagaaugugccgaucugcugugaggaccacgcugccgguaugaacauuugcauucccuucuauuucaugguuauucugcucucacacccccccccccccaaaaaaaaucuuugcugaauaauugcaucagaccauaugagagugaaugcugacuuauguaugugaugccuucaauuagaggucagagggcaccuugagaaucaguucucuguacuacacgggaugauggcaagccccuuaaugugcugagcaucuuaaauuguacauuuuaguacggcuguacgaagaagaaaauuaaaacccagcccagggagguuaaaccacuuguccaaggucacucagaaggaggacagcaaagugaucugcgguuuccugguccaugcagucauggaauugauuaaacuucaucucugcucagcacccccaagaccugacuuguuguuggcacagguuacuuggauagccagccauccucacaucugacaccucugcaauaagaucaugcuccuguuccaugaucacgcuagugcacugugaucauguuagugcagugugaucaugcuaauaaugcagugugaucaugcuaaugcagugugaucaugcuagugcagugugaucauguuagugcagugugaucaugcuagugcacugugaucaugcuagugcacugugaucaugcuaguguguggugcugcauaaccuugcauaacacaucacgucucugaaagugucccucuggccuguggaugaguggaaacugcuugaucaguuuacaaagcacacuugucaccuuugggauaagcugauguccccuugucuuugugaccagcguucaguucagaacauggccugcugcaauuccucauugguaucucaccaucagcuuccugaucugaaaagccagaguuucaguuucaaauaggcaaauuuuaucuuuauuuucccuugugguuuguuuauguuuuauguuuucuggguaagagguuguuuuaaaccuuaaaguuguagauaucuauuuuuuaaaauuagaagccaugaugcuuuguuauacucaaucauaauauccaguuauaauugagaacagaagagcucacagauaccaauuuuuaaauagaaguaauaauauuuuguugauuuugagcauaaaauccaacuauaauugauaagagaccacagauguccacuuuaaaauaaagaucauaacuuguuacauuugaguguaaaaguauaacugauaugggaguaugcucaauagggaucuaacaucuuuuucaaaaaucucauuuauuuauuugggggcagggaggugaguguagaguucagaagcaacuuggcuuucucgcuaucaugugguuaucaggcuuggcggcaugaccccuuaccugcugagcugagccaucuugaagccucagagaaucuaacgucuuaucuuuuccuuaugaauaauucauaguuuuccagagggauucacagauuuuuuuuuuuuuaaagcauuuauuccggguaccucucacgauguuucauguuaggaaagagugaauaaaagcuguugaaggagccaaucggcacugcaacauggggacaguuuugaaaauugagcuucugucugcucucugaucugggagucugacugucuguccuuugcuggaacucaauagggauucuguccuuucagauguuugacaaggaggagcuccuaaaguguauucuucagcuucuacagaucgaccaagaauggguucccuacuccaccucugccagccucuacauccgccccacauuuaucggaacugagguacggccuggcucuauuuaggggauauauauauauauauauauauauauauauauauauauauauauauauaauuuaaagucuuuaaaaaaauuuauuuuuauguguacauaagugggcuugugugagccaccacguguguggaugucagaauugcaucuuggguauugauucuucuacuaugugugcuguggggauggagcuuggguaguuuggauuggcagaaaguaccuucauccucagagucaucuuguaugccccaaagguaauuuucauuuuuuuuuuaaucacucaccccacuaccaccacgugagcacacaaacacacacaacacacacacacacacaaacacacacuacacuuccacauaccccucccuguacacaccugucccaguaauuuuuugaccucccuugauggcuaguucugggguguggcucccucaugacagacccuuggagaucgaugcggucaugcuguagaaaguuugucagagagaacgcuugguuuuauuuuuauuauccugaauccuuagcaauucugcuaaaaaaaaaaauaggaagagaaggcccccauucgaagaaaaauugcugaaaauauacuucaucaggagcugguagggaaggguuggauaauaaaaccuagggcuacuagauaggccauacuuguuggcaagugucuuuacccacugagcuaucacacaagacccacucuuuauaagauaaauccauugcagaaggcuucucugucuguaauuggcaucuguugagaaacaaguauugaauugcuuucacauucauuuauuuuaugggcguuacaccuacauguagaaugcuacacauucuaaacaugugcuuggugcccuaggaugucagaggaggguauuggacccuauggaacuguaguaauggaugguugugagucacucuaugggagcuguaaugaaacccagguccuuucaacacaggauuucucuguguagcccuggcuguccugguacuugcucuuuagaccaggcuggccuugaaugccaaguccuucugccucugccuccuaguacuaagauuaaaaguguguaaccacacguggcuccuguggcuugauucuugcucagcuugcaagcguugguggcuacagguguggguaaccugucugacucaaguauuuaacuguaguuuaaagucacuguuugcaucuuuuguuuuuugauuuuuuaaaaaauguguuuuaaaggcuucuucacuuggucauuccucuguuuuaaaguuuucuuuauuuccuuuaaaccucacccaugugaauguuaaagagcucacuuucuccacggagacaccaaguuguauccccagguaucgauuacacagguccacauuggaugaaucaauuccguaucgauugcagugccuguucacagcacaucaggcuuugauugguaaugucugucacagcacaucaggcuuugauugguaaugucugucuuggggcuuccuacccaugucuucucuuuauguaguuuguugcccccgugccuugccauggucuuugcucucaguguugugcccuuggucaccugaccuggugucuucuggcucccucacacccagccuugguuagcuggccucuuuggagaugucuuaacuauagaaguuaguaagggacuugucauuuggcugacaaaccucuuccuggggagccacaacacaucgcagauagggagcccauaacagauuugaagcacaugccaccaaaauccagcguggugagccugagagucucaucauuguuccuuacaggaauaugggugaggggucacuugcuggagaagaaaugacucaaagacagcugcgucacaaguccaccccagcacgggugacagcucccaaagcuggggaccuggagcagccacagccugcaggcagcgcagcagcuuggccaguccuuuccaugugccucacaguugaucuaaaucucucccaggcggcucggcugguuuccgcuuccacugcagcugguguggccuccaagucuucuuugcagcuuugcuuuucugagacagauucucagcuuuuauugccuguucuagccagaguguugggguggcggucgugacucagggacacccuagaaccguuuugaguuguuuagcuuacugcuugaggagcuucugggcuggauggaauguauuggaaugaaaacacaacagcuuacuuauuauuauuuauccugaggagacaaguucucauuagccuagccacacuagucuagaauuuaccgugcaguagcccaggcuggccucauuuuuauaccagugcuauuggggcagcuuccccacuucugggauuggcagcuugaaacagaaucuuuuuuuuuuuuuuuuuuuuuuuugguggaucagggucucagccucucucccugauugucgacuucaaauuuacagguaaucuccugccucugcuucccgagugggauugccagcacacccccacacccccacaucuggcuuuguguuugcuuucuccucuacccagcuugagcuagcaguuggaaugguaaggucagagcagugaggagauuccuagucuuaugagccaucucuuacugugcagcccugcagcucagagcaggccccacacaccuuggguuuuacaagccacauagccacucagccugccccaagccugucccaucacaccggaagggaaggagcaggccagcgacugugacagggagcgaaugacauugucugagagugaccuguguuguguacucuuccucuugacccuuucccaguguucuugugcacuugaccauguggacauuucugcuuaggacugauuuuagauuuaccgagccuuguuucucagguccuaaccucacgaucugacuuuuccuuggcauucguuuugaguuuucacacugaguguuaagcucucggaccacaucuccugucaguaugcuauaaccucacacacccuacggugcugggccuggccucucugaggugucauuagccucgaggugaagccucaguggaaaaggcuguaauaccugucauuugugucacugacagcuucauuucugugguagugacuugagcgguggaggguggggccucuuuuuagugucaguaaugcaggaggcagcuuugcucacagaccuguuucccaacugcaggagcuuagcauggugacuuggaggagggaggaagaggaggggagcaggcaguggaggaggaggaggaggaggaggaggaggaggaggaggaggaggaggaggaggaggaggcugggauccuccuguuuccacugcugcaccuugcacauccuacugcccuagucaggguuucuauucuugcacaaaacgucaugaccaagaaucaaguuggggagguaaggguuuauucagcuugcacuuucuacauugcuguucaucacuaaaggacgucaggacuguaacucacacagggcaggaagcaggagcugaugcagaggccauggagggauguuacuuacugccuugcuucuccuggcuuccucagcuuucuuuccuauagaacccaggacuaccaguccagggauggcaccacccacaaugggcccucccacccuugaucacuaauugagaaaugccuuacagcuggaucucauggaggcauuuccucaauugaguguccuuucuuucucugugauaacuccagcuuauaucaaguugacacacaaagccagccaguacacaccuaccguacugggccuggcuucucugaggugucauuagccucgaggugaagccucaguggagaaaaguugccagccuucuuuguccuuuucugcucacccugcgggacauuugugagucuaggugugaagucacuguucccagaagugcucuucagaauccccgaaaaguagccagggacuccucaccugagcccacggggacagagcuauucuuuaauagcaaagccugugggaggucagcaauguaacccugggcuggcugaccuucagauauaguggcuuugauguuauuuguguggaacaaggucuccuguaucccagaugggccugaacucacuuuguagcccaggcugaacuugaccaaacggcaauucuucugccucagacucucaaguguuugagauuacaggugcuugcuucugugcccgucucuauaccccuuuucuuuuuuuuuucuuuuaauauuuuuuauuagguauuuuccucauuuacauuuccaaugcuaucccaaaauucccccauaccacccccccacuaccuaccacucccacuuuuuggcccuggcaaguuccccugcacuggggcauauauaguuugcauguccaaugggccucucuuuccacugauggccaacuaggccaccuuuugauacauaugcagcuagagucaagaucuccgggguacugguuaguucauaauguuguuccaccuauaggguugcaguucccuuuagcucuauggguacuuucucuagcuccuccauugggggcccugugauccauccaauaguugacugugagcauacacuuauguguuugcuaggccccggcauagucucacaagagagagcgcuaucuugcuaguguaugcaauggugucagcguuuggaggcugacuaugggauggaucccuggauauggcagucucuacaugguccauccuuuugucucagcuccaaacuuugucucuguaacuccuuccauggguguuuuguucccaauucaaagaaggggcaaaguguccacacuuuggucuucauucuucuugaguuucauguguuuugcaaauuguaucuuauaucuuggguauucuaaguuucugggcuaauauccacauaccagugaguacauaucauuugaguucuuuugugauuggguugccucacucaggaugaugcccuccagguccaaccauuugccuaggaauuucacaaauucauucuuuuuaauagcugaguaguacuccauuguguaaauguaccacauuuucuguauccauuccucuguugaggggcaucuggguucuuuccagcuucuggcuauuauaaauaaggcugcuaugaacauaguggagcauguguccuucuuaacuguugggacaucuucuguauaacaccuguccagggucuuuuggcuuucauagucucuguugaaaagucugauguaauucugauaggccugccuuuauauguuacuugaccuuuuucccuuacugcuuuuaauauucucucuuuauuuagugcauuuguuguucugauuauuauuugucgggaggaaugucuuuucugguucagucuauuuggaauucuguagccuuguaugcucaugggcaugccuuucuuuagguuugggaaguuuucuucuauaguuuuguugaagauauuugcuggcccuuuaaguugaaaaaucuucauucucaucuacuccuauuauccguagguuuggucuucucauugaguccuggauuuccuggauguuuugaauuaggaucuuuuugcauuuugcauuuucuuugauuguugugccgauguucucuauggaauauucugcaucugagauucuuucuuccaucucuuguauucuguugcugaugcucgcaucuaugauuccagauuucuuuccuaggguuucuaucuccagcguugccucacuuuggguuuucuuuauugugucuacuucccuuuuuaggucuuggaugauuuuauucaauuccaucaucuguuugguuguguuuucuugcaauucuuuaaaggauuuuugugcuuccucuuuaaggucuucuaccuguuuagcaguguucuccuguauuucuuuaagugaguuauuaaaguccuucuugauguccucuaccaucaucaugagauaugcuuuuaaauccgggacuaucuuuucagguguguuggggugccuaggacuggguggggugggagugcugcguucugaugauagugaguggucuugguuucuguuaguaagaugccuuucgccaucugguaaucucuggaguuaguuguuuuaguugccucugguuagagcuuguuccucaggugauuauguuagccucuaucagcagaccugggagacuagcucucuccugaguuucaguguuuagaguauucucugcaggcaagcucuccucuugcagggaaggugcccagauaucugguguucaaaccugacuccuggcagagguugugauccacucaccagagguccuaagaucccgugaagaguccuguggggaccuugggggugucugcagacuccgagcccaaggugccccggagcuggugcagaccagaagggacuugugacccugaucaggccagguuuucugcuucccuaauuaaugcagucucagguccugcgagauuggauuggagcacuauacccauuuucuacaaggaaugucuuacuaagguuugguuguuuuucuacaaauauuugauaaaaaucaggaauaauggugcuggagagauggcuaguggcuaagaauacuggcugcucuugcagagaccugaguucaguuucuagcacucacacgguggcucacaacuauccuucacucuaguuacaggggaucuaaagucuucuucuggccucugcagggaccaggcacacacacacaauacacuuacauacauguagacaaaacacgcaugauaaaaaugguucugcuuuauggagacacacugguuaucaaaacagaaagaaaugaguagauuuaagaugucuauuaguccgccuuugacaagcuggaugcucgagaaccacauaccacagcaccucacucagguugggggcacuugcuccugaagugacaucuaaaggauguguaagaugggcuucaauguuggaugcuaccgggaugagucuuagugugacuggcugcuuuguuacagugccacagugaguuaauuauuuuucaguugcuaugauuaaauaccgugagcaaaagcagcuuggggaagaaagaguuuacuuuagcuuaugugagguccuggaggauggggcucaucaccuagggaggguguggcauugggcagaaaguugguagaucacauuuccauuggcacaagggagagagagaacuggggucagauuauaaacccucaaagcccacagcccugcugccuagucugacuugccuccucuagcacggguugcaucuucuaaagguuccaucuccuuuccagacaucucuaccaucuggagaccaagaguugucauguccuucucuuacagacugagcagcucaaacugcaguuauuuuugcaguguuuuggagccugggcauccaugccugauuguggcuggcuucaggugguaccuuccuuccaggugguccucccuggcccuugucugcccagaagggagaguuucuguaaauuuuucucuauauaaggacccaagucuggcaggauggcuuuacccuugugaccucccaugaugcaccaaccuaaaagccccuauggcuuuggacagucauaccagagcugugaucuuacucucugccugacuggauuugcgauccccuagcagccauuccucugagugagucuaugaggguguuagcagagagguuuaacugaguagagaagaccuguccugaauguugugguacugacucacgggcuugggucccugacugaacaaaagggaaacgguguugagcaucagcaaacaucccucucccugcucucugaccguggacacagagaccagacacccacauuuccuaugcgauuccuuccuuauagcagugagaaaagucauuaaugcagggagucagggcuucaacggggacuucagaggagguaauagagguggggagggcaggagaggaccuggaagguggagagggaggagaauugaaugacaagucaugcugugcugaucggggauggagcucaggcagcagcaagugccuucagggaaggucuuggguacuuacuguauugauuauuucuauuauuauuacauguaugugagugcuuugucugccuuauggcugaggaugucaggagaggguuuugaaucccugggaacuggaauuacagcuucuguaaggcauaucucacuugggugcuggaacugauauuggguccuuuagaaccagcaggcacccauagcccaccuaagcaucucuccagcucuaaguuguugcugcuguuccuccuccuccuccucuucuucuuccuucuucuccuccuccuccucuucuagacuuauucagcccccaaaucuuaggcagcuaaauuggccuugacccccaauccuccugccucagccucccaagugcugagaugauaggcaagagacaugguuccauuuucucauuuaacucugaaagcuuuuaaaacagaagucucugaaagcaagcgagcugguugucuuccucuggauccagccaccuuauuauuugcuuuguuggcuucggucagaacuguccucccacuugcaggcugcccugcucccugccucugaggccacacuguagacuaauggaauuucucaguucacugacuccuuucugccacccuucaaauaacucgugacauccccccuucugugaagggauuucugggugacccagaaagaaguagccuuuguuucucaccacacccaagcgccauuugucugugcagaggacuaaugggucugguuauugugaagcuuagccccgucucccaaagcuaaaacaaaaccaccacgcugaaauguuccugagacaaacagacuuggcacaggccauuugcaguguccaccggccgcugacauccuuauucccuauuuaguuauguggcuuuucuuuuaguuaauaagaagcacaacuuuaucaucccauaaccuugucugucauucgguuggcauuacauaauaaaauucacuuaauaggagcacaggauauguaaauugcuuuucaggguagaagaggagauuggagcaaggggcuaagucagggauccugaguguauguguguguguguguguguguguguguguguuuguuugugguagagggacaaugcuugucacuaaaucuuucuugacgccuagacugaauuuugacucacucaguauugaaguggcauggagacuuucuccccacuugcucuccaaggaacggcagugaguucuuugaagauuugauuuuuauuuuacaucuaugaguguccuaucugugcacaugggugcagugcccauuugaggccagaagagggcaucagaucccuggaauugaaguuacugagauuccacgugguugcuggaaacugaaccuggguccucugcaagaagagcugagccggugcuccagcccucaaugaauucuuuucauggagagacaauggauguaagcuauggaagguuccuaagccaucuaugguccacagaggaacuucgggcuugcaaucaugaguggaccuggauuaaauuuuagaaaauacauuccuacgcacagcuuuggccagcauuaacaaaugcuauuuauuguauaacuuagcuguugcuaaggauauggauaugaaugaagcgacucaucaagaugcuuugucagcgggagauuugguggcugugucuaauucugcgucuuuccaucugugcucgcugcugcccccuaguggacuaaaugcaaacuaacuuaccaaggucaggaaagcacacgcacacagaggaauuccccuuugcuucuauacugugugcccucacagauccuaacgucccagcccgaacgaggugaaauuuaguacagagaaaaaaaauuauuacucuguagcuacuguuacuuucuuuucuuuucuuuucuuuucuuuucuuuucuuuucuuuucuuuucuuuucuuuucucuucucuucucuucucuucucuucucuucucuucucuucucuucuuuucuuucuuucuuucuuucuuucuuuuuuuuuuuuuuuuuguauaaugcaauuguauaaaauacuuggugugugugcaccagcauucaugagguaggggacaaaguacuauuagguuguacauaagacagacaauucauucagaaauuuagaagcuagauguggccuucagauaacagcuagcauaucauaucugaguggccucucuggauuccuuaucauuugaguugguuagucuccuguugugauccuacugugaacaaggcagcuugcagagggagggguuuacuuggguuggugauuacagaggguuagcucacaauggcaggggaggaaugacagauggcaggcaggaagccggcaaaucacauccuuaaccucgagcaaacggcagccgggugagacccucuagaugugaggugcugcuaccagugaaaguccuccggguucuucucaaaagaaagacuucagaggcaguuuaucuagcaaagcagaaugugcauuucaaagagagccuggagcaguauggcccauaaugaggagcggcccacugaguucuggguuguggauuuugaaacuuuacauugcaguagucuaugcuaauuauaccuaaggggucuccugacauuucauacacguuuauaacauauuuggaccacucuccucccauuaaccccuuuccuuuuccugacaaguugugcuauuuuuaaaaguugucuuuaugguuauuuauaaggcagguggcauauuuauuggauaaagugacuccuuucccccuggguuauuguggaucagguuucccuuuuuaggguuugucuuccucccagcuucuagaaaagcccaaaagggaagagagacugacagcuacaaugggaguguuugacggggagccgggggucuuugcgcccucacacccucacugguguuuguguguggcaacuaggaaagugugcccccuuucucuggcugccuuugcuucugacacagcagaaauauccuaacugcagcuucaaggccucagagaggugcucagagcaccagagacacagaagacgcugcaacagcgacuuccucaguuaucuccugucugacaccuugcccacacagucucaccauugaagaaacucucagagacaagaugguucccccagagcugggacgaaacagguguggaucugugcacagucucccucccagaugagaagacauagaguucccaagcucuucauccugcagggggagaagauaaguuccuauugaagaacaaacaccuuuaaucucagcaucugggaggcagaggcagggggaucucuguguuggaggccagccugggcuauagagugaguuccaugacagccaggauuauguagagagacugucucaaaacaaaaaccaaccaaccaaccauauucaaacuagccccacugcucucagaccggucucucugacucagucauguaguuuaccaucaguuuauucuaggggcucagaguccugcuugguccuccugauagagggagguggggggcuuucaggugauguccuuacccacagacaguguguguguguaugugcuguauguguauguuugugcaugugugugagugucaauguauguguguguguggguguaugugguguguguauguaucugagugaguguguauaugugagcaugaauguguguguauaugugcauauauguguauuugugaguauguguaugugugagugugaauguguuauaugugugugaguguguguguguuugugagcaugugugcuugugugucuaugugugugagugugugcauguaugugugugaacauguguguugguguguguaugugugugugccucacgcacaugugucauggcacaguaguacagugugcaugucggagggcagcuuucagaaguuguuuucucaucucaccucuaugaggcaguaucuaucugccaugucaugagcuccaggcuagcuugcccaccagcugcuggcugcucugucuucuuccggccucucuauaggagugcugggcucacacgugccacauccugccacaucuggcuccuucccauguucuggggauucaacucaggcagucaagcauauguggcaaacaagccgguucacuggcccacaacugcuuccugggcuucagcuauuuaccaccugggucuaauggagagggccugagggcaggcagugcgugcuagaggcaggugugguggagacucaagcaaaaggcagcugcagagucugucagcaucagcuuguuaggcagagagcauaaagugugcagccagcuagagucagggcccucuucauugucacugagcggcugccagccucugugucacagguacagaacacugcaguggucagcauccauccugggggauccuggcuuguugguuuguucuugccgucuuacauaguauagcugaauggaacugaccuguaugucuucaugacacacggccucugggacuuggaguuucugauaauccacugcccucacuucacgacuuuuccuugugcuagagaaauuuauagucuuccuguauuuguggaaaaggcugucuucugucuuguauccauuugccaaagauuuaucuuuauuuuaugcacauggccguuuugccugcuuguaugugugcacacacgcacgcacagcauagaggccaggagagggcacuggauccccuggaaguggauuuaugaacagcugugagccuccauguaggugcugugaacugaacccggguccccuacaagagcagccagugcuaguaacugaaccaccuuuccaguucccuguuguccaugaugugaagucuaaguucucucaucuccuuuugaugggacuucugcugucucugccugccuucuguugucuauuaugugcugcagaggcaggcaccaucacagcuggcuuccccaugcccaccucugcucaugggccucaccuuuucuggagugcccagcaggcuucacaaagacuugaaggggguggguuauguucuaggaggcaggcucuucacucuuccugugagcaguuucagcaacugcaacugacagcuguguuucucccucugaaaucauaacucagaaagcaaaccaaaacggaacuuaaaguucuuuuaaauuacaaugauuuguuuauguuguguugaccgugcaugccguagcaugucuguggaggucucaggucagcuuguagugguuggcucucuucuuuccaccacgcgaggcucagggaccagacucagguagucagcuuuucagguguggcagcaaacaagcauuuauccacugaggcaucugugucccauccuuuuaucccccacacccaaauuuaaauacgcauucucaguauauucuuuaaaaagcuuugugucacuaagcuuuguuugggugaccuucugggauguggacacaggucuauuuuagacucuuaagaaggaugucucacuguugguuacagaggcaugguuucucucuuuauuacagccaucucuuggcgucaagaagccuuccaaagcccuacucuuugugauccugagccccgugggaccuuauuuuucuaguggaucuuuuacuccggugucccugugggccaauccaaaguacaucagagccuggaaaggugggacuggagacugcaagaugggcggguaagucggucccuguguccuuccuguauagugacaguugugcgcuuucaauggcggugugcuugguagaguucacaagcgaguagcugucugugguuuaagauuuagcuuuguaaacguguuaguuguuggagguguugcuuguggccccucuaaggcagcaguguggcauggguauugugucccacucgaccggcaagaaagacgcaacaaacuggaaucuuccguggcaaaagcuuuauugcuuacuucuucaggaagaccuugaaccgggaaaauggcgccgccuuuauaacccgcagugugacguuucagcaccccgauauggcgugacggcuccugauucguugcucgcccaucaccccacuauuacacuccgagaaugggagugacuaggcgugaguucacucuugcaccugcguacaaggcuuguuuacuaguuaggcacagcggaggccagcgccaucuuauaauggcgauugcucgcggcacggcucuccacacaugggcauggagcagugacuugaaccaggguccuuuccagcuagagacuggcccuggggaugaugcuuucacuuggcuccagggaacccugucuggaaaggugacuauuucacugucugcuuagccacagauggcaggcucaccugcugugaaggggcagaggaaagcccugcuuuggcucugccuggccagccucaccggccaucuguagcuggcaggaaacaaaagaggguuugagaugugcuggccaguuucagcguugacuuggcucugaauucagaaugucccucgguggauacaacagaaggagcaaguaucacggacucgucccuggucugaaucaacuggugacauacagagaugcuccuggaaagugacuuucagugauguucugagagguuuaggaaagucauugcccagggauaggccucugauaugagggcugauggcagcaagaugcgaaagguaucccacaagccccaugugcuccccacccccuacagagcauuuauagaugaccagcuucucuagaaaacuguagcuugggcgccucaggucagcuuccucugucuuuguguaugcaacacuguugcgucucaccugagcgguauuugcuacagaauuaauucuagccucccagcuuagcagucaccagcacuugcugcucuucuagagauccuaaguuaagcucucugcccccgugucagcaggcuggcaacaaccuguaacuccugcucccugggaucugaggcucucucauggccuuuauaggcacaugcacaugacacacacacacacacacacacacacacacacacacacacacacacggagagugcauauuuguguuacuguucauguugccagugagcaaggcagggacugagugagcaaggcagggacugagugagcuuuaggccugccuuauucacagagcccgugaucuaagaagauaguagaauaacaacuuaauauuaucucaccucacaccuugucugcauccagcaagcuucacagggagggguggaguuaacacaagccagccuucaaagcaagugcucugcuugcaugcaagucugcgaaccaugcucuuuccugguacccuuggaggccagacgaguacuuuuagguagucagggguugccaugugagugcuaggaacugaacugggguccuuugcaagagaaucaagugcucuuaagcacggagaugucucuccagcuucugcaccucucuuguuauuguuucuugccaucucugacugcauucucuaauauuuggaauuaaacccugugaagugugaaugguguagaccagggagauggcagggagguuaacccagaacaaacucugagcagugugcaugcgugaagcuguuaauauguaugcuuggacuccuaauguggaguauaaaugucuccucaugggagagaauauugaagugccccucuucaguccuccagccccuccauuauuuguauaguccuucacgucuuguccccuucucugcccaugccaacaaccagguuucauggcaccuguaucaguuucaaaguuggucacucuuucccauugcaaguugcucccaaaccuuccuguggggaaauguggucucccucaguccaaggcugucccugggcuaucauggugacaucgcaguuacaugaagacauuaaugccaccugcagggugucuugacauaagugacuugacacagucacagguucugagccuaaggguguggacaucacugagggagagaauauucugcaauggcuuuaagguucccaaaaggugcuuggaagcuaaaagugugacugcaucgccugaccauuuccugcgcugacgucaugugugggcguggucuccagucaugugugggcguggucuccagucaugugugggcauggucuccagucaugggaaauagaaaaccaggucacuuuggacucgcauuugaagccacuaaacagcgagcgagcgagcgagcgagcgagcgagcgagugagcgagagagagagagagagagagagagagagagagagagagagagaacgagagagaacaaagaaaacaaaauguagaguauuuaacuaaauaagcccgagguuggcagacuucucagugaggcuuugccuuucccaacgauuagaggccaagcaugcugagaguggguagagauguauuagccugaguaguuaguugaucacuaggcucauuccuuguagcauucugagagugaguggagauguguuagccugaguaguugaccacuuggcucauaccuggccugaguuucagguuaguucucaaauccuguuuccccuccucccucugccagggcagcauuugucuuuuaacauccauguuugucuguccuacagguacuuaagucauuugugugucgcguguuaauguaugugccagggcaugcauggugggucagaagacaccucaugggacucaguucucuccucccacugcgugggcccugggaucaagcccaggucacuagucuuggcaguaggcuccuucacugacugagcucuuuuccggcccagggaagaaguuuuuuuuuuaaagggaaguguuuuggaggagaucagucaguuuguuggagccucaacccaggguauagccuaugguuuucccaggcaagacaaugucaaguauuccuuagccaaauuauaagaccacuaauuuuccaaauuuauaaguggauuauaguaaucuuggggguuggcagagaaagagaaagacucagguagacaugcgccuccugucccagugucuggaacaauugguccucccuuccccccguugguguguccacagugcauguauggagaucagaggauaaaucguggaaguggguuaacucuugccacccugugggaucugaagauguaaggucaguaggccuucgaaggaagugagccaucuuggccaccuucaagucuuaaacgcuaacucucucucucucucucucucucucucucucucucucucucugucucucucucugucucucucuuccucucucuuccucucucuuccucucucucucucucucugucucucucucucucccccuagcaauuauggagccucccuucuggcacagugcgaggccguggagaauggcugucagcagguccuguggcuguacggcaaggacaaccagauaacugaaguaggcacaaugaaucuuuuccucuacuggauaaacgaagacggagguaauugcucuucuggugucuugacagcugaugcugucaagagcgcagggggcggggacaucgagggcagugcggggcuggggacuauaguggcugcuguggagaccgcaucaggguugguuuuuauucuuguuucugcuguuuggcuugaaaagcuugagacugauuucaaacugagcugcuguacauauggcucagcauguaaaagcccuggcugcucuugcagaggaccugaguucuguucugagcaaccacacuguggcucacaacugucugugacucuaauuucaggggauccagcccucuucuggacuccagggguacugcacccaugcacgcacacacaguguauagcccaggauaaccuugaagucauuauaccacaagggcuggcuuugaaauguuagauccuccauucuguauggcaagaauauaugggauuguaucauaccuggcuugaguguuuuguuuuuuggguuuuuuuguuuuuguuuuuuguuuuuguuuuuuuuuuuuuuuguuuuuuuguuuuuuaagacaggguaccacuugguagcuuacagaaauccuccuuuggaaugagguugugggaugcuauaauuauaaacaugugccacuauauguggcuaucuuuagcauccuggaugcucagugccugcuuugauaagaguucaggggaaguguugacaguuuauguagcaucgagugaaaugccauaaagcagggaacagagcagaccugugucgacuguuagcauuucaauaggugugcagaacuuaggaacacaguuuuagaccugcuuaugauuguagauuauuuauuucaugguaauuauagacaccgagaaugugcaacgacuucagggguguggcuggcuguuuacauuucuaacaccagcauuaggaaguggagacaggcagacccugggagcucacugacccaucggccucccagacagggugagcugcagguucagugagcgaggcuaacucaaaaauaacauggagagagcuagaggaaggcacucaauguuguccucugguucugcauguaugcacacacacgugugugcacacacucccuuguacaugugcacacaugcuugaaugaacaaaugcucauacacauguacauaugcucucucucucucucucucucucucucucucucucucucucucacacacacacacacacacacacacacacacacacgcacgcacacgguaagauaauacuuccauguacaaguucccagucuugccuucggugaccauuaaagaacucauugcuuugcgguagcccccuccacaccagcuucauuuugcugucgaggugggaagaagugauucagccaagguugcaugcagcccugcgugcugaucugaguacaggccugccuuauauuccaucugagggagagugaacagccugcccugaacuugaucugagcacuucugcuuguguuccucuggcccugggcaugcgauucugggagaugcaccaggcaccuucuucaaagucugcuguacuuggaaauguaagagaaccaaauuuaugcuggaauuugggggauuucaaacuagaacuucacauaaacauacauuggaagugaugguagagagaagauggccagugcugacuucuguguucaggagacaucuuccucucuagucacuccuguccugguccccaccuaccagcaccacagauacaaauagggacaucauucagaaaaggcaaagucauuauuuaugggaggugucaaggacuuagccacuaucuacgucauagccauacaaguuaaccagacacuguccugcucaaauaauugucccuuauccagacacaagucacgggacacgcuuacauggcaggucgcaguggggauaaguggguuuguuuucugccucuugcaaaauauaugaggccuuacuaagaguuagauuuuauaacuuuugcccaagccaguuuuaguuucaauguguuucuucaguugggguguuuagcaggcgaagggggguuggagaggaugggucaggaugaaaacuucaguuccuagcaccuauaccuggcagcucauggcucacagcugccuguaacugcagcuccgggagauccacaggcacuugcguacuugggcauaaagucucucucucucucucucucucucucacacacacacacacacacacacacacacacacacacacacacacacacacacacacaauuaauaaacaaacgguuccugucucuuuacccaucuucucugucucauugauaaucuaacaccauguaacagagaaaccuccuucgauucuccuccuuggaggaugaagauggaucccacagaaugcaggacagcaaccaacugcaacauuugcagagucacaagccaugucuguggggcucuguuuccuccuggguguucuggaacucgcucuggcuccugggaguguguugugguugcagaggaaaacgaauacuucucacccaaaugcuaucauguagccggcucugucugggaaccaggggacagaugucccaugucaucugcucugucuggggaccaggggacagauguucuauuucuugaccucaggcuggcgguuacagcaggaggcuaaauucauuccauagaacagccuuugcgugugugaacacugcuguuuggguuuaacucgguguugucggagagcuacgcuaacuguaagaaaggucucucucugugugaaaacugcacacacacacacacacacacacacacacccaugcauuucucugucuagcuaacgaguuaucccaaacacauuuauuuuaagaccauaaacacuuaacaaaugacaaguacccuugggaacaucgccaguaccaaucucuucuuucuaaaaagugauuuucagaaaauaaauggucccugcugcagcccagcaaagagaauucauucauucauauuuuaaaauuaaaaaauacuuauuauggaggcuggggaaauggcuccacaauccgugauuaggagcaguagcugcucuuccaaaggauccagguucaguucccagcacuuacagaucugacccuuuucuguucaagggcacuaccugcauguaccacacauucccauauaccucccuaggccagacaucgugcagaaacuggggcauacaaagauggaaaccaucagagagcaggagagauucuagcuccaccccguccugagacagagagaagcacuaggggaauagaugcgcuugcauccugagacagagagcuguagucccagggcuggaacacugcugugggauccgagcguucucucacaggucugggcaaacauacauuuguuucucugguaagauaaggauuggucuggguuaguucuaaaguuccuaucuauauucaaggcccugggggagccccaaagcaacagggcagcgugagcccugcaauagcagggcaauuccucuagugcuucuagcuggugcuucucuaagcauauuugugacauccucugcacucagggaguaggucauggacagguugucugcuauaagguucagcaucuuuguaaggugauauuuaaggcuuguugguccacauugcuagaugccaguagugagaaggaaggggggaguugacuaccaaggaugacuuuuuaaagauagaacagcccagacuagucucaaaucugaucuaaggacgaccuugaauucccaauucugccuucaauucccuagugcugggauugcaucuguaagucacccacauccaauucaugugaugaggggaucaaacccagggcuucacacauacucugaaagcagucuaccuacugauguauucccugaguccaccagagugacuugaaagggggaggguuacccagagcuuacagcuggagcgcugcgccuggcuuucaugguggagcguucacuugggggucucccguguagucagaguggcaguucaucucuugagacgguguuugcauuuuuucucuuuucuucuuuugaagacacgaagcuuccccugagcccacugccuucagaucucugugggaaacuccggaucgcccccauucaugcagcaccaguguagcucgacccacagaugaugugggcuucugaaggcagugugcaggcagcaccaggagcaagaacucguguguguguguguguguguguguguguguguguguguuguacugcuguggagcucagaggaaugagaaagggagggugucugcucuugugugugcuccuguggggguguacugcuguagagcccagaggacugagguagggucuucucuugcuucuuuccaccuuaugugcugagacacaaggccuuucuuucacugagcccagggcuacugguuuggcuaaacuaguuggccaggcagugucuccuuguuucuguagcaccagugugagcccccccauccagcucuuaugugggugcugggaucugaacucaggucccugacaagcucuugcuugccuccagucaucucucuggcucaggcuacccaacucugagguaaugggcuucucgcagaaacaaacgcuugguacucccuuggguccugagcaagauuuuaugcguguuguuauagguaccaauuaauuuuuaucuacuuugggaauaauuuugacaugacugcucaucuugaagaguauuucuuaauucucaguacugagaauagaguucacuuuuaacuuauuuauuuauuuauuuauaauguuuuauuuguguguguguguguguguguugucuuuagcauguguuaaugcucucuauauagauacccuuggcagccaguagagggcgcuagaaugcuuggaauuagaguuauacacaguugugagggccugguugguguuuucuccugcugugggaucccagaggauugaauucagguggucagacucaggagccagugcccuuacccacugucaucuguuucugcuuaucuaagaaaauuuguuguauucucucucucucuuucucucucucucucucucucucucucuguguguguguguguguguguguguguaggaaugugcacacgaaugcagggaccauggaguccagaagggaggacguggaaaugccucggggcagagucaggugguugugagccuccuuauguggguaugagaacagagcucuggucugaguagcagcagcuguuggcauccucugagcugucucuucuguucucauaugaaaguggcuuuaagaauugucacugcugcgguauguuguuaaugauggaaaucuugcaagcaucccuguuucuaauugacagaagaggagcuggcaacgcccccacuagauggcaucauucucccaggagugaccaggcagagcauccuggagcuggcacaacagugggugagugccugaacaacauccaugagcccaacagacacacacacacagauguacacacagauguacacagacauacacacacacagauguacauacagacacacagacguauauauauacacacacaaacauacacagacauacagucauacacacacauacacauacacagacgugcacacacauacacacacacagacauacacacauacacagacacacacacagacauacacagacauacucacacaugcacacucauacagacacacacacacacacacacauucacacacaauccaaaugagcuuugcuuugcaaugauagcauaccccauaguucccaccuguguuaucuaaucuuuaaaucucaccucgagcgaagaucuccugagaaggucuguguuggcagaccuuuuuaagcagggaaccagcuggagaaggugucuuacugaggagggcuucaauacuagccccaguccgugugcagggugccuucuaagccagcuuggucagacuggauguuuccaccccgucuuaacugcaagcuauuccauguuguguugaugacauauccuauccuguaauguauuccaguauuauaggagcuacagauuuuuauugauauauuaauaucaacguaauauuaauuugguccugauuuuuuuucuucccccacuaccccauucccauugucucagauuuccacacauguuuauuuuaaaaucaaaaacacucaaagaaaauauaaaguuguuuucuguggauguucacauccauggaaccaagguuggaguuuguuauuugaagugacauagcguuuguaaggcggauguggaguagauuggcuggcuggcagggguucuuggcuggcacuaaugauucauguguuccaaaaguccccauagaccaugaaaagguuuucaggacacuguggucagacaguccucauacacaaauguuuggacacacacauaauuuuggaguggaccacaguuucucuggaaaagacugcaaacagaggcuguaagcuaaauaauccuacuaaguccagaguggacaaaaccccagugcugccuguuggcuggcacacagugggcacggccuuugcaagcugcugguuuaauuucaacagcuugcccugucccaaauauguuugcaguuggaaagauagcuuccugacguucaguaauuucuguuuuauuaagagaguaaaucaaccgagcacagaagguugccggaccaggccaguaagagccaguuucacaccucuggcucuugagccuggaagauagguuauucuggaggauauucuggcuuuccuugucuccuuaucugcagcuuacuuuaaagcuuuguugaaaaugccaagaggcaccggggucacagcuugccgcacagggagcuaauccacagacgagcccugcucuguugaugugcaagaggguuauuuuucuguugcuucucuccagaacgcagaccucaacaguucucaguaagguuugaugauuuucugaaacaugcuuguuuaauaauuuauuuaacuuuaaacaaaaucacaacagcucucacuguaguugcucauacaaauucaaaacauuggcuccuaacaaagagcgaugacuucagcucucagagcucagguuaugauuuuuuacuaauuuugaaggcaaucaggugaggauuguuuggcccugggaaagccccuccccaucuggagcccaagcauccucaccuguaauguaaagaggacgucuucagcauuagagaccucggcccaugguggguacaaagucaacggccauucucauaccaacgucugaugcagucgcuuguucuccucuaucauggaagacacagaaaauguguuaagugcgugaagugguucuuagagucagcugcuugugaaauccaugacaaugugcacgcccuaaagucaugacugugcgucaugacuccaugaugaauaucuagacaaguuccuuugaaagcugugauuuggaaguggguugcucagaguguugggcaaacacacagugugcccuuucccacucaacuuguuaagguaaucgcacagugggcccuuuccugcucccugcaggggaccauuaugacaccauccaaguucagccagauccaaagacacacagugacuuuuuuuuucuuuuucucuuuuuucuuccaccacuaccuccuccccuuccuccuccccguccucuucucccuccucuucccccuccuccuucgccucuuccuucuccuccuccuccuccucuuucuaacauuccaaacagggugaguuuaagguaugugagagacaccucaccauggaugaccuggccaccgcccuugaggggaacagagugaaggagauguucggcucagggacagccugcguugucugcccagucucugauauucuguacaagggccagguaagagaaguaguuuuaugugcucaucauuccuagcccuuugcccagggcuggugauggcgcagugauggagacguuuaucauccaggcugagaacuuaagauuuggucccugggacccacuuaguggaaggaaagaaagugacuugcaaagcuuaccucugaccuccucuccugcacuugucugcacccuccuccuacacacacacacacacacacacacacaauaagcgaguaaaugagugaauggaauuuuaaagauauaaacauuuaccuguaauugaaugaagucauaacgugagggaaauuggagagcaugguccuggguuggcucaaacauuucaccuuccuggugguuucaugagaacucaaccaugagaucaagucagcccugaccuuggaaaaugugugagccuaacuuggucagacuguccccugguucugccagcccgcugcaguaggaauuaggaguggagcggccacugaaugcaugcgaggugaaauuucaucagaugccauugcuguugucaggguucaguagaacacugcacagacauuucaacacuuucccuuuuuuaauauuuaauaauuuauuuuauguaugugaguacacuguagcugucuucagacacaccagaagagggcaucagaucucauuacagaugguugugagccaccaugugguugcugggauuugaacucaggaccucuggaagauuagucggugcucuuaaccacugagccaucucuccagccccugcacagacauuucaaaugaugcccucugauguccuauuaucuucuugcuacauuugucugauuuuuuuaaagaacagauuuauuugcuuuuauuucauguguauggguauuuugucugcacgucugucugugcaccgugugugugcagugucuguggaggcccuaacacugcaguuacagacaaccaugugggugcugggaaucaaaccugggucccuggaggagcagccagugcccuuaaccaccgagccgucucuccagccccauuaauucacuuuugcuugugucguguguguauuauuuugacaguucgagggcuuuuccucgugcacaucugucagccucugucuuuauaguguaaggauauauauauauauauauauaggaauugcuuuccaggguuuccauaaguguguagcugcuaugcuguggccaugcaggcagccuguaacugcguagguguuguuccuacaagacuaacuacuucugauggcuuguuagauacaaaguccccugauuccugaaucgaaccuuauaaucucagcugacuagucugaucauuauuacuauucauuaucauugcuauuaauuauuauuauuauuauuuguuauuauguuuugcuuaacacuuuagaauuugcuuuucagggcugguuggugauguaguuugacaugcagauauuucucaguggggaaacuaccugguuuuauguugauauggcagagagauggggaugagggaggaggaggaggaggaggaggcaugcauaccagggagggacagagagaagcaaagagaggaagaaaggauuguaagggcccagucugaguauuuuacgauaaugucuagguauguuauuuguccauuuuaguaacuaaaauccaauuguuccuccacucuagaaauaaaaaguuuacaaagguuaacuuaucuuuaaugcuucuccuaaaugcuccagggaggcauucagagcccaaaggguuccuaauuaucguauuauacuaaaaggcauaauaagaagaguguuugagaauaugagcuaucuacuaacuaucaaagcaucaaaagccagcccgccagcaaggcaugaacgggcauggcucagauauaagccaagggcaugagaucucuuucagcuaggaauuuaacccugccuucccaugggaguuguggcccauggaggugcgcccugccccagauguagguucagaaacuccuuauguaaaagaagagccuugcuuuaauucaucucuuugaaaugucuugcuuuuguuuguugagaaauaucuuugaggucugguuccuugccagcguguucaguagggggcaauuauccauccuguggauucuuagacuccuggguugaguuagucuacuguuucagggaccccuucuagucugaauuccuuuuuuuuuuuuuuaaagauuuauuuauuuacuuuaugucuaugugcacacacuguacagauugugagccuucaucuggcuguugggaauugacuuuuagggccucugcuugcucuagucaaccccgcucacccugucccaaagauuuauuuuuuguuauagauaaguacacuguagcugucuucagacagcaccagaagaggugggucagaucucauuacagaugguugugagccaccaugugguugcugggauuugaacucaaagaccuucggaagagcagucagugcucuuacccacugagccaucucaccagcccuauucugaauuccuuaaaccacccugaagaaugauuuccaaaccuuuugugcuuucaguugaguugguaggaaaugaauauguugucauuaauugacuuuuuuauucaaguaggagaaucaacaauaugaacuaaccaguaccccgcagaacugugucucuaguugcauauguagcagaggauggccuaguuugccaucaaugggaggagaggcccuuggucuugggaagaucauaugccccaguacaggggaaugccagggccaggaagcgggaguggguggguaggggagcagagcgggggggggguauaggggacuuuugggauagcauuugaaauauaaaugaagaaaauaucuaauaaaaaaauggaaaaagaaaaagcucagguuagggagguagcauguguuggcaguaugucaggugccucccuuggucuggugggauugccuuccuguuguaggaauggucuuccuguucccaccaugcaugccucucccccucagacuccggucuuccuguucccaccaugcgcgccucucccccucagacuccaguguuccuguucucaccaugcgcgccucucccccucagacuccggucuuccuguucccaccaugcgcgccucucccccucagacuccggucuuccuggucccaccaugcgcgccucucccccucagacuccuuucuccuuccuuccucagaugcugcauauuccaacgauggagaauggccccaagcuugcaagucgaauccugggaaagcugacugauauccagguagccaucuucaccaccugggguugggggccagcuggggagaugagauggcucaggggauaagagcguuugcugcucuuguagcggaccuguguucauuucaugucucagcacacccauaucaaucaguucacagcucuggcuccaggaguucugguacacucuuuugugugccucuggcauuccacauggauggugcacauucauacaugcaggcaaaauacucagauacguaaaagaaaaaaauauuaaaaaaaaaaucccucuagggcucaggcuguggucagugagauagcccaaguuuagugcuaaagcauuauguccuccacauaguagaaccacaaaggaaagagaugaaguggugugauucagggcgaguaauuuaaacuuaaggaagauauuccugacagaauaagcagaguugaguaagaccggagaugaaagagagaaggcggggaggggguggggggugggguggggggugggggguguggaaguggaguacucaugagggauguggugucagcuagcauuccagaauaaauguguuucaauacuuuaaaauucugauuuaagaguauaacauguuauuguaaaaauggaaaauauauuaaaaauaggagacaggguuggaauauaguggugcugucuuaaccuaccaugugguaaugucaggucaugucucaauaaccagagcugggggaggggggaagaaagaaagaggaauuaaacuuacccauggaucuagcacuuagauacaauuacuguuaauucuaaguuuugaauguuuauaacuccaauauuauauaagcauuuaccuguuuacuuauauuuuccaacaagauaguuguaauuaaacacaauuuuguuaccugcuuuuucuauauaauaagccaccugcuuuucucucccgaguuucucaggcuggggacagagcucauuugguggaguccuugcuuacugggcacaaagccuuggggucaggccccagccucucacaccagacagcuggucacauuuguaaucucacuacaucuggaguucaggagaccagaggccauccuccaccaaaugaacuuccaagcuagccugggcuauaugaaacccugucuuaaaaagccaaaacuaauaacuaauaaagaaggaaagagaauaguuacuuauuguuuuacaccagugaggugcuuuccauagagaucuuuuauaagaaaguuggugaggagaacaccuuuaaucccagcacuuuggagggaugggcaagggaucucugaguucaaagccagccuggucuacaucgggaguuggcguucaacagggcuauauagugagaccugauuuuuuuuuuuaaagguuaaaauugaaaagacgcacauaggggaugagugcuuaaaugcuugucacccacagaauucagguacccagaauccuauguagauugcugcaugacaugacaacccaccuggugauucugaaagaaagccaggagauccccaaagcaaucugcccaguucaaccagccuuauccaugcgcucugggcuugauugagugacccuaucucugugaauaaggaagaagagugucaaccuuaggacuuugcaugcacgugcacauauauauauauguaucuacauguccacauguccagacacauauagacacgccuacaacaccacacacacacacacacacacacacacacacacacacuggaaaaaggaaaaaaauaaauaacagacacaugugguagagcgguugagaaaacccaaacuuuccccucuugauuuaugugcuucagggacggugacauuaaauccaacgucaggccuggggaaguagaguauuuccgguugcaggcacaugcugguaauccagcacuugguggguggacauggggaucagaaguucacagucaucacacauuuugcaagucugagccccccccccccccccccccccguccacucagaauccauacugaacaaagacaaaggucguaaccacaggcacaggagaucagagaugacucggagucagucacaagcacacacccccgugucccccagugcguuaagcaacagggccuuccguccauaaucaaaaccacaucuucuucccucaauuauuuuaugcuuguguccucaagucuccaaauuauccucugacaagauggcaaauuggugcuguuagccaagugacuagcucgccuguuuccaagaaaaauaauuuuaguaauuacugagggggaaaaaagaagucugauguuacaucauguuugacauuugaucucuuuggguguuacacagaaacaugauguuucccuacaaaguguuccacaaaauuaaagacaagaguuaaaaaaaaacccacaaaagaaaaauuaaaacccaaguucuugccaguaugacccagggggaauuuuugaaaccucagauguauaaacuuuugaauauuaggauaaguacuuguccgguguagcuaauuauccacauuggucccugggugcuagcuuacgggaccuucacuuuaccuccugcaaagggcacagucccaacacaagauuguuuugugccccaccccuucuuuuuauaaugaggagggagaggcacuagcucuccaugucgccugcucuccuguuuccacccacccuacacucccagcucccacucuggggguggggggcggggcaaaagcaccuuuguuucaugaggccacgucucugcugagccuccuacaacgugguugcauuauaaggucauggcugucuguccuucaguguucaaucccuguaggaaccuuuucauuggauuuguuuuuaagacagggucccacuguguagaccaggcuggcccugaaccuuccagaguucccccagagcaugugcggcacaccuccuguggaaagcuuuuaaauaccuccugagcuaccuagacuccaaaguucagucacacccgucccuccuagagcugcuugaaugcuuggguuuuggguuuguuuguuuguuuguuuguuuguuuugcuuuguuuuaaacuucucuuuaugucccuugggauuagcacaagucuuggguagaguauacagacaguaauauuucuucauugaaagaaggaaugagaugccaagauaauuuuuuuuaaauacagcucauguguuacuuuuguguauuuacauauaggaagagacgggaaaugucuuaaacaauauggcauugauagguuucauauuauuaaacaacauacuugagguagucauuuuauaacgagaaaagguuugucuagcucacaguuuuagagauuagacauuggucuggucucugagacuggcagguagguggcagguuucuaugcagugaaaggcaauggcucuagugagcuaagggccaaggccacagcuucaguucugcuaucauuugguagcuccacccuggggacagagccuucaaaccagagcuauugaagagacacggcagacaucacaucacagcaagcaucaaauucuuccaugguauccuaacaagaugaauauuauuaauaccaccaugccugccucggggcagcaggagccugggcuucaggcaucagggaaaggggugugaggaaugggcucuuguuucauggaguaggaaaaggaagcugcagguucauccugaggccauuaucauuuuauugauugauugagauagucuuuuacaguccaggcuagccuuaaaugccugucgauccuuacugccuucaccucccaagugcugggacuacggguaggugccaacacacucauuuucuuuuuuuagaagauucgcuuuuauuuuuaauuaugugucuaugggaauagagggggugguaugugcacaugaaacagagaggguguugaauccgcuggagcgggaauuaaagacuuuugaacccaggugcugauagaagccagguccucuggaagaucaguccgagcucuuagcugcagagccccugcugcagcugauggagccugugggguuuuguugagcugcucgcuuuuagacugaagcacguguuuuugcuuuuguuucaguauggaaggguggagagugacuggacaaucgagcuacccugacggcaaagcucaggguaucggugacggugccacagaagagcgacuccugcccucgagcugggaccaccugugaccaucuagucuugcacauuguagucgcguuccucauguguuaccaaaugagguuuuuuuccuugagccacagaaaguugccaguguucaaugccaccuauauacaugguagcaauugcuuacuguagucucccucacccuguaccagauccuuaguaggagaauggguucccaaaccaauaagaugucuaugugcuggaagggcuacugaggaaaugucacaggcggccucccugugacucaugggcacucucagagcaggacacuuuguuucuuuugcuggugagguucuuuuguuuuuuguuuugguuguuuuuuuuuuguuuguuuguuucuaauuggggcagauuugggcuccccaugcagcccugcuggccugguguucccuaauguucaccccggcuggucucagacucagagcagccuucccgucucccucagccuucuggaugcuggggugauugacaggcguccuaccaugauuuguuuuuguuuuuuaaucaaaaguucggucaccuggauuucuuuucuccguuggucccuggguccacgcuaaggugacugucccuucuucguaucacggucugcacuaaucucacccaaggugucugaggcugguuguccgcacugcccuuuuuacguaacuauaacuggcugcucacugcgcugcuaugagacuagggguccugugccuucuagaucuuugcauccucaaagcccagcacauaguagguauuuucaguacauguuuacucuaagaaugaacauagaaguguacuuucugucucuccaugcugaaacccuuucggaagccaggccugauuugggcagcauguagcaguauuuaccucaggcugucuuuccuguccauggacuccuccagacagcacagucaguuggaagaauugucuuauguuuuaagauuaucuuggaauugaagcgauugcccuggaaagaugaaauacuaaccacauggaagugacagauacuauacauuauguguuaaaugccaaauaaagggucagguugggagauaaacucuggauuugaaucuua

SEQ ID NO: 3479 - RNA, 2874 nt, Mus musculus
agugaaccacagcacagauuuuucucuuuauuacuguuguuucagucaccaucuauagccaaguccaguuguggaucugcaucaaucccaucuacugccuggcucuuuugaugcagccgagugauacucugcccaauaggcauggcaauaugucauuaggagucauucauugcuauguuucuuuagcagaauaauaguagguuuuccuuuagucccaugacuuauccagucucaguuuggccacuucagcagugcaauguauggguuccaucucacagagugggccuuaaaucuaauagaaaaguagccaguuacucccauaacuauaagugagggcagaaaggaaagcuuauuugaggagucaaaaugcugugcugucuuggcaggggaguguguguguggacagagcaggaagccuuuaggcgucaggaaaggagaggucaaggccagaaaaguguagguguuagugcaggguuaguuaggaacuagaugcccuugccagaggucagguccgcaagggguacaguggcuuccuugguaacacaauccugcaauaggagauugcuaucagaugcugauaauuccccccccccuuuuuucccuuuccuuuuguaacaauccuucuguuuaccugaucaagucagaguccuucuguuuaggacacaauuaccugcauugccauuugagggccauuuuguauccaacaauaacauuuauguaacuuuguauccaacaguaacauuuguaccacuaucuccccaugacaucuugcagucaggucuccguuguggaucucaugguucauagauggguaauauuggugauuacuuuucuccucuggugguaugugaugaaguaccucccagugccaugugugcuggucuggagggguagagcuucaguuaggcugauauucuccauguuugaugacauaugcaaauuaugucuucagcaaacagggcuuuaccauuagcuuauggagaguaaacaauagccuuggcuauagacugugauguuugggagaguccaugggaccccuuuggaaacaagucucagaggugaacaauagggagaauggaggcccuguuauuauuuagcucauuaaaaucaguagugaaggcagaaaugaaggaguuagcuucugccaccugagugcgaggacucaaggucagcuggugguccuuggagcugguagugauuguggauucuaaccccuagguugguuuguuugcuugcuugcuugggaggcugggucucacuguuuguagcacaggucgucggaaacucuuagcaaucaucuuucaucagcccuucaagggcggggguuaaaagcgacagacaccaccccgcacuaacaggacggcuguuuugccugaaccauaggccguauggugguugcaucggaggcuacuggcagggaacagcgaggcagaguccacguuucgaggucagcaacuguaggacuguugcaggcgagagccgaagcacaaaugcaggucccugcugcaaauccagaucggagagagggcccuugugaugcuaaugugucucugagauguccagagcccugcccuucagaguuccuuaguaaagugcgggugcuccugagcccucuaugcgcgugcccagccaugcgugacugcacgcacccgcaacgcggagaugcugcaucggcugcgcucgccccugcgccgggugcuugcugguggcucucccaucguaccucuuucacccgccacgccaaacugcagucccgggcugucgggauccgcggugcgccacgagucgccgcugugccacguauucccacgcucccgcagcuucgucauggccugcuugcccagagcaacugcaacccuggcccgccagguaccugcguggcgaaaggcgaggggcgccaggaccagcaucccgcggggacucacucggggggcggggguuacugcgguagggcgccacuaggcucuuggguauuaccgcaaggcaacacuggucgcgaggggaugcggggaggggggcggggcugggggguuacggcgagggacuuggaggugcgggggaacucggaggucgccacuaggggacucaaggauggagauaauucaugggugcucguggucgccacuggggacuccggagcuaagagugucuccacuggggaauucuggggucauccuggggauuuucacggaggacacuacuggggacucagggaucacuguggggauuuaggggucgucgcaagaguugcuggggucacagacuagcacggagagaaaacgugcuagacgagggucgccacaggaucuugggcacguuagggaugaugugauggcuggggaucaccagggaugcuggagucuaggcuaggaaaacuggaggauuaaagggaagauuuugccaccaaaacauccagaccgcugccuuugcagucuuggaucccuucguucccucuuucccaguuauuuagcaaacuggcuuccagcuuuugaaugccugccccuuucccuaguuaauucggaaccacgguaucauuuauuuauuuaauugcuggcaguaucaagagaucuuguuuuucaagugcaauguuuuggccgccgccaaagcaugggggacccuguggguggagaaaaugguuccagccaguccgcauccccucacgcuuaaagcagccugccuauugugcgcccuugauugacaagaccacgaggcugagcgcgcucgggagauuuuuuuuuuccccaccccuuuauaaauggcuuaaacccucguucuagacgacuuacuggacauuugggagacaauugccuucuuguucuuugcuggagaaccccggcuccugggcugacccggaauuuaaggagcuccucccua

SEQ ID NO: 3480 - RNA, 2630 nt, Mus musculus
uggucacuugaacaucauggggcagaauaacaucauugggcaucaagccccuauuagaaauaauaguguccuacuaaaaugacaacgccaucauuccuuuacucaaaguccccagggagaaaggacuuacagcuccuccuugcacauauccauguuccuggaauagcccgugacuuugagccaugcacucauccaacuuugauaacuuccaggacuccaugcaggucucugcagcaauuaaguuguuuucuaguuugcaaacuaaagguuuuucccagcagcaaaaauaaacuaaaaauuccugaaaaucaacuguaucauaaauuaccaucaaagugcauggggcagggguaggcgaaucuuuuauuacucauacucugugggaaaagcaauugggaaggagaacuaaggcaggucucuaaaagcuuucacaaguuacaaaugccaaguuuuaucuauauaauaauuucaagccacauaguuuuaagucauucuucaacaagguauaccauccugguauuauauuacuccuccccucucucccuacucccacuguuaauauuauuaguuaaacacaccuguuaaauuaccuuucaguauuacacuaaaucuucagggaaagaaaacaaaccaugaaauuaaaagagaaaagagagagaugguuauggcaguaagacucuggaagcuggagcccaugagugacuaugagucaacccuagcaaaccucaguggacacucacuacucuucccaagaggaagcaagcagaaucaacuaggaucuguacacuuggacacuaaacgcaacaccagucacaauugucaguauuagugacagggugccacuauguaacuucaaucauagcucuccuugaacuaagggucuuccccugccucagcuuccauccagcucaacacaauaauuuuuggacgaauuuugagaaucuccauuuucugcuaguuaauuguaaaguaaccuuuaauucaucuuuaaaaauaaucuacuuugaaauuuuauuuuuccugaauaauacaguccaaaagauauuaguugucuggcucuaagcaaaagcagcagccuuaagggacaggaugaagggcugggagaccuuaagaauucaagacaaaggaaacaggucucagguaaaagugguuugugacagcagccuagcagaagaggacacugauuggguggagaggguaguggcacagguuguuggaguuaggacagggugagcauuccaggcaagagugggaucugggagggaagguacgagguggugacagugguaagaauuugguucuaguagaagugaugauccaaaaaagucaauuaaugaggauaauaggaaccagcuuuuuugcuguuggacaugaguuuuagaauuacugacaggaagcuaaaauaaaaauaaauccuguaauaugggaacaagcuaguaccagauuauagaaaggucacuaaaaaccacacacaugcacacaacacucaagucuacaggugcacaccuuuacuagguggcacuuacugccaaaugggcaguuccauuuguagugcuucuacuaccguauuucucaaccccugggucaugaccccuuuggggucaaaaugauccucacaggggugaccuaugaccaucugcuugucagauguuuaugauucauaacaguaccaacauuacaguuacaaagcaacagugaaauguuaugguugggaaucacuacaccgugaggaacuauaugaaggggucacagaacuaggaagguugagaaauaguuuucuaguacauacaucguacuuccuaagauaccccauccgugugcugguuuauaaacccgcuacaugaacgaggcucuugggaagaaauaaucucacaguggagaaugguggcaaguacuguauucggguggucagaacuaccaucagccauacuggauggaacacagugggaaucuuuuuuagguuuggucuaacgaggccucuccuucuccuuggcagcuaaagcaccgagucaaaagcauggucagcagcauggaugcugucugcucugccucccguggaaccuuuccaagugcucccuuugcccgcugccucuuacucugcauucuccuuaaggaccaaccuucuugaucuugaucgaacaacccaauuuaucuuaguuuuaaaauuuccuccaagaauacucuucuagauuuggacucuuaguuucuuccaaauaaucaagccaagccuugagagcagggcagacagcuuuacuuuugguaaggaaagcaggcuuagaaaagugguguuacccagugccucaauaaaacagcucaguacaaauaaccauuuggggggauaagaagucuuaauggcaaagcacuugcacaaacaagaggguccuguagaccugcaaguuuguaaucccaguguacauacaggggggugagagguaggagaaucccuaaaugaaggaagggccagcuguuugcagcaacaacuaagacccguggaaaggacugacagcugaggucaucagcuccaaaugcacacuggcaaguacaagucuguacacaagaaugaaaagccagcucaccagcuccaugggaagaucucugguucuuuaagauuuacaaugcaguuauuugca

SEQ ID NO: 3481 - RNA, 2630 nt, Mus musculus
ugcaaauaacugcauuguaaaucuuaaagaaccagagaucuucccauggagcuggugagcuggcuuuucauucuuguguacagacuuguacuugccagugugcauuuggagcugaugaccucagcugucaguccuuuccacgggucuuaguuguugcugcaaacagcuggcccuuccuucauuuagggauucuccuaccucucaccccccuguauguacacugggauuacaaacuugcaggucuacaggacccucuuguuugugcaagugcuuugccauuaagacuucuuauccccccaaaugguuauuuguacugagcuguuuuauugaggcacuggguaacaccacuuuucuaagccugcuuuccuuaccaaaaguaaagcugucugcccugcucucaaggcuuggcuugauuauuuggaagaaacuaagaguccaaaucuagaagaguauucuuggaggaaauuuuaaaacuaagauaaauuggguuguucgaucaagaucaagaagguugguccuuaaggagaaugcagaguaagaggcagcgggcaaagggagcacuuggaaagguuccacgggaggcagagcagacagcauccaugcugcugaccaugcuuuugacucggugcuuuagcugccaaggagaaggagaggccucguuagaccaaaccuaaaaaagauucccacuguguuccauccaguauggcugaugguaguucugaccacccgaauacaguacuugccaccauucuccacugugagauuauuucuucccaagagccucguucauguagcggguuuauaaaccagcacacggaugggguaucuuaggaaguacgauguauguacuagaaaacuauuucucaaccuuccuaguucugugaccccuucauauaguuccucacgguguagugauucccaaccauaacauuucacuguugcuuuguaacuguaauguugguacuguuaugaaucauaaacaucugacaagcagauggucauaggucaccccugugaggaucauuuugaccccaaaggggucaugacccagggguugagaaauacgguaguagaagcacuacaaauggaacugcccauuuggcaguaagugccaccuaguaaaggugugcaccuguagacuugaguguugugugcaugugugugguuuuuagugaccuuucuauaaucugguacuagcuuguucccauauuacaggauuuauuuuuauuuuagcuuccugucaguaauucuaaaacucauguccaacagcaaaaaagcugguuccuauuauccucauuaauugacuuuuuuggaucaucacuucuacuagaaccaaauucuuaccacugucaccaccucguaccuucccucccagaucccacucuugccuggaaugcucacccuguccuaacuccaacaaccugugccacuacccucuccacccaaucaguguccucuucugcuaggcugcugucacaaaccacuuuuaccugagaccuguuuccuuugucuugaauucuuaaggucucccagcccuucauccugucccuuaaggcugcugcuuuugcuuagagccagacaacuaauaucuuuuggacuguauuauucaggaaaaauaaaauuucaaaguagauuauuuuuaaagaugaauuaaagguuacuuuacaauuaacuagcagaaaauggagauucucaaaauucguccaaaaauuauuguguugagcuggauggaagcugaggcaggggaagacccuuaguucaaggagagcuaugauugaaguuacauaguggcacccugucacuaauacugacaauugugacugguguugcguuuaguguccaaguguacagauccuaguugauucugcuugcuuccucuugggaagaguagugaguguccacugagguuugcuaggguugacucauagucacucaugggcuccagcuuccagagucuuacugccauaaccaucucucucuuuucucuuuuaauuucaugguuuguuuucuuucccugaagauuuaguguaauacugaaagguaauuuaacagguguguuuaacuaauaauauuaacagugggaguagggagagaggggaggaguaauauaauaccaggaugguauaccuuguugaagaaugacuuaaaacuauguggcuugaaauuauuauauagauaaaacuuggcauuuguaacuugugaaagcuuuuagagaccugccuuaguucuccuucccaauugcuuuucccacagaguaugaguaauaaaagauucgccuaccccugccccaugcacuuugaugguaauuuaugauacaguugauuuucaggaauuuuuaguuuauuuuugcugcugggaaaaaccuuuaguuugcaaacuagaaaacaacuuaauugcugcagagaccugcauggaguccuggaaguuaucaaaguuggaugagugcauggcucaaagucacgggcuauuccaggaacauggauaugugcaaggaggagcuguaaguccuuucucccuggggacuuugaguaaaggaaugauggcguugucauuuuaguaggacacuauuauuucuaauaggggcuugaugcccaaugauguuauucugccccaugauguucaagugacca

SEQ ID NO: 3482 - RNA, 1038 nt, Mus musculus
cccagcgugcacuagcggucucaaaagauucaaaguccaagauggcaacccucaaggaccagcugauuaugaaucuucuuaaggaagagcaggcuccccagaacaagauuacaguuguuggggucggugcuguuggcauggcuuguaucaucagugucuuaacgaaggacuugguggaugagcuugcccuuguugacaucauggaagacaagcuaaaggguaagaugaugaaucuucagcauggcagcuucuuccuuaaaacaccaaaaauugucuccagcaaagaguauuguguaacugcaaacgccaagcuggucaucaucacagggggcccgucagcaaaagggagagagccggcucugucugguccagcgaaacgugaacaucuucaaguucaucauuggcaacauugagaaguaccguccacacugcgagcugcugauugucuccaauccaguggauaucugaccuacguggcuugggaaaucaguggcuuucccaaaagccgaguuauugggagugguugcaaucuggauucagcuggguuccguuaccugaugggagaaaggcuggggcuucacucgcugagcugucacggcuggguccugggagaacauagcgacgccagugugccugugugaaguggugugaauguugucggcgucucccugaagucucugaacccagaauugggcacugaugcagacgaggagcaguggaaggagguucacaggcaggugguggacaaugcguacgaggugaucaagcugaaagguuacacauccugggccauuggccucucuguggcagacuuggccgaaaacaaaaugaagaaccuuaggcgagugcaucccauuuccaccaugauuaagggucucuauggaaucaaugauggugucuuccucagugucucauguauccugacacaaaauggaaucucagguguugugaaggugacacugacucccaaggaagaggccggucugaagaagagcgcagacacccuuuggggaauccagaaggaauugcaauucuaaa

SEQ ID NO: 3483 - RNA, 3140 nt, Mus musculus
aggagaggucccugggggucugauugcugugcuuugggaaucacgcgcaggugauauacuugagaacaacccacuuccuuuuuggacuuuaugccaugcacagcagggugaauguugcuugccaagacgucgacguggacagagugcuuguucuagacauagagacagaggagagagcacccaggucaggcauuuuuuaccaaggaauaaaauuaaauucagaguauguuuuuuauuuuuaaguuugacuuuauaggauauuagucuccauuuauauuuguaucauuuguguauaaagccaaaaaugagucaguacuuugcucucgagcagugacuucacugcagucaacaguaauauuuagacaggagcugccaggugccucagcccuucccauucuccaguaaauuugguacaguauaacuaagacuuuaaucugaaauuuaaaguagcuuuuaauccugaagagaaugcauccucuguauuauuuacaugcaauaauaugaaaguggguuagcauagugaugccgcaaccacacucaaggugagcugaggugggugaccacacccaacuuacuucugguuugaugaauguucgaugaagccgagaaugcugcuuuauuuuaguuuccaaugaaaagauuuaagacuggcugugaaguaguagacacuuguagagaacugaaauuuguguaguguugccuucuacccaagugaauugcagaccucagcugaacgccgacucacccagugggucuugcugucacugccucgcaggugacuugagaaguaaauuauucuuucugaaauaaccauugccugaacacauuugcuccagauuuguagcaacuguuucauaucucuauauauuuaaaaagaauaauucaaaguccgaguaacuugcagcuuucgguggcacgggugaguccacaggcccagggccugccuuacucucagacucuuccucuguugagucauugcauugaucagauaaauugaaaccuugcucauaaaggaagacacuguacaaauggauuaucuuccauuuaaaccaaaauguuggugguagguagguuacacucuaugaaaaaaaugaaagaugaagcugggcgugguggcucaugaccgugauuccagcacucuggagguugaggcaggacaguugccaggaagcccaggcuauccuaaguuacaggggaaguucuaggauagccuggggucuggugugagacccuguggaaagaaagagaauugcacagauccccugacacacucaguugugaacugucuggcuuacugaggaaccuaaagaagggcggcuucccaccagcucgcagcaguccuggcucuccaccaccgucaccucugaaccuggaagcugccagcuacucucccggccucccggccuccccgacugguggggugcagccuugagaguugacaagcacguugagaagcugugcugugucacgagucacagggccuucacaggcucaucacuguccaguguuuucuaaagcuuuuuuagcucggggugggggugggggggggaaacaacuaauuuguguaggaacaucugaaaauauuuuagucugcugucacaguuuuuaccuauugugacuauaaaugaauuggcuuaugaacccuaccuuuggcuacaugucagagggguacagccaaugguauuaaaaaacuaccaaaugcaaaauuuugcauauggagaaguauacagguucuaaauaauaaauuagaucacaaauuuuugugucuuuuuaauuaguacuacagguuacauuaugugguuuuucuacagguauuaaauauauuacaaguuuuuuucuuaccaaugaauaauuugaguaucauuggucuauuugaccuauagaguauccucuuucucagagaaucacccacaguggguuaccucacuuuguguguuuauuuuuuuucauuuccuuuacauuuuggcuguuaguguuccuuuuuugucuccgugaacagggaauuuuauaugugaggcuucaguugguauugauagaaguugcccucugacugugcagauugacauaacuaucagggggcaguugggcauagcuccgcccagcagagccugcacagugaagaugcagcucaugguacucgcuguggaguguggcagcacggaccgacagaucagcacuccuccacagcuaagacagcccaguccugcggcaacacagcugcuuguaagugcaaaaaggucugcagagacaagaagucuucaccuagagcaacaucugggaacaucuuugcaaguaaggaccuugauagauugaggaaaucaugugaaaaagacaaaggccugauggcaggcgggcacaggaagaugggcaguuagcauuggacauugccuuugacagguuaggccuuaauguauauuaaacgaugcucugugugcuucccaaacacaagccugucuugaucgguagauacuguggcgaggcuagcucgugaguauuccuuuuguaucacgccaguguuuuaaaguuguguguucguaugucugcugugguauuuuuaaguucugggagaagccugcuggccgugucagcucacggccaucaguaguuacucaguauugcugcuccacguuucccagugcaccuuccaugccagggcaguggcugcgugcgugcaagccgcgggagcgccuucccgcucauuuuauauguauuuauagaaaccaaaugaccgcagauggcuauauggugugguguuaaaccaguggaacucuaauggcaauaaauauaugcauaugugugggagaggggaaaaguggaaauacagguuuacagccagacauggugggugauagcccuucaguguauuucucugucccuucacugaccuagaaggauuugagcugcugcagcuuuagacagaaaauguccacauuugcugauugugggccauaaauaugcuuuuaguacugcuuugcugauguauaaauaagaaaucuguaauauguacuauauguaauuauuuucuuuugacuuuauuucaaaauguauauuuucugauuauuaucaugagcuauaaagcaaaaagaucaauaucugauauucucccaaauaauaaauuuucaagauucauuggagcaaua

SEQ ID NO: 3484 - RNA, 8274 nt, Mus musculus
gcugggugcuggucuggccggcgacgcgcgugcccuguggccaaacacugcccggagugagagcaaacuaccagcgcagugcgugugugcgcgcgggugugcgcgcgcgggugugcgagagggcgagcgagcgagcacggggcggaggggcggccaacugcuucacacuuucaauacugcacugaagagggagagcgagacagccuggagacgcacacauccccccaaaaucucuccaggcgaccgucccacagauuacaggacagaaaccuccaaaucgaaacggacagccauugaacauggacgaaggaaucccucauuugcaagagagacaguuacuggaacauagggauuuuauaggguaagguguacgcaccguugcgaauaucugucuaggcgucgguuuggcuuuuuuuuuuuuaauccccugcacaaagugauauggagcgggugagggcagagccccucccggaaugggggccugaugcugauuucuguuuuugcagacuggacuauuccucuuuguauauguguaaacccaaaaggagcuugaagcgagacgauaccaagguaagucuuaaguuucccauaaccugccuggauaguuaauuagggccauugauuucgcaaggaaacucugcccgcaaauauauuccagcccugagcuuuccuaacugugaauuuuaaguggcuugcuggauacuccgggggauauucaacaccgcaccugaauuuaaauugcauuuuagaagucuagaggagagaguucugggcauuaguucauuacauaguguguuuggggguuggggugggaggguucuauccaguaagugaaugaauguuuagcucacugcuguaucuuuucucuggcucguguaugaaggauaccuacaaguuaccgcacagauuaauagaaaagaagagacgagaccgaauuaaugaaugcauugcucagcugaaagauuuacugcccgaacaucugaaauugacaguaagaugcacauuuucauucuccugauggacuccgggguguauuuaccugauaaaauucccagagauaggauaauaaauguaaauauuaagaggccugccuucuaacuugugcuguaacuaagaguuucccagagacucagaacaggggcuccgggcuaauggcagagaucauugacgaccugacuguggggagcugagcagcgcuuccuucccaguggugugugugugugugugugugugugugugugccugucuuaaguugcugggcugcguggaaauaaaaaugcguguuuuaaaguaaccccugucccccuuugucgcaccacugcagacacuggggcauuuggagaaagcaguagucuuggaauuaacuuuaaagcacuugaaagcgcuaacagccuuaacugagcagcagcaucagaagauaauugcuuuacagaaugguaagugggucugaggaagccagccugcccugauacaaaaggggguaacgcugggggcgcaacgcuaggacucccccgcugcguccucuccuggugaacgucgccucuuucccuuugguggcaaguacccagagcaucccaaaggcuucccgcagagcuggaggagccccguuuuuauuuaaaguggcggcugcaccucuucaguuggguuuuucagccaggaagagagcgccucaccgcgccacccccuccucucucggcagucugcggauuauaucgcuggaaugcccaggaaaagccgagcucacuguaggcagcgcagggcccacgugaugagcagaugucuuaacgccgcgguuuuucuucucgccucccucccccgugcacccuaggggagcgcucucugaaaucgccgguccaggccgacuuggaugcguuccacucgggguuucaaaccugcgccaaagaagucuugcaauaccucgcgcgcuuugagagcuggacacccagggagccgcgcugcgcacagcucgucagccaccugcaugccguggccacccagcuccugacgccacaggugcccuccggcaggggcucugggcgcgcgcccugcagcgcgggggcugcggccgccucgggucccgagcgcgucgcccgcugcgugccggucauccagcggacucagcccggcacggagccggaacacgacacggacaccgacagcggcuacggaggcgaggcggagcagggccgcgcggccgucaagcaggagccacccggggacucgucgccugcgcccaagaggccgaagcuggaggcgcgcggcgcgcuccugggcccggagcccgcgcugcucggcucgcucguggcgcuuggcgggggcgcgcccuucgcgcagcccgcugccgcgcccuucugccugcccuucuaucugcugucgccguccgccgccgccuacguacagcccuggcuagacaagagcggccuggacaaguaucuguaccccgcggcggccgcgcccuucccgcugcuguaucccggcaucccagcagcggccgccgcugcugcugccgccgcuuucccuugcuugucguccgugcugucgccacccccggagaaggccggcgcgaccgccggugccccguuccuggcgcacgagguggcgcccccggggccgcugcgcccccagcacgcgcauagccgcacccaccugccgcgcgcugugaacccggagagcucucaggaagaugccacgcagccggccaaggacgcccccugaacccagcauuccuuccagaacagggcagggggcucccgaggagucgccggguuuccaaguucaaacguccucuaaagcgugccagggaggaagaguaagcgaugcucgacaggcuuaggacaaaaacagguguuuuguguauguuuggaguuccuguuuuguccgucucacccuuuugccaccccacccaguacccuuucacacccccucccccgucccugcugucaaggagccucccugauaaaugguuaucuucuauuacucuccuuaccuuuaguucucguucacucuuuccaaauacagacucugguucaggagucuguugggugggagagccauguggaaugacuuaagagugccugguaccagggcucgacccaagccuggaacaguagaugugucucccaacuguccccuuaggaggugguccauuaccugagagucucugagaguuacuuuuacauggcaguauuuuguauuguucaucuuuuuuggaagguaccuauuuucaaagaagugagaaugcuuguugcccgguuaugagguggcuggagugugucuauaccuugcaccuguugggagaaauugagaguugggccaucuugaggcacuguggugggagcuggaagagggagguuggagccuuggcgccuuugcucgcacuuuauugacaaauugaccucaaacccuuuguuucaugucucagcucacacauauaugucauagguuauauauuuguguuucugaucccucauuauuuuauccaucauggucccaaauuuuuguaacauuacuuuuuuuuuuuuuuuuuuuuuuuuuuuuuuuuuuuuuuuggagaaggacauggauguuaaagugcucugggcugggaaaagaaaaguccaaacagauugauuguugaauucuuagaugacagaaguggagagaggggcuugcagucccuugugaugggaagugcugugaacauagagaaggccuugccaggccucucaaggcuguauguauuuuucgggagaccaaaaccagauaccagaagaaaguuuuucaaaaucaggcauaaaccaagaccuugucuagauauuuuuaguuuguugccaagguagcacugagaaaucucacuugaauguuacauaaggggugagacacaauagugaagaaaguuaccuggggcugugaguguucgggucguuugcugcugcuguugcuacuguuugccucaaacgcuguguuuaaacaacguuaaaacuucuuagccuaccaaggcggcuguauguacauagcuguugauacucccaauuaaugaugucugacaugcuauuuuuguagggagaagauaccugcuaaugauauuuuuaguuaaaauaucuuuuggggcggacuuggugaaauguuugcacuuugguuacaugcuuuuacugcuuggugcaagcuuacgcugucuuaaauuauuaaacaaauaaaaauauuaucugcaagaaaaaccagcugguuuagacaaguuuaguauguaaagauaagcuagaaacuaucuuuauauucuaguauuuucagcacuccauauuaccuaaauauugccacacuauuuugugauuuaaaaguucuuacuaaggaauaaaauguuuauauaugauaugcgauggucuaauaauuaaacgauacuggguacccaaugaguuuucagagacugcuguguacaaggaccugagcucaucugcguacuuggacgcuuuccguuugguuuugguuuuaauauauuuaaucacugguuucuccagggagacuccugguuugggccuuggguccccacuucucccagucuaucuuaaugaaaaccacagaaggaauagucuagcacucgcuggaaggucguucauuguagacccaguuugcuaauguuuuuuuaugauuuaccugguuugggucugugaccccagauacccucucuuguguggucugcuguuucucuucugcccaggucugaaacacacuagggggagagauguuucauucaugcaaauauuuugccuucuuaacuuuuacaaaguagcccugguauugggaguuugccuuggaguucaggaaacaauuuuaggcuuuucucaagcuuaagaucauaccugugcuuggagacaaagggcuguccacuuucuuuggguagugguguugaaccccugacuuaagguguaugagugacaguuucuaagaaacuguaagggaagcacucccucugcugacugugacaagcugacugugacaaggcaugguaaaccggaagccacagcucauacaucugcuaggucaguccccugaacucuguaagggaagaaagucaggcaaggucacagaggcacuggccagagcaugacuaggcccagcaucucccucuacuugaggacuucagcuuucugggccaaggaugcugguuuugaugggcuaaagcuccugaaacugaacaaaccaaccacgggggcaaaggaaacaaaauucagcuaaugcugucagcuagaggcucuguagagccuugauaaugucagucacgagaaagauggcuugcccuaaauuuaaaauuacauaaaaaaacagcauuuuaaguauugugagcuacaucuuguugccauuauugucacgacugaaaagaagaugcaacaguugacauuugcaugguuuuguaacauguaauagaagcuuucuuuuuuacuuuggccagguuuauagguugcuuauucagucugaaguuauaaauaguaacaugauaaaauuacgaaguuagggcagaaaauaaaaauaguaguuuccguauuacaucucaugugaucucguguguuucuagggaugguacucaggacuuuggacaaucugggccagagugcuaccacuggccugggcccucagccucuggaagcuauuauuugagucagugguugauuuuaaugaauuaacagcugagucagaacccacuaaggagguagaagauuugaaacaucagcugaacuuaguacaucaugugaucuuccaacuuaacaacuacgaaucuuuauucaauaaugcaguuaguauucauuaauuuugcaucgauagacuuagggaacuuuguguugaauuuauaaauguucuuacuaaccagcuaaaauuuacauuuucaagguguuggaaaccacagcugugaaacucuaccuggcauucuagucccaugguuguggaaguccuuugacuucacgcuguuacuggcuuaagagaccaagagauuugcgauuccuagccuguggugagugaccuuagccuggugaccauagccuggugaccuuagccugguccuuuucugucacuggucagucaaguguuuguccucuccauaggaggugacugcuugagaccuugggaagacagggcuggacaagcagaccuuaaaggcuuuuuauuucaggaugagcagagugauuuaagacuccuuaugugaagauauaagccuccucaugugaaagaggcauuuuuuuuuugucucagcaagcacaucucuuacuaaaaacucuuuucuucaucuguugacccuuuauuccaauauauuaagucccucuaccaacuauucucuuguuaauuuaagcaaguucuaaauagauuuauaauaugcucacuccuaccucaagugccagcuuuucaugagugaauuugguggagaauugagagaaaaaucucauuuucuagggacgggggauugcacugcaaaugugcuagucucagaguuccgugucugccuuaaaaucauauuucugguacgauuggaacaaacucuaaacaaauacaaaacuguacuuuaaaaagaguugguauuuuaaaacucugagucuugagacacucccguaaacagcagacgcuucuaaguuaauguauuauuuuucuuuucuuuucuuuggaaaaaaauaguggaacgcacacuaaaguuuauuguaucuauccugugggauguucuaggagcuacccuaugcauaugcaauguuucuaacgaucuagggaugggagcaucaauguaacacgauguguuuuugugugugcaguguuugcacuugggccggcccauccggagcaguugugucagaugauuuauacugagucgguuucacaaugaagcgcuggcuggccuggaacuccucuaucgaccacaugccucucucucuccugaguguugagaugagaggcgccaccacaccuggcuacaucuguuuuuucaggguuucagccuuucccuagccagucugcuaacugucacuucucaguggucagagagaggccuccaacacauaccugguuuggugccuguuuacugugggcacggacagaaccacacccauuuucacacgugucuaaaaugggagaaaauagguucagacagaggccccaaaggcccugcuguaagcaaaucauguaugcuuacauucucagggaugguuucuuccacaagcuaucucuauuuucuaaaacuucuagauucucagcagaguuccccaucagauuauuugauaucuacaagugcuuuccauuauuauguaaaaauaaaagccgggugcuaaugguuucggaggauagcaguaagaauaacauucucuugaacuaagacauuggcugguugcuucuuucuuucaggucagugagaccaggguguuaguguuaaagacugguggagcauuuccauucaugggugauccuggacccuuuuucuggguuguaacaccuaccugauggguacagguccagcaagaacauucuggaagcugucuggguggguugcacucguguauucagacacacccauggcagaggcucuaugaaggagcuucagauccacugcacauaaucuuuuuccuuuugagccuauagguucaagccaguaugugaaggugaccaugcauauauuuugcuuuuacagaagaggcuguggaaagugcgggauuaugaaauauuaaaccuugggaccucagugucauagggguuauagaaugauacuaaaaugacacagugacgugacauaagaggugacugcaguggccugugagaugcucagacucucuggucagcagcguuugcugaccucugugugaguggggcaggcuucgaggaguagcugggguuuugcagaguggauaagaguucaugaaaagacuucuggaccagccugucucaagcuacgcuuucaguuucaugaguaauauuaaacuugaggucagagcgaggauuuccuaauuucucuugucucuugagaccuuugacugcccugcuggcucuuagccuugccaucuccugugggaauggacccuagacuggagcgguccugacccuucccacugcaaugggagaugcaguuguauuguuguguaaugauauugugguagagaagggagacugcaccucaccguccggucugcccugccuccugugggcauguguuccaagcagacacagcacaaacaagcauaccccauggugacuucugucucuucugugaaggugaccaguucucacucagugacagaagagaagacaggcauucuaaggacuacuuuuuca

SEQ ID NO: 3485 - RNA, 28207 nt, Mus musculus
gcuucucuccucgccccccucucaagguuuugcucugccgcucgcacacucucgcguguuuuccgaggggcuaccggcccggacuggaggcggagaggggagguuggguggguaggcucugccuguccagagccgaggcuggcuugucccggccguggcuuaguacuuuguggggggaucucucgggucguccugaccguucuucccuacgguugauugggaacaaauguuaaaggcuuuuuuuuuccccucacuugcuccgcccucuuccgguucggccucugguggcuucuaaggagaagggaagauggcggggcugugcgagagcgccgugcgcacgcgcgaguccgagugcgcucuugugcuugcacgcgcaugcgcgcgccccugcguuuaagcagccggaguguugggagaugagccgggcagucagucuucugcggguuguaccagaccgacugugcgccgacuccccacccacccucguccgccuucucucucagccuccguucauucacugcaggaccaggcacgaaaguaagcgaaccucgaugccgaggucuuccccauccacucaccucguucgccgccccccaccccccuugcagucaggugugugcagaagguuugcagacagggacuuuggcggggaggggcggugcguuccagagcagcaggagguaauagcgggacccuaaggugguuuguuaccuugaacacuugcuguuucccaggugcuuuagaauguagguuuaaaaaaaaaauuuuuuuuuuuuuggucuguaaaauuuuaggagcgaagcagggcagugcaccacauguucuguguuuauaagaaaaaguuuuagaaguguuuucucuucgccagcaugggauagcaucugcuuguuguggucuacguggugaauuacuguaguguauugcaaguggagggagaggaugaguuugaagccauagaaagacgcaauaugcaguuaccguaggagaugugugucuauuuuggguuguacuuuugcugucagucuuuuccuguugauuucccuuagccccuaacaaggaucaccauaaauacauuugaggaauuagaucugugauuuguaggcauaagaaucaaauacaaugugcacagauguuuucuucuauuuuaagugcuuuguaaaagaaaaaaagaaguaugaacuaacuucauuugguagauagacugcaugguaugauguggcauauucuuugaacuggcaccauuacuuuggccuuuuuugcacaaaauucucagaacuuaggauccguaucaaaucuugaaaacacacuuaagugagaaaucauuuaugauaaauguuaugugucaucguuuugacuaguuuguuuauccuuuuacagguuaaaacaaaaugaagauuuuuucugaaucucauaaaacaguguuuguuguggaucacugcccauacauggcagaauccuguaggcagcauguggaguuugauaugcuggugaagaacaggacccaaggcaucaucccuuuggcucccaucuccaaauccuuguggacuugcucaguagaaucuuccauggaauauuguagaauaauguaugacauauuuccuuucaaaaagcuggugaguguuaugaacacaauugugaugggaugauguacuuaauuaacugugucuauaauuauuaugugaauuuacuguagauuuauaacuguauaguucaaauguauguagagcugcccuuuaugauuagugcaguguugguauuuaguugcagacagcaguaaugauggcgcugagcacuuacaagauccagguguaucccaaaguacuguauaccuacuggccucuccaacaguccagugaaguauguacuaucuauacauguuaggccauauauaaaguauguuguaagcauggaacaggcacugaacuuugagaacaauugggaauguugagguuauuuuguagcccuggcuguccuggaucucacuuuguagaccaaguuggccuuggacucacagaaguccaccuuucucucaagugcugggauuaaagaugugaaccauuuccccaacuccaaaaaacuaaguuuuuguuguuguuguugcugguguuuuguuuuucuuuucuuuuguuuucaucaguaagaggaaacauugacauuugauagaaauuccaaauauuaaaguuaccuuuagguuugaguaucuuagauguuucaggguuauuugcaaguagauggcauguguucgaucuuacuugcagaagccuaagcuggaaccuagcagaugagauuuuuuugcuuggccaagguccuuaucaucuuaccugaucggauuuuguuuuguuguggugcuaggauugaugcuaacacugcaugauaggcaaacacuauaucacugaguuguauuuucaucccuuacaguauuuuuuaacuuuguauuuuacugagggugaagaaagaauguaguuuaugacuguuauuugccugucaguguggcugucugugccuuucauggcuaucagugcucaaauacccugcuucuucaggguuaccuuuaaaccuucuacuuguuuuggauuuugccuuuugggaaguguauuuaaauuuaagaccuuuuacaucugcuguuugcuguacuuggaguuaucuauuccuggcuuguuuuguggcugguucacuagucaauuuguagcccccucaaguugcuacgucuguagagggccuaugugucaacaccuggucuugaguaguuuugaguuacuuuucauagcauuuaucauucccugaaaugacccuguacauuauauuugcuuguguuuuuccuauacugcuuuaccacauuuuucaccccagacauucucuacauugugacagaacuguuuuaucuaucucuucuuucccauauacucagugcuggaauagcagcugcaugucccaggcauuuaugccuguacaguagauggaucagaugauuuccagugcuaggaaucgugugugguuuuacagugugauggugacugagaaaguagaguggaauacuaauuguuucuuugacgucuauuaggugaauuucauuguuagugauucgggagcacauguuuuaaauucuuggacucaagaagaccaaaacuuacaggagguaugugcaguuuuugaaaauuaucugaaugugguaaaacuuucuaagaauaauuuuuuuuaauuccuguaucuaaugcagaauuuuaauauccuaacuuauauuacaagaaaaacagcucuuuccauuucagcaccccccaagaaaaucucagcucuagugucuuuuuuuacuuauauguuaaauauaauuucuguauagcauuuuuuuauugaauucuuaauaaauuuuaucuuuaaacuuuaucaugauuauuaguaaugaucuacuaaaacuuccacacucaugcuuuuccuuuguuuuuucugaucagaauuuuuguuagaauuuuuauuagaauccuauauuugcauuauaauauucauaaaaguauuguucacuacugugccaaauauuguuuaugauuauuuauuuguagaauuuaucauuuccuuugccucucugcauaccuauuguuauauaccuguauacauauguaucuguauauaugccucucaaagccucucaguaucagauaauucaggguuuccucugcacagacugcaugacaccaggcgucuucugcuucucacauugcauugauuccucuuugugaccauuugucugguagaguauggccuccacaguuccuguaacaugauucuucuucucaguauuuuggauauagaaggaauaaucuuaucgaaauugugaggaucucacuccacuauuccuuugaugcuguugaagucuaguguugugccgugccauuugaaugcugaggucuuaagagucuuuuauuuucucauuuauauucugaacauuuucaguguucugccuguguggggcuuuucuucauuuguuggauugaaccuuauagucuuuuuaguuaaggaaauucugaguugugucuuugauauuauucuuauauuguucaauguauuuauuaguaggauguuggacuucccaguuuaaagucacuuuucucauugggcuccucucuguuauuugacuauuuugaaccuuuaaacucuuauuuggaaguuuuauuuggcuguauuuuaauuuucaagagcuuguccuuauauuuuaauuauguccuuuugucagauuuuuuuucauuuuaugguuguauauauuguaggguuauuaauuagggcuuauugaagaucaguuuuaaucccucuguucccagaguacuuuccauguugagacuuuacuuaaaugccugcugacuuuuggcuaucuagucucauuuacuagcaaggcacugaacaggcaauuagaagauccucaguuguagguagauauuccugucugggcuucacugugcuauaagccaguuguucuuauuaaagaacugcaagggaagagaggccccuuggucuugcaaacuuuauaugccucaguacgggggaacaccagggccaagaagugggaguggguggguaggggaguugggagggaggagggucugggggacuuuugggauagcauuugaaauguaaaugaagaaaauaccuaauuaaaaaaaauaaauuauaagaaaaaagaaaaaaaaaagaagaaaaaagaaagaacugcaaaaugucauagucaacagauuaucucuuugggaccuugcagggucuccagagaguguccucuacuuuuuuacuugugugcuaugaacuucauugucagcuuucugggaugaaagaaaggcagguucugccauucauaggaggauuuuugagacuauauuuaauuuuucgguuuuucauguaguacuuuguuauaguaagagaaguuuuagcuuuguguggcuauuuaaaauuuaaauuauaguuccuuuguacccuuugcuaugcuuaggugauuaguaagccacagguagauggugguuccucuauggaccaggacagacaggaaauucugcauuucauaaagcucuguugggcagugcuaguccaggacuuugcuuuugcacucugcugugcucugugcucuacaugcaugguauguugcuaauguuauucuguguccggcugugguugccugggaaagguaauagauuagggucugaguccgagugugcuguauaauacugacuuagcuauuuguagguuuuucaguaccuccuucagcuuugcucugugugaugcauggugccuccuauuuggaaaugaacucuuccuguaaggugugucaucuugucuuccuucccauguaugcacuuagacuucagcuuguucaguacuguuauguucauugccaauuuuccauuuuuauaauucucagugacauuuccauauucuucuuucuuauuuauuggcuguguuuaauauggggauuuugugcuuuuuuuuauuguggcaguggugggaguauucuuggggauuagauuuauggccuccugcauucuagacaagcacuguaacaugagcugcaucuccuuuauagacuuuucagaccuuaaauuuaugauuccccugccucaccuccauguaguuaguauuagaugccugcccuauuaaggcugguagguuuaugcuuuuuaaaauuuccuuuccuguggucuuaguugggugagcauaaagaaacuuagucuguauucuuuauguuuauucuuuguauuauuuguuagugaagaacauugaauuucugguagcuuuuguuuuuuucuauuguuuauuuugggcagaagaugucuccucgguucuucccugaugccuaugaacagcaugaggcaaagggauuaaugaaauauuugaacgaauuuacuuaaaaauuuuucugcuaaugaacacuccuuaauggaaauaaucauuccaagguuaggguuuuuuuguuuuguuuuguuuuguuuguuuucgagacaggguuucucuguauagcccuggcuguccuggaacucauuuuguagaccaggcuggccucgaacucagaaaucagccugucucugccucccaagugcugggauuaaaggcgugcaccaccacgcccggcuuccaagguuaguuuuaauagaagauuuuaaaucguguuuaucacagugcuugguccuacaauauuugugauuagucuuuuaaacuguaacggugucuaacucucauuguuuugagguaagucacuauauuagucaggguucucuagagucauagaacuuauggguagucucuauauaguaagggaguuugugaugacuuacagucugaagucuaacuuccagcaauggucagcagcagcugugaauggaaguccaaggaucuagcaguugcucagucccacaaggcaagcaggggaagagagagagugaaucuuccuucuuccaguguucuuauuuaggucuccagcagguguagcucagauuaaaggugugugccaucacaccuuuaaucccagaugaccuugaacucagaguucucucugucuuaaucuucuggaacucagccacuaugauaaagaucucaaugccaagaucaggguuagaaacuuguaucuccagccuccagauuaggaucacuggggagccuuccaauucuggauuguaguucauuccagauauagucaaggugacaaccaggaauggccacuacagucacugagaaauggaguuuuguuggcuuggcuuuguacuuuuaccucuccagaauauucuuaauauucugcuaauuauuugaaaacaauuuaaggauucuauaaaggauucugucuuucaggaaguacaaugaaaacaaaucuuggagccuuucuacuuguguauaaauaaaaaucagcacauacuuguauagaucuuccuuucugcaucacugagguauauccauaguauaugacuacaaaagaaguugcuggcacaacuucugaugugcaugauggcacaguccuguauucaggaggucuugcugccucuaacuagccccaauuggcagucuucccuucuccuguucacuugucuccuagccaccuguacuuucucagccauaaacccccugugguuuguggucccaaauuccaggaacccaguaaaucaaaacucuugaagcuuauaauuaaccagucagauuuauauaacaauaaauucucaauucauaagaugcccacacaauaauuuuggagccaauugauagugauacaagcugcccaucuagauuugacaaguuaucccaauuauucuguccucuuauuauauucauagcuaccuguggcuauuuaaagccacacagaaucuggauugucuuccuccagcuucaucuuucuuccucccuucuaccugucuucuccauuuucauuucugcaacucuucgcuccaccucccuuuucccuguccaaucacaggcuucuuguauuaauauuuaaugugauuggacagggaaaacucugcuacaaggaggaauaggcagccgaaucaggaguuuaagaucagucuugacuacauagugucaagguuugucaagauaaucuugacuacaagugucauaguuugaggguagccuggacuauagcagauccuguugcaaaaagcaaacccaacauaccaaaugaagcaaguuccaugaaugucuaguguugggagaaacccuucaauacucugaaguugugaguacaucaggaagaaacuccauugugaggacaacucaguaugucaccgauguuuaaugcauuuuguuuguuuguuuuuuuugaaguguauuuaguacauugugcuuugguuauucuugacacagugaguugucagaaauccucaugaauaaugaaugaagucagcugguugcaaauauuuaggcugaagggacuuuagacauccuuugcuauguaauuccucccucaugcaggcaaaaggcccaagacccacagcuaccggagauggucuuuucauuguggcacccaucucuacacuguauacauguuuuguuuuguuuuuaauuuuuuuucucacacuugagggguuuaggucuuauuugucuguucaauaaagcuugaccaagagugucacuaauguggaacaaguucuauuauuuuuauuuucaguuaaaugaggaaaagggccagaagagauuggccagggucacacagcuaauaaaagacugaagagaaugucaaucuauaucugacuccaaauauuuuuuuucuucugcuuucccaaggaaauauauuauccccucucauaaaccaaugcguguuaagcuuuuccuauaauuuuucucuucuuuuaguuacuuuuaaaaccagacaauguccaucuaauuuuacaaaauguccauuucuacccauacauguauaccucuacguaugugucucauaaucacguucauuacuuuuccuguugcuguggcauaaugccugucagaagcaauuuaagggaggaaggcauuacuuugguucacaguuucagaugagugcagucccaucauggcagagaaggcaugguggcugcagcccuuucuggagcuaucugugugggaaugugagauuggcagaucaggaggccaagagggagacuagaagccaggucaggcugucucccucaaagaccugccuuacaucugcuuugugggcuucugaaugcaaaggauaguuccaccagcuggggaccacaugugcaaacaugagagccuguggaggccgauuugaauuaaacuauaacaaguacaaauuguuugcuaaaacacugccuaauuuuaauuucuuugggcauuggugcuaaaaccuguuuguagcaguugaagagagcugaaccagugucauuauaaacaucuucacauuagcaauacccugauuccacaucacaguguaaagagaaacugcaaaucaaugcuuuaaaaaaccaaaacaacaaaaccccuuuauuuucauugguuacagaaauauauguguugauggaauaagaagugauguuuuaguauguauacauuguauaacauucaaaucagguaaacugucucugcaaaaacuuuucuuuagacugaaaacuuaaaaauuuuucauagacuagauauguagcucauuugguagaacacuuauguaugugguaggcaugaagccuugcauucauaucuguagcgguaaaugcccaugaucuaagcacuggaguuguagggaggagcuguucagaaugcaggucauccucagcugcguagaguuugagccuagcuagagguacuggaguaccuuccacaaacaaacuaucauagcauagaaacauccaguucuccauuucuuucuccuuugucgauccugggaaugaaacucaaauugucaagcuugauggcaagcauguauccucacugagccaucucauagcccuccuuuccuauuuuuaugauaaaucuagucacugguccccuugcauccugugaagguuucuacugugaccuagaaauaauguguggcaaaugcaguacaugugaugcucaacacauguauacauuguauaguuguuuaaaucugauaaacagugcucaacaguccuuuagccaccacccccacccccaguuaaaccauuuaaaucauaagcuauuugaguugaugcuucuguuggagaugacuucaggaggauccuccuaccucuugaaucuguuguucauuugagugaaaaugugucacuuguuuuuguuuuauuuuuuucuuuuauauuuuuucuuuucuuuuucuuuuugagaugagguuucacuauguaguccucgcugguuuagaaaugaguguguagaccaggauggccuugaacuuaccaagauccaccuguaauaucugccuuucaaguucuggaauuaaagucacgggcugcuaagacugcaguguuaauauauuuucuuucuuuuuuauuuuuuuaaaaaucauuuaauauaaaauaagauuauugguaggguagaauaugcuuauuucuuauauuaauguuuuauaaauccuuugaaugucuugagguguuaauucuacaauaauauuaaaauccauagauauuuagaauuccagauacauuuaugagcuuuuauaauagaauauuacaugaaaaauuuaaauguccuuauuuauuacacggaauauguagagucagaaaguagggagccaaaacaaugugauuauaguguuuaauaguuaauaugauacuugaauucucagucaagcagucuuucuaccucacccucuucaguagcuaagaccacaggcacaugacacagcuuuuuaaaaaaaagcuauacugaaaauaacucauauaccaugaaauuugcccguugaaaguauagaauuauugaacuauacauuacuaaaauuuuaauauauccauagcuauagugauuaccacugucaauuuuagaacauccccauacauacuuguuauuacuacuuccagacaauuaaucacuaaucuuucuguguagauuucucuguucuagucuuuauaugaauggaauccuguaauauguauauguaauaauauguggcuucuuuggcuuaacauuugcgucguuuucaagguccauccauaauguuguuuaaguuugcuuccuucccacccccaagacaguuuccucuauauauuauagcccuggcuguucuggaacccacucuguaagaccaggcuggccucaaacucagaaaucucccugccucugcuuccugaguacugggaucaaaggcaccugccaccacuauguggucauauuuuuuuuuucuaauuguguauguguucaugauguguaugugcauccauguggaggaucagagggcagcuuuguggagucauuucucuccuuccaucuuuacauaguuaugcacugaacucagguugucaggcuugcaucaucagguagcaagaggacaagccaucucucuagcucuguucgauuuuuauuacagacuguuguaugaguuuguacuucauuuuguuugucaggcauuggacauuuggggcuuuuaugaguaauacugcuaugaauacccauacacacuuuucaugugaaaauuaugaccccuuguuuuguuuuuuguuuuuuauacauacuugucauuuuuuuuuugucaacauaguuguuuuuccuuuuccuuagcuaauggcagcacuagcuacaguggggccuccuaacccucgggcagauccagagugcugcagcauccugcauggucuuguugcagcaguggaaacccuuugcaagauuaccgaauaccagcaugaggcucgcacuuuacucauggagaaugcagaacgaguugggaauagaggacggauaaucugcaucacaaaugcaaaaaggugggcugcuaaucacagugauccuuuccuugagagaauuuuaauuacuauguuuuuauuuuacaaaguauggauggccucuauauguauggauauguaaauggcuucucugauuuauuuuauuucuagcauuugucuuuaauauugagacugggcuuauucuaaauaaaaauccaucuugauaagauguauauaugcuuauggauaucuguagucuuagcacuugggaaguggggcaggaagauugcccugaguuugaggccagccuaaccuauguagugagcuccagguuagccagggcuacagagcaaaacugucucaacaaaaucaucuuagugaaaacuguuuaaauuuucauguaaauugauaagacuuuuuuuuucacugacuuuuuuaagcuaauaauuugauaauacgaauaagauauguucaggacagucuuugcugaaguaauuuuuuuaaguauuuuuauuuuuuaaguuaauauguacauauguaucugugagugggccuaugaguacaggugcugcaaaggcuagaagaugacuucagauccccugcagcuagaguuacaggcaguugugagcucuuggacuuagguguugggaacugagguccucugcaagagcaguacuugcuccuaaccucugagcacucccuccagccccugcugaaguaauuuuaugugccagugucagcaugcuacagcugaauaguggcuuuagcuguuuucuuacuacuuguguuccuauaaaaucuuuuuuuuuuuuuuuuuuaaacauagugauagucauguccgaaugcucgaagauuguguccaggaaacaauucaugagcauaacaagcuugcugcaaauucagaucagugaguauaaucauagaugaaauaacucuuuaacuucacaugauauaauuucauacuuauuugcaacaauuuuuuaauauguuugguagcauuuccuugauuuuucuuacuuaauaaauuagcauaauacuguaaguuugaucauuuuccuugcauuuuagaguauuacuuucuuuucacaggaaagggguucagaaugcuaaaaaaauaccuaaauuuauaaugcauacuuguuucaguaggucauuaucauacccuucuaggaacuuaaaaaacauauaaauuguugaugucauuacucauuauuuauuaguucaaaauguaacagcuaauaggaguugaaaagaacuuuuuuuuuuaauacucauagcaauauuuagggaugaucaaaaguguuuuguuuguuuguucuuuuauaccaaauaauuuugucacucugugggcaacaugugggucacuugcaguucauuuaugauaccagcucucuggaguuagugcagccccucgagauuaggagcucaguuuucaggaugccuuccuuacccuuucugacaccagugucagccugacuugcuccaucaguuguucccacagccccauccugucuaacaguuugcuguaaacuaguaugcuaaaguguuugaaaggauagagguaaagcaggugacauagcacgaagcagaggaagucccagguguaggaguuuuuaucccuuggaggugaaugugugucuucacgguguguggauguguucaugucaagauccuaaguccuuuaucucuggggcuuucauggagaugucacccaggcaugacugguuauucuccggcccccucuuuccugccuaaaggauggcagaguaaggcucaaaggucccaagcuucuaaucaaagcauuaucuuucugguuauaucuucuccauccaggagcugaagaaucccaaucaggcuauuaaaacagaggaaccuaguacccaggacauucccagagauucaggaaccagcugucaagaacuuagauucaaggucacauaguagagagcugaaacucucacagccaguaagaguguguuuacugcaguuauacuggacugcaguuuagaucaagcaguuacuaauuuucuuauguggaauuaggaacauuucuauuagaaauggaacuguccuuagaaggguccugaaguguuugggaaugucuuguacaguucacuugagaauggcucaguaagaaacagucgcaccucuauucagagucagaaagaacacaaacguagcuaacagugaaugugugugauauacaauguagaauauauggauuuucauugaauauaguacugucagcuuuucuucagaauacaagguuagggaagggcuggugaaauggcuccauaucugacaacaugaauugagaaacuaugugguggaaggagaaacuccaacauuauccucugaucuccacaugugcacugguacacucccucucauaaaaauguauauuugagaaacugggacauuuuucacucuaguauucuuagaaauaaucauuuacaacuaguacauuugcaauuaguauugccugaccuuuguucuuaagaaaaaauuaagaaauucaauauacagguaaucauuuucuuugugauaauuauagaaaauugugagaccuuucucuacauuguuauuuuuuaacuuugaacagauuuuuauuaugcaaagauugccguauaauuagauacauucugcuuuguacugucucuuacucuucacaguaacuucuucugagcaucucaucucccaguggcagcaggagugggauugccucagugacucacauaaaagcagggcccuggugcaugucuggaaccuggcacccaccgucagugucuuuauaacuuaaauacacagagaaagguuuugcauuuauuuuaaacaaaugcaguuauucauuauguacuguguaacuguuuagcuuagagugauaacagcgauaucuaauuacaguuuuauuuauuguguaccuaauacuauuuauuaugauaagguuaaaauaguuugcuugccugaauucuuuauaauaucuauucuaacauuuuaagugaaaguuuuuuuuuaagucucaugcagauucaaaaaugugaguuggucuugauucacaccuacccaguuggugaagauagccuugugucugaccguccuaaaaaagaaguaaguauggaaguacugcaggaagagaugguugugaguucaaauuaagcaaugcugagaaugauagcauuaaacugaucacauugcuguuuuuuucugccaagaaacuaugugaaugucugagaacaaaccuauaugucaaacaucuaacuagucagaauagacuguuguaauuacagauguuacacguuucauguuuuuccuucauuacugacauuuauuuuaauaaaauguguugcaaauccauacaauuuuuauucuuaccauucuuuauugugaauuuuaguuacuucaguaacuuuaauuuuuccucauuuuggaaaaggaguguauucuaaucucagaggacaaagaaaccaacuuaaaaaguagaaaaacuuuaaaugaaaagauaauuuuguugguugguagguauauccauaucacaucuucauugguaguuuauauucagaaauacaaaucuauccauuuauauaguuauaguaaacauauaguagugugcuaauuuuuauuuauuuauuuuuuuaauuuaaccuuauccacuuggucaggguuucuauuccugcacaaacaucaugaccaagaagcaaguuggggaggaaaggguuuauucagcuuacacuuccacauugcuguucaucaccaaaggaaggugcuacuggaacucacacagggaggaagcaggaacugaggcagaagccauggagggacguuacuuacuggcuugcuugcuugcucucuuauagaacccaagacuaccagcuuaggguuggcaccauccacaaugggcccucuccucuugaucacuaauugagaaaaugccuuauaguuggaucucauggaggcauccucaccugaagcuccuuucucugugauaacuccagcugugucaaguugacacaaaaccagccaguacaccacugguacuuuagaauaugaauuuuuguauuuaagugauauuuucagguuguuaauauuuucagguuguugaccaucauuuuuaggugcuuucuugguuacuuuaugccucuuucaugauccaauauguugguuuuaccuuuuaguaacuaaaacaauuaaauauacuauuauugcccuggaauuaauaaaauuuuguuaguuugcuuauuuuuuuugcucccuuaccucucauacugguaaugaagucagauguuugugauuuccauguuccuucuuaauuuuuauuugcaguuuuguccuuuauaaagugaguuauuuuucuuauauuaucucuauaugacuucaaggcuauuuucauaucgauaagcagaauuuuagugaaugguuccaaucuagguuuuaagaggacaaugacugucuguauuguggcuacgugguaauggcucacauaguuccugacuauaguauaguaaauggauuacauauguuacagaugaaacuucauugaugaaauaauuauccuugcuugcuuuuauacccuccuggcccaucuuuaaaagccacuggauacuuuauaggaaaauacucagcacagggcuaccaugaaauaaugcuuuguggauuaucuuucuugguacuuucuuauaguuguccccaguuuugaccagugaaguccacaguguccgagcugggcggcaucuugcuaccaaguugaauguucuaguacagcaacauuuugacuuggcuucaacgaccaucacaaacauuccuaugaagguaggcaguucugagagcucuucugugcuuuuuaauuguuugcuugauaugccuuauucacuuuaauugaaccuuuacuuuuucuccccauaucauauuuuguuuugcuagcccacauucagugucuuugaacaggucaguaaauacugaaaaucaaaaagaaaggaucacagaccaaaguauauuauuacuauuucuaauaagaacauaccauaugagauucuuaagaacuauguucuuauuauuuuuuaucaagaucuauauuuuaaauuauuucucugugauucuuuuccugagagcuguauaauuagauuuaacguuguauauuugaguggaucuuuuuauuuccuguacuuucguucuuacccacccaaguguaaagauguugauaaaggucugacuagugaaaaacagcccauggcuuccuguugguuuaacucuucagauagagagccguggguaugagucuaugguuacaccagugggcauuucuuaggagacugucacuuuauucaugcuuuaaguugucaagacuaagcaaaaugccugguccacaguaagcuucaaaugaguuauuacuaaauugggcccauaauguaacaacuuuucccuaaaaauucauggugacuuucuuggagucugguuucaacuuuucuuuuuugcuuauuauugagacaggguuucacuuuauaguccaugcuggcuuaaaaugugugauccuccugccucagcuucccuaaugcuagacucacaguugugaaucacaguacccagcuggguuuucaguucuuuugcuauuaccucauggauacuaaauugcaugagaagucuuagauuuucauuuuucauccuccaaacaugguuggcugguuuguugcuaguucuaggagacccuguagcaggcauuugaugagaggcagugaacaaauaaaacuuuguaacaaacuucagcuuaugucugaguugaaacagaauugccaagaaggcagcagguggcuugcuuguuggacuugauacugugugccucuguagucuguguucuuucuguuaauagauaauaucaaaaacaaguuacuuaagcuuguuuauuaguuaguauuugcuauuuuaaauaagugguguucauucauucaucgcagguauuuaaagaugcuauugccuauuuuuaagaguuauuuuaaguucaacuucuuccaaugauaguauauuuggguauuaaaacuauuggcaagaaaauacauuaguaguaaaauucaaaaauucuagaagagucauuuguguuaauccugacaugagaaaguuauuacuugccuguguuccauuaauaguucuacaauagaguuuguuacacuguuggaaaguauugcaucuuuaaauaaacgagagcaaaccauccucuuauuuagcuaauguuguagaauauauuugaccucacuuucagcaaaaagcaaaguaauuuauuucauuauuuugaaagcagacccaaguuauuuaaaaugucuuaaacuuugcuuaaaggaagagcagcaugccaacacaucugccaacuaugacguggagcuacuucaucacaaagaugcacauguagauuuccugagaagugguaagaggcguuacccaggauucucaccaagcacacagacugagcucaucuuugucccaacuccugugcagugucaccaucauagugucugucaacuugacacaaauuacauucaccugggaaaaggccaucucaauuggagaauugauuucaucaguuuggcuuguggcuguuuguggggcauuuucuuaauugcuaauuaauauacccacugggaguaccgcuauccccgggcagguggaucuggggucuauucugagaaagguagcugagcaagccaggauuagcaagcugguaagcagcauuccuccauggccucuucaguuccugucuucagguuccugacuggagcaucugcuuuggcuuccacgaugaaggacucugacuuacgaugaaguaaacccuggccuccccaaguugcuucuggucaugguuuuuaucacaccaacaaagagcaacugggacaguguccauggaacugguacucuguaguuugcuuuccccuucaggcugugcuuuccgucacugcacccucgugcuuuaggguaugagggaagagcuuuagcaaggauuuugucaggacagcagcccuguguuucuauauuucacuuuuuguguuuaaaaacugcagacacaauagcaggaugaaccuuaauauuucauucacuccuaauauugaaugacacuuuuaaggugugaagucuuuaaauuccugaggcuuuucuuuguagauuggugcugacagaguuacaggacugauguugagcauguugugugcagucauucugaagcguaauugugagccagcugggguuaugugucuauggaauauugggauucacugacugaauuacuagcaguagaaaaacgacuaugauauauguaucuacugauguuagcaagggaauguagaaaauguaacuuguggagauucuaagaaccuaugagaugaugucagcuuuuaagacuuuuguuuuaacuuagaagauuguauaacauucucuuggcuauggagauaauuaugucuguggagauggcuuaguggguagaagcacuugcucugaaagccuguaaagccacaguuuggagcagagaaugggaggucccaggaggcauuagccacacccaugccaugccuuuacaguauaccuaugaauaaauaaaaauuuuuuuguaaagugcuccuguggcaauaggagcagagccugugaaggcugcaugugguuauaacucugaacguuaggcaagccguacugaggagggauaccagagcaggaucucaauucguaggcuuguacuuuaacccaagcaucuccccuaagcuccauaucuauguauucugcugcuucaugucaguacuucaucuaagacucaauacucccagaacaauugguaagcuuuaugacagggacuuagcacuuucgguggauaguccaguuguuuuugcauuucuauuauauagaaaccuuaagaucaucuugagaugccucucugacacuuucuauaucaacuuuaucaucucauuuucuuaauuucaucuuguguuuuucugauacaaccauuucugcaucucugcuaccacuugguacuuccugaauaaaaccuauuauuuucucaccuaacauuccagauccucccuccguugucucacugcucccuccugcaaagaucuugacauuugcuguccucucugcacagauugcuuucuccucuuuucuuuuaauuccuauaccauucucugagaacuuaagccaauuuuuaugucuaaaggaggcuuuuuucagugucuuagaauaggucagaccucugugcuggaggcucucauaccacauacauauacauauauacauacauauauauauauauauauauacacauauauacauauauauaucuacacacauacauacauauauauauauauauauuuuuuuuuuagugucuuuuucaacaaaguauuuugucaacuuugugauuucaaauuugccugcuaagcuauuggauugacagaucugcucugccacacugcagguuucaugaaggcauggguacugacugcucugcuuccuuauguauucacuuccagaaccuuuaugcuuccucuaaagaaacacaauuugguauaguugugcauuuuagacucuuaaaccuucugaauauugaccauguuacuuuaucauuuauuugcaugggcagggagagagcauuauaucagaggucuaugaaauuuuauuacuggcuauuaagacagugacccaaauuaguuaaaccagugaaugaaaacuaaagugaaaaauaugaagggaaauuacuuaucgaugcuaaccguaguuuauaucccauucucuauuuggccuuuuccacugagacuuuguaaaaagcguguucucauagagcucuuuucucuuccagaguuuaaacuuauuuucaaaacuuaaauaaccaccacuuugaaguuggugaccuccuuaguaaaguuaguguuucuaugaccucucuaaaggugacagccacucugggagcagcagcagagaagggccauuuaaggagacaguaacccugaaguggugcacacccaggaccaacagcauugguaaggagaugggccagggggguggcggggagcuagagcacacaaaggucuguaagugugauguuaaaucucaaguuucuuuuugaauuuuuguuuucauugccuuaagggacucaguacagcagauuuucuuucucuuagguguaggguauuuuauuauauucuuuaaggugguguguuuuccuauuucagaauugcacuauugcacuggagcuuaccggauuucaccuguggauguaaauaguagaccuucuuccugccuuacuaauuuccuccucaaugguaaccaucauuuaaugccuuaccuucaguuauugcuauguggggucauucaugucacgauagucuauuugccaagauugcuuuaaauucauguuaguggaaauagucuguaacaguuuugcugggggcagaaauuuacuuucuuucugacuucgaggcuuuauaucuaagugaguuuuauccaacauauuuuuuaaaauguugauuagaaauuugaucuuugggcuggugagauggcucaguggguaagagcacccgacugcucuuccgaagguccggaguucaaaucccagcaaccacaugguggcucacaaccauccguaauaagaucugacucccucuucuggagugucugaagacagcuacaguguacuuacauauaauaaauaaauaaaucuuaaaaaaaaaaaaaaaaagaaaaaaaaaaaaaagaaauuugaucuuuaggguucgacuuaacacuuuuuuggaagcuuaggguaaucuuaaguuuuagaaccauugauuaaaagucugucuuuuuuccaagguuacuuucauuauaauguucaguuugauuaucguaauauguaauauucaccaguauucagcaugugaauuagaaacaauuaugccaaaaagguggcaggcauuguggauagggauugggacuaugccuuuuccucaaauacuuuguagcauuaauaaccugagaauuccucaguaguuuaauuuugauuuuugaaugucuaggagggaauuuuuaugugaacuugaauuucaguaaaacaaacauaccauuauaauuguuugggaacauagccauauaccuguguaaaccuuaaagugucugagagaagcuaaguauuaggagagaaguauagaugcacuagcuuagcaguacuguuuaaaauauagcuguuugaguuuucuuacugacagcucgaucuugcuucugacaggucggucuguguugcuggagcagccacgaaagucaggcuccaaagucaucagucacaugcuuagcagccauggaggagagaucuuucugcauguccuuagcaguucucgauccauucuggaagauccgccuucaauuagugagggcuguggaggaagaguuacagacuaccggauuacagugagacuuuuuaaaaaauguuuauuguauguguaugaguguuuuuccucuguguaugucugugcgccaugugcauguacguaccugguacccuuggaggccagcagaggguguuggauccucuggaacuggaguuacugacuguuguuagccauuaugugggugcuaagaaucuaaccuggguccuaggcaagagcagccagugccuuuaaccacugagccaucucucuagcccugccauaaaacuuacuauucuguagauuuuguuuugagucaguuagcaagaguucuuguuauguuaagguuauggagaaaagcgaucucagaaaagcguucucaaaagagcugauuguuguuuucaguaaucaucaucgcugaauacucugccaugugacagauuuagugacugggagugucuaaguccugaaacacuggcguuagagagagaauaugauuaaauuagugcuuucucuugcauauguugacauuucagggcuacuuuuuugagaugguugugggacuuauauguggauuuauauguauaauuacucuauaaacuuccaaauauuauauaauuuaauuaauuuauuaggcuuuuuuuggguaguuauuuuaauaagggcuugaaagccaauaaguauucauuauggaaaacagaaucuaaaggcaucugaaaaccaaccaaacaaaaacccuaacuuaccuuuaauuucauuauugaaagaauaacacucaucauuuugauauucuaucaaagcagcuuuuuauaagcaaacuggccuugccaugugauaaacucacacacaucugaaagaaagcaguuucaucauaggagugaaguggggacaugcuucauuuccacuguguaaaugcugauagcuuucaacuucaaaaggggguggggcaagcagugaggugggucacuguuagagaaagggcuuugcuggcagucacaggacagaggacagagggaaacggcugugauggaacauuagacuaguuucuaauugugucuuaucugguuaucauuaggauuuuggugaauuuaugagggaaaacagguuaacuccuuuucuagaccccagauauaaaaucgaugcaagucuagagaucccguuggagcgugcaaaggaucaguuagaaaagcacacccguuacuggcccaugauuauuucacaaaccaccauuuucaacaugcaagcggugagucucuuuuuuuuuuuuuucuggauuaguauguauuugcaaauacauuuuuagaaaguaaauuuuuaaauuuguaauuggugccauuucucaagcaagauaggaagcaugagguuguuguggcugaagaauuagugacugagaacagaagcagcaguuaugguguuccccucuauguggccaucuuuaauaucagcuuuaaaccaaguucuuccuuuucuuuuuuucuuuuucuuucuuucuuucuuucucucucucucuuuuuuuuaaccuaacagguaguuccauuagcuggugucauugugaaagagucuuugacagaagaggauguguuaaacugucagaagaccauauacaacuuaguugauauggaaaggaagaaugacccucuuccuguuucuacagucgguaccagaggaaagggaccuaaaagguagugcuguuuucuuuacaccuucacacauccuguuuauuuaacaggcauuacucuguaagauaauucuucuguguguaaauuaucugaggagguguauguaccauaugauggggacauaguaggcauugcuacaguguaacuuggaguuccacuauuaaguauggaguaaaaagaaaaaaauacaucuccauuucuguuucuuuuaccauagcaagugccuaauauuuauuauaaccaggaccauuucugagugugcuuuugauguuuacuccagagaugaacaguaccggaucauguggaaugaacuagagacucucgucagagcccauaucagcaacucugagaagcaucagagaguauuggagugucuaauggcauguaggagcaaacccccagaagaagaagagcggaagaagcgagggaggaagagggaggacagggaagacaagucggaacaagcagggaaggagcacggcacggaaaaggcccggccggaugcagacaggugacuuguccccuagcacccaccuuggccugucacacauucacuucauucaguaugugcuuguccacgcuaacuguacucuuagucaccccauccuucugugccuuaaaaugguaugaacuuuuauuguuaugacaaaauuguguuaauuuuuugcuaacuaauucugguuaucauuaugguguuugauaccaguauauacuuugaauauuauaaaauucacaaacauaauuuuauguuuagugagucacuggccaggcauucaucacaagaugucauccugaaagaacacccugccuuauuuuagagauaggucauacuucagugaucacagcacaguguggaaaacgcuaucuuauacgaauuagguucagguugcccuuuggaacggacuagcaugcaauccuaauuuugacaucauuccuaaucagcacacuguuuccccuugaagccacacuugaguaucugaguuggauuccugggaccaacauggucuaggagagaacugacuccugcaugguguccucugaccuucacacacaugccauuguacaugaauugccuguacccuuauuuaacaaguaucuuaauauaucaacuccuauguccuugcacagaucagacaagacagcuagauuuauuguaguggcaaauagccucugccuucacaguuacuaauucauggaagaccucugcucauacauacauguuuccaugucuaccaucuucacuguaggucuguaggaauguguugacaguaguucuugaaguccucaucauuucuagacagguagagcacuuuacuucucagcaguuuaaacaguacacuuuacuucagcuccagcugaccuccaguguauggccuugugcauauaugagaaguauuccucuuacuaaggaagccuaauaaaagcuuagaguagggcuuuuucaucuuagcgcuuagguagaagcacuuugguugaucugaguucuagguuagccuagucuauauagagaguuucaggcuagccagagcuacacacugagaccgucucaagaaaaagcuuuagagugaugaggcuugcgaguaagaacaccugagagcauaccuugucacacagaccgcaccacacuagacaguaaggacuaauuuuauuuguaauuugucauagauuuuuuuuuccuucauuuuuaaaaugugggucuugugaaaugucuuguucauaauuacauuguuucuaaccuuuuaacuacuaacuuaaguuuccuugguuugguuuuaacuuuuacauuggacuaauuccugaacuguuacuacuauaaagggaaauaaaauugugaagaacucauuaaacuaauuuauaugauuuuuagauucuuuugugagaucaaguauguuuuauaaaaacugauacacacaguaguguaguuacugggccacuuauagacuuauaaacuaaacucugcuucauuacuuguuccucuuccagauugaaagggauuuuagaacgagggaaagaagaguuggcugaagcagaggucauaaaggacucaccugauucuccagaaccuccaaacaaaaagccccuuguugaaacggaugagacaccacacauggaaaagucuaaaggugaggacaaccuugggaguggccugggcaguuuagcuaagcacauguuucugggcaguguuacuucacauuguaucugugagaaagagcuacugacgccuggaugccuggagauguuguuuacauccuuggaagugaagauguuuuuaacauuuaaaaaaaaaauaguagcaguaugcuucuaucaauaaaagcuuugaaaaauaaaauacuuuauauaaaaucuauacuuuaagaauuuguaaauuagaagcuuaaaucugcuuauguucccagaacugccaagugcuggcuuauggaggacagacuguccccaagccccuuuaucauuauucauuucgauuaaugaacaaaauaauugguuuucuugugacauauuuauucaguacaucaugguuuguugcucauaguuccccuccacgugagaugcucuucugccccacucuccuucaauaaucccuucauaccccucccacucuuacauaugcaugugcguacacaugaaaaccucucuuccacuuucacaugugcaugugcauacauauaacauuuagauccuaugugugaaaaagagagaaauacuuguucuucucuccacccaacucuugguacccagggaagaauguaaucauauuuacucauuuaguaguaacauaugaccaagcuuaagugaagauauuguuuaaaaccuuuaauauuauuuauaggcugagaaaauuaaauuucuucauguaauucuaggucuaaaugaugggacuuagacuuggguuccugaugucauucugggccugagugucugugaagguauccuggguucaguccucuuagaguauauggaaaaucaucagacuaucugaugccugugucuccuagccaucaagaacagggcagcccaguguuauuggcuggucauccucugagcaugcaggcuagucacuccuuagucagugcacugggacauacucauucuucaagccacuaauguccuugcauuuggggaagcaggggucaccuugaggugguuuggugccugccucucaggucuuugcuagaguuagaaauaauaggguuuaaauugguguuuacugagauaauuacacaucucacaugcugaauguaccacuauggauuagaaugagaaauuuaguuauacuucaaagauuuuauuuauuuuuuuacucuuugcgaucucauacgugcauuugaaucauacccauccccaauucuuguuucccucuucccuuaggugucccucucaccuucaugucuuucauucuguuuuacaagcuaacucuuuguguguuuucugaucaacagcauucuuuaacccauuucaucuacuuuggaaaagacuucccaccuucugucccccccaaagccaguuguguaccugaugucuaccuacacugccuuuaaggcuguuuuuccuaaguguguccuguggauuugguggaaaucuguucaacuuucuuggcaugguacagugccugaagaguauaaaaugaacaacagaagugaggguuaaauuuauuacauuucuaaaauuugaaguaguaauuuuucugcuuuuuuucucuucuuucugcucuaacaccagggccaguguccuuauuauccuuguggaguaacagaauaaacacugccaauuccagaaagcaccaggaguuugcugggcguuugaacucugucaauaacagagcagagcuguaucaacaccuuaaggaggaaaauggguuuguguaauuuccuguggaaacugcuuuguugauuguguaguccuguaaugaaacugcuugcuuuuggucagcaguuuuguacuacucuuaugauuuaauacuuauauugccucuaaggagaaagauauuaaccuguuagacccuuggcgcucacaaaggcccaguuuauugauuguaauuaugaagcugugugcauuauauuuucagggggauaaaaaccacacacugaaucuauguaauguuaaagauuuagaauaaauuucagacaugauuauuuuaaucgguuguuuuaagaagauauauuccuauaguacacuguuaaaggcauuccuuuuguagaaaucuuugacuaaauggaggagacuuccguuuucuucuguuuucuucucuuggagaagggugagggauagggaggggaccuuagggaagcgcccugauguuuacaggcucaccuuucucucgugugcacagugaggagguuggacugacuggaggaccccgaacugcaaucccuuucuuaaagugcccacguucuccuguugugaauagguuagauuuuaguuccaauggguaaaaguagauaaaacuacuacuaaauugcuacuaaauauuuuaucaccgucucacuuuccuucuucuaaauuuuucaggauggagacaacagaaaaugggaaagccagccgccagugaagagugacuugagaaaccaaauuuagaauauugugaaaaauauuuugggcagaauuugauauaaguacuuuuacagcaagauuguauagcuauguugucuggacugguuuuuacauuuuuagagaauuucaaugaauuaucuuuuuuguacuaauucugagauuggcagagucaaaauauauacauuggagauuugcccucccagaccacacaguuuauuuuaugguaaaagguguucccucuggaaauguuuuuuuaaaaacucuuaggcuucucuuugccaaauaaaacuauuaaaauguuugaaaugccaag

SEQ ID NO: 3486 - RNA, 40576 nt, Mus musculus
ugaaguucuuaaaacaacuguauuuuccagauuaaauuuauauaaguacauacaagacugguauaaacuccuggagacauccuaauaaggaggacauuaagcauuuuuuucaaaguagguauuuauuacaaaaauuauacaaaugguauuaaaaauuaugaaaauuuacaaauauuuuguauuucccuccgagaaagcauacucugccuuuuuuagcucugacuggcaguguguuccgacaguacaaagaauaguucuccaacaaucuguacaacuaaaaugcaagcaugugacaagccagaaacccuauagcaauuaaaauauauauauauauugcugaagcuagguaguaauaacagaauaggauuuucagaaauaaaccaaaagggguucauuuuauaauuuuucauuauguuuuaacuucagaaccuuuuuucaaagccacaacugaagacuccacccacucccugaaaugucaaggcuauagucauugcugugaagagacuaagaagcacaccacugacaaaccagcgcacugugggccacacacgucagggaagccaguucucagcccugccguucagaggagucaagagcaugucccuccuuacagaacccauggugguggcuaagugaucaaucccucugagcuucagagcacaggggcuuugauuauacagagcaaucauuagcacaacuucacaggugcuaggaaggucucauugaugucucucugacaaaauacgguccagucaccgucuaaugcaaccuaagaaagaagggucagcagccaacacugcucuaaauggccccaacacaaaaugggcuauaaauaacuuacucauauaaaaguuuuauuaucuuuaauaaacugagcuauuuuagauuacagaaaaaauuuaguuauuuaccacuuaaagcacuaacuggcaaaacaacaggaaaucuacauuguuacguguuaggauaauuugccaguuuuuaaaauaaaucguuugaauauugaaaauaaaugaaaaggguuccugauuuuauuauaagaugcagccaaauauaaucagacugcuuuuaaggaaaagggggguuacuuuucccuuagucuugacauucaaggacccaaaucaaaucccuaaacuucuacacacaaagcgaauaaauacccacugccugccuccccuccacagguucugacugagucauaacuguccaagaagcuacaagaacaaaacacuagggcuucaaggagacauuuuuauuuuuugguguauuuuauaaaagacaucaaucaucaaaagguaacuucucaagacuguggaaaaugaggaaaaacaucuacggccaacuuuuuggagacuuuucucaccauaucacuuagaauccucuaacuccacugcuguacauccacgggggcgucacccugucacccacccuggcuggcccugcauggaccugggacaacugggcagucuagacgagaacuccagggcaagcacacugacccucagccuucuacagaagcaaggguguccucucuccagccggcuguuccuucuggaagagcucuuugauccgagcaacccgaccauaaagccucucucucaggggagggaugugauggcugggguccaggauguuggucacucugcguucucucucuugcuuccauagcuuguagggguggggagggaaaggcggcuguccucuuucucuucgaaucugaaguguaauuccacugacagccagcaucccccacacggccaggaugauguagucuaaaggagagaaguauccuuuguacucaggggauucuguguuguggguugguuuugcuuuucaguauaugucucaagauauagcccagacuagcccuaaacuuauggcaauccuccugccuucuauugaauaccaagauuauagacaugcgccaucaagucagcaguuuuugugugguguguguggaggccaguguggguggcaaguguccucuccuauugcuccucuguugcucuccaucuuacuguuuggacaggcgccugucccauugaaccagcaagccccgcuaacuguaguugcuuaugcacgcucucacacucagcguuuuguuuuguuuuguuauuuuguuuuucaagacaggguuucucuguauagcccuggcugaccuggaacucacuuuguagaccaggcuggccuugaacucagaaauccaccugccucugccucccaagugcugggauuaaaggugugcgccaccacugcccggcucacgccggcuuuuuacuuggggaucugaacuuggguccucacaacacagagcaagcaccuuacccacugagccacccauccuggccccaacuucuuuuucuuucucuuuccuuguuccuuuucucucuuuccucccucacacccuuuuauucuuuuauuuuuuuaauuuuucaagaugguggucuuaauuccauagucaguccugaccuggaacucacuaugagcccuugcuggccucaaauuuguggccauccuccugcuucaguuuccugagugcuaggagugaagcuguguaggaacacgccugguucugaacuguuuaacauuuagugugcaccagcgcuuccccuucacgugcuaaaugcaugucuuccuuucaauuuuggacauauguccaaauguaucuccucacuuacaagccaaggcacaaggagacacgacaguagcuucuucuacuacagacauccagaaaguugaagcagggagugaaagcuggcuguguagcuuccuggagcuuccaugugcagugccugcagacauggcugcccuagcuacucucuacauacucccagggggguuggaugcuuacauggaugggacgcaagacaaugugaguugacaccccagauuccaccaagcauccaacaaagacauagcucugggaaugccauugccuggacugugugcagacuuuccaguguggcugccuugggcucacccaagcucuuaaagacaaccucuuccccagacucuaauuaagcccaauaaacucacugcuucucacagggaacucugguggaaccaaccuuagguugagaccuuagaaggucauggguagacacuuccuuagaccccacacccccagggagaaaaaucucugagcgcaaggucuccacgucugaccucucaucccaaggggaagaucuugauuauugucucuaaguagaggcaaagauuugcccuaaaaaaaaaaucuuaacagucacaguugcuacaucccaauucugagacaugcuucucuacccuaugucuuuaaacuugucugaaaucaacacaguuugaaaacucuguaaauauguaguguguucuuuccuuuaaagcguuaacacaagccacauguugggguccacacucaacaucucagggaagguagagacaggaggaucaguguuaauuugaggcuagccuaggcuagagagaaccugucuccaagaggucaaauuaaaauagaaacucaauaaugaacagaaucuucuaauuaagguaaugauuugaucacuaauugaaaauaaaccacaucuucauugaagugaagaaacaaagggacacaguuaauuaaauccggugcgacucucauuccucaccggauagaugccaaacaggguccccaucugagaauggacagguaagcaagcccagcuagcaaaguccacucagauguuuggaaggaugaguacccaguaccuuagacauuucaguccuuuaguuacuggcagagugcucucauggcaucuguaccauggcuccucuuucagccccaggugaugcuuauguguuccuguuaggguggguggguuagucagcacgccuauuuagccaucaguccagugucuuaccguuggucuggaaaggcacucuaaugacagccccucggaaaucuguguugagagcucuccugaggacguucagggugauguaggagaggcuugugaacauguaacuguuaacagccaacaccacggaguaggagcccacgacuccacaagccaggauguucaacugcgggagagcagaggagacagguaucacccuuggaaugagagcagccuccagcucucucgguggccucgugcugucucagcacugacaagggcuaugguaaaacaaccuuccuugcccacagugggucugcuuuuuauucugugagaguuucauacaguguauuuuuaucauauucguuccuguccuccccucccccguaguagguucuuaccacacuguuuaaauugggcuaucaaauaggguugcucagugguugagaccacuugcugcucuugcaggggagccagcgcucacauggaaguucacauccguccuuaaccagaguucauacgggaugggacaccuggccuccauggguaccaggcaugcaccagguacacauacuuacaugcaggcaaaacacucaaacuacugugcaacaauauggccagugacgccaucccguaagacccucuguggugacuguggcccuccaggucccuguaguucauucugaugccugaaccauggggaaacugccuaagggugucugacuucuuagaaggcagcccuguuacugagugacgcacaacucaacuguagaaaauaaucuucccagaagaagaaaggaggaggaggagaggaaaacuugcaccguaaaaucuaaucaaaggagccauucugcagcggcagcuaaaacuaaauggccuuugaguugcugcaguagagggaggugguuugcucugcucucacagguacugacacucugagcgacugggggcucuucagaucucugacaggcagggcaaagcaaucgggaaaggggccacagacagauaauaaagauagcguacuucccgauucuucauccucuucacaggagacaaaggccauagguuuuuuucucccugacaggaccccuuucugggugaccaguccaggaugaucagauauguuaaaggcuggcucagaacaugcuuaccugaagcuacaggccugucagcuccccuuucuuuguuuaaguugaucagucuaaguuaaucaguccaaaaucaggggaggagagcucaccccaggccaccagaaacagugcugugugugcugugugugugcacuuucacaguacaacuugcuugcuuucaucugaggggaagauggccugcccugagacagacacuugguaaucaaagaacuuccucagcacagauaaccacagagcccucccuaaggaaggaaacacacagcucuccaugaggaccccugaaggcuggcaggaugggucaucggacugcgcuggcacacuuacgauucuuaggcagcccaugaagaugacuggaacaagcagcgcuaugcaggagaacgucacccagaacacuccaucaucaugaaaaacauuuagguuuccuggaaaaguagagaaaucaagaauacacaagacacucacagguuaaauuucacugucuugaguauggacgaagacacucacaaggcuuaaaaugacagccaggcaauaugcuggcagccagacccacacucuaaguuugcauuuaauggucaguauaauccauaccacccuguguguguuugucugagacaggguuucucuguguagcuuuggcuguccuguagauagaucaagcuggccucugucuuuacaucaggaagcccugccucugcuaggauuaaaagugugugcaaccaugcccagcuaacauaaucccuuuuuuguuuguuugguuggcuuuuuuuuuaaaaaaagauuuacuuauuuuacguaugugaguauacuguaguugucuucaugcacaccagaaguagguaucaguucccauuauagaugguugcaaggcaccaugugguugcugggaauugaacucaggaccucuagaagaacagucagugcucuuaaccacugagccaucucuccagcccgacauuaucccuuuuaagggcauguccuagaaggugugaggggucuagagggugaccugaagagacugccaucgccuugcucuccuguucauccacugugagacucuggucugauuccuaucucuaguguggcaagaguuauuauuauacuguuauauuauuaugcuguguggaggcucaccgcccuucuaacucuaagcuuuuguaaucuucaguaaugaggagauuuccacagacgcuauuccaaguuaagcagugaacucaguaugaauagauuugaaccauuagcccacuuccucucaugaagaacuaacuccaggacagaccagaguaggacacuuaugcucuucauacgcuuucugcuacuacacaccugggugacccagagcugcaugcggucaugacaacugcacucccagacccucgggcgucugaagagguacagacaccugcacucccagacacuugggcgucucaagaggagugcuucugcacugaggagguagacucaagagaaucucugaauuugaggccagcuuggucuacaccaaguucuaagcuagccagaaccacauaaugagacccugucuccaaaggaaaaaaaaaaaaaaaagaagcaaaaguuaguaaauaaaaguuagaaaugaaaaagggagcugugguguugagaagccucagcaugggaagacucuugccacaagccuaaggacuuguuaaccucaaacaggcuaaugagaugguuuuacuucucauagauucauuuaauuuauguguaugaguguucggauacauguauccaccaaaugcaaaccugguacccacugaggucucaagagggugccagaucccuggaaccggaguuacaguugugagcuaccaaccaccugggugcuggaaaccaaaccuggauccucugcaaaagcagccagugcuauuaacugccgagccgucucuccagcaacaaacagauuuuuguaacugauggaaauaaauaccguaacacaagaacuucacuacagaacccugcagaaccagccucagaguccacaggcugcuugagacccccccaucagggugggugauggcaaagggugggacagaggcaggucaagagaagaccggaaacagcaccagguucccaagcuuggugcccaccagcacagccccugguucauccaggagacauccugggagugagguuuaaaauguuuacaaaguaacuaggcacaguggcucacagcuguaaucccaguacucagaaauuugaaacaaaaggauuacugugaguugaaaccagccuggacugcaaaguuaaaccuuguaucaaaauacacaaaauuuaaaguaaaauuuaaaaauaaaaauaaagccccuguccuccccuaugagccucaacaccuaccuuagcccauggagagcugucccugaggacauucuaagguccccaaggagggugcucucagcuggcccuccccuuggggucaagccaucucugcaaguacuuugacucuccagaaggcagagauaagcaacacacuucaggauccagauuccugacaguuccaaagcccaaguaaaaccccacacagccugagagucagcaucuccuacccagaggcgugaagaaagucccagaagacacgaggaagcccagcacgagucccacacacagcaugcagagugugaggaucccgaaucgccaccaugaagccaccaggaggaggccaccaaagcugccagcuacagcggugagagccaggcgaacugcacaagggagagaacacagagaugagucggcaggcuucaaccugagcuucaggauaagcuuaagguagucacccuagggcuggggacaggacaacuuugucaguaaggcaggaccacgaaagcaaaggugacaaccaaucuguuaaaugugucggggcugaggauguggcucagcugguagaguucaccuaacauaggcucuggcuuccaucugcauucaucaggaaggaccagagguucaaggucucccuguccacagagcaaguuccuggccagccugaguuauacgagccccugccucaagaaauaaaugaagcugggaaaaggagaauguuugaaguuccuucccucccggggacacugugugcuauuuugaggcauugucuuacucuguagcccaggcuggucuuaaacucagguuucccuccuucugccucugucucucugccucucugccucucucucucugccucuaucucugccucucucucucucugugccucugcaccucugccucugcauacuggaguagcagguacucacuuacccagagcuaucugucucuauuucuaacugcggagccacucugggcuccugccucugguuuuguuucuugagacaagguuuuacaauguagcacaggcugcucucaaacauguaauccuccugccucagcuuccugagagcugguuuuacaggcaugugcccuggccugaccucuguuguacucagaagagaaagccgagaugaggagguggagcagguuccaggcacggguugcccaucuccgcacacuugaugcgugaugacccccagcacaggcuaaacagccggaaggcacuguggguggggacccagcagcuuccugucugaaccccagcuaagcugucaucuauacucaccgucauacugaaggggugucagucuggugaucaggauguagaagaagaaccccaggaagaugaagccaaugaagaauaaaucuaggaagaaaugaaccaucagaaaaugagcagcgccggggccuagcaaacacagaaguggaugcucacagucagcuauuggauggaucacagggcucccaauggaggagcuagagaaaguacccaaggagcuaaagggaucugcaacccuauagguggaacaacauuaugaacuaaccaguaccccagagcucuugacucuagcugcauauguaucaaaagauggccuagugggacaucacuggaaagagaggcccauuggacacgcaaacuuuauaugccccaguacaggggaacgccagggccaaaaaaauggggauggguggguagggaagugggggaaggguaugggggacuuuugggauagcauuggaaauguaauugaggaaaauacguaauaaaaaaaauauuuuuuaaaaaaagaauauaacaaagcaagaaaagagaggggaauaaugugaagauaaaagaauuaucaaauaaagaauuaaaaugaaaaaaaaaaaagaaaaugagcagcgaaugaaaaccucugucagggagccaauggaggcaucuaauuuacaagugugugcuggagcaccuacgccucaaucgccacgcccagucacagauggaaugguuaucuaaaaggcagggaaacuuagaagucaggggauaaugaauguacuaggcugcagcauuagauacugguugugugugccuguauugagccuguugcauaauuaaacgguuacuugcucgucucaguucauuaacuacaugucucuccucuucucuuccuccuccuccuccuucuuuuucuucucccuucucccccucuucucccuccucuucuuugggggcuccuuuauguagcccaggcuagccucagacucauggacucauggacuucuaccucagcuuuccaaagucuggaauuacaggcaugugcuaccacaacaugucacuguuuuuuucaauguguuugugugugcguguguuugugaagccagaaacaaucccagccaucaccuuuuacaccccgagacaccguugagguggaucucuuguccugcugcuccuuugccuacccauuugcuggcuccagagccucuggggcucuccuuucuccacaccccaccuugccucacugacacgcacuaccacgcccagaucucaauggguccugcgguuugaacuugggcccuccacacagccaucuccccagcccucugucuuuucuuuugcacacacccaccaaauacucuagcauuagcuauauccuggagccgugguuuucuacugaaaacacuugugucuaaucugaaaggacacacuaaauauuacauaaacaacagcaaacaaaaaauaaggagaaaguaaaaugugacuuucauauauuaucuucauccacugaaguccauguagucugggcauacagauaacucuuguuucccacaaguaaaucuaaucuucucuuuuugggggaguugagguggggugggauuugagaccgguuuuccuucuguagcccuggcuguccuggaacucacucuguagaccaggcuggccucaaacucagaaauccaccugccucugccuccugagugcugggacuaaaccugugcaccaccacugcccgagauuaaucaagacuaucuagauuaaucaggauaaaucugauugugaugaggaggacacagcucuguggguuuucucaaauucuccccagcuguuacugaacacuguaucucaacacagcagguuuggggacuuuucccaggauggcaauuauauucucagucuguagucacugcgcccugggcauggacuucccugugauuuuuuucuuaucaccuaagcaagaaaaaagaucaugucaaaaugaaaggaagaaggcugugacaucaacucugucagaacaggcucucaggcagcgcugcccagggauuacaguugcuggccucagagcucagccucacaaccucugacucacugugcauguucugccuaugaaaacauuaccuaaaaggcagugugggcgucacugaagucccacuugcugcccuguggcaccugcuccauccugaagcugaaaugcucagcacugaacagaucccgggucacucuucaccacggccauagccugauuucuuaaauucaaaccuacugcugccuccaaacucaggggguuuuccagucucucucaccccuaaucucagccagccccggcuugcaagccgucagagccauacaaccccacuuacauccccucgaaagagggagcugcgccacgcugcugaaauugggaaaauuaaagacgcacagcagcuacacagacuugcccacagaaaucugcgaacaguggagacacccucacgagccccggcagcaggggacacgucacaaggugcagaaugagggcugggugggagagauaccuguuuuccagaaucuguguccaaagaaacaaacgaagagcccaagcagggcaaccaaaguggagaacacuuucguagauacucuuccuucaaacaaacaaacaaacaaacaaacaaacaaauauuaguggacaagugugucuguguuaauuaauaagcaacacagggaagacuggaagcuauaguggcuuaagaauaacaugaucacggccccuaaaaauauccuuguucccugaugagugaaucuaugcaggcagcuaccgcaauggcugcuuuuuauaacaaggagaaccagaacacacgcuccugacaaaggcacuccaggcuacuuaugguguuccuuuaggagcgauauaacagagcauguuaccuaaaacaagucgucguuucuucagcaaauaaacugcaaagagaaaaagcgggcgccccgguuaacggaaacucaugagcccuggguagaugccgcaucugcaucccgacucagcacacaggggugaugcaugccuucaagccuagcccagggaggcugaggcaggaaaagcacuucgcaggcaaggccaacugugcuacauggucacuuccaagucagccugagauaaagagugagcccugucucacuaagacugaacagugggggcuggagguacagcucaguggguaagagcacuguugcuuuuauagagaacgaagauccgagucccagcacccaaccaucuguaacuccagcuccauaggauacaacgcccucuucuggccucugccugcacugcacucacagacuacacagggcacacacagacaaaacauccaugugcacaaaauaaacguaaauuaaucagucauuguuucaaaaaaaaaauaccccuuaucaagaggaaacccugcucacaaaagucaccuuccuuggaaacccucaaaaugagccuaaggaaauuauccuugagugagaacagaccucuacacucugaaaacuuacaagauggagcaggugcaccaggcgcuuacgugaaagcacgggacaugcacuuaaacaacaaaugagaagugcagaccagggucugugaaccacggucgguccacagaucuaacucuucugaccucacagaacuaugcagcaaaagauaaaaguguacauucugcuuccgaaggugggugaccgugacccaaaacacagggcuggugggugggugacugucaccccaaaacacagagcugguggacuguuccaccuugcuuucuuucaaauacaaaaccuggggucugggaagauagcuugguuguaaaaugccuuccaagccugagauccacauccucgugaaaaguuggguguggcagugaacgccucccaaugcuggggcggugcggaagggaggagcccugaggcgugcuggccagcugguccagccaaaauagagaucuccagguacagugagagacugccucaaaagaguaugugaaggacaaagauguccaacaccaaccucuggccucugcaugcacacacauguaugcacacaugaacaccaucuuagaauacuuuucuauucccaugagaaggcaucauggccaagcaauguauaaaauaaagcauuuaacugggggcuuccuuacaguuucagagguaauuucaugaccaucauaucacggugggaagcaggacagacagacuugacuugacuuggcaugacuugagcauggguagcuguguuugagucaggugggaguauuugugugaacacacacuacucagguucuggaaccuucuccuggacccugugucacauccuugcaaaguuuaguuucaaaaaaaaucugacgacuccaauaaacuagaauuucuucuccucccuccgcuggccaccacuaucugauggcaccaaaugucugacagggucccucauccucugcccacccucaaagugacaucucaucaaccugguuucucuucagcaagaauccugacacugcacuuuuuauaaacuccacaccccagacgcugacuuuuggugacuuuccucccaguugccuauacuuguuggagauugguucuaaugcuuugguucaaucaggaaucuguguacguguccagaugcugaagacccuuguccccaauugauuuuugauccaucaauaaagaugccaauggccaaugacugggcaccgggcaagacacuuaagaguugugcggguaggacgaagagaggaacggggcagaacugccaugacuugggguagaaggaugggacacaggaguggcagggaaauacagccaaccaaccaugugagaguuuucagguaaguggccucuggcuacuucuccaauugggccugggguagcaggggaauauuuaggaguguccagccuuugagguagccaaggaauuuuaaaauaaguuugugugugugugugugugugugugugugugugugugugugugugugugugugucuuucauucgaggauccacgggugggugcaccugugugaucugugggagcacaaagcaggguaagcaaaaccugcuggcuacauggacugucuuuagagcugagcccucucuuccccgcugcaaauucucacuauggcggcggcauccugacauccuaacuguaagagcccugucuuuucacagcgcuccucaugacuuuaccaugagucacaggagacaggauguaccucucagcggcacagcugucauguggugcuuucccagcaugcacagggccuaccuuaacccucagcacuaccgaauaaauuccugaggaaggaaaguguugagacaugguuucauguagcccaggcuggccucaaacuuucuauguagcccaggcuggcccaccacaaccaccggaugcuucuuuagaagguugcuccuuguaagagcuccugaacguucuccacauccuguccugugugcccucgcuggcacccaugagcuccgugcugcgaagccaguggucacuuuucaacagagcuuacucuuccucggcuuuauccagaugacacguuucccuuugaaaugcuuucucacacuaucuucaugagacaugucuuucuccccccccucucccaucaguccugcucucucagccaugguagcaggaucuuucagggcuuguucucagaacuaauucccuuuuucauguucucacgccaagcgggaagccaucuccgcuguggaugugcaucuugggugacauucuccgguccuaguccuccccuacauuagcugacacauccaaccaacuagggacugaaaucucaaugagaacgcuccauggggcucucaaacugccacagcccuucccgcuagugaacagcagcucuccuacaguggcucaagguaacaacgugucuuaguuucuuuuccuguugcugggacaaaagcaacuuaacccugaaaaaugcaacuuaagagaaaaagcauuuauucugacucacaguucaaaggugaacuccaucauuguggggaaaucccaguagcagggagaacugguucauacuacaugcauagugaaaaagcaaaggcuucacaaauacuuagcuagcucagcucacuccuucugcuuuacagaguccagguucccuguccagggaauggucccacccauguauguguguguguagcuuacccucaggugacagaaacagagaggagugugugcagacacagcaaagagggagaaaaguaaacagcacugcacagcaacuaacacugagagacuaaggcacgagugugugcaacuucuucauuuuaguuuugcaucuuuucuguaaaauuauuucaaaauaaguaugaaucaggguguacgugugagcauguggacacgcaugugcacacacucacauacacacaggucucaugaccucuccacugacauccuucuauaucacagcaucucucaccuauaucacuucaagaagucucaugaucacgucugaaucuaagauggaugagggcgcccuuuggucaaaaccuuccagugcuuucuauguccuccagaagagaagcuagagcuagagccuacucugaccuacaaggcuggccuggagccaccaggcugcgccccuguucucacaccuucugucacuguuccuguccucacugcucugccucagaccucaaggcagucgcccagaaacaggauggcuuaguauggcuguccccucugccuggcacauacccagauaugcacauggcuccugccugcaaggccuucaccaacccucucaccucagacuuuucucagacuggcccccuuccugcucugucuuucucccugguacucauuaguuucucaaauguuauguuuuacaaauacaccaaccccauccuagcucccucacuacacauauauguguaucauaugugguggggaaaugggcagcaccagucacaugcccagugcucagcucugaguuuugugcacucagauauucuauugccuugcauggaggauaugauacagcgucuucuuuuagauguauuuauuuuauuuuauuuuauguauauggguguuuugcuugcaugcaugucuaugaaccaugugcauuccuggugugaugguuuggauaugcuuggcccugggaguggcaauauuagaagcuauggucuuguuggagugggugugucacugugagcauggacccuuaagacccucguucuagcugccuagaagucagucuuccacuagcagccuucagaugaagauuuagaauucucagcuccuccugucuggacacugcaccugccuugaugauaauggacugaaccucugaacuuguaagccagccccaauuagauguugcucuuauaagaguuaccuuggucauggugucucuucacagcaguaaaacccuaagauaccugguauucuuggaggucagcagagggcaucagauaccaagaacuggaguuauacaugguugugagcugccaugugagugcuggaacugaaccuugguccuuuacaaaagugcucuuaacuagugagccauccccucagcccuaauguggggucuuaccaaaggcaacuagugacugagugaaugaaagcucgacaaaacguuuuuaacaaccuuaagcucuucacugguggaaaucaaguggcaaagccaaggacaaaucuguccagguugaagucuacauacucaccaggaaaagcacaguuaccauccacugacucaaagcugcaggcguaugugugcacgggcacauaagcagcagaaguauugagggacggaucccaaacgaugacauuauagaugacuccuugucccgggagggaagagaaggacacggcuguuuuaucgucagcuguuaggguggccaccuaaagcaaaacauaacaagugguguugacguggcuuuuaaagcugugaucaccugcaugagaccuacacaggaccaugcaagucagcagugcacuggagccauuggcagccgaugccuucuggggaaggacucagguucccuuuuuaaaagauugugugaguguggguacccaucagcccagaagagggagucacauccccgagagcugaaguuacaggcaguugugagccaccugaaaugggagcuggcaacugaauccaaguccucugcaagagcagcaaaugcucucaacaccugagacaucuuuccagcacugagagucaguuuucuuuaagaauguggccccuggcaggucagccacgcuccaccggacacucuuacucaugaguauaugaguagcaugaacuagacucagugaaauauuugaaacaaacaaaaacaaaaggcagaaggcaggaaauuggagggagucaggaggggugggugugggaggaguuacagggaggaguuuggagggguggaugugggagggguuaggaguuuggagguggaugugggaggaguuagagggaagaguuuggagugaauaugaucagaauacacugcauucauguaugaacgucucaaagaaagcaauaaaacacaugacaggggcuggugagauggcucaguggguaagagcacccgacugcucuucugaagguccagaguucaaaucccagcaaccacaugguggcucacaaccaucuguaacaagaucugacgcccucuucuggagugucugaagacagcuaaaguauacuuacauauaauaaauaaauaaaucuuuaaaaaaaaaaaagaaucaguugccuuuauuauaaaaaaaaaaaaacaugacaaauacuaacaccaguguauauacccuucagcaguuucucaguuuacuucccauuacacuuaccagaaguucuuaucuaaauugcugaaguauucaaaaaauuaucaucuacuucuuuuccugccucaggaugaugaggucacagauauggcaggaaucaaaacaaaacugacuugccucuccccaaagguuaaaucauuuccgagcacccaaacuagccucaugagcuguaagaaccagacuuaccuugauggcacuggccuucaccugagccaccugggccauccucugaagaugauggagcagagaggccucggugaggucgcccucgggcaggaaguacugguacacgucauagcgcagccuccaccuggacucucggcuggugcucacaucacacggugggggcucuguagcccuaaagauaaccacagcucagcaucagugucaaccucuccuggcucaagcccuguccaugaaaaggagccagagcuaucuucaaacuucuacaggcgcaaucccaacuacgcagcugugagucuaagugucacucuagagaaaguagcacacagagauagucuggguuucauuuccuaucccugcuuccaaugugacgggaugguaaauuggcugugggagauagucagucagguccugagggggaacucuccugagugggaccagcgcccuuauagaaguggccucagacagcucucaggcaaucuucucuucuccuaaggacacaguaagaggucugcagccugcaggaggccccucaccaaagcccaaaggcgcugcuccagaaagcaauaggaggagccuucagggcguggugcauggcugugguccuagaacuugggagccagaaggagaaugaaugcaaguucaaggccagccuggucuacauagaaacucccaagcaaaccagugacacguggauauaaguaaauaaauaccuauaaauaaauaaauuacuguuauucacaauccauccaaguagauuuugguacagauuaaccauucuuaaucuaaaaccugaggggcuggagagauggcucggcaguuaagggcacggacugcucuuccagaggaccuggguaaaaaucccagcacccacauggcagcucacaacggucuguaacuccaagaucuaacacccucacacagauauacaugcaggccaaauacuaagacauauaaaauaaaaauagauuuuaaaaaucugaaaccugaaacuaaucaggcuccacucugacuucggacguuugggauuuguuagauuugggguuuuuagauuagggaugcucaaccauuaaggucuacaccagugucaaacacuucuggccccagaugauucagauaaaggaugucuagccuauucuuuacaagggcagcacuggcugacuguuauacacagaagccaagugguuaaaagaaaaauagauucugaugugagucaggcccacagcgaugacaccuuuccuaucugacacugugucauguaguuagaaauauuugauuuuauuuguguguguguguguguguguguauacuugugaguguggguacccauggaauccagaagagaauguuuaaccucaaaguucgcagaaaaccucucuguaaaauaaaagcaacugcuucuuccuaaaaguauuaagauuaaauaacaaggagcacacagcauccaaugcugagguagguggcaggcagagaguuuucaaaugaucguugcuauucaaguagaaacugaggcaguuuugcaaaauuaaauccucauaagguguaagaaauuagggcuaugaaugccuucuguguuugaacgcuuugaggaaacuaaggcaaggcuggagagacggcucggugguuaaaugcacauacucgucuuacagaagaccaagcucauccccaccccgggcagcucgcaaccaccugucagcucagcuccgaggcauccgcaucucuagccuuuacagguacucacacagacauaaauauacacuuaaaaauaauaaaaauaaaucuuuaaagcagaaaacuaagaugcacuucuaagcucacagcaggcuuacaccacaccugucucuucaaaugaugaauccguaagcacuaaggagauuauucaguauaaagaauauuggcaccgagguuuaaauuaugcugacccccaaauaagaaacaauuccacauugcuauagaagcgauggcugugagccaguuagcuggucccgcucuacagucaccuaagagcagcuuuggcagggugggguugccagccuaccuugcauagccuauguuugcuggugcgaacuugauaguugucucaaaaaaauuauaguccaaauagagguuggggucaauaucuaaaucaaacuccaaauugcagccuccaggaaugggaucugcauggaaaauggugagauuaguaacacaagaguccuuuucauguuccaggaaacaguccuacacagccauaucagcacagaaugccagcacuucugcuguccggugacugaggucagaaggguacaguucccucaugcccuuucccuucaaaccgucucuuucacgccauaugcacuucaccacugagcuauucacuacccagccccacccaagcuccugcagccucacuucccucacacaccuucgcuuagccaucacugugagcugacucuuucccagugcugccuggaccagaugcuaauggacaccccuggcucaccacugcucuuucauucagacaccacuggucacgucuuuggacuuuucuggaauucacuauucccuacugcuggcucaggccgguguuccaggcauuccucuuaccuccagguaucuccucagccaugcgccugguccucagcagucaccaucgcccagguaccgugcuugacaugugcucaacacuaggaaacgguugcguucccccagguaccucuccacucucacgcauggccuugacuuugacaccagcugucuaucuaaucuuauuacuuuaauccaggccaggauucuacgacaugcuuccaaugagacguccuaugagcaucucagacucacugugcccucacaggagucaccacugacuccauccuaccccaugaaagagccauccccacaucuaaacauacugugcaguacaaucucugaucuguccaaacaggaggcccagguuccucccggguagcuuguagccaaggccccucccugguagcauguagccaaggccccucuccccugguagcauguagccacugugccuugucgguugcccuccccaguccuggcucagcaccugcuuucagaccccacuuuucacuuuccucauagccgucaggcuccauccuacucagcucuuucuucuucauguagcucaggcuagccuucaacgugccacagagcuggcucugaccuguuaguccucuugccagauuauuggcacgugccacaacggccaauuuuacacggugcuggagauggaacccagggugugacgcauacugggcaagcacugaucagccaagcugcaccaccagcuccucugucgucagcuuucuaaagaugaaauggacuacguugcuccccucucaaacuuuaugcuuucuuugaggccaccuuagcaaugcugcgugcaaacuguguucaaggcucuuugcuuucuggcucaaaacauacccacugcccaucacuccaaacccugcaccuuucuucagauaagccuacugccuccucugcccacaaugacgagggaggaaugaacucuccaagucacaacaugagcuucccgccccacuagcucucugccccuuucacagugaaacacucugguuaaauaaaccacacccauaauaaacaauuuuaccaggauaguguuccuuaggauuccacagacagaugacgcucaccacugagcuauucacuacccaguaccuugguacuccacggauuaccuuggagagggaguuaccucuuucugaguaggagagcguaagggccacgcuuuggacaggcuuggugucucccgucuccaaguaccaaguacacacugccugcuccggucuaagaaugaagaccagcccucugucguugccuguuccugacgugcugggaaggagagucugcauuugagaagcaaaaccaucauggaaacugacuugagaaaucacauccacugcagagcugcccagugugcacugcucucuccaaacccucucagaacaaaaaggggaaaauuccucagggggggguuucaucucuguguucuagcacccacaccuucacacuggagaacucuaaacauaucacugggggcuggagugauggcuuuagcaguuaggagugucaguugcucuuccaaaggaccuggguucaguucccaacauccacaugauggcuuacaacagccuguaauuccaguuccaggggaccugauacccucuuuuagucuacacaaguacugggcacaugugugauacgcacgcauacauacugguaaaacacccauacaaaagaaauacgguauuggccuuuaucccucuccaacuucuuacuuaauuuacauguuuagauuuaugacugguuucauuuuauguauacgagugguuugccugcauccgugaacagacaccauaugcaugcuggguggcucagaggucagaucuccuggaacuggaguuauagauggucaugagcugcucugugaguacugggaacugaacccagguccucuccaagaacaagcccucuuaacugcugagccaccucuccauccccugcagaugacuuuucaagacaugucucucacggaaccuggagcucagugcucagugauuggcuaggcugaguaggcaguugagccuuguuucuaccuccccagaccuaauguaacaaacccacaccaggccuggcuaguuuuuggcgugugugcaugugugguugguugguugguugguugguugguugguugguugguugguuuguuuguuuguuuguuuguuuugguguguuuuaaggaucaaacucagguccuauagacugggccuucuccucaguccucagcuuccauuccuuaauaccaagauaccaggggucaggguguagaccagugguaaagcacuugccuguggagucugauggccuggauuucauucccagcuuaauaugggaagaaaauaaaacaaaacagacaaaagcaaagaaacaaacaaaaccucuaugacuugcacauugaauuuuccaagcacugcaguucaacugaguuaagacuuauucuguccggcccugaggcuaacaagacaaaaccagagcucuggccccaaagaguucaguuuacaaaaagcguuuguuuuaaagacguguuuaauuauuuacuuuuaauuuaugaguaucaaugguuuuuuccuguaugcauuucugcacaccauacacacgccugguaccuguggaggccagaggaggauucagagacucuggcaccagaguuaggaauaguugugacugcuaugugggcgcuggggaccaaacccaggaacucugcaagagcugcaagugccccuuaaccacugagccauccugcuggaaaucuuuuccccuuuaaggcaacuguucaccuaggucaggucaucucugccucacugugcaguggaagcuggcccaaugccccugccuccacagccagaauggucucuuaaaucuaagagaauaagaaggaaaaauguaccugguaaguuucaacuuggcaagccucaaagcaagcggcuuuaccuacagagucagugggcuucagagaacccauugccauggcaaccaaaaaucaaacaaaagaccaaggacaacacuggccaucagaaaggacacaagaaagagcucugcucgucacagucauuucuagaacccuguguaguucuguuugccugcauagccugugagucaagggaacugagagcagcccaggcacugaggguggcccaggcgcuaagaucuugcaacuaaaaagauagccgaaaccuugcugcauggagaucaggcccacucacacacagacaucaaauucucuaacacggaugcucacagucagcuaauggauggaucacagggcucccaauggaggagcuagagaaagaacccaaggagcuaaagggaucugcaacccuauagguggaacaacauuaugaacuaaccaguaccccggagcucuugacucuagcugcauauguaucaaaagauggccuagucggccaucacuggaaagagaggcccauuggacacgcaaacuuuauaugccccaguacaggggaacgccagggccaaaaagggggaguggguggguaggggaguggggguggguggguaugggggacuuuugguauagcauugggaauguaaaugagcuaaauaccuaauaaaaaauggaaaaaaaaaaacaaaaaaaaauucucuaacacacaagacucaacauuauagagaugcucuuuuuacuggaggaacgcuuugcacuuaccuuaguaaaugaaaccgugguauucugauacugugaguguauuuggaaaagaagaaaggucacauugcuugaaauauggcgcaggacggccuccugcggagaggacuugcugagcacaaaguauguaaauuuucccacagaaaacucaaggaaaccuacaaugaaaaaaguuucucauuacagcauuguaccucuagcaucaauuuguagaaaucucauucacaagcaaaugcaugguacuaauuuaacccucaaaaaaacccuggagagucggguaugguggugcaaaccagauaucucagcacuugggaggcuaaagcagagagaucuaugugaggaccuggccagccuggaguacaaagaucaaaaagacccuguuggugucuggguggugcaugucacaacaaggauagugaaacgucaaaacugaagccuagucagacgaagccacugagguccugaugccacugcgguccugauucacgacagccguggucgccugcaccaggccugcacaaggccagcccuguggaauccaucacagguagcagagggguucuugggugcaauccuuccugcugagcugugaccacugacagauccuagggaugucacugucuucaguuaaaagugaccuugucucaaaaacaaugcaaacaugcuuucuggccugucggcugugguggggacacuguuccuggcccucagggacagguauccuuccccugugcaaggagcucuccacucauuucugccuccauuuucugguuucauuuuuugucuccucccgcuccccuaugcacacacgcuuuucccucauuuucuccaguugacaaguaucagcaagcacauauaaaguagcuaucugugcccaaaaguugagcaagcaaauccacugcagcuucucuaucggagccgcccaccaccgugucucgggcuuuccuccgcuguacucuagagauguugugguggcccuugugauuucccgagacacagacucugcaccagaacaguucauaagacacugaagccaccucuagagauaugcugguggcuagcuuuccuuagccucucucuucaacccaggagugagagccauucuccaagauuccaacacacuagaagaaccacaagaccaaaggcuagcagguaagaguccagcuauucucccagugacccagguucaguucccagaaccuacauggcagcucauaacugccuauauccuguuccaggggaucgcauacccucuuauggccacugcaggcagcaagcacacauguggugcacacgcguacacucagacacacacacaaaaaaaccuauacacauaaaauaagucuuuagaaaagaaacaggaccacagcaauuaaaaugauuaagcaacuggcuacugauaacacgaggagcgaugcuaaaagcaagcauccccaggacuaugugucaagugguuuuucuuuacauauacucuuuuucaaguuucaaaguguucuucucagaaauuucaugauuuaacaaaagguuccagcuuugauggccucaagauucaaguucuaccuugagucuacauuuuaaauuuguuaaaacaacaccaccaguacacacauacacacacacacacacacaccugcacacacacagcuauguucaauucucagcacuuagaagaaaggaagacacaacaauacagggaugcucucaaccccugcccauggcuuccccaguacaaauguccccacagcugacaucugguauaugugccaucacccuucagcauccacaggguacaagucccaaacccuccaacugccaaccacugcccacaccucacauaaaaugauagauaccguaggaaaugaagagauggcuccauggguaagaccacuuaugaagcaagcaugagggaccugaguuugaaucccagaacccacaugaaaagccaggcacugccacauacacuguaacuucuauacuauggagggcagggauaguaagaucacuggggcuuucuggccaccaguguaguuccagguuuagugagagguucuuuucaagggaauaaggcacaaacacgcauaaacacgcacaaacacacacacacacacacacacacacacacacacacacacacacacacacggggagggagguagaauuagcauuucuucuagacucugccccacaguugccuggcaacagccagguaugccugacucacuauaaaaggggcugcucuccccuccucuuucucuuguucucacucuccacaugcucauggccugccucuacuccucuaugcucucacuuuccuucucucucucucucucuccuacccucucaaucccccuccccaugcccuaaauaaacucuauucuauacuauacucauguggcugguccuucaggaggaagggaugccucagcaugggccugcagaggcacccucuuaaccugaacuauacugcgccucuaaaaaacauaucccuggcuucucuuucuuuuuuauaaaacacaacacacgcacacaugcacacacacuguauguauuuuuuaaaaugccauuaugaugaacauauacccacauacuuuguggauuauuuacauaccugacacagugcuacaucauuauacuguuagagaacaauaacaugaagagucuguacacauuugguacagguacacuuuuuaaaaaguauuuuaaagccgggcgugguggcgcaugccuuuaaucccagcacuccggaggcagaggcaggcggauuucugaguucgaggccagccuggucuacagaguuaguuccaggacagccagggcuacacagagaaacccugucucaaaaaacaaaaauaauaauaauaauaauaauaauaauaauaauaauaauaauaauaauaauauuuuaacucugcagcuuguugaaucugcaggauauaaagcucuggguuaugcagaccaacucugcguugaagauucagucucugaacucauacugccuauuucuacacaugugcaagaagauguuuaaaugugaggcacagaccacucacuaggucuuaggcaucuguauaugucaauauuaauaauucagggcuggagccuggugagagaguguuuguuuagcauguaugaggcugagcuccaugccagugcuaccacggccuggcggguggggauuccagcuggccccuguuaaagcugcugaguaucgcaccaugcaugcauauccuaacugcauauauugaugagcauaaccacugauacucuagugugaaaaacaaauuaagaaaaaugcuaugcauggcauguacacuuuuaaucuccacacucagagguuuuuugaguuaggguuucuauugcugugaagagauaccaugaacacagcaacucuuaagagaacauuuaguuggggcuggcuuacaguuucugagguuuauuccauggucauccugguggcaugcaggcagacauagugcuggagaaggagcagagaguucuacaucuugguccacaggcagcaagaaaaaaacuggcuugaacuucuaagaccucaaagcccacccuccagugacacacuuccucuaguaaagccacaucacaccuccuaauagucccaccccuuagggaucaaguauucaaacacauagucuaucagggacauuccuauucaaaccaccacaggagcagggaccagaagaccaggguuucaggucauccuaggcuagacagugagcuugaagccagauuggacuauaggagacucugucucaaaaauucccccaaauaaaauaaaauaguucuguuuugcaggaaaguguucuagaaagcaaauaggucaggugauuaacuuaauaugaugucaugguguaacagaugaccuuugcccuuauggugaaacuguaccuaaguugucuuccugucuaaaaagucacaacuggaaacaaagagccugagacacaaccuggguagcaggacugaaauuccaagcugaagcuugugcuucugacuucaggaaguucacccaggcuccuaggaaccacaaggaagagcgccugcguuuuuuagacaugaugcuucauggaggccccacccccacgugccugcagcaggaaccugcugaagacagauagugaaggcggauggaaagacagucuacgguaucuaaaacugguccuguuguaguaacaucggaaacauuaaaaacagcuaccuaaaaguguuucucuuuuccaaauacaguuccuuacuuaucaccuuuucuauaguuuuuauuaaacgcccuuaucauaaggaaacuacaauauucccugguucuuuguggaggugaucucuugccacgaaucacccauaccacucagaugaaaaugccuagcaguagcugcagaccagaauuugaaaacaaacauucauucaaacaucaugaggaagggcugggacuguggcucaguugggaggucugaccagcucaaccaacaugcucagagcccuggguuugaacaccaaccauguauaagcaagugaugggugcuguaauccaacacuggggagagggauggagacaggagggucaaguguuuaaguuauccucaguuauguauaguucaaguauagcccagccucagaaaacaaagcagaaaguucuccacguaccugagaacugcuaacaucaaguuuggugaauaagagacucucacgucuccauucuuuuucuguuguuguuguuguuuguuuuuuuguuguuuuuguuuuucgagacaggguuucucugugcaguccuggcuuuccuggaacucacucuguagaccagaauggccuuaaacucagaaauccaccugccucugccucccaagugcugagauuaaaggcgugcgccaccacugccuggcucacgucuccauucuuaaccgagcugcuuugugcaaggcaaugauuugcuggaccagaaccauugcacaauuuguacagaaggcugcauuuuaaccccagugccugugguuucccuccuggcuaugaaggucucugucauaucugaugauccagugucuggcacuguaucaguggccuggcagugaaagccgguucaacacugacugaacucugugacuuaaggcaagguauuuauuuccucugggccuuuguucucuugcaguuaaagggaagcagcuaugcuacagaaaccacccaacaaaugggaggaugguuuuauaaccuagaggagcugccuagcagggaccaugaacuucugaagccugccagugcuuuggagacgcaaaaauguucaggcauccucagguuggccccacaaagacacuagugaggagaggauuaauuuguccucacagagaugcccugccuaucauaagcugcauugaggggacuuccacagagauacuuacucaagguggggccugggguauagcuuaugguagauguuugaacagagcucugaguucaauucccaguaccaccaaaaauaacccagaaaugagagagaagaacagggguguggaauaacacacucucucucucucuuucucccugucucuuucucugucucucuaagacuaaacugcuuuugccacauacaugauagaaauuuaauuuaauuuccuuuuguuugcuuuuauuauuauuuaguuguuuucuaguacuggagauugaaccuagggccucucaagcuccgagcaggccauccagcacuaaaccacacccuagcucuuuaacauuugcauuucaagacagagucuaaggugcccgaacugccuuggaccuuacucuauugugauccuucugccucaacuucccaaacagcuagcuggguuaugacaagcuugagacagccaaccuggcuggaaacggcauuuaauuccuauucacaagagacuuggcaauagaagacauacccaaaauacauccugcagaaguuaauaggacccuacccuggccuccaagccgucaggagaaggagucaccagaaacauuugacuggcguaauuagaucuuaugacuggggugugggaagcagacagcacaucaaagguuguuacagagcaggcggcccagucaagauggcgugguuacucgaacggaacuugggagagugauggcucugcuuuaucugacauuucaaaagcaacccaaacugccaucagcaugggagggucagguuuucuauuuucauacguacuuuccaucuuuaaccagccagagucucuuuuuccuuccacuaacuccauucuagaagaccuuccacuccucaucuucuccucuuucccaaucagauccguaucuuaaaaccacccaacuaacucccucgucgacugcguuacuaaaaggcaccuuagacuucccuccauugucugacacagcagccaacuuuaggagcagcgacaaagugcaucccuccuaaguggacuaauucucaguccaaacacucagggcaagagguacagcugcugucaccuguaccauaaccccagcuccgccauccacgggaggcucacccuucgacugucuguaauguccaugcugccuuucaccagccagauggggaauaucagcuuuuaaucacacagcuguugagugucucaguucuaucccucuccugcacacaauaauacuaacuuaaaacagaaagaacagcacacaggaaggcagcagugccgugccguaaucagaggugagacaagguaaggaaaaccccaauccucaacuaagugcuucucuuucugugaaaaguuuccggauauuaaguacugaaacuccaaacuggaaauaaaagcucuggcucccaggccuccagacacaggagcuuuccaaaucaaccccaagcucaacccuuccucucucccaccuucagaaggauguuccgaagauacgcacucgcagauuaaauauaacacagcauuaugcugugaaagguuuggggguuuuuuguuuguuugauuuuuguuuuuguuuuuuugguuuuuuuuugagauagggucucacguaguccaggcuggccuccgaauccuuauauaguugaaucugauucugcacucuggauucuccacguucuaaaugcuggggucuaggccuguaccaccacacccaguccaugccaugcucaggaagggcaccaggccugcuuaaaugcuaggcgaacacucuaccaacucagcuacauccccagcccgggggcaagauauuccucucagaaaguggcuuugcugaagugcaggggucaugcaacuugcagggcaacacaccagguguugcuacguuuguagcaaacgagcauuuggagccuccagaggguuggauugauugcuagcuccuggggcguugaggauuagaguacucaggcugugaaacggaccuagcauucagccagggccagaggccaaugcuuccucucugcuguaagccagaguuuucuucaagaaaauagguguguguguguguguguguguguguguguguguguguguguguguguguguguauacacuuaacacacaaauauuuguacuuuucaguacuggccuuaguuguacucgaagauccuaaagugcgguacuaucccuggcuuuucacagauaaacauuaggagaaaugaucccaucacucagaagacuauuguauuugcuacuugucuagagcucaaaacaaggaauguacuuaacgcagccagaaacaacacgugaccaccagcguggcacaauuagugcuuuucaugcuucccauuaacgcccccgcuccugcccaacagucgcuaaaccccucucucucagcacaagaccuaggauuucacgucccaucacuggcucauuuuuccucucaaacugcaaaucgucacccaguuaaaaaagcaacuagauuucggaguaucaaagucagcuacugcguggaacgccuuaguuccucgauggacuuugcuaccgguagccgacggguucgguuugguuuuaguuugggccugacgcucacucuccgggcggucucgaacacauaauccuccugucgcagccucaggggugcugcgcuuacaggcguccuccccgaaauucaguuuaaaaggccguuucaaugcguccaauuaaaaccacaaacauggcugcucccugccgggaagaaugccucaaagggggcuacuuaucucuucccgguucccagcccaaaccaggcgcuggcaggauggacacggucccgaacccgcggccugacgcgcaucugcaaccggggagggcugcacagagccgggcagccugcggcccugcugcaggagcggaggcaaguucgggaagcucaccgucgcuggaguucgccugggccucggcgcugcccgccgccagcaccgcuaggaccagcaggcgcagccgccacaucgcugcgggccggggcgcgcgggccaggggcgcgcaggccaggucgcuugcuaccccggagcgcccgcgcgcaucgcuuuagcgcgccggccccgcgcgugcaccugccgccccagccccgccgggcgcgcgcuuccggcacgacagccgcgcgcguccccggccggcccuugcgggcgcgcgccuccugccggggcuucugggcuccccgggcucacggggcaagccgggacgaguucuugcuuuugugucuuuccuuucucucuucuucuuuccuuccuuccuuccuuccuuccuuccuuccuuccuuccuuccuuccuuccuuccuuccuuccuuccuuccuuuuuucuucuuucucuuuucuucuuccucuuucugucuuucuuuuuucuuuuccuuuuauuccuuguuuuuuuucaagauaggguuuuucuguguagccccagcuguucuggaauucacucuguagacuaggcugcccuugaacucagaaaucgccugccucugcugguacuaaaggcaugcaccaccaccacccagcuacuuuuugucauucuaauugugcaaaauaacucucucucucucucucucucucucucucucucucucucucucucucucucucucucucucucucucucucucucucucucucucucucucucucucucucucugucucucucucucucucucucucccuccuaagacuaggucucucacaauccagagugaccuccagcugcuaugcaguagagaugaccuugaacuucugaccucucgcuacuuccucccaagggcugggaagauaaacuugugccaccacuaaugaauuucauauuuuauugagauauugaggcacagugaggugccccaagccacaaauaggauucuuaguaucuuaaaaggcacuuaugaaaaggggacuggggaaaacuuaaaaaaaaaaaaaaaaacaagcauaacacaaacuugaguuaauaauauaaccugucgcacucuuuucacugagauaugucucaauguaggauaccaaugacagccaugauagaaacggauguaaaauguaugagaaauuuugcaauuuuuccuguaaccuaaaccuauuuuaaaauaaauugauaacauuuuaaauggaaaaggcaggaugucuggugcuuguuuuuccagcacuucggaggcugagguaggaagcuugccaagaacaggagaacacagacuccauacauagugagacuguugaaaaauaguaaugauaaaaucaguaaacaaauuaacauaauggacagugcuggagucauuccuaugcaacaccacuuacagcagugguucucaaccuuccuaauacugcagcccuuuaauacagcucguguuauggugaccccaaaccaaaaaauuauuuuuguugcuacuuuauaacuauaauuuuguuauugcuaugucauaaaugucuguguuuuccauggacuuaggugaccccugugaaaugauccccccccccaggguuuugagacccacagguugagaacagcugacuuaaaguauccuugugucugcagcaugggugugcucugaaagucagcaugaagguauccaugauuuccagguaaggguaacagaggaauacaaacaucccacgucgucauaucacacacauuaaaccaaacaucccaagucgucauaucacacacauuaaacacaugccugcuucucucaaguaucagcuacauuccuugugcuucuuuauuguuuuaauuauuauuacuuauuuugguuuugugagacacggucuugggccuuucauugguagccuaggauagccuagaauucacuauguagcccaggcuggccucaaccuccugcugcaaagaaccccuguuugugcuuaagagcccuuugcaaauaaaauaagauaaaauaaaauaaaauaaaauaaaauaauaaauaaaggaauucagugcuuggguuuuguuuguuuguuuguuuagaacaacauuggaagauuguugccuccugccgcaacugucuaagcuacuacagcugaccuuaggucugcuuuugaaguguuugcugagacccauggggaaaaauuuuuuucucucuucuaagcaaaaauauccuugaaaacucacagccucagucuacuucucaaaucuccuaucugugugcuguugaagagccgccagcccacgcaacagaagagcacuccaggaucacggggcccauuauggacuugucugggacggcugccuugcuuuuuuuuuuuuuuuuucuguguuugauuuuuagguucauguaugaagguguuuuucugaauaaguauuagugcaccaggugcauacaaugcccgaggaggccagaaagggagcuuugaaucccuuggaauuggaguuacagaugguggugagcugugagugcugggaauugaacccagguccucugcaagagcuaccaguacucucuuuuuuuuuuuuuaaagauuuauuuauuuauuauauggaaguacauuguagcugucuucagacacuccagaagagggagucagaucucguuacggaugguugugagccaccaugugguugcugggauuugaacucuggaagagcagucgggugcucuuacccacugagccaucucaccagcccgcuaccaguacucuuaauagcugagccacucaugugugcgugccccucccacuauauaauuaaaauaacaaaaacgaguuuuuuuauaaaagaaauucaggaagaaauugcuaagcaaaaaggaaaggaagagcccauagagaaaaggauaggcagaacuggcugcauagacaauucugucaacauuagaaagcaaacaacccacagcugacaaucagaaaaagugaauccaaaggcagacauccacaaagcacaguagggggcucaccacaagugagaaaaaucuuauuaauaaacaaacaaaaaaaaaccaaauacacacaucaggcuugggggcucaugccucuaauucuagcaaugagaagguagauacaggaggauugccaugaggucaaagccagucuggguuaaauagucagacuguaucucaggcaaacacaaacaaggcaguguucuaauguaaguaaacuguacaauucuuuuaagcauauuguauaaaaaaucuuuuccucaaucacugccccuugaccaaaacaacccuuuauuuauauaauuuugguguaauaauuccauuuuaaguauauaacuagauagcaaaauuagcauaagcuggaccauggugguacaugucuuuaccagcacauaggaggcagaagcaggaggaucucugugaauuccaggacagccuggucuacagagugauuuauaggacagccaaggcuacacagagaaacccuaucuugaaaacaacaacaaauuagcuucaaaaauuggguggguaaaauggcucagugguaaaggcacacauugccacaccugaugacgucugcuucauuccuggggcccaugugguagaagucagguugccucugacuucuucugugguguguacccccaacacacacgcacauaaaaaaauaaauaaguaaguaaauaaaauguaaaaaugaaauuuuaaaucagugucaagaaauguucaagcuguugucuguaacaaaagacacgugucugacuuuaggcccuaaccugauaacagcgaauagccaucuaguagaguccugugcugcccuugguaauguuucagaaaguaacugacucauuugaaagguuuaggaaagggcaauugugaagcaauguacacauccuuuaaaaauaugcauuuaugguuaaauucacagaaagauaggauucaaguauguauguauagcuaucauauguaaccaauauuuaaaauacuaacaagugacugaauugauggcauuucucugcacauuucuauauuaaaaugcuauauguaggauuugugucuauugaauaagaaaauaugauuuuaagagauacacaugauuuuuaaugcuugauuauaaaaaugcauugucugucuaaacaagacccagagguucugaaaagacugcuguuucuuugugaagaacagagcauagucacaggaacagaacucugcaugagcugugcuaaacucagagcuuaguccaaaaggcggccgaggcaaggggaaguuaguagagacaaaauuaggaaaguuacaucaggcauuuugaaacaguaguccguggccaaaacgguuaauaaaaaguggugacugaagugucacucugaggggaacaguguaugggcucauguccuuguauaagaauguuuguuuuuaaaacugugagugcuuguguguguaggugcacaugugcccauguguguaugugcacaugugcccguguguguaggugcacaugugccaguguguguaggugcacaugugcauuaaagcugguggugaaucuugguguuguuccucgggaaucucuguugguuuuuaauuuguuuuuguuuuuucaagacaggguuucuguauguagccuuggcuguccuggaacucgcucuguaggccaggcuggccucaaacucacagagcucugccugcuucugccucccaagugcugguauuaaaggcaugugccaucacccauccagccguuuuuuuguuuuguuuuuauuguuuaggauguagucccccacggaucuggggcucauccauuuggcuagguugucuguucagccucagagaucuccacagcuucaggaagcuaauuauuuccauuuaaaaauguaugcaaacauuuggccagacaguggugguauaugccuuuaaucccaacacuugggaggcagaggcaggaggaucucuagggucuaggauagcuuggucuacagagcagguuccaggacagccagggcuacaaagagaaaacccuguuucagaagacaaacaagcaaacaaaaauguaugcaaacauuugagacuugucuggaggaaaggcucugacuacacuuuggauauuaggcccacauucuacagacuuguucccaaauguuacuacuggaagguaaccaaaacuuuaagagguauauucuaggagagaccaccuuaugugacuggggugacccuugaagggauaauggaguucuggccucucgucucucuccuuguuuguccuggucauaaacugaguuccaccauaugaucugcuggugcugaccuaauguaacaaggcuaaucaauaacaggcgacagccuccaaaggcacuaguaagauaucuuuuguugacugguugauuaucucaagucauacuacacuaucaaaaagcuaacacagacucauugcuuuaacaggacucuucaaacaguccacagauaaguccagugguugggggcuuuggcugaaguagguggaccuggcagaaggcucagggacaugaguaaauuuuggcuaagaaucuugggauugcagcauggguugucuugaggugaccccauugcagcauggguugucuugaggaggccccauugcagcaugggaugucuugagguggccccauugcagcauggguugucuugaggaggccccauugcagcaugggaugucuugaggaggccccauugcagcaugggaugucuugaggaggccccauugcagcauggguugucuugaggaggccccauugcagcauaggaugucuugagguggcuccuguacuucaggcagcucucuucuauggggcuggcaaccucagacucuuuaccaagugggauaaguugcagccuaucaguaaccaucuguuuuaaguguucuuucagaaguguuuaaccaagauggcacgggugcucagcauguaaagguguuugcagaacaagccugacaacccaaguccaaucccuaagacucaccuauaauagagaacaauucuacaauguucuacgaccuucacaugcacguugugacauauacacacauacauaucacacacacaaacauaaugcacacacacaauaaauaauuuuaaaauguuuucauucuuuucugucugcucuuuuauuuuuuugcuuuuguguagagaaauuuuuuaaauuuauuuuauauaggggaguuuugucuguguguaugucugugugcaagaugugcacuaacccauccagauuuuugggguuuuuuuagacauggucucacuauguagcucuggcugcccuggaacgugauguauagaauaggcuagucucaaacucagagauacaaguaccgggauuaaaggcaagugcuaccaaaccuaacugucaauuucauuuguaagaggaagugcaagaccuguggagguucccaguuugaccacagugguaaaguacacuguugguggaaaugaagacagaugugaaacacaaguggaacuuccuauagacgagugggaaaaaauaucccagaagcugagauccucaaaauuauuuccucgauuucaaaaugccauuccaucuacuagaauuuuaaaucccaaagucauguguuacuaggauuugagaccuuuggaaagugacugggaucuucagguccccuuaagggcccauucauguugaugggcuauaaugugauugacgugugcucucuugcccugccuuguaacaggcccggauuuuagcacaacuuacucuacgaugaaguaucauaaaacugaggauguaggcagcaccaccugccaaaacgaaaauaaaaguccauaucaaaguccauaguucugggaaagucuguaaauguacuaaccuugcuuuuugguuucuguaguuacacuucuacccaacuauuuuuguuaacugagucaugucaacucaagauacgaauuuugugcuagaaaguucacccugaggaaggcugggauccugaauacccaguauagucgauggcuggcuaaucaugacuaucuguuggcuuaaaccacaucugaggagucuucucugguggauaccucccaaccuccucaucuguuauguccuccucuguuaggauucaccaagaaggcucucucacgaugacaguccaccuugauaguggacuucccagccuccagaacacuguagggaguaaacguucuuuguaauugcuugucugugcuauucaguuguagcaacaaaaaacaggcucacauacccacccaccuccaacuccagaaaugaucaucuuggaaacuaugauaaacaguuugucugaguuccacaaaccagguauuugcagauucaggacucacuucccaucagaauauccccaggcuaacagaaaugaccuuucugcuaucacccuucacacggaaaacugucaggaagccccaguucuaaauuuacauucugaagcugaucuuucuuaagaucgaaccugccuagaccgggcgugguggcgcacaccuuuaaucccagcacuuggaaggcagaggcaggcagauuucugcguucgaggccagccuggucuacagaguuugcaccuccuaccuucaaaugcucuucuuccuccuuuucacuuuacuuaucacccguuccucaucacagagcuguuuaaugcuuuccauuucccccaggcacucccacucagaauuaaagcacuaaucuagucuccaguuggguaagcaccuccugccccaaacuaauuagccacccuuuucuagccauuuugauuuccuggagaauguuaauuucucgaauuuaaauguugugaauggcgggcugcgaguaugcuuugugguauaccugcaaaguaaaagcaaaggaaaacaaguguuccagauaaacaaaacaaagaaacgaacgaacaaaaacaaaaccccucacaaacaaaacacauuccaggccagccaggacuacaccgugaggcauagccucgucagagcuaacagacagaauggaggaagcaccuucccuucacaggcucgguccagcguaaacgcgaacccguagcagcucagccugcacgcgucccuccucccccacaccagcccuggaucccacccgccugacgucagcaggcccgcaggcuggccccgccccuccccggcagcaugcuuccuuaaccacgccccucaaggaggaaggccugugauugguccggaggcgucauaaauuggccaaucgcucgcgcucuagcagcuuuugcgcacccuugcgugcguggugaacauggcggauagacucacucagcugcaggacgcugugaacucggugagggcuuuccucugcucgccagccuugcuuuccugacgcggagagaggaggaaggggcgaggcaaggccccggggagcgcgcagauugaggucgccgcgggcggcgcaccccgugaggccugggucucacguaguccacagggcggggucugaggagacgggccuguccu

SEQ ID NO: 3487 - RNA, 4095 nt, Mus musculus
ggagguaguuuuuuuuuaaucaagcauacuguacugaaauaaaaggguauuaaauccaugagguucguuugaaaugugggauaagacggaaauuguuuagcaagggaacuucuugaucuggacuaauaaucuuucagggaauuuauccaagggcuuuugcacccacucugcugaagacgggcucauucagcaguguuaucugauagggauuuuguuucuucugaaagcugaccauuguucuguuugcuggggaguuaggggguagcaggaaaagacuccuggcaggcagugcaacauaaaccccaccugucauccugaaauuagacaccaugugugcuguguaaauuaauucuucacuugcaguucacauuugaagcaauugauuauuucuccuaacuacauccuucuuuaauauugaauuuagagccuuagcauucucuaggaauucauuuagcauuuacuucauuuuuauucuccugucuuaugagggaauuugaaacagggucucucucuguaaccuuggcuauucugaagcuugguauguaaaccaggcuggucucaaacucacagagaucugauugcuucugucucccaagugcuagaacuaaaagugccuggaagauguucuugugucuaaauagacuugaacucauaucugccuugaacuaugaauuugucuuguauucuuaaagucuugggaaaaaaagauuuuacccuuguuuacugauauaucaccccaaaccccguagcaggguucuuuucaugguuggucuauaaugcauuagcguuagcauuugcagagagcugaauaacuucuaaguuugauaaauuauuuugcuguauccuauauuuacaguauuaugaauuccagaauaugauuguguaaguuauacucacccagauaauucaagcaacugagccuucccuucaaggaugagauacacuuuaaagaaugguuuuacauuuucagucaugagguuaaauagaucccagaauuuauugauuaaugagauuaauaugugccugacaauuauaguaauucuacaggagacuuaaagguucaguaaaauucuuacccccaacaccccaguggcccuccagcucccacgcaucccuuuugguacucacuagccucaccccuuccccacaugugaggcuuagaggaccugcuuugguuggauaaugcauuggacacuagaaugaacgagcuaugcuugaauacuuccuauugccgcauuccagagguuaaaaggaguaggcagaaaccagaaaucuuacuaaagaauugggcuuuuucuucaguauagucuugggggagaugggaaccccugcucaacaauccccacgucuuuuuccccaguaaacacagaucucucuuaugugugucuucuccaagcaaauuacuuugacucaggcugaaaauaugcuuguugaauucagaaggcugaauuaacucuugguaaacuuagguaguaugcugcuuccuaaaagaauagcauccccucucccuccuucuuuuugccuccauuuuguuuauguguguuuuacucuuucauuaugcaaacccucauuuccagaaggcaguauauaucccaccagccucccgccauggugggguggcuuagguugugcuuccagugggcacugagacuguuuggagccacuccuuagucgaggguccaacaucaagacagcaguucuggugguccaggauaccagacuacuucagguacacuuguucccugguuguaauaaguggcuuguucagaaggaaugugaagauuggaaacucccacuguguacuccagguauugauuuccucagcugugagguggaagagaggacacauaccucuuaggaauuuuugaacaagaggcuucaaagguuuaaaacucuggggcugucaggugaacucauuccugugucauucuugggguuggauucuguugcuucugagagaauguauauuucucacugcuuucuggugccagguguugguagccuggcuagggcgcugucuccuccaucgggagaagauuuguguccgcagccauuggaagacccaccgaaaguucauacagaauauguugugugagcgggaagcacccucuggcugaggggaugacacggaggagguuuccaaggagcucucagaugccugucuuaucuccugcugagaaaacaggaugaguuagaugcauguagugucaaaaucagugggccugcugucuacuccuuuauagaacccaagcccauuugcccaaauagcccaaauauagcaaaguuucgagacaaacugacuagaacacacacuuccauuuuuaugugguugugguugaggguugcugugccuaccccucuucccucccucugugcucuguaguaucuuuccuacagugccccaucuccucuccuuacuguuaucuuccccccuguccuagucuccuggggcccaccuugccucacagcagguagugagagugaggcuccacuguccaaccuugucuuccccaguccugccccuugcucuccugggaggcaugcaucucugugcucaccacaacuucgucuuucaguaaccuuggaggauccucuagcaccugacagauaucuucauuuuccagggaucuuugcuuggacaagucuugacaaacaucacguucuuuaggacugaccugagcaguauguggagggguagugcuguugagguggacaucuuccuucugaguagauucagggagcacacagccgucaugcuggccaccuuuuucuuuuccuagaaaugucucaaguuucuguacuagguuauacaguuugcagggagucaguuuugucuugucuucuggccacuuauccauccacuggcuaugggcauuuagauccagauuagcaagagagucugcaugguuagaguccacaucgauaucccaggccagugugaugcuuagcuugcugaacugcucugggucaugcuccaccugaucucguuuccugaagagucuccuuaaacucucuguccuccaggugcuuuggacaggagggaggaaauggaccaaagaauccacagaggcugucuccucacgggagaccagguccucauaggaaaagguguucucagagggguaguagcccaccgaggcgcucugguuggacuugcauucauaaauagaauccucugugcuacuguagucacugcuggagggugagguugucauggugcugagaguguccaaucucaaguuuuccuugauucuggaaacuucagaagaaaaaaauuaguaaaugauauuauggggggaaguuauaugacccauuccuuuuucuuauugaaacuauuccuuccacucuguauaguccacccuuuuguacuuucugccucuguaaagacaaaaacacucuggcaucucuucuuugugccucuuauuuguuugacaguagcugagagagcuuauaaacaaaaaggagaauuugaaaaugacagggaagugugacuagagucaaguauguuuucaguccacucuucugaggucaagguaacuaauuucuuaguauauauguauaucugugcgcauauguacauauacacacauauccaaauacaugugguucucacaucaauagaaacuuauuaucaaguuuauaauaaccuauggcuauucuaauauucuuaacuacuuucuuauuaaauagccuuaggugucaccuacugauacucaauaacuuggcugauuaaugaucacuagguuacuuaagaccauaccaugauccauggaguuaguggaccaaagaucauaaauauauagacauaauaauugauaccagaaugcuuuccagaaaggugacugucauuugagcacccaucuucccaccaucugauggcauguuuauucugcauuuuccauaaucucccuguaagcaaaccuggaagaccacacacucacacucacacacaugcucaugccuuugucaugcccugaucugagggcugcccagaugagacaggcgcuuccagcaguggagacaaagugauggagucagaaacccuucagagcccaugucucagugauguaaagcccaacugcuucugagaaguuu

SEQ ID NO: 3488 - RNA, 1650 nt, Mus musculus
cauagccucuugcuuugauuuaauagguaaguguguugacagaccagguggaggcucagggagagaagauucgggauuuggaguucugucuugaagagcacagagagaagcugaaugccacugaagaaaugcugcagcagguaugggccaaagcuggugggggaggggaugcuggauuguguuaucugaggugcaacauuccugucuugucucagcagcaguaaauuccagaaucccuagacuguuuuguuugaagucuagaguagcagagucuaaaaccacagagacacacaacacugugcaguuaugagagaacacaauauuacaggaauuauaaguugaucuuuugcgcucauauuauuucuaacucucaaccgugagaugaaaaaucaccauauguggcuuguuaaggcaaaaccucauauauauauaugcgucccagugcguacauggggcuuguggaugaaaagccugugaugccgcagagacuguauuuggaugcagaguugcugcuguugaacaucagucugugcuauugccugccuugacaggcuccggaccucccuguccucgugaucuaggcuuccauguuucuagaaacccugauaaaugaggcugauaagcucuucuuccucaggagacuuuugcagggacugaacucaugagcaugucucccaguuccugauauagcaggcaccaugcacagcaccaucagugcugucguugggcucaggagucugccagaugcgucuccccgacacccugaugacacguuguaguucuguucagaagaggucacuagauuaagugauccucagccgugugguguguggcaguacuucacccacaggcuacacuuaaccguugccgcucugccgucacgacagaaauguguaauguaaaacuugugaacaucuggaauccuaacaggagcuucugaguaggaccuccuuagagacacagaagcuggagcugauggcugagaucucuaacuugaaguuaaaacugacggccguagagaaggacaggcuggauuaugaagaucgguucagagacacagagguaaguagcgcaugcucgcaugcucgcaugcucguucugucucuucccucccuccucagcccucacugugcuccuuagggcaagagcacugcucagucucuucaucagacugauuaaggcuuuuaacccccuuugauguuugagacaugguuucccuguguagccuggcuguccuggaacucacauuguagacuaggcuggccucgaacucagaaauccaccugccucugccucccgagugcugggauaaaggcuuuugccaccaccaucuggcuuuauuuuccuguaagagucuguuuagacuuuucccuuuuccuuacccucucaucccuaauagaacaguugcuguugaaccuucguaguagcuggggcugcaggaggauuguuucagugguggugggaggaggcuguagggaugggaacuaggaggcuggauggcggauaggaagggaguugaggaggcuguccacacuguaggaggcggagucuuacuuaccuggugcacugugcuuaguuuaaucugguuaugaggcugguugugagguuuugcagcagguguuugucacgccuuguuucucccuacuucug

SEQ ID NO: 3489 - RNA, 773 nt, Mus musculus
guuuuuuuuucuuuuauaaaaugcucuuucucacagaaagccuuagggucuccagccuuuaggaguuuuccuucaguguguuacgccugcacccagaugcugaccuuugccccaugugagaccagcccugccgcuucccacagcaucuggaugucccgaggaccacacggcagcaaaggcugaugacggcagcacccagggucacacaagccagccagaccccugcagacgcuggcgcuccaucccauggcucuucguucucagaugagugguuucugcugugggaccccuuuguuuuguucacugaugguuugcuaauguugagucgagaucggcugggcaccugggaaacucuugugucuguggguccaaagaaaggagaaauagucuuguugccuggacugugggugaagucugugcuuggugauaccauguugaccuugguagcaguggacacguuugcagaugugaaucuuaaccccacauccgugguugacuuccuggaauaacugauacccguguuugcaccuaaauccugcugugugguugacgcugccucuguggauggcaccaugcgguucaucacaucuggguauacuccuucacucccuacacucauagcuuuuagaauccgcagucuaucccaccauucggacgaggagcggcuguuuggguagaugggagauguaugcucaaaaaccagcaagucugggucuaugccugaaagauaagagauauuuuauuuuuaaaaauaacagcuuauuugagaauuu

SEQ ID NO: 3490 - RNA, 7023 nt, Mus musculus
cagguugaaaacacgaggggaacaacacaaaauuguucacaauauugucuuuucuucugguaagugauguguuuucacugcuuuugguuaaacuuagcuggaauuuugauuccugaacuucaagagcuuaaugucagacuggugguucuaagaaacauguaacaguuagaaaauuaacuaagaaaaacaaaagaauccucauuauauaacaaucuuauuuuguggguguguauuuggcaugcaugcgugugugugugugcaugcacauguauucacauaaguauguagaggucagaggucaacucaguuucucucuaccuuguuuuuugagacaggacuucuuacugaacuugaaguuuacugauucagcuacagugguugaucaagaaagcuguagcaaucuaucugguuccaccuccccaauacuaugguuacaagugugcacugcugugcccauauuuuaaggggucuggucuucauuaugguguggcaaccaguuuacucacugccuccuucccaccuccccagcccuggacuuccuucuuuaacaauaaucuguauuguuaucacaaaagcacaacaccuuuuauacaguagaaaucgacuuccuuuaaaacaaguuugcaaaccaucacauggagaaacagcaagcaagggacuuuuacacaugaagauauuaaagaauuaucucagggcuggagggaagcauggcagucaggaggacuggcuauacuuccagagauuccagguuuaguuccuagcucccacacggcagcucacaacugccuguaacuccaguuccagaggaucccauauccuuugucacuuccuugagucuuucaugcauguagaacacauacacaugugcaggcaaagcacucacauacaugaacucuagaaaaguuuaaaaaaccagcuaccuccugugucucauaguuuuguagcuugcaaggcauuacgaaguuugauuugaaauguccacgauuuaaacguuucaguugcuagauuuuagauuuggggauuuuguuucauuaaaaaaauuuuucacccuagaauuucacccuagugagaugaacaugaaauuacuauuguuuuuaaucuggaagacuuacuauuuuguccugaaaugagcuucugagauuuuaagacgcucucuggaugagagucggagccucugaugaccacaugaacaucaauacaguaccccguucuucauguccagaaacgggugaccaggauaccacuaggaucacuugccaauagacaaaguucucaacuguaaccucacaggauugucaaucacaauacuuuuucucugccaauccaggacucaucuuaacgcacacuuuccuuuccucucacggagcugaaccaaaguucaccaacuccuaaugagcuuggccaugagccaggaucagagaaagaaguuccccaacaucuguguuugcucuuuccugaccccuuaucaggauuccaacuucugguacuuuccagaauccugcauaaagaacugcuuguggauucugacuuugugauccuccaucucuucaagaacucguagucaccgacuuccccacacuauccuggcaguccuugucccuaugugaagcuccugucacuggauauauucacaccucagguagacuuacuugccuacaguaaaugucccuauugaguaaaucaacacuugcuaacauagaagaaagucucuaaguaaaucagcauguuaaguguuggaauaauucauaaacuguguuuugaauguagaauuuauuugacaaaucugugaacagaugacuuaaucaaaaacagucagggucaaucaccucugggagaauucagcugcaggaggaaaagugggguguggugaauaauaggagaauaagauauaaaacaaagguguguggaaagucauuuaguaaaauguugcacgaguuuauacauugucugagauuaauagacagaauagaagugggaagaguaaguagcugaaguucugcugaagcucagacggaauaaaauuauaggaaaggugggcugggagacauggacuggggagaggugggccgaagagaagugggcuggggagugaagggcuggggacauaugggcuagggagacauggacuggggagagguggaccaggaaaacgugggcuggggagacaugggcuggggaguggugggccggggaguaauggguuggggacacaugagcuggggagacauggagugggugggccggggagagguggacuggggaagcaugggcuggggagacauaggcuggugacacaagagcuggggagacaugggcuggggagaggugugauggagagagaucucagucacugccuuauaagaagaucugauuugauuucuagaacacagaggaggaaucugagcaugguggugcaugccuuuaauuccuaugcugggaaauuggagccagcuagauccuuagggcuugcuggauggagccuagcauauucucucuuugucucugucuuugucucccccccccucucucacacacacacacacacacaccacuuuaucacccacaccaacacacaugaacaugugcacauacacauaaccuuaaagaaagacagaaguaucaaucuugggcaggaggaggugagucaucuucucugaaggaaaaaaauuuaagguugguggggggcugaacagaaccugccacagaucugccucuguggagugaaaguccugcauugccuguaaagccaagcacaaaaggaaaggagcuugaagauagguaaauguuuguaaugacugcucaaaauaaggugugaaccaccagaaaacagcgaaggaucuaccguagcuucugguuucucugaggaccaagaugcauuuucauuucuccugucuccuaugaguauuuaccuguucugucaagcaacacccaaugcuuauaugaaguuguagcagagaacacagauggcuggcaagagccaaguucagggacugcaggauggcuuggcggcgucaugauacuuuagcagaggaucaggaagcucacuccuaucucuaccuccaacuccaggggauccaacauccucaccuggcuucugaggauaccugcacuuaguguggcauguaaacucaggcauacucacaugcaaaucaauaaaucauuuuucaaagaucaaaauucagagagaaaauauggaaaaaguguaggaugagcaugaaggaaugauucacaaauguaggcuacacagaggaggggguaagaucaacaggaaguuacccauaccaagaaagguauguuucucuauguggcuaccugugucuacuggggaaucaaaugaacaacgguguuacugaccuagaacagagggaggaagaagccucuggaaacaauguucuuacacaagugugacacucagauauagaaauccuauguaacacugugcagaaugguguuaagaugagaguuggccucuccugcagauuuccaaaaauggaaaccuuuggugcucaaaauaaaaauggacagagaugcaagguugcagcucuggggaacucugugcuuguccacaugugacuugcugucaaggauacuuuuaaaagugggaauggaauggagcuaaaaaaaauauuaaacaccacggaauggucugggggcacagcugaccaugaauggaauuccuuuggaugagaaagccuguguugaugacauggucaaagaagauuccuccugacccauauucugggaugcauauaaaagcccuccaaggaguauaaaauacaguuaacaauggagaggauuaugaagcauaguucuguguaaaauuguggcuacugucuaugcauacagcacacacacagagacacaacacagccuucaccuguauucaguaacugcuaguauuuuuuuuuuuuuuaggcucugccuaacaguuaccuggcgacagcaauguaggccuggcuagcuauaaaaggggguguuuggccccuccaugcucucuuacucucucugucccuuuuuucucuccaauuuucuucucucccugacuccuuucucccugucucccauccuccucccuccauguuccuggccggccucuccucuaucucucucugucucugucucucucugucucugucucucucugucucugucucucugugugugucugugucucugucucucuuuuucucugucucuacucccuucucaacucuccuccccaugcccuaaauaaacucuauucuauauuauacugaucauauggcugguagcucagggggaaggaaugccucagcuugggccugcugaggcaccccucccaccucaucauaccuggcucgacaaaacauauccuggcucucuuuuuuauaaaacauaacaguaacacuuccuacucacaccagcaacuuuuacauuagcaaaccauaauguauuucacauacacagcuuagucuuuucucacaagagcccugugagaucaaacaggaauaaagagauuuagugacuugcugaggacaaggacaaggacaaggucugugacgaaugccaacuugacacaguguagaaucacuuuauugcucucugcucuugacuauggagauaaucgaccuguuuucucaagucuacugaaagauacuggagucuucugguggcugucaguaaugagaaagcuucagccaaguguucauuugcuucccgauucucuuguauuuaggguauauuugauaauugcuuuuuuuuuuaagacagggucucuuuacauaguccuggcuguccuggaacuauguuuugaagcaggcuggcuuccaacucacagagauucucuugccucuggucccuagugcuaggaucagaugccugccuucuuuccuucuuuccuucuuuccuuuuuuccuucuuuccuucuuuccuucuuuccuucuuuccuucuuuccuuccuuccuuccuuccuuccuuccuuccuucauuccucccucccucccucccuuccuucuucccuugcuucucuugaccaucacauuacagcagcaaaacucugacaaccuacaaguaggggcuugucaaguuccaagcucuucauuuuuaucuacaagugugugauuauuuucaaaacuuuuaguuguaaauaugaacccauagcucuauuugugagaaguuggguuauuagaacugaacauagaauaaguuuucauagaaacaggaaucuacuuuaaagcuaaauaugccuauggcauccaaauacauuuggagugucauaauaacugauauaucuuucauacuagaucucucaagguagauuuuuuugaguuggggauaucucucuuaugugaaguugugcuucuguaaugguuauauucuaauaguaaugucugcccgauaauucuacuuaaaacuucaugggucucuucgccucugcaaucaagcucucccaauaaacgugugcagaaggauccuauugcagcaucguucuugcugucgagucagggugcgcgcgcaagaaguggugcugaaacccgggaaaagaaacaucuucaggcacaagcgaagaccccccugcuacagggaggauucagaacucuucagcuggggaacggugguaauaaaguguucccguaaaacagacugcugagaaggaucugguguggauucagaacucuucagcuggggaacggugguacugguaagucucccaaauugauccccgcguuaaagggggauauauuuuuuaagaaaaaggaaaaggaaagugaggaaaaauaaaaggaaucagugauaaagaaaaggaaauagugaaggaaaggaaaagggaaaggaaaggaaaggaagggaaagaaaggaaaggaaagaaagaaaggaaaggaaagaaaggaaggagagaagggaaagagagaagagaaggaaagaaaggauugagaugauaagguuccuggcuuugggacaaguuaagguucaugaguuaugcuuuuuucucccauugacccuuuguggguacgucugauaguuuuggucuuguuuguucugauauauggacuguguuacuguuugaaacuguguguagaggcagucaagacaggucagaaaauccuuacagagcaacaagagaguaugucggaagaggagaagggcuuaaaaagaaaaagaagggagacacaguguuaucagguggacagaaagaacaaaauaaaagagccgaggcagaggaggaaggcgaauuagcuucugcacccccucccuaugccuccucggcagccaccuauagaaggaccuucuguccagagguuuggagagagguuagauucuccuugcugggauguccuauuuuuaccguccaagcagggcagagauaucaugagccucuagauuucaaaguaaucaggaauuuggcugaguccaugcggacauacggcuuaauugccuccuauacuguggcucaaguagaggccuugaauagacacugcauggcgccaucugauugggcagucuuggugaaggcaugccuuucaccugggcaguauuuagauuggaaagccuuccuuauugaauuugcaaauuaacaggcagcagcuaacucugcugcaggaaauccagcaugggauagagauaugcugcuugaucaaggucgcuuuauacaacaacagacaggauauccagugcagguguuugagcaggugaaucagauugccauaagggcguggaaaucauugcccaccaguguugacgguguugaugguguugacgguguugacgugggcgagagggucuguuuguguguuuccacaggaucaccgacaacagcugugggucccagaacagcugaccagagcaauucaaaacaagcagagcuaugaggacguggauguuccuguggcugggggugcucccgcuagugagaacugaagagcucuguguuccugaaaccaugcuguugaugcauucggcuguuuccucaauucuuuacaucuaaugccagauuuuaagccuuaauggaacgcgaauagaacccaucauuguuggcaauuuuac

SEQ ID NO: 3491 - RNA, 947 nt, Mus musculus
cacuccgcuugugcucugggaaggagaagggcguguuuccgcuugcuccuccgccauggcucguggucccaagaaacaccugaagcguguggcggccccacgccacuggaugcuggacaaacugaccgguguguucgcgccccguccgucugccggcccgcaccgccugcgggagugccugccgcucgccaucuuccugaggaacaggcucaaguacgcccugaccggcgacgaggugaagaagaucugcaugcagcggcucauuaaggucgacggcaaggucagaaccgauguggccuacccagcuggcuucauggaugucaucagcaucgacaagagcggcgagaacuuccgccucgucuacgacaccaagggccgcuucgcgguacaccgcaucacgcccgaggaggccaaguacaagcugugcaaggugaggaaagucuucguggguaccaagggcaucccgcaccucgucacgcacgacgcgcguaccauccgcuacccugacccgcucaucaaggucaacgacaccgugcagaucucgcuagacagcggaaaaaucaccgaugccaucaaguuugauaccggcaaccugugcaugguaaccggaggcgccaaccugggucgcaucggcgucaucaccaaccgcgagcgccaccccggcuccuuugacgugguccacgugaaagaugccaacggcaauggcuucgcuacccgccucuccaacaucuucgugaucgggaagggcaacaagccguggaucucccuuccccggggaaaaggaauccgccucaccauugccgaagagagagacaagaggcuggcggccaagcagagcgggugaaguggacucugagggacauugcggggaaggggcguuuacguuuguuuauacuuaaaaguuuuuuaagcagcauguugaauuaaaaaagaaagcaagcuucuuu

SEQ ID NO: 3492 - RNA, 947 nt, Mus musculus
aaagaagcuugcuuucuuuuuuaauucaacaugcugcuuaaaaaacuuuuaaguauaaacaaacguaaacgccccuuccccgcaaugucccucagaguccacuucacccgcucugcuuggccgccagccucuugucucucucuucggcaauggugaggcggauuccuuuuccccggggaagggagauccacggcuuguugcccuucccgaucacgaagauguuggagaggcggguagcgaagccauugccguuggcaucuuucacguggaccacgucaaaggagccgggguggcgcucgcgguuggugaugacgccgaugcgacccagguuggcgccuccgguuaccaugcacagguugccgguaucaaacuugauggcaucggugauuuuuccgcugucuagcgagaucugcacggugucguugaccuugaugagcgggucaggguagcggaugguacgcgcgucgugcgugacgaggugcgggaugcccuugguacccacgaagacuuuccucaccuugcacagcuuguacuuggccuccucgggcgugaugcgguguaccgcgaagcggcccuuggugucguagacgaggcggaaguucucgccgcucuugucgaugcugaugacauccaugaagccagcuggguaggccacaucgguucugaccuugccgucgaccuuaaugagccgcugcaugcagaucuucuucaccucgucgccggucagggcguacuugagccuguuccucaggaagauggcgagcggcaggcacucccgcaggcggugcgggccggcagacggacggggcgcgaacacaccggucaguuuguccagcauccaguggcguggggccgccacacgcuucagguguuucuugggaccacgagccauggcggaggagcaagcggaaacacgcccuucuccuucccagagcacaagcggagug

SEQ ID NO: 3493 - RNA, 323 nt, Mus musculus
ccuagagccuuucuccucguugggcgucugaaggcaagaugggucaccagcagcucuacuggagucacccacggaaguucggccaggguucucgcucuugccgcgucugcuccaaccgccacugucugauccgcaaauacgggcugaacaagugccgccagugcuuccggcaguacgcgaaggacauaggcuucauuaaguuggacuaagcgaccuugaauggauucgucugacuaccaaguggaaccgaucaugcuagucuuugugcacaaagaauaaaaaugugaagaacuuuaaaaaaaaaaaaaaaaaaaaacucuccu

SEQ ID NO: 3494 - RNA, 1755 nt, Mus musculus
gaggcagaggcagacgaauuucugaguuugaggucagccagggcuauacagagaaacccugucucgaaaaaccaaaaaaaaaaaaaaaaaaauaauaauaauaauaauaauaauaauaagaagaagaagaagaagaagaagaagaagaagaagaagaagaagaagaagaagaagaaagaaagaaacagggucucauuuuguagcccuagcuagccuggaacugcaucuaccuccugagugcuggaauuuaagguauaggcugccacacccaacacagauugguuuuaaugcuauaaaaauaucuauuaaagacacgagccuaucuuuacuugcauuuugugucaaauaaacauuacuuacauauuucagggcauucucaacccugagcuaacaugugugucccugcguaucccuguggaaugucuggcaaacaaaucaaauccucuuggggaaaugagccccacugaauauaccucacaguaucagaauacaaaacaaggcaauaaacuaucaugaugaaaagggagguacggguguaagaggaugagcuuuaaauguuuuaaaauaugcaguccuuacuggggucuaugucguuggccaagaucuuugaugcuccacucaucuuggcagcaauggcuguagcuccacauccacucccaagaucuaagacagacuuuccucuaacaacagcaggguuauccaaaagauaccuaaauuaggaaggaggaaacagcugagguauggaaaaugagaguaagaagcauuaaaacaaaaacaggcaagaugguuuaguagauaaaugugcuugcuuggaagucuggugaacugaguucaacauaguguagaaaaaaaaacaauucaugcaaguuguccucucgaccuucacaugcacaccacaguauaccuguacuuccacacacaaagcaacuaaauauaaccuuuuucugaugguagagaaccuaccuggccuguagcaguaacaauacuauuccuggaaaauagaagaccuuuugucugacagcucuacauccuuaagacaaucagaugaaaucaagauaaacgcuaaagcaaagagauggacauacuaaaaguguuugccuuuguuucugcuacuguuuccuaacaaaaaguauaguugcaacuauaugaaaaaacaagauggaugaugcuaaauugaaucaaaugcaggacccaccuaaaaugagccgccaaagagaaaaucccaagugaucagcuucugugugcugaagagccaaugcuacaagcaggcagcauuuauaguaauaaagcagggucuuugaagggcugggucuuuaggauccaucaaggaacucuguacuaauuguugauaugcacaugaaucugagcacaaaguaagacauggaucuuuuaugaccauguagguucuuuaauagcucauacuagaguuucuugagggguggaaucuuaaucugugguuaugccuuaaguucguguauggcaauaaaacuaugcaacaaagcaaugaccaaacugcuauaaaaacaagaguuugggucaagguauguguuacaaaaguuaguaggaaggcuggagaguuagcucagugauggagaauuggcucagugguuaagagcacuugguacucuugcagaagauucaaguucaaguuccagaggaucagaugccuuuaucugacuuucaugggcaccaggcacacacaugaagugcagauauaacauucaggcaaaacacucagacacaaaauagguaagu

SEQ ID NO: 3495 - RNA, 3199 nt, Mus musculus
cauuaccggggcauaguuggagauuuaccacaauacucucucuagcuuuuuucugaacucuagcuggaugguucaacucagcuguucuggcucaaacucuucuccagucucuuacucaauuuggcuuauuucagcuucucacugaauugcucugcuuagccuuaaacuaacuagcauuuuauucuaaucuucuggcuccuuauccucuggcuuauucuaucuuccuaaaacaucucucuauaaaacugcuuccucucuguugucuugagaguugggcauauccuacucucugacucauucggucaaaucuuugauuagucacuuucucugccccucaacuagcuaucacuuucaaacaugacugauuccaucuauaaacuaaccuuacuuuucuuucuuuuuuuuaaaaaaagauuuauuuauuauuauacauaaguacguuguagcugucuucagacaccagaagagggugucagaucucauuacgggugguugugagccaccgugugguugcugggauuugaacucaggaccuuggaagaacaguugagccaucucgccagccccuaaccuuacuuuucauuguuugggacuaaagguaugcacuaaagaaaugacugcauuccagccacaccacaacuacugugaucuagggaguaccuguauuccagcugaaucacauaaacuuagaaagccuuuggaugugaucccuugccagagcagccauauuguugaacuaaaauuccucuacauaaccaguuauagcuuuaaucuguaauaccuccucacugccaagauuuguguugaaagccuaguccauccccagugaauucguguucauaaguggaucuuaaguguugggauucagaccuggaaccaaguggcugaaaugcauauuuuacauaacaaagugaaccugaccuccagguucucccaccuguuacagggcacacaauuggcauacccagcccucugucaugaacuguccagcugacgugcugggcuuccccacccauagaagaucuucccuauauaacccagauauuuuggucucccucucucucccucccucucuccugcauuuucucucccugcuuguacacucuuucucucauucucuuccccauggcaacuucccuggucuuguuccuugggaccagugaacccacccuuaucccuggucccuugcucucugcuuccuggucaccauaaugugagaagccauuucugcugcauacugugguugccuuaauaucucaccccaccucaacacaaagcaauggaaccagcagaccauggauuggagccucugaaacggagcuagaucacuucucuuuuaagcugauuuccucaguuauuuugauauaguaucagaaagauaacacuugaguuccuuauuuaucuuuccagagauauuuuauuaauacugaagcaaauuauauauauuacauccauacauacauacauauauaaauauaccuucuacauaugcaauuguauaugauagagugcuuuguuauaaaauccugacaccuugguaugugaaaugggaacauaaccauaacuaacuuuaauaaaccauacaguuauucaaggugucacagcaaaggaaugaagaaauuuacuuuauuaucuaucuaucuauuuuuggaacagggucuuacuauauagcucuggcuguccuugaacucacuauagaccaagcuguccucaaagucacagagaugcgccuacuucagccucccaagugguaguauucaaggcccaauccaccacaagccacugaauugcauucuuuaaacuguugaauaccuccuacagaggauauuuuuagaacuuaacacaaacagaacuauauucauacuugaaagcacuuuaacaaaucagggaugaaaaucccauacagcacuuguggucaguccauuguucucuugcugaguuggcucuggaaguguguauucuacuaguugguacaguugaugccgaaugcuauguccacugaacuggggccucccagggucaccaaucaguacucggguuccauggguccaaaaguaguucugcagccacagaugaagacugucugcaaggucuucaucauaaaacauaucuccaagaacaaugagaucaaacuuaccuuguuggguauucaaaauguuuuuaguuaaaacaggaaaaggauucaguccauuuaauuugcaauuuaguguaaucgccauuccugcaacuuuagaaaacaugaugaauuggucuguaagcauguaucaguaggcuguuuuaauuccuuauuauuuaaacacuuuuaaaaaucuaacauuaggggccaaugagaaggcucugcagguuaagaugcuugcugcuaaaccuaaagaguucaacaucugaaggccaggaaugauggcacacaacuuaaauccccggucucagaugagacaagcagaucucugugauuuuaaggccagccuggucuuuauagggaguucuaggacagccaggacuacauagaaagacccuguuucaacaaacaaaguucaauauaugugacacacaugguggaaagaaggaaccaaaucccacacaaugacccugaucuccccaugugguguacacucacaaaugaacuaauaaauguaaaaauaaucuaauacuuaccuuuuguuaaaacggauuuuuuuucuuguuuuuguuguuuucaauuuuauuucauauguguuuugucuggauucaugucuaugugaguguauuggauccccuggaacuguagcuacagagaauugugagcugccaugugaguccugagaacugaaccuggguccuauggacgagcagccagugcucuuaaccacuaagcaaucucuccagcuccuguuauuuuuuaggcaaagaaguuuaaaauuuaugccaguauaaauuacauacuggcuaggcaugaugguaaacaccugucacuccaaggcuugguaauauacggcaggaagauuccugcaaguaugagccaaccugggauacaaagggagguaccaagccagcugugucuucagccuaaaaccuuccucaaacaaacaacaaaacaaagaggcuggacaugguggcacaugccuauaaccccaaagguggaauuaggaagaucauaaauucaagguuauccuuaguuaaagaacuaagagaccaucaugggcuauaugaaacugucucauaa

SEQ ID NO: 3496 - RNA, 26330 nt, Mus musculus
gcacaccugcccggcacuaggaccgcggcccuggugcaagcgcucgggggcggaguggggacccagcuggacccgccccaacgaaggcugccaccaaaccucugcgcgcucugcgcuuggcagaggccucgucccuugcuauuggcguguaagcacccgccgggcggcaggucugcuucggaucgggcuuuuguucggcccccugggcucggggcuggguuuucgccaccucugucccggcggaggggcgccgcccggguccucgcuguaccgcggggucgcugcgcgccgggcgggcgcggucugagguuguuggcccgagaagcaggcgggcuuguugcagcuaagcgucccuuccgguuucggaaggagaagcagagcuuuguuuuguuuuucgguuucuuucugucucggucuuccgcuccuuggccccccugcgacccagcggaauugccuugcgcuccgccuucgagcgcccaggccugugugagcgccgcggcccgcagcaucuuggaaucuguuugcauuugugguacuuaagagugccuuccuagaaaaauggaaaaacagguaaagugggugagcuggcuugcauuucaguaggccaacuacagaacuugcguggggauuuaaauugucugcuggguguguuacaguuaaggggaaucuuaaguuuguuucuuguuaccauucagauauacuaaggucuuaguuauugcuccacucagcccccaucagguucucuuuuaucaguccacuaaaauuacuaaagaaguauuuuugcuuugguauuaaagggcaguaguggacuuggagaagcccgcuugaauucuaguggcagggaauauuuugagaguagccuaauucaguaguuuuguuuuuagcacaauugaaauaaauucaguaaacuuaguauggucucaaugacacuguaagggaaauguacuagaccuuaacucuugcuuucuuguuucuugauuuucauagaauuagaggcgugaauaccuuguggaagagauuaaaagguaaaauuguauuuacagguaaguuugccuuuuauaaagccuauccugguucuacuggaugacuauuugcauuguaccguggacuaacuuauuuuagaauaaagaguaucauugaaucaacacuaguuaaaccuacagaacuugccuagcaugugcuugccuucaauuuuugcauuugggagaccaagucagacagaucuuugaguuaaaggcuagccuaaucuacauaccaaauuucaguuuagcuaggacugcauagugaaagacucaaaaaacuaucaccaaacaaaacugucacagauccaaugggacacaguagauuugauggcaaagcuuaagaaauaauguuguugguaugguacuuaacaauuuuauuuuuugccuucaugagauagaggagagaugauuuuugcauuuuuuguuuuguuuugaauuuuggcaguguucgagauagaacucagccagauugcuacccuggaaaagauuaugguagcuggugaauuaaaguuaccuaggcagaggcuagcucuuauuuuuggugggaauguaguaccagggacuguuucuuauuuauuuuuaacuuguuuuaauuuaugugcguaaguguuuugcccacauguaaguguaguuuugugugcuugguguguagagcucagaagaaggccuggauccucuagaacuggaguuacaggcaguuauagccacauguuagugcugggaccacuuuuagggccacaacuauugagucaugucuuuaagcacuuauacuuagugaucucuaggguuccaguccaugaccauaaaaccuguuagaaagccuuuucugccuacgagggcuaugguuccuacaguguaaggaacaagauaaagaaaugauaccauggaugaauguagccauggaaaccaagccuagagugugugcaugaguaugauaaaguugaaguaaggugaacuuccaauggaguaaugugugaaugcuuuaauuauuauugguuaaguguagcuuaaauacuccugucuggccaccgcaacucacucuagguuugguuuccaugguuacauucauccauuguauuguuuccuuaucuuguuccuuacauacaguuauguuacuuggauucaggucuugcuugaccccuccaacuugggucuaccacuuacuguaaaaucucagaagaauuuuacuuuccugcuuagcuucucaucuguaaaugggauaacaguaguaccuacauuauggaacugugguaaguuacaagggggaagcagagacaggcaaaucucuuaguuccaggccagccuagucuacauauugugacccugucuaaaaaaucauucccaaacaaaaccagccagucaaccaaccucuuagauacucuuuuuuuuuuuuuuaaagacuuaguuauauauaaguacacuguagcugucuucagacacagcagaagagggcaucaaaucucauuacagaugguuuugagccaccaugugguugcuggauuugaacuaaguaccucuggaagagcagucagugcucuuaaccgcugagucaucucuccagcccugaacacucuuaaaauagcucccagcacauagucuauuuuuuacagccuuaggcauuucacagcuaggcuggccuugaacuuccuggccuugaacuucuugucuagcaaggaugaccuucaauugauucuucucuucuuccuccugaguuuugggauuagauuugccaugccaagcucuccucucuacuggguguuuguggccaaaaccaaccaguggcuaucuuggccuaccuuuuucuuuuccucuuuccuguuugauuaguucugauaucuuguacauuaucagugcuuugauuuuuaggaauuuagcuguuuagggauuauaaucuuguuaaacuuuauaauaaaggugaacuucaagaauuuuugguuuaucugccuuucuuuacuauuucuuuggaaacuaauccaugcaaaaacaguaguaggaaguauuccuacuaguugagguaaagcaagaguuuacaccgacccuggcuauagaaaugcaaacuaagugcaaauggaaaaaaacuuuaggacugggaauucugguuuuuguuuuuggaggcaggguacuuaaaauucuuaguaugcuaaauuaacuaguaaaugaaggguguaguuacuguuggccuagugagguuagaacuaccaacaaacaacucugaagaugugaaagcuaucuuugagcugugcuauucucugccuuggguucuuaggcagucuuagaggagguugggguuuuuauuuucauacauacuaaaauguguaaauugggaagcucggguucaauuagaaauuaaacaaagguugcuuuaaaggaauuuuuuuuaugaggaacaaugacuuaaaaucacuuguuuugaacaauuuugauuugccuugcuaguuguuuagaauuaauguauauuggugcaagcagucugcuuauauacguaggacuggccuaacccuaucccuaaccccaucuccuuucuacaaauacacuuagagugcuguacuagcugguuuugugugucaauuugacacaagcuggaguuaucacagaaaaaggagcuucauuugagguaaugccuccaugcgauccagcugugagguauuuucucaauuggugaucaagugaggcugaucucuaggcugguagucuuggguucuauaagaaagcaggcugagcaagccaggagaagcaagccaguaaggaacaucccuccauggccucugaaucagcuccugcuuccugaccugcuugaguuccaguccugacuuccuugguggugaacagcaguauagaaguguaagcugaauaaacccuuuccuccccaacuugcuucuuggucacaauguuuuguccaggaauagaaacccugaguaagacaagugcugagaaagaauacuucuuaaagccccuuccugcgaaugaauguuaaugcuauauuacccuuagaucacuacuucaguugcuggcagaaugacccuucuuuuuccuaucaccccuuuuuccuggugccauuuucuugggcccaaguuggaaagggaguugggauauuucaaauaagcuuugucuauaucuauugagaucaucugauuuucauccuuuuugaaccuuuuugauuuuuuuuuuuuugcauuaguuugugauguugcacuauccuugaauuacuggaauauaucucagagucauggcauagaauuuuaguaugcacuugaaguuuacuuacuugcauuaauauuucaugaggggauuuuucugucuguauuuugagagauugucuucauacuguacaggauaauaguagguucaaagaauucaguugagugguuuuuuuccuugucuuggaacauucuguuuagaguugauuuuaaacuuucagguuuaaugugacuacugaagccaucugagcccaaacauuucuuuauggguaguuuuuuggcuaauuguuauggcuugaaugugaaauguuguucccccaugugaugguguaugccucuaaucucaauacuugggaggcagaguucgguagaccucugaguuugagaacaaucauacagugauauuacuaagagaacaucuuuauucuuuugacccagggaguuuuauugagcaugguaucaauguauaacccagaguccccaucuccuuuauggcaaauaccuggucuggacaaacagagcaauguaguaaggcccugucucaaacucgcacacacacagagguuuuuguuuuuguuguuuuagcugaccauguuagcauaggccaauaguaucaggacuauuagacugaggcuuguaggucacaaauaagaggucaaccucuacuguguaaugaguucuaagccagcuugugcaucaugacuggaauuuacuguuuacuaugccauuaaagacuaagucaucuggguggguaugggggacuuuugguauagcacuggaaauguaaaugagcuaaauaccuaauaaaaaauggaaaaaaaaaucagcaacaaugccuaaaaaaaaaaaaaaaaaaaaaaaaagacuaagucauauaaauccugacaagucuguguauuuaaauucugcaugacugacuuggaucagcaugucuuucuaaaguggcagguuucugagaggagggaggauaaagagaugagaaguaaagaagacaggaaagcuaagguuuggaaguuuauuaggauuuauagggggacagugggacagagucagcagaaagcuaucauacaaugugaugaagacaucuggaagcuaaucaagcaaugguacacaaagagacacaggauaucucaagugcagcacagacugagcacucaacauccuugagacagauagcgccagucuucuucagggggaaaaggcauguucccagaaacugaaacaucuaacuccauugaggcccuggcucuaaccuggaccagacuuuauaaugucugccccugggcaaggauauagaacuaguuaguucccuuugucuuuucaucagggauucugguacagaacacauaccaguggacaaauacugugauuaggguagcuuaaauuuuggaguucguuaguaacuaagugaaugaagucauucugcuuaguuggcagcaaacuucuuuuccuccugagacauuuuaccaccuccaguucugaaaaucuuaaaaagugaaacaaggaaauccuggggcuauuccugucacucauuagcugcuccaaguuccucuugcugauuaccaaacccuugguaaccuacuaaugaauggaaauaaucaacucuucuuuauuagucaugguuucccauggucuucuggugccaagaaaguacgcuguaugacuucuggauugcaaugugacucugaugguagggucuucauacccuguuuauugugcugacaagaagauagacuggcuaaugggaccauugggauguuuuaagucucuuuucaucguuaacuccagccuucauuuuguaagaucuagguuuuacuuccaagguucauaaaaagccuguguuaaaguucuuguaaacaacuaacugaacagaaucugaauaaucaaacagaguagacccuugaguguagccugcaugaccuauaaauaacagggaaacaauuccaucaggcaucuuaacaggaauuauucaguuguucacaaggagaucucuguaccccaaggggcauauucaacuuuuaaggacugauacuuaaaauuuuuguaugucuaacucaguuuuguauuucaucugucaguugacugccugccuaugucugucucucuuauuuuuuauagaggggaacucaggguggcuuugaacuuugacccuccugccucccucucccaaguucugagauuacaugugguaguucuugcagaaauguuucugaaggcuuauacuuccuuaccacacaucaacuuaauauguauacuuggagguaguuguuaggacuuuauagauauuuaagaccacuagcuuauuaggcauggugguacaugucuugaucucagcacucuaaggggguuucuacuacuuggauaagaggauuucuuugaguuuuaggcuagccucagcuacagauugagaccuucuuucuaaagaaaaaugaucuucagggcuagaaagaugggcucagcaguuaagggcaguuguugcacuuucagaaccugaguugguucccaacauccguauugagaagcucugcaacuccaguugcagaggcuuucacaccucccucugaccuaaggccaccugcucauauauugcauaugcacaaacacaaauaaauaguaaauaaucuguuuaaauagucuaccucuuuagugagucauauuccuugggauaaauacuaaaacaagacacugagcaaaauucaaagaaugauauuuuacuucuguaaaauuuaauucuagugauagaguaguaauauagccauaagggauagguucaacauugaguaaaaccacacagccuuguauauauguagucugcuguuaacugagauguugucuagucuguggcauuaaguuaucugauugauuggcccaugcuucuguuuguucuuuugcuuuugguuuuuuuuaguuuuucgagacaggguuucucuguauagcccuggcuguccuggaacucacuuuguagaccagucuggccuugaacucagaaauccuccugccucugccuccugaaugcugggauuaaaggcaugcacuaccaugcccggcuccuuuuguuuguuuguuuguuuguuuguuuuuuggcccaugcuucugaauagaauuuguauuguaguugaauucauaaaaaaaaaaaaaauaacaauugccacaaugauuuacucuuauuaaugaucaacccagcuuaggucacuucuugcauaccuuuugggaacucacuuagaaccacaagaaucagacuuacacagccacagauuguucuucugcauccuaguucccaucaacaggaccuguacagccuuccccuucauucagguguuagaaugacccacuuccaagcuggcuuuucaguagcccauguuuugacugauuaauauaauucuuuccuccuuuucuggacuauuguggaacuaugccuucuguguucuaccauugagccccauucucaguucugugucuaaaaaacuccuugagguaccaaaaccagaggaugcuuacauuuguaaguucugcuuauucuccuguguacuucacaucauuucuagguuauuuaaaaugcuuaauacaaaguaagugcuauguagaccauuguuaugcaguagucuuuagagaauagaaacacgacagaaucguaccaacacaauuucucuuguuuuuuguuuugguuuuucgagacaggguuucucuguauagcccuggcuguucuggagcucacuuuguagaccaggcuggccuugaacucagaaauccaccagccucugccucugccuccccaguacugggauuaaaggcgugcgccaccacgcccgguucauuucucuuguuuuuaaucuuugauuaaauuuaguuuguauuguucuuuguucaucugguuuuuuuuuauuaauuuuuauauauuuuguuuauaugaguauacuauagcugucuucagacacagcaaaaaaggcaucugauccuauuauagaugguugugagccaccaugugguugcugggaauugaccucaggaccuguggaaaagcagucagugcucuaaaccacugagccaucucuccagcccccucaucuguuuuucuugacaggaucuugcugcauaggcaaagcuggccucaaagcugugacccucuuucuccagccucugaugcuggggcuacagguauguacugcuuugcccaccuauaguuguuggcacauauacauuucugauagguuaacuuauuuauuauagacuagaguuguauuauaauguaaaauuuaggaaaauugauuauauaaaaccuaucagacuaggaagccuaugacugaccuuucccccacugugguuaaggauauagaaggccagagauacuauagauggacuaaaucauacuuuuagaauuccuugaauuguuagcauuuguaauuuugcagaguuuuaguggauuuuuuuuuuuugggugcuuuuauuguaaauuagaaauacugguuuucacuuuaaucacuuuaguguacuguuuguacaaacuucauuuuguaaugugaaagcuuguuaagcagucuggcaagucaaaaaauauauauguacaggaaaaguuuaauaucuugugguaggaguuaaggcagcaugugcaagggccacugaauggcacuggcaggaggaauucaggauuugucccagggcagacagcaggaaagugcuguaccuagacaaggaaugaaaacaaaaucccucacaaugugagguaauacgaugguguguuaacuaauucuuuccuacugucagccuuccuggggacucaggacccagcuucaaaguauagcucuuuggccaauggaguccuuugaacgaaaggagaaaagggaccucuaaugucagucucucuccacucuucucauccuccugucucuaaacuccuuuucaugaagccaaccacagauguggaaaggcuauucugcccucuacccucugcuucuuuguaagaauuggcuauaaggguuccucugaccuguguaggauugccagccucacucacagagguucuugccccaaacccagaggaaaguaccacaaggagaccaagaaaaagcagacagacaaguguggcugaauuuuccauauguccacucacuacuaccuuuuuaucucaucauuuuuuuaaagauuuuuuaaagauuuauuuauuauauguaaguacacuguagcugucuucagacacuccagaagagggugucauaucucauuacggaugguugugagccacgaugugguugcugggauuugaacucaggaccuucagaaaaguagucagugcucuuaacuguugagccaucucuccaggcccuuaucucaucauuuuuuaaguuaaauuaguuuacccuauguagauggguguuuuguccacaugcaccgugugaggccagaaaaguacauuggaucucuugggacuggaguaacagaugguuucuggaaauugaacuuggguacucuagaagaccaccuaguucuuaacugcugagcuaucucuccagcccucucucuaaucacaugucugcauaauuguuuauucuuuaaaucuaaacuugaaaauggauaguuuccauuaaucuucguucuuuagagucuucauuucugaaguuuccugucacauaaaaauguugguuacauuuauuauuacuauuuuuuuaaaugucuuucuuaguguucugagauuucugauaauauucacucagcaaacauugacuggacauucuuuacccuccuucaacucagcuugccauacuuuuauuuaucuauuuauuuauuuauuuauuuauuuauuuauuuuuuauaaguaucuucucagauuucucaugggaaauggugacaguaguaauacccuaucccugcaaaacuaaauggcagacauugucuacuucuagguaguagacacuaaccagucacuucuaguauccacuaccuagaaguagguacuuuuggauauugauguguaguuugggcucucuaagauggaccuuuuaugucuuucauaugacuguuaauagcaccuguccuaguuuccuuccuauugcugugauaauguggugguauucaaauccaugggaaagaccaaacacuuugauucaauucagauuuagaugaaaugaguuuauccuuacggcuagcagaaggauaacagccuuauugcugaacagcaugacgugcagaagguggguuaaggugaguuuuaagggucgacaucagaaaaguguguauugcaacaauccauggaauccauagcugagcagaauuguuuuacugcccucaguugauucuuacuuuccuacuauacaguaauaaaaagaccauuucauuccuuucccacaacaauaaacagguuuuacagaagcaaaggcagcuguuaauaccucagggcccauuauccucuccuuaucuccucugcaggccacuagaaccucccaggcauuccagagaaaaaggucaguggcccuuaaggauuggaugccugguuccauauuaaguuccuuuaguuauccugggggccuguguaaauuauuacgcagaucugggcacucuaaugacugggauagagaaguucauuuuugggcagaaacacagugccauuggauuagggcugguugucaucucuuuacaaucaaauaacucacaaaacauguuuuaagagaaagagaauuuagaagacauacaauucuaacguacacucuaucauuguggggaaguugaagcaggaauuugaagcacccuguuccauccccacaguuaagagcaagaaugagagcaugcauccuuguucaguuuacuuucuuaggaaguuucagacucagaaccaccuuaauuagcauaaucaagucacccacugguuaguuuaauauagguaaucccucauuuggcuuauuuuaggagauggauucuagguuguaugaaguugauuguuaaaacuaacaucauagaaucuuaguaaaaucuucauaaaauuuuugaguuaaaaauguuuaccuauucauccccauccucuccacccuccuucaacucaucuucauaacuuccuacacuuuuuaaaauaaucaucuucucggguuucugguaggaaauaguacuaguacuaauaccauauaagauuaaaucuccugcaaaacuaaaugguagacuuugucugcuucuagguaguaaguuuuguuacuguguaguaagcuaucugaacaccucuuuccuuagccuuccaagugcaaacuaucauaccugguuauuauaaggguccgaaaaucacugaaggaagaccugagauucagauagauaauaugcaaagacaaagagcauuuauucugcagaaacagguagcaugcaaagguuaccauuuuuuccaaaaggcacacccccuacuccccagacauuugaguuccuuuuauucagagauacagcagacuucuaaaacuuagggcauguuccaagggaucacagaaaccauuaacugaaggucauaaaaaagauauauaccucgggaccccaggugcaaaacaggagauaagauauuacaguuaaaguguguuauugaaagagauuaaggcaagaacuuuugaaguauuccugaguagagagagaauguaggcaugugugcuaauuucuuuuuuuuuucuuuaagauuuauuuauuauguaaguacacuguagcugucuucagacacuccagaagagggcaucagauuucguuacagaugguugugagccaccaugugguugcugggauuugaacucgggaccuuuggaagagcaguaggugcccuuaaccacugagccaucuugccagcccccccacccccccuuuuuuuuuucuuccuugagacagggcuucucuauauccugccuguccuggaacucauucuguagaccaggcugaccucaaacugccucugcucccuaaaggugugcgccaccacugcccggcucuaauuucuuuuauacugcgcaggguccagacucuuggaauggugcuacauauaguagacugaguggucacaguaacaguuaacauaaugaaagcagucuuccacugacauguccacagggcauccuaaucuagacaauucuucauugagacuaguugaccaguucagcuaacccuagcacccaaugagccaucucccuagcucuuucuuguguuuuugagauagggccuugcugugcaguccacacuggccuggaauuuaugacacaccugcuuuagccuuccuuccaggugcuaugaauucaagcagcuccacuauacccagcuuauuucugauuugggcauagcauaguagagucacuuaaguaaaacaguauuugauaaacuuaagcuuuuagaaauuuuuaugaacguuuaaaaauaacaagaaagucuugggggccagagauaugucucagcgcuuaagagcacugacugcucuuccagagguccugaguucaauuaccagcaaccacaugguggcucacaaacaucuguuaaugggaucugaugcccucuucuggugcaucugaagacagugacaguguacucauauaaauaaaauuaauuaauuaauuaaaaaaagaaaaguuggcaucuaagauuuuaaaaaaagaagaaagucucucuccaaaauaaugauuaaaauuuaaacaaguggaagugcuuacugccucauuuaacccuuaaccauugugcauugagaacauguaucaaauuauauuaugccccucaauauguaaaauauauuucaguagauaaauuuuaagaaaauccuauauuuuggcucaaaaaaccaacuuaugcucuuaguaauuuucuauugcuguguagacaagacaccaugauuaagacaauuuaagcaguagcugagagcuuuuaucuugguccaucaacaugaggcauagagagcuaacuuggaaggguguggcuuuaaaagccacuucuauuaacaauacccccauuuucaaaaccucaaaaauccaucccaauuaacauuacccccagugacccaccuccuccaaaaagccacauuuccucaucccauucaaauaguaccaccaaauggugggaacuaagcacucauauauaugagccuacaugaaccauucucauccaaaucacuacaugcuccuaugaaauaacuaaaauauauaggauguaagaguguuuacuauuuaaccaaguagacccaaauuuaagucccuagcacccauguaagagccaggaauggacauuucauauaggcuagcuggccaaagaauucccagauccagugguuucuauucuccaaccuccaucaugggguuaccaggauguauagcuguuuucaguuggucaugguugaacaugcuuuguaauuacagcacuugagaaguagagaggcaggaggaucaccucaaguuaauagucagauaagacaaaauagugagacccagucucaaaucuguugguauuuggggagcuuuguccagaacuggaacagugguaaaguacugauaacauuuuguacuauguauacacacacacaaauacacacacauacaacauagcaaaauguucagccaacguucuugauucagcagccuugaaguccagaauuuuuguguaucuuaaaguuuaucuucaggguaugcuccuuguagguuccuuugguuugccagcaacucuagcgugucuucacauaauccacaugguuuuaaugcuguuuucucauauucauauaacacuugugacaacaggaaguuuucuuccugccaacucauucucuagguuuugggguuuguguguguguguguguguguguguguguauacauucuggguauccugcucucccauccaauccuguaucaucaaauucuacuaguuaaacggcucaguuccacaagacagucccagaucccauuccuggaagucuugcauuucuaaugacaauuguaaaauuaaggggugucuuaugacgguccuuucuuuuuauacucaauaaaacugaaggaugagguggcuaugacaagccuuuuuuuuuuuuuuuuuaauggcuuaggugggguuuucauuucuagucagaacacacuacccucucaauacuaccuuguaucacaucucacucaauagugguguuugcagaguuaagcucugcugcuguuucuaaagcuaugggugggguugaaaguucuauccuuuuggugcugacugccuccuggguggguucuuccucuuaucucaguaguguacacucagauguaagcaaaagaaggucuugacgaaaggaaaagaagaugccccugucagccagugcauugcaagugauguaguuuuguacuaggaaucaaauauguuuuucuuuuuuuuuuuuuuuuuuuugucuuuaugacuaggcuaguacagccccagacagcauaggguccuggaagcguggcagugcuagacagaccucuggcuucacuucaagaaugauuaaguuuucuuuuuccacagcuguuccugcagcaguuuagcuaucuacuaaagauagaauugaauguaaggcuucuuugcccuguucucugaguuccucuuccguacuucucuagucuuguggucuuguuugugcuagaggacguuucuacuuagacaucaucucaugccugcaguguucugaagucauguagucacacuuuagucagaguuugugcuuaagaaagaaacugcagaccaucuggacccccauaguuuuaacuuuuuacuuugagauuggggggguccacugaguugcccagguaagcuuccuuaaacuuacugucugccugcuucagcuuaauuauagacauguacaaccagugcuggcucaaguacacuucuugguaugucaggagugauauagccacaaguagaauguuauguaaguagauaacauuuuuagugaaguaaaauaaccugccuguguaugauaaugaaauacaaacaguagauugaguuugguacgauuccauuugucuuaaaagauguuuuuggcugggcggcgguggcgcacgccuuuaaucccagcacuugggaggcagaggcagcccgauuucugaguucaaggccagccuggucuacagagugaguuccaggacagccagggcuacacaaagaaacccugucuugaggugggggaggggggggguuagauuuuguuugauuuguuuuuugauuuuuugguuuuuuuguuuuucagauagggucucuccacauuguccagacauuuucacagucuuguuuagcuucuucaguagcugagaguaaggugggaaguuuuauuuauuaauuuuuguuuaugcuuagaaauuuuaugagaagauaguauuguguacuucaauauaauuauguguuggggauguucaguaagaaauuuuuauguaagcuuugcuuuacaacuagcauggauugcauggacuaaagaaauuaucaaaauaaguggaaacagguuaacauaccuaguuaguguuagagcgaaugcuuagcaugccugagacucuaguccaucaccuacaccucaaaaauaauaaaaguagaaaaguaccacuuaaauguaacggggugauagcaucuuucuucagagugguucuuuaucauugaucuugacauuuuucucaauuauuguugcagcuugcuauacuaauucucuuuccagauuaaguguacagcuuauuaauuugagguccuucuuuaguuaccauagacaugguuuguuucuaauuuuuuuuuccaaauuuugucuaggcagugugauuauuauaaguuugaagccaaucuggucuacagaagaaguucuaggccagaaaggcugucucaaagggagguugagagaaaaguuuuuaauaaaagaucuuuauuuguauuucuugcagauuuaugacauucaaaaccacagacuuuacaauacugcuaagucagaucaacuaugaauuggaauacaaaacaagagaauguucccaaacccccaccauauucuaaaacccagucaucuaucuugcagcauuuuuuaaugacuucuacaacaucucaaaguucuuucaacuauucuccccauaaccaagaagcaucucaaacuucuuucaacuauucucuccauaaccaagaagcaugcauguauucugggaauucaaauucaguuucacagccacuucugagcggcagaaauuauauaacuccucagacucagaucucuguuucuaauaugccuaccagaacaauuguggccucacagucuucaauggaaagaguuguaucuacaaaugguaaaggaccacaacaaccaaaccacaauuugcaaacagugucuucaggaauuaugcagaaugucugguugccuucccauacagaagcaaccauaucucauaaucccgacggagggacuaauaugccuuacaugcauccaccacagaaucagcuugucacaucagauaccuauucuaugcaacuacaaauggcuccuuuacauucuggaaaaguaccuaugacacaucaaggaagucagggacuuaaucacuucauaccagaucaguugguugacuggacacaguauacauccaacgaacuuucuuauccugaauacaggccaccuccaaagcaauacuccuacauacugccagcuacuacaucauuacaaguuaaaaauaaucagcucccaacuuauacacagagcuuacagucaaagcauucuguaccuuugucaucacaucaguaugcugcagaagccagcaaaagacucucugcccuuccuuacagcuguagauaugaaaaccaacaugugcagaaugcucagccuguuucuaaacacuugccuauggaaguuccucagaguucagaagugcacucaucugaaaaaaagaaagauacuuacagaggcuuuaagcagcaguggcagaacccuaaugagaaagucagcauuggacaauucucugaggugaaaauaaauaucaagcagccuuacagugaaucuguuagaccuucuggggaugguguucaggcacuuguucaaaauaaucaagaaaaaagaaaauauaccuacaauccuaauacaaaucaaguaauagauacaaaugccacaaaagaaaagcuggugagggauauuaaaucucuaguagaaaucaaaaagaaguuuucagaacuugcaagaaaaauuaaaauuaauaaaagucuuuugauggcagcugguuguaguaaaacagcuaauacuucuuauacugaaccaauucagcauucugaauuuucagcaaaagaaaugucugcuaaaaauggcaaugacuguuccauggaauugcuagcaacaugucuuucucuuuggaaaaaccaaccuucaaaaaccacagaagaaaauguuccaaaaccuuuagaagaaaaacaguguaacacaucaagaaucaguacaaccguagugggcagugccaaucccacaaaugaaguucauguuaagaguuuguguucugguguuggaaauucucagaaaaugaugagcucaucacaaacaguauugccaguucucauaccgagcugugagucuuccgguguagcuguaggaaaaggaacagagcuucagauugcuguggugucgccuuuaguucuuucagauacuaauaccuuaccuggaaaagacucagugccugaaguuuuaccugaaacacuguauccaguuguuaaggaagguaguguuuguagcuuacaaacccaaccaacagaaacuguugcuuuaccuuuugauguuauaggagcuguagcaaguaauaacauaucagcagagauuccucugccuguugauaaggaaaagcagcacaaaccaauacagggugauccagacauagcugauagcagcuuaggaaaacacucuccccugggcacugaaguucugccuaagccuauggauagcaccauugugaguggaccuauguuacaaaucgaaaguaucuguucucuugcagaaggggauguaucuuacaauucccagauagcugagauauucaacucuguacaaacugagccccagaaaccuucaccuaaucagguaauugauagucaacaagaacaaguauaugauaccacugaaaauaaagacuuuagcuuacagaaagauaaguguguacaguguacagauguuccucaugaggucccugagcagccagagccucugcagccugaagagccagcaucuagugaguauguggaagcaaacagagaagccacagaggaaagcuguagggaguacacugguagaaaagaaaguacagcuaaggauguauguuuaccagcugcuauucagcaggauccucacccucgggaaacugauauguucaguaaaucagaccacagucuuccugcaauaaaugagauuaaugaugaaagugaaccuaucucauaccuacaugaccagcugucagagcuuuuaaaagaguucccuuauggcauugaaacuuuuaacagacaugaagugucuuuggaccaacaaaagacacauaaaaucguagaaaaucaaacuggugguaaaacuaguaaugugucuggggauagcacagaccaaauaaaaauuacaguauuaaacucugaacaaaucaaagaacuauuuccugaagaugaucagcccugugacaaguuggcggaaccugagaauaaagaaauuguugcggaaguaaagagcccaugugacucacagauuccuagagaagaaagucaugaccuuggaauguuggauccagagaaagacaaaauccauugcugugccuuggguuggcucucaaugguguaugaaggugugccacagugucauugcaguucuacagaaaagaaggagaaagaccaguguuuggacaucaacagcagcaaacaaggagagcagcccugcaauaguggaaucacuauuuuugaaauuaauccuguuucuaauaacucaaaaacuccucugacccaagcaacugaggaaggccauuuuucugcagugcauggugaaaagaccaaagcaucuaaaacaaaagacaacagggagggacaggaauuagccugucauuuuucagcuaaauguuacaaaaaagauaaaaaagguaauuuuaaaauaaggcaugauaccucacugaaaauggagcaaaaacuaaaaaauauuucaucuaaaugugacauaccaaaccccucaaaaugcaauaagauagcagccccugaaauacuucacguaacaacuucuaacucugcuaaaaauaugccauuuucuaaacaagccucucaggaaagccuacagaagaaacacacgucccaagacuuggguccaguaaaagcaccuauagaacuuucgucaaacacagauccgugcaggaguaauaccucuucaguacagucaguaucaccagaaaagaaaaaacuaaaauucaaagcagguggcuccagguugaaauauuuugaaaaaagaaagacggaucacguuauuauuccagauguagaaauaaaaaagaagaaauaugaaaagcaagaacagaacaaaaaugcuggagacacacucaaauugugcaguauucuuacagagucaaaugaaagagccaguguucaagaaaagacaguuccaaguccugaguccucagacccaaaggguagcuccucuaagaguacuagaguuauaacagugcaggaauauuuacaacggcagaaagacaaacaaauaacugggaauaaugcuuccagaaacaucuguguagaaacugugcuaugugacucggggcacacgaagaccaguaagcauucugcagcaguaagcuggggaaaguuaguugaggggcagaguaucagugcagagacugcaaaagaacuggaacauaauucuagcagccaugguaaagacuucaagauccaucacucugaggcgucuagaacacacagugugucaaauaauaauaaaggaaaguuugaugggaagcagccugauaaaauguuuaaaaauaagaccaguaugaauaaugaguccaaccagaugccucuccagguaaaagaacaaaggaaacaguacuugaaucgaguugcguuuaaaugcacagaacgggaaagcauaugucucaccaaauuggauagugcauccaagaagcuuaguauagagaaaaagaguggggaauauacaucuaagacaaaagacacagacaaaccuaguaugcuggaguuuaaauuauguccagaugugcuauugaagaauacaagcacuguugacaagcaggauuguccugguccugguccugagaaagagcaagcaccugugcaagguccaguauaauuuuuuuucucucccuuuuuuucaugggggaauggggaaaguuccacauaguucagacugguguuaaaccaucaucaagguugguuuaauucugaucauuuuguuuucaucucccaaguguguaagccacgggcccaacuauugguuuuauguaugaggaacaguagagguguaauccuaggaguggcugaguaaauagggcagcauuuuuuuuauguuuguugcuuuuuauuuuaaauuacaguaaauuaguacugacaauauuuucaacuuuaacauuuacuaaauacaaauauuuagucccaaagagacuacacuaugaaaagcauuuuuauucuuuuguguguggggggugggggugggggugaaaguuuuaaaaguaucaaguguacauuuauuucaagaaguuuugaguuuugauguauugguggucaaaccacugguauuagacccugaaccacagccagagucuggguuuuaguuuccuuuuguacuuguaauuucaaagaggcuccugugugaaacuuuguuccaaauauuggaagguacuguacuuguuauagugggucaguuuguuacuuugacugacacugaggauaaaguuauccccaaaguuaaaagguagcaucuauuuuaccuauuaaauacaaggccuguaagagcuguaugugcuuggaacaaauuaaucucaaauuagucagucacaaaggucuaaauggugacuggguagagucguacauguggaaugcugguggcagaagaaucuagggaauuuaaguccagccuuggcuauaagacuuuguuucaaaaacuaaaaacaaugaaaccagaauagcaauuaugagucauagguagcaucucugaaaggcagaauuaaagggguauauggaugaguaguugugaucauaagagguugugaaacuguagguauuauagcuaauacauuguauaauaaaacucagauuggaaaaauaugggauuuuaguugaaguuuuaguuuaaucuggguuuuuuucccucugguuaugucuguuggggugaauaaaacuauagcauaaaugguauucuuuguugaagguuauagguauagaauacaaaaauacuuuuguuuaagauagcugauuucaaggccaggcaagauggcacauaccaacacuugggaggcaaaggcagguggaucucuguguaguugagacgagcuugguuuacaucaagagauacauaaugggauccugucaacaacaaauaaaacuaaaaccaaaaaagguugauuucaguaggcauuuuguauuagguuuuuagaaucugagaacuuggguguaaauagaaauuugggauugagcaggggcaguagcuuccucucucauaccuguaaaugcccugagaaauguuggugauucagccaagaaaauguuuucuuaaugugacaauuaaaaacuauucauuuucuuguuguaaaauauacacacggggaaaaugauuuccaagccccuuaaaguuuguauuaucuauggaauauagguauggcauaucaucaguauuauauacauuuaggugagguuuugauaguuuucauuaagcuaaaauggaggaguaaaaguuauauaucuuaaaacaaguauuuaaacaguuucaggaauaaaaaguacaaaagaagacugguuaaaaugcaucccuacaaggacaaagaugccugaaucaagucaaagagguaagccaucauguuuccuuuuuuuguuuuguuuuuaaguugcuagauuguguaugaauaacauggauauaauuacaauauuaucacagugcacaguuuuauugauaaucuuguuuuuuagucauuugguuuuguuuugagacaggguuucucuguguagcucuggcuguccugaaacucacucuguagaccaggcugacucagaaauucgccugccucugucucccaagugcugggauuaaaggugugcgccaccacaccuggcagguauuuuuuucugaagguaaaauagcauuguuuucucugucaggauggagcaggaagccaggaucuaguuccuuuuaacaggaaaauaauacuaucacacugaauuagguaagggaguuuugaaucuuuucccugaguagggcuagaguuaaugauuuucugaaucugagcugaccucaauucugacauuguaucaagugauaucuaaauaagaauauuguaaucaugauuaaacucuucacuaagaucuggggcaagcuggauuggccuccauuuaauuuuuugcaggcucauucauucaguucccugaacaagguaggcaaguacauucccauuugucguuuggcuuauuacauugcuagaauagggacuuggaccuggacccuuccuucaaaauuuauugaggauaauggucuaaguauuuaaaguacagaaagcuaguuaucaugguagcuuuuauccguuuguuggagauuaggcuuagcaacuaucugguaggcuagccuuguacucaccaugaacugauccucuugccucuacuaccucccacauacugaagguuuaugugcugcugagaguagaguccagggcucugugcaugcuaaacaaaaacuguauuaacugaauccucauugucuguuuagcuaaaaguguagugaauguacugucuuggguuugugcauugagaauuagaagguagaacugaagaguugugucuuaaauuuugcuuaguuuaaaagaguuucagagucuuaaaauuggaaacaaacaauuuuacuaggaacaaugauagaauguuuuuagaagauacuuaaauuuuaaagauuuuuaauaaguaggucuaugggucugugcacaugagugccauuaagguguaaggucccccggggcuggauuuauaacaguuucgagccaccaacauggaugcugggauuacaucuugugucuacuccaagagggguaugcacucuuagucacugagucaucucucucuagcuccaaauugaacaaagaugagaacagagauucaaauguguauaagcaagcauguacagauugagucauagaaauaucaagauaaugcuuauaugaaagagcuuagcuagugaugcuguuugaugcuugucaacccuguacuugaggggaugaggcaggaggauuacagagccagagacuaaccccgguuauagaauuuaguacugucucaaagaauaaaagaugagcugggauauagcucaguagguugagugcuugcuuugcauucaugaggcucuggguucacacucagugcugaagggauuaaaguauaaauuccauuuugguuuuucagaccuauuuuaaauuaacuuguccucagagugucuugaccccuacccuugaguucugagaaaaacacgauauucuuggcaguuacaaaauagacauaacagcuguggcuagccaauaauaacaggguaggcuaagaaaacaugaguuguucccaagucaagauguucccuuuagguguguggucccuccuugugguuugaccagaugcugugaacaaaucagcuuaaaggccaacauucuuuuaccuucuuacccaaucauguaacgccaaggcuuggaaaucccugcuuccagguuuuuuuuuuaccuuuauaaaccccauuuccuuugaccuugagcuguucucgauccuguuacaucagaaggguuugugguccaggcucaagccugaauaaagacuaucuuguguuugcaucggaguuguggucucuuuggggcucccgugauguggacauagcaggaucgaacagguguaggauaaggaggccccugaggugagagaguuccaucuaaauguuuagaagguagagaagcaaagcuagaauaucaaaauuacacccuuuccauucacuguuuggaaauggccacacuuuuuauugcucauuuuucugcuuuuuuucuuaaagauggugucuuauauagcccaggcuggacuugaacuuuguguauaguugauacugagcuuacacucugaucaucuuaccuccaccuucuaaguucuggguuacaguccugugccuggcuaccuuucuguauuuucuccauuuuguuugguuauuuguuugguuuugagauaggguuucucuguguagaccuagcugucuuagaacuugcucuauagaccaggcuggccuugaacucacagaggcccaucuaccucugccucccaagugcugggauuaaaggugugcaccaccacugcccagcuuguuuuuauuuuuaauuauguguauauauggcaggggagggggugaugugcauguggauguuagcccuuagaauccagaagacgacauugaauuccguagagcuaauaggcaguugugugcccuuaggauguaggugcugaaaaccaaaaccaaaucgcuugcuuuuuuuuuuuuuuuuuuuuuuuuuuuuuuuugagacagguuuucacuauguugucuuagcugacuuggaacucuccuuuuagauagaccaggcucaaacucagaucuaaaugccucuguuucccaagugcugaggcuaaagauagccaccaccaaacuaucucucuagguccuccuuugguuuuuugaggcaaauuuuugccgugaaacucagacuggccuugaguugaagauucuccuuccccaaccuugaaaaugcugagauuauaggcaugcacugccauuucagcuaucuggcuuuguuuucuguucccauacagauacuguacauuuugucucacuucugauuguuguauauuuguuguacugaacauuaaguaucauuuuuauuuucucagauagugcugacucaagacuuucuaagagaagccucagugcagaugaauuugaaauacuacaaaacccaguaaaagaaucaaauaucauguuccggaccuacaaaaagauguaccuugagaagagaagcagaagccucgggaguaguccaguuaaauagucccaggaagucaugguuuuuguuuuuaccaagagaacaccccuagucuuuucuuuucaggcucccuugcagaaaauaccucaggacagucacaucgggauuucucagccaaggaguuccuguauagcuuuucacugauacuaugugacugaaauguuggauuagcugcuggugagcaggcaaaaagaaagauugcauuugucugggaauuacaaaguguaugcuaaugaugcagugaucugcauuguugaacuguguuuacuggguuuuuuguuuuguuuucuuuuuuuuuuuuuuuuuuugagacaggguuucucuguagcccuugcuguccuggaacucacucuguaguccaagcuggccuugaacucagagauccaccugccucugccucccgagugcugggauuaaaggccugcaccaccacgccugguucacguuuacuguuuuaagucuugcuggcacaguggugcauaccugugacccuaacauuugacucguggacacaagaggaucaagaauucagggucauucucaacagaauagugagucuggugaagucagcuuaggcuacaugggagccucucucuaaaagcaaaacaacagcaaccaaaaaaggggaaugaggguggcuuauacaaaccuuacuuugaaaugcugucauccugagguaacuugguuguuugacuggggcuguaaauagauucuuguuucuaagcacauuagcaaaauuuauuuuucagaaagugcccauugugaaugucaaaguauauuccaaguauuuuguaccucauuguaaagguuuuuucagaagucuuguuuuauacuuuuguuaaagugaauggaguuuuuggaagaugucuuaacauuacuuuucauacuugaaauaaacauuuauuuuuuaaagaacuacag

SEQ ID NO: 3497 - RNA, 26330 nt, Mus musculus
cuguaguucuuuaaaaaauaaauguuuauuucaaguaugaaaaguaauguuaagacaucuuccaaaaacuccauucacuuuaacaaaaguauaaaacaagacuucugaaaaaaccuuuacaaugagguacaaaauacuuggaauauacuuugacauucacaaugggcacuuucugaaaaauaaauuuugcuaaugugcuuagaaacaagaaucuauuuacagccccagucaaacaaccaaguuaccucaggaugacagcauuucaaaguaagguuuguauaagccacccucauuccccuuuuuugguugcuguuguuuugcuuuuagagagaggcucccauguagccuaagcugacuucaccagacucacuauucuguugagaaugacccugaauucuugauccucuuguguccacgagucaaauguuagggucacagguaugcaccacugugccagcaagacuuaaaacaguaaacgugaaccaggcgugguggugcaggccuuuaaucccagcacucgggaggcagaggcagguggaucucugaguucaaggccagcuuggacuacagagugaguuccaggacagcaagggcuacagagaaacccugucucaaaaaaaaaaaaaaaaaaagaaaacaaaacaaaaaacccaguaaacacaguucaacaaugcagaucacugcaucauuagcauacacuuuguaauucccagacaaaugcaaucuuucuuuuugccugcucaccagcagcuaauccaacauuucagucacauaguaucagugaaaagcuauacaggaacuccuuggcugagaaaucccgaugugacuguccugagguauuuucugcaagggagccugaaaagaaaagacuagggguguucucuugguaaaaacaaaaaccaugacuuccugggacuauuuaacuggacuacucccgaggcuucugcuucucuucucaagguacaucuuuuuguagguccggaacaugauauuugauucuuuuacuggguuuuguaguauuucaaauucaucugcacugaggcuucucuuagaaagucuugagucagcacuaucugagaaaauaaaaaugauacuuaauguucaguacaacaaauauacaacaaucagaagugagacaaaauguacaguaucuguaugggaacagaaaacaaagccagauagcugaaauggcagugcaugccuauaaucucagcauuuucaagguuggggaaggagaaucuucaacucaaggccagucugaguuucacggcaaaaauuugccucaaaaaaccaaaggaggaccuagagagauaguuuggugguggcuaucuuuagccucagcacuugggaaacagaggcauuuagaucugaguuugagccuggucuaucuaaaaggagaguuccaagucagcuaagacaacauagugaaaaccugucucaaaaaaaaaaaaaaaaaaaaaaaaaaaaaaaagcaagcgauuugguuuugguuuucagcaccuacauccuaagggcacacaacugccuauuagcucuacggaauucaaugucgucuucuggauucuaagggcuaacauccacaugcacaucacccccuccccugccauauauacacauaauuaaaaauaaaaacaagcugggcagugguggugcacaccuuuaaucccagcacuugggaggcagagguagaugggccucugugaguucaaggccagccuggucuauagagcaaguucuaagacagcuaggucuacacagagaaacccuaucucaaaaccaaacaaauaaccaaacaaaauggagaaaauacagaaagguagccaggcacaggacuguaacccagaacuuagaagguggagguaagaugaucagaguguaagcucaguaucaacuauacacaaaguucaaguccagccugggcuauauaagacaccaucuuuaagaaaaaaagcagaaaaaugagcaauaaaaaguguggccauuuccaaacagugaauggaaaggguguaauuuugauauucuagcuuugcuucucuaccuucuaaacauuuagauggaacucucucaccucaggggccuccuuauccuacaccuguucgauccugcuauguccacaucacgggagccccaaagagaccacaacuccgaugcaaacacaagauagucuuuauucaggcuugagccuggaccacaaacccuucugauguaacaggaucgagaacagcucaaggucaaaggaaaugggguuuauaaagguaaaaaaaaaaccuggaagcagggauuuccaagccuuggcguuacaugauuggguaagaagguaaaagaauguuggccuuuaagcugauuuguucacagcaucuggucaaaccacaaggagggaccacacaccuaaagggaacaucuugacuugggaacaacucauguuuucuuagccuacccuguuauuauuggcuagccacagcuguuaugucuauuuuguaacugccaagaauaucguguuuuucucagaacucaaggguaggggucaagacacucugaggacaaguuaauuuaaaauaggucugaaaaaccaaaauggaauuuauacuuuaaucccuucagcacugagugugaacccagagccucaugaaugcaaagcaagcacucaaccuacugagcuauaucccagcucaucuuuuauucuuugagacaguacuaaauucuauaaccgggguuagucucuggcucuguaauccuccugccucauccccucaaguacaggguugacaagcaucaaacagcaucacuagcuaagcucuuucauauaagcauuaucuugauauuucuaugacucaaucuguacaugcuugcuuauacacauuugaaucucuguucucaucuuuguucaauuuggagcuagagagagaugacucagugacuaagagugcauaccccucuuggaguagacacaagauguaaucccagcauccauguugguggcucgaaacuguuauaaauccagccccgggggaccuuacaccuuaauggcacucaugugcacagacccauagaccuacuuauuaaaaaucuuuaaaauuuaaguaucuucuaaaaacauucuaucauuguuccuaguaaaauuguuuguuuccaauuuuaagacucugaaacucuuuuaaacuaagcaaaauuuaagacacaacucuucaguucuaccuucuaauucucaaugcacaaacccaagacaguacauucacuacacuuuuagcuaaacagacaaugaggauucaguuaauacaguuuuuguuuagcaugcacagagcccuggacucuacucucagcagcacauaaaccuucaguaugugggagguaguagaggcaagaggaucaguucauggugaguacaaggcuagccuaccagauaguugcuaagccuaaucuccaacaaacggauaaaagcuaccaugauaacuagcuuucuguacuuuaaauacuuagaccauuauccucaauaaauuuugaaggaaggguccagguccaagucccuauucuagcaauguaauaagccaaacgacaaaugggaauguacuugccuaccuuguucagggaacugaaugaaugagccugcaaaaaauuaaauggaggccaauccagcuugccccagaucuuagugaagaguuuaaucaugauuacaauauucuuauuuagauaucacuugauacaaugucagaauugaggucagcucagauucagaaaaucauuaacucuagcccuacucagggaaaagauucaaaacucccuuaccuaauucagugugauaguauuauuuuccuguuaaaaggaacuagauccuggcuuccugcuccauccugacagagaaaacaaugcuauuuuaccuucagaaaaaaauaccugccaggugugguggcgcacaccuuuaaucccagcacuugggagacagaggcaggcgaauuucugagucagccuggucuacagagugaguuucaggacagccagagcuacacagagaaacccugucucaaaacaaaaccaaaugacuaaaaaacaagauuaucaauaaaacugugcacugugauaauauuguaauuauauccauguuauucauacacaaucuagcaacuuaaaaacaaaacaaaaaaaggaaacaugauggcuuaccucuuugacuugauucaggcaucuuuguccuuguagggaugcauuuuaaccagucuucuuuuguacuuuuuauuccugaaacuguuuaaauacuuguuuuaagauauauaacuuuuacuccuccauuuuagcuuaaugaaaacuaucaaaaccucaccuaaauguauauaauacugaugauaugccauaccuauauuccauagauaauacaaacuuuaaggggcuuggaaaucauuuuccccguguguauauuuuacaacaagaaaaugaauaguuuuuaauugucacauuaagaaaacauuuucuuggcugaaucaccaacauuucucagggcauuuacagguaugagagaggaagcuacugccccugcucaaucccaaauuucuauuuacacccaaguucucagauucuaaaaaccuaauacaaaaugccuacugaaaucaaccuuuuuugguuuuaguuuuauuuguuguugacaggaucccauuauguaucucuugauguaaaccaagcucgucucaacuacacagagauccaccugccuuugccucccaaguguugguaugugccaucuugccuggccuugaaaucagcuaucuuaaacaaaaguauuuuuguauucuauaccuauaaccuucaacaaagaauaccauuuaugcuauaguuuuauucaccccaacagacauaaccagagggaaaaaaacccagauuaaacuaaaacuucaacuaaaaucccauauuuuuccaaucugaguuuuauuauacaauguauuagcuauaauaccuacaguuucacaaccucuuaugaucacaacuacucauccauauaccccuuuaauucugccuuucagagaugcuaccuaugacucauaauugcuauucugguuucauuguuuuuaguuuuugaaacaaagucuuauagccaaggcuggacuuaaauucccuagauucuucugccaccagcauuccacauguacgacucuacccagucaccauuuagaccuuugugacugacuaauuugagauuaauuuguuccaagcacauacagcucuuacaggccuuguauuuaauagguaaaauagaugcuaccuuuuaacuuuggggauaacuuuauccucagugucagucaaaguaacaaacugacccacuauaacaaguacaguaccuuccaauauuuggaacaaaguuucacacaggagccucuuugaaauuacaaguacaaaaggaaacuaaaacccagacucuggcugugguucagggucuaauaccagugguuugaccaccaauacaucaaaacucaaaacuucuugaaauaaauguacacuugauacuuuuaaaacuuucacccccacccccaccccccacacacaaaagaauaaaaaugcuuuucauaguguagucucuuugggacuaaauauuuguauuuaguaaauguuaaaguugaaaauauugucaguacuaauuuacuguaauuuaaaauaaaaagcaacaaacauaaaaaaaaugcugcccuauuuacucagccacuccuaggauuacaccucuacuguuccucauacauaaaaccaauaguugggcccguggcuuacacacuugggagaugaaaacaaaaugaucagaauuaaaccaaccuugaugaugguuuaacaccagucugaacuauguggaacuuuccccauucccccaugaaaaaaagggagagaaaaaaaauuauacuggaccuugcacaggugcuugcucuuucucaggaccaggaccaggacaauccugcuugucaacagugcuuguauucuucaauagcacaucuggacauaauuuaaacuccagcauacuagguuugucugugucuuuugucuuagauguauauuccccacucuuuuucucuauacuaagcuucuuggaugcacuauccaauuuggugagacauaugcuuucccguucugugcauuuaaacgcaacucgauucaaguacuguuuccuuuguucuuuuaccuggagaggcaucugguuggacucauuauucauacuggucuuauuuuuaaacauuuuaucaggcugcuucccaucaaacuuuccuuuauuauuauuugacacacuguguguucuagacgccucagagugauggaucuugaagucuuuaccauggcugcuagaauuauguuccaguucuuuugcagucucugcacugauacucugccccucaacuaacuuuccccagcuuacugcugcagaaugcuuacuggucuucgugugccccgagucacauagcacaguuucuacacagauguuucuggaagcauuauucccaguuauuuguuugucuuucugccguuguaaauauuccugcacuguuauaacucuaguacucuuagaggagcuacccuuugggucugaggacucaggacuuggaacugucuuuucuugaacacuggcucuuucauuugacucuguaagaauacugcacaauuugagugugucuccagcauuuuuguucuguucuugcuuuucauauuucuucuuuuuuauuucuacaucuggaauaauaacgugauccgucuuucuuuuuucaaaauauuucaaccuggagccaccugcuuugaauuuuaguuuuuucuuuucuggugauacugacuguacugaagagguauuacuccugcacggaucuguguuugacgaaaguucuauaggugcuuuuacuggacccaagucuugggacguguguuucuucuguaggcuuuccugagaggcuuguuuagaaaauggcauauuuuuagcagaguuagaaguuguuacgugaaguauuucaggggcugcuaucuuauugcauuuugagggguuugguaugucacauuuagaugaaauauuuuuuaguuuuugcuccauuuucagugagguaucaugccuuauuuuaaaauuaccuuuuuuaucuuuuuuguaacauuuagcugaaaaaugacaggcuaauuccugucccucccuguugucuuuuguuuuagaugcuuuggucuuuucaccaugcacugcagaaaaauggccuuccucaguugcuugggucagaggaguuuuugaguuauuagaaacaggauuaauuucaaaaauagugauuccacuauugcagggcugcucuccuuguuugcugcuguugauguccaaacacuggucuuucuccuucuuuucuguagaacugcaaugacacuguggcacaccuucauacaccauugagagccaacccaaggcacagcaauggauuuugucuuucucuggauccaacauuccaaggucaugacuuucuucucuaggaaucugugagucacaugggcucuuuacuuccgcaacaauuucuuuauucucagguuccgccaacuugucacagggcugaucaucuucaggaaauaguucuuugauuuguucagaguuuaauacuguaauuuuuauuuggucugugcuauccccagacacauuacuaguuuuaccaccaguuugauuuucuacgauuuuaugugucuuuuguugguccaaagacacuucaugucuguuaaaaguuucaaugccauaagggaacucuuuuaaaagcucugacagcuggucauguagguaugagauagguucacuuucaucauuaaucucauuuauugcaggaagacuguggucugauuuacugaacauaucaguuucccgagggugaggauccugcugaauagcagcugguaaacauacauccuuagcuguacuuucuuuucuaccaguguacucccuacagcuuuccucuguggcuucucuguuugcuuccacauacucacuagaugcuggcucuucaggcugcagaggcucuggcugcucagggaccucaugaggaacaucuguacacuguacacacuuaucuuucuguaagcuaaagucuuuauuuucagugguaucauauacuuguucuuguugacuaucaauuaccugauuaggugaagguuucuggggcucaguuuguacagaguugaauaucucagcuaucugggaauuguaagauacauccccuucugcaagagaacagauacuuucgauuuguaacauagguccacucacaauggugcuauccauaggcuuaggcagaacuucagugcccaggggagaguguuuuccuaagcugcuaucagcuaugucuggaucacccuguauugguuugugcugcuuuuccuuaucaacaggcagaggaaucucugcugauauguuauuacuugcuacagcuccuauaacaucaaaagguaaagcaacaguuucuguugguuggguuuguaagcuacaaacacuaccuuccuuaacaacuggauacaguguuucagguaaaacuucaggcacugagucuuuuccagguaagguauuaguaucugaaagaacuaaaggcgacaccacagcaaucugaagcucuguuccuuuuccuacagcuacaccggaagacucacagcucgguaugagaacuggcaauacuguuugugaugagcucaucauuuucugagaauuuccaacaccagaacacaaacucuuaacaugaacuucauuugugggauuggcacugcccacuacgguuguacugauucuugauguguuacacuguuuuucuucuaaagguuuuggaacauuuucuucugugguuuuugaagguugguuuuuccaaagagaaagacauguugcuagcaauuccauggaacagucauugccauuuuuagcagacauuucuuuugcugaaaauucagaaugcugaauugguucaguauaagaaguauuagcuguuuuacuacaaccagcugccaucaaaagacuuuuauuaauuuuaauuuuucuugcaaguucugaaaacuucuuuuugauuucuacuagagauuuaauaucccucaccagcuuuucuuuuguggcauuuguaucuauuacuugauuuguauuaggauuguagguauauuuucuuuuuucuugauuauuuugaacaagugccugaacaccauccccagaaggucuaacagauucacuguaaggcugcuugauauuuauuuucaccucagagaauuguccaaugcugacuuucucauuaggguucugccacugcugcuuaaagccucuguaaguaucuuucuuuuuuucagaugagugcacuucugaacucugaggaacuuccauaggcaaguguuuagaaacaggcugagcauucugcacauguugguuuucauaucuacagcuguaaggaagggcagagagucuuuugcuggcuucugcagcauacugaugugaugacaaagguacagaaugcuuugacuguaagcucuguguauaaguugggagcugauuauuuuuaacuuguaaugauguaguagcuggcaguauguaggaguauugcuuuggagguggccuguauucaggauaagaaaguucguuggauguauacuguguccagucaaccaacugaucugguaugaagugauuaagucccugacuuccuugaugugucauagguacuuuuccagaauguaaaggagccauuuguaguugcauagaauagguaucugaugugacaagcugauucugugguggaugcauguaaggcauauuagucccuccgucgggauuaugagauaugguugcuucuguaugggaaggcaaccagacauucugcauaauuccugaagacacuguuugcaaauugugguuugguuguugugguccuuuaccauuuguagauacaacucuuuccauugaagacugugaggccacaauuguucugguaggcauauuagaaacagagaucugagucugaggaguuauauaauuucugccgcucagaaguggcugugaaacugaauuugaauucccagaauacaugcaugcuucuugguuauggagagaauaguugaaagaaguuugagaugcuucuugguuauggggagaauaguugaaagaacuuugagauguuguagaagucauuaaaaaaugcugcaagauagaugacuggguuuuagaauaugguggggguuugggaacauucucuuguuuuguauuccaauucauaguugaucugacuuagcaguauuguaaagucugugguuuugaaugucauaaaucugcaagaaauacaaauaaagaucuuuuauuaaaaacuuuucucucaaccucccuuugagacagccuuucuggccuagaacuucuucuguagaccagauuggcuucaaacuuauaauaaucacacugccuagacaaaauuuggaaaaaaaaauuagaaacaaaccaugucuaugguaacuaaagaaggaccucaaauuaauaagcuguacacuuaaucuggaaagagaauuaguauagcaagcugcaacaauaauugagaaaaaugucaagaucaaugauaaagaaccacucugaagaaagaugcuaucaccccguuacauuuaagugguacuuuucuacuuuuauuauuuuugagguguaggugauggacuagagucucaggcaugcuaagcauucgcucuaacacuaacuagguauguuaaccuguuuccacuuauuuugauaauuucuuuaguccaugcaauccaugcuaguuguaaagcaaagcuuacauaaaaauuucuuacugaacauccccaacacauaauuauauugaaguacacaauacuaucuucucauaaaauuucuaagcauaaacaaaaauuaauaaauaaaacuucccaccuuacucucagcuacugaagaagcuaaacaagacugugaaaaugucuggacaauguggagagacccuaucugaaaaacaaaaaaaccaaaaaaucaaaaaacaaaucaaacaaaaucuaacccccccccucccccaccucaagacaggguuucuuuguguagcccuggcuguccuggaacucacucuguagaccaggcuggccuugaacucagaaaucgggcugccucugccucccaagugcugggauuaaaggcgugcgccaccgccgcccagccaaaaacaucuuuuaagacaaauggaaucguaccaaacucaaucuacuguuuguauuucauuaucauacacaggcagguuauuuuacuucacuaaaaauguuaucuacuuacauaacauucuacuuguggcuauaucacuccugacauaccaagaaguguacuugagccagcacugguuguacaugucuauaauuaagcugaagcaggcagacaguaaguuuaaggaagcuuaccugggcaacucaguggacccccccaaucucaaaguaaaaaguuaaaacuauggggguccagauggucugcaguuucuuucuuaagcacaaacucugacuaaagugugacuacaugacuucagaacacugcaggcaugagaugaugucuaaguagaaacguccucuagcacaaacaagaccacaagacuagagaaguacggaagaggaacucagagaacagggcaaagaagccuuacauucaauucuaucuuuaguagauagcuaaacugcugcaggaacagcuguggaaaaagaaaacuuaaucauucuugaagugaagccagaggucugucuagcacugccacgcuuccaggacccuaugcugucuggggcuguacuagccuagucauaaagacaaaaaaaaaaaaaaaaaaaagaaaaacauauuugauuccuaguacaaaacuacaucacuugcaaugcacuggcugacaggggcaucuucuuuuccuuucgucaagaccuucuuuugcuuacaucugaguguacacuacugagauaagaggaagaacccacccaggaggcagucagcaccaaaaggauagaacuuucaaccccacccauagcuuuagaaacagcagcagagcuuaacucugcaaacaccacuauugagugagaugugauacaagguaguauugagaggguaguguguucugacuagaaaugaaaaccccaccuaagccauuaaaaaaaaaaaaaaaaaggcuugucauagccaccucauccuucaguuuuauugaguauaaaaagaaaggaccgucauaagacaccccuuaauuuuacaauugucauuagaaaugcaagacuuccaggaaugggaucugggacugucuuguggaacugagccguuuaacuaguagaauuugaugauacaggauuggaugggagagcaggauacccagaauguauacacacacacacacacacacacacacacaaaccccaaaaccuagagaaugaguuggcaggaagaaaacuuccuguugucacaaguguuauaugaauaugagaaaacagcauuaaaaccauguggauuaugugaagacacgcuagaguugcuggcaaaccaaaggaaccuacaaggagcauacccugaagauaaacuuuaagauacacaaaaauucuggacuucaaggcugcugaaucaagaacguuggcugaacauuuugcuauguuguauguguguguauuuguguguguguauacauaguacaaaauguuaucaguacuuuaccacuguuccaguucuggacaaagcuccccaaauaccaacagauuugagacugggucucacuauuuugucuuaucugacuauuaacuugaggugauccuccugccucucuacuucucaagugcuguaauuacaaagcauguucaaccaugaccaacugaaaacagcuauacauccugguaaccccaugauggagguuggagaauagaaaccacuggaucugggaauucuuuggccagcuagccuauaugaaauguccauuccuggcucuuacaugggugcuagggacuuaaauuugggucuacuugguuaaauaguaaacacucuuacauccuauauauuuuaguuauuucauaggagcauguagugauuuggaugagaaugguucauguaggcucauauauaugagugcuuaguucccaccauuuggugguacuauuugaaugggaugaggaaauguggcuuuuuggaggaggugggucacuggggguaauguuaauugggauggauuuuugagguuuugaaaauggggguauuguuaauagaaguggcuuuuaaagccacacccuuccaaguuagcucucuaugccucauguugauggaccaagauaaaagcucucagcuacugcuuaaauugucuuaaucauggugucuugucuacacagcaauagaaaauuacuaagagcauaaguugguuuuuugagccaaaauauaggauuuucuuaaaauuuaucuacugaaauauauuuuacauauugaggggcauaauauaauuugauacauguucucaaugcacaaugguuaaggguuaaaugaggcaguaagcacuuccacuuguuuaaauuuuaaucauuauuuuggagagagacuuucuucuuuuuuuaaaaucuuagaugccaacuuuucuuuuuuuaauuaauuaauuaauuuuauuuauaugaguacacugucacugucuucagaugcaccagaagagggcaucagaucccauuaacagauguuugugagccaccaugugguugcugguaauugaacucaggaccucuggaagagcagucagugcucuuaagcgcugagacauaucucuggcccccaagacuuucuuguuauuuuuaaacguucauaaaaauuucuaaaagcuuaaguuuaucaaauacuguuuuacuuaagugacucuacuaugcuaugcccaaaucagaaauaagcuggguauaguggagcugcuugaauucauagcaccuggaaggaaggcuaaagcaggugugucauaaauuccaggccaguguggacugcacagcaaggcccuaucucaaaaacacaagaaagagcuagggagauggcucauugggugcuaggguuagcugaacuggucaacuagucucaaugaagaauugucuagauuaggaugcccuguggacaugucaguggaagacugcuuucauuauguuaacuguuacugugaccacucagucuacuauauguagcaccauuccaagagucuggacccugcgcaguauaaaagaaauuagagccgggcagugguggcgcacaccuuuagggagcagaggcaguuugaggucagccuggucuacagaaugaguuccaggacaggcaggauauagagaagcccugucucaaggaagaaaaaaaaaagggggggugggggggcuggcaagauggcucagugguuaagggcaccuacugcucuuccaaaggucccgaguucaaaucccagcaaccacaugguggcucacaaccaucuguaacgaaaucugaugcccucuucuggagugucugaagacagcuacaguguacuuacauaauaaauaaaucuuaaagaaaaaaaaaagaaauuagcacacaugccuacauucucucucuacucaggaauacuucaaaaguucuugccuuaaucucuuucaauaacacacuuuaacuguaauaucuuaucuccuguuuugcaccuggggucccgagguauauaucuuuuuuaugaccuucaguuaaugguuucugugaucccuuggaacaugcccuaaguuuuagaagucugcuguaucucugaauaaaaggaacucaaaugucuggggaguagggggugugccuuuuggaaaaaaugguaaccuuugcaugcuaccuguuucugcagaauaaaugcucuuugucuuugcauauuaucuaucugaaucucaggucuuccuucagugauuuucggacccuuauaauaaccagguaugauaguuugcacuuggaaggcuaaggaaagagguguucagauagcuuacuacacaguaacaaaacuuacuaccuagaagcagacaaagucuaccauuuaguuuugcaggagauuuaaucuuauaugguauuaguacuaguacuauuuccuaccagaaacccgagaagaugauuauuuuaaaaaguguaggaaguuaugaagaugaguugaaggaggguggagaggauggggaugaauagguaaacauuuuuaacucaaaaauuuuaugaagauuuuacuaagauucuaugauguuaguuuuaacaaucaacuucauacaaccuagaauccaucuccuaaaauaagccaaaugagggauuaccuauauuaaacuaaccagugggugacuugauuaugcuaauuaaggugguucugagucugaaacuuccuaagaaaguaaacugaacaaggaugcaugcucucauucuugcucuuaacuguggggauggaacagggugcuucaaauuccugcuucaacuuccccacaaugauagaguguacguuagaauuguaugucuucuaaauucucuuucucuuaaaacauguuuugugaguuauuugauuguaaagagaugacaaccagcccuaauccaauggcacuguguuucugcccaaaaaugaacuucucuaucccagucauuagagugcccagaucugcguaauaauuuacacaggcccccaggauaacuaaaggaacuuaauauggaaccaggcauccaauccuuaagggccacugaccuuuuucucuggaaugccugggagguucuaguggccugcagaggagauaaggagaggauaaugggcccugagguauuaacagcugccuuugcuucuguaaaaccuguuuauuguugugggaaaggaaugaaauggucuuuuuauuacuguauaguaggaaaguaagaaucaacugagggcaguaaaacaauucugcucagcuauggauuccauggauuguugcaauacacacuuuucugaugucgacccuuaaaacucaccuuaacccaccuucugcacgucaugcuguucagcaauaaggcuguuauccuucugcuagccguaaggauaaacucauuucaucuaaaucugaauugaaucaaaguguuuggucuuucccauggauuugaauaccaccacauuaucacagcaauaggaaggaaacuaggacaggugcuauuaacagucauaugaaagacauaaaagguccaucuuagagagcccaaacuacacaucaauauccaaaaguaccuacuucuagguaguggauacuagaagugacugguuagugucuacuaccuagaaguagacaaugucugccauuuaguuuugcagggauaggguauuacuacugucaccauuucccaugagaaaucugagaagauacuuauaaaaaauaaauaaauaaauaaauaaauaaauaaauagauaaauaaaaguauggcaagcugaguugaaggaggguaaagaauguccagucaauguuugcugagugaauauuaucagaaaucucagaacacuaagaaagacauuuaaaaaaauaguaauaauaaauguaaccaacauuuuuaugugacaggaaacuucagaaaugaagacucuaaagaacgaagauuaauggaaacuauccauuuucaaguuuagauuuaaagaauaaacaauuaugcagacaugugauuagagagagggcuggagagauagcucagcaguuaagaacuagguggucuucuagaguacccaaguucaauuuccagaaaccaucuguuacuccagucccaagagauccaauguacuuuucuggccucacacggugcauguggacaaaacacccaucuacauaggguaaacuaauuuaacuuaaaaaaugaugagauaagggccuggagagauggcucaacaguuaagagcacugacuacuuuucugaagguccugaguucaaaucccagcaaccacaucguggcucacaaccauccguaaugagauaugacacccucuucuggagugucugaagacagcuacaguguacuuacauauaauaaauaaaucuuuaaaaaaucuuuaaaaaaaugaugagauaaaaagguaguagugaguggacauauggaaaauucagccacacuugucugucugcuuuuucuuggucuccuugugguacuuuccucuggguuuggggcaagaaccucugugagugaggcuggcaauccuacacaggucagaggaacccuuauagccaauucuuacaaagaagcagaggguagagggcagaauagccuuuccacaucugugguuggcuucaugaaaaggaguuuagagacaggaggaugagaagaguggagagagacugacauuagaggucccuuuucuccuuucguucaaaggacuccauuggccaaagagcuauacuuugaagcuggguccugaguccccaggaaggcugacaguaggaaagaauuaguuaacacaccaucguauuaccucacauugugagggauuuuguuuucauuccuugucuagguacagcacuuuccugcugucugcccugggacaaauccugaauuccuccugccagugccauucaguggcccuugcacaugcugccuuaacuccuaccacaagauauuaaacuuuuccuguacauauauauuuuuugacuugccagacugcuuaacaagcuuucacauuacaaaaugaaguuuguacaaacaguacacuaaagugauuaaagugaaaaccaguauuucuaauuuacaauaaaagcacccaaaaaaaaaaaauccacuaaaacucugcaaaauuacaaaugcuaacaauucaaggaauucuaaaaguaugauuuaguccaucuauaguaucucuggccuucuauauccuuaaccacagugggggaaaggucagucauaggcuuccuagucugauagguuuuauauaaucaauuuuccuaaauuuuacauuauaauacaacucuagucuauaauaaauaaguuaaccuaucagaaauguauaugugccaacaacuauaggugggcaaagcaguacauaccuguagccccagcaucagaggcuggagaaagagggucacagcuuugaggccagcuuugccuaugcagcaagauccugucaagaaaaacagaugagggggcuggagagauggcucagugguuuagagcacugacugcuuuuccacagguccugaggucaauucccagcaaccacaugguggcucacaaccaucuauaauaggaucagaugccuuuuuugcugugucugaagacagcuauaguauacucauauaaacaaaauauauaaaaauuaauaaaaaaaaaccagaugaacaaagaacaauacaaacuaaauuuaaucaaagauuaaaaacaagagaaaugaaccgggcgugguggcgcacgccuuuaaucccaguacuggggaggcagaggcagaggcugguggauuucugaguucaaggccagccuggucuacaaagugagcuccagaacagccagggcuauacagagaaacccugucucgaaaaaccaaaacaaaaaacaagagaaauuguguugguacgauucugucguguuucuauucucuaaagacuacugcauaacaauggucuacauagcacuuacuuuguauuaagcauuuuaaauaaccuagaaaugaugugaaguacacaggagaauaagcagaacuuacaaauguaagcauccucugguuuugguaccucaaggaguuuuuuagacacagaacugagaauggggcucaaugguagaacacagaaggcauaguuccacaauaguccagaaaaggaggaaagaauuauauuaaucagucaaaacaugggcuacugaaaagccagcuuggaagugggucauucuaacaccugaaugaaggggaaggcuguacagguccuguugaugggaacuaggaugcagaagaacaaucuguggcuguguaagucugauucuugugguucuaagugaguucccaaaagguaugcaagaagugaccuaagcuggguugaucauuaauaagaguaaaucauuguggcaauuguuauuuuuuuuuuuuuuaugaauucaacuacaauacaaauucuauucagaagcaugggccaaaaaacaaacaaacaaacaaacaaacaaaaggagccgggcaugguagugcaugccuuuaaucccagcauucaggaggcagaggcaggaggauuucugaguucaaggccagacuggucuacaaagugaguuccaggacagccagggcuauacagagaaacccugucucgaaaaacuaaaaaaaaccaaaagcaaaagaacaaacagaagcaugggccaaucaaucagauaacuuaaugccacagacuagacaacaucucaguuaacagcagacuacauauauacaaggcugugugguuuuacucaauguugaaccuaucccuuauggcuauauuacuacucuaucacuagaauuaaauuuuacagaaguaaaauaucauucuuugaauuuugcucagugucuuguuuuaguauuuaucccaaggaauaugacucacuaaagagguagacuauuuaaacagauuauuuacuauuuauuuguguuugugcauaugcaauauaugagcagguggccuuaggucagagggaggugugaaagccucugcaacuggaguugcagagcuucucaauacggauguugggaaccaacucagguucugaaagugcaacaacugcccuuaacugcugagcccaucuuucuagcccugaagaucauuuuucuuuagaaagaaggucucaaucuguagcugaggcuagccuaaaacucaaagaaauccucuuauccaaguaguagaaacccccuuagagugcugagaucaagacauguaccaccaugccuaauaagcuaguggucuuaaauaucuauaaaguccuaacaacuaccuccaaguauacauauuaaguugaugugugguaaggaaguauaagccuucagaaacauuucugcaagaacuaccacauguaaucucagaacuugggagagggaggcaggagggucaaaguucaaagccacccugaguuccccucuauaaaaaauaagagagacagacauaggcaggcagucaacugacagaugaaauacaaaacugaguuagacauacaaaaauuuuaaguaucaguccuuaaaaguugaauaugccccuugggguacagagaucuccuugugaacaacugaauaauuccuguuaagaugccugauggaauuguuucccuguuauuuauaggucaugcaggcuacacucaagggucuacucuguuugauuauucagauucuguucaguuaguuguuuacaagaacuuuaacacaggcuuuuuaugaaccuuggaaguaaaaccuagaucuuacaaaaugaaggcuggaguuaacgaugaaaagagacuuaaaacaucccaauggucccauuagccagucuaucuucuugucagcacaauaaacaggguaugaagacccuaccaucagagucacauugcaauccagaagucauacagcguacuuucuuggcaccagaagaccaugggaaaccaugacuaauaaagaagaguugauuauuuccauucauuaguagguuaccaaggguuugguaaucagcaagaggaacuuggagcagcuaaugagugacaggaauagccccaggauuuccuuguuucacuuuuuaagauuuucagaacuggaggugguaaaaugucucaggaggaaaagaaguuugcugccaacuaagcagaaugacuucauucacuuaguuacuaacgaacuccaaaauuuaagcuacccuaaucacaguauuuguccacugguauguguucuguaccagaaucccugaugaaaagacaaagggaacuaacuaguucuauauccuugcccaggggcagacauuauaaagucugguccagguuagagccagggccucaauggaguuagauguuucaguuucugggaacaugccuuuucccccugaagaagacuggcgcuaucugucucaaggauguugagugcucagucugugcugcacuugagauauccugugucucuuuguguaccauugcuugauuagcuuccagaugucuucaucacauuguaugauagcuuucugcugacucugucccacugucccccuauaaauccuaauaaacuuccaaaccuuagcuuuccugucuucuuuacuucucaucucuuuauccucccuccucucagaaaccugccacuuuagaaagacaugcugauccaagucagucaugcagaauuuaaauacacagacuugucaggauuuauaugacuuagucuuuuuuuuuuuuuuuuuuuuuuuuuaggcauuguugcugauuuuuuuuuccauuuuuuauuagguauuuagcucauuuacauuuccagugcuauaccaaaagucccccauacccacccagaugacuuagucuuuaauggcauaguaaacaguaaauuccagucaugaugcacaagcuggcuuagaacucauuacacaguagagguugaccucuuauuugugaccuacaagccucagucuaauaguccugauacuauuggccuaugcuaacauggucagcuaaaacaacaaaaacaaaaaccucugugugugugcgaguuugagacagggccuuacuacauugcucuguuuguccagaccagguauuugccauaaaggagauggggacucuggguuauacauugauaccaugcucaauaaaacucccugggucaaaagaauaaagauguucucuuaguaauaucacuguaugauuguucucaaacucagaggucuaccgaacucugccucccaaguauugagauuagaggcauacaccaucacaugggggaacaacauuucacauucaagccauaacaauuagccaaaaaacuacccauaaagaaauguuugggcucagauggcuucaguagucacauuaaaccugaaaguuuaaaaucaacucuaaacagaauguuccaagacaaggaaaaaaaccacucaacugaauucuuugaaccuacuauuauccuguacaguaugaagacaaucucucaaaauacagacagaaaaauccccucaugaaauauuaaugcaaguaaguaaacuucaagugcauacuaaaauucuaugccaugacucugagauauauuccaguaauucaaggauagugcaacaucacaaacuaaugcaaaaaaaaaaaaaucaaaaagguucaaaaaggaugaaaaucagaugaucucaauagauauagacaaagcuuauuugaaauaucccaacucccuuuccaacuugggcccaagaaaauggcaccaggaaaaaggggugauaggaaaaagaagggucauucugccagcaacugaaguagugaucuaaggguaauauagcauuaacauucauucgcaggaaggggcuuuaagaaguauucuuucucagcacuugucuuacucaggguuucuauuccuggacaaaacauugugaccaagaagcaaguuggggaggaaaggguuuauucagcuuacacuucuauacugcuguucaccaccaaggaagucaggacuggaacucaagcaggucaggaagcaggagcugauucagaggccauggagggauguuccuuacuggcuugcuucuccuggcuugcucagccugcuuucuuauagaacccaagacuaccagccuagagaucagccucacuugaucaccaauugagaaaauaccucacagcuggaucgcauggaggcauuaccucaaaugaagcuccuuuuucugugauaacuccagcuugugucaaauugacacacaaaaccagcuaguacagcacucuaaguguauuuguagaaaggagaugggguuagggauaggguuaggccaguccuacguauauaagcagacugcuugcaccaauauacauuaauucuaaacaacuagcaaggcaaaucaaaauuguucaaaacaagugauuuuaagucauuguuccucauaaaaaaaauuccuuuaaagcaaccuuuguuuaauuucuaauugaacccgagcuucccaauuuacacauuuuaguauguaugaaaauaaaaaccccaaccuccucuaagacugccuaagaacccaaggcagagaauagcacagcucaaagauagcuuucacaucuucagaguuguuuguugguaguucuaaccucacuaggccaacaguaacuacacccuucauuuacuaguuaauuuagcauacuaagaauuuuaaguacccugccuccaaaaacaaaaaccagaauucccaguccuaaaguuuuuuuccauuugcacuuaguuugcauuucuauagccagggucgguguaaacucuugcuuuaccucaacuaguaggaauacuuccuacuacuguuuuugcauggauuaguuuccaaagaaauaguaaagaaaggcagauaaaccaaaaauucuugaaguucaccuuuauuauaaaguuuaacaagauuauaaucccuaaacagcuaaauuccuaaaaaucaaagcacugauaauguacaagauaucagaacuaaucaaacaggaaagaggaaaagaaaaagguaggccaagauagccacugguugguuuuggccacaaacacccaguagagaggagagcuuggcauggcaaaucuaaucccaaaacucaggaggaagaagagaagaaucaauugaaggucauccuugcuagacaagaaguucaaggccaggaaguucaaggccagccuagcugugaaaugccuaaggcuguaaaaaauagacuaugugcugggagcuauuuuaagaguguucagggcuggagagaugacucagcgguuaagagcacugacugcucuuccagagguacuuaguucaaauccagcaaccacaugguggcucaaaaccaucuguaaugagauuugaugcccucuucugcugugucugaagacagcuacaguguacuuauauauaacuaagucuuuaaaaaaaaaaaaaagaguaucuaagagguugguugacuggcugguuuuguuugggaaugauuuuuuagacagggucacaauauguagacuaggcuggccuggaacuaagagauuugccugucucugcuucccccuuguaacuuaccacaguuccauaauguagguacuacuguuaucccauuuacagaugagaagcuaagcaggaaaguaaaauucuucugagauuuuacaguaagugguagacccaaguuggaggggucaagcaagaccugaauccaaguaacauaacuguauguaaggaacaagauaaggaaacaauacaauggaugaauguaaccauggaaaccaaaccuagagugaguugcgguggccagacaggaguauuuaagcuacacuuaaccaauaauaauuaaagcauucacacauuacuccauuggaaguucaccuuacuucaacuuuaucauacucaugcacacacucuaggcuugguuuccauggcuacauucauccaugguaucauuucuuuaucuuguuccuuacacuguaggaaccauagcccucguaggcagaaaaggcuuucuaacagguuuuauggucauggacuggaacccuagagaucacuaaguauaagugcuuaaagacaugacucaauaguuguggcccuaaaaguggucccagcacuaacauguggcuauaacugccuguaacuccaguucuagaggauccaggccuucuucugagcucuacacaccaagcacacaaaacuacacuuacaugugggcaaaacacuuacgcacauaaauuaaaacaaguuaaaaauaaauaagaaacagucccugguacuacauucccaccaaaaauaagagcuagccucugccuagguaacuuuaauucaccagcuaccauaaucuuuuccaggguagcaaucuggcugaguucuaucucgaacacugccaaaauucaaaacaaaacaaaaaaugcaaaaaucaucucuccucuaucucaugaaggcaaaaaauaaaauuguuaaguaccauaccaacaacauuauuucuuaagcuuugccaucaaaucuacugugucccauuggaucugugacaguuuuguuuggugauaguuuuuugagucuuucacuaugcaguccuagcuaaacugaaauuugguauguagauuaggcuagccuuuaacucaaagaucugucugacuuggucucccaaaugcaaaaauugaaggcaagcacaugcuaggcaaguucuguagguuuaacuaguguugauucaaugauacucuuuauucuaaaauaaguuaguccacgguacaaugcaaauagucauccaguagaaccaggauaggcuuuauaaaaggcaaacuuaccuguaaauacaauuuuaccuuuuaaucucuuccacaagguauucacgccucuaauucuaugaaaaucaagaaacaagaaagcaagaguuaaggucuaguacauuucccuuacagugucauugagaccauacuaaguuuacugaauuuauuucaauugugcuaaaaacaaaacuacugaauuaggcuacucucaaaauauucccugccacuagaauucaagcgggcuucuccaaguccacuacugcccuuuaauaccaaagcaaaaauacuucuuuaguaauuuuaguggacugauaaaagagaaccugaugggggcugaguggagcaauaacuaagaccuuaguauaucugaaugguaacaagaaacaaacuuaagauuccccuuaacuguaacacacccagcagacaauuuaaauccccacgcaaguucuguaguuggccuacugaaaugcaagccagcucacccacuuuaccuguuuuuccauuuuucuaggaaggcacucuuaaguaccacaaaugcaaacagauuccaagaugcugcgggccgcggcgcucacacaggccugggcgcucgaaggcggagcgcaaggcaauuccgcugggucgcaggggggccaaggagcggaagaccgagacagaaagaaaccgaaaaacaaaacaaagcucugcuucuccuuccgaaaccggaagggacgcuuagcugcaacaagcccgccugcuucucgggccaacaaccucagaccgcgcccgcccggcgcgcagcgaccccgcgguacagcgaggacccgggcggcgccccuccgccgggacagagguggcgaaaacccagccccgagcccagggggccgaacaaaagcccgauccgaagcagaccugccgcccggcgggugcuuacacgccaauagcaagggacgaggccucugccaagcgcagagcgcgcagagguuugguggcagccuucguuggggcggguccagcuggguccccacuccgcccccgagcgcuugcaccagggccgcgguccuagugccgggcaggugugc
